United States Patent 8,952,217 (PROCESS FOR DECREASING VERBASCOSE IN A PLANT BY EXPRESSION OF A CHLOROPLAST-TARGETED FIMD PROTEIN) - sequence listing, part 4

SEQ ID NO: 7460 - DNA, 1437 bp, Pyrococcus kodakaraensis
  CDS (1)..(1437)
atgcggctcccaggacagaaaaccaagataatagccaccctaggtcctgcgtctctcaacgaaaagaccataacggcaatggttcgagcggggatgagtgttgcaaggataaacttcgcccacggtgatctgaaacagcacgagaagtcgataaaactcgtgagaaaggtctctgagaggctcaacaggcccgttgcaattctcggagacctgcccggagtgaagatccgcgttggtgagattgagggcggctcagtgacgctgagacgctggcagacggtaacccttaccacgagggacgtaatcggcaacgaggccgttatacccgttgagttcaaggactttccaaggctcgtctcgaagggggacgtcatctatctcagcgacggtttcatagcgctaagggttgaagacgtcagggaccaggatgtcatctgtaaggtgctcgtcggaggaactctcttctcccgcaaaggaatcaacattcccaaggctcgcctggctatcgaagcaataaccgagaaggatttagaattcctggagttctctctggagcacggagttgacgccgtcggcataagcttcgtcggttccgcctacgacgttctaaaggcaaggcgattcgtcgaggaaaggaacggcaagctgttcctgatagccaaaatagaaaggcccgacgcggtgagaaacttcgacgagattctcagggcggcggacggggtcatggtagccaggggagacctcggagtggagatgcccatagaaaagctcccgattctccagaaaaagcttatccaaaaggcaaactgtgcgggaaagcccgtgataacagcgactcagatgctagagagcatgacccacgagaagctcccaacgagggctgaggtcaccgatgttgcgaacgcaatccttgatggaaccgacgccgtgatgctctccgaggagacggcggtcggaaagtacccggttgagaccgtcaaaatgatggccaggatagcgaagactaccgaggcatacagggactccaaatgggctgaaagaaccgtcgaatggaagatgagtgagttgaggggtacacggccgacaaagggtaccataaaggacgcaataacgaggagtataatagaggccctgaactccatagacattaaatacatactaacaccgaccaggatgggacaaactgcgaggctaatagcccgttttaagccaaagcagtgggtactggcatttgtaactgatgaatgggtcaaaaacactctgatgttctcctacggcgtttatccgttcctcgttgaggacaccagcgaagaggagatactgcgcgtgataaccgggctcggactggtagatgagggcgatacggtacttctgacgaagggaacgcccataggaaagaccgcggggacgaacaccatccgcatcttcaacgtttga

SEQ ID NO: 7461 - protein, 478 aa, Pyrococcus kodakaraensis
MRLPGQKTKIIATLGPASLNEKTITAMVRAGMSVARINFAHGDLKQHEKSIKLVRKVSERLNRPVAILGDLPGVKIRVGEIEGGSVTLRRWQTVTLTTRDVIGNEAVIPVEFKDFPRLVSKGDVIYLSDGFIALRVEDVRDQDVICKVLVGGTLFSRKGINIPKARLAIEAITEKDLEFLEFSLEHGVDAVGISFVGSAYDVLKARRFVEERNGKLFLIAKIERPDAVRNFDEILRAADGVMVARGDLGVEMPIEKLPILQKKLIQKANCAGKPVITATQMLESMTHEKLPTRAEVTDVANAILDGTDAVMLSEETAVGKYPVETVKMMARIAKTTEAYRDSKWAERTVEWKMSELRGTRPTKGTIKDAITRSIIEALNSIDIKYILTPTRMGQTARLIARFKPKQWVLAFVTDEWVKNTLMFSYGVYPFLVEDTSEEEILRVITGLGLVDEGDTVLLTKGTPIGKTAGTNTIRIFNV

SEQ ID NO: 7462 - DNA, 1503 bp, Streptococcus pyogenes
  CDS (1)..(1503)
atgaataaacgcgtaaaaatcgttgcaacacttggtcctgcggttgaaatccgtggtggtaaaaaatacggagaagatggctactgggctggtcaacttgatgttgaagaatcagcaaaaaaaatcgctgaattaattgaagctggtgcgaatgttttccgtttcaatttctcacatggtgaccacaaagaacaaggtgaccgtatggcaactgttcgccttgcagaagaaattgctcgtcaaaaagttggtttccttttggatactaaaggtcctgaaatgcgtacggaattgtttgcagatgatgctaaagaattcagctatgtcactggagaaaaaatccgtgtagcgactacacaaggtattcaatcaactcgcgatgttattgctttgaacgttgctggtagccttgacatctacgatgaagtagaagtaggtcatactattcttatcgatgatggtaaactcggtttgaaagtgatcgacaaagatatcgcaacacgtcaatttatcgttgaagtagaaaacgatggtattattgctaaacaaaaaggtgttaatatccctaacactaaaattcctttcccagcacttgcggaacgcgacaatgctgatatccgttttggtcttgaacaaggacttaactttattgcaatctcatttgttcgtacagccaaagacgttgaggaagttcgtgaaatctgtcgcgaaactggtaacgatcatgtgcaattatttgctaagattgaaaaccaacaaggtatcgataatcttgatgaaatcatcgaagctgctgatggtatcatgattgcacgtggcgacatgggtatcgaagtaccatttgaaatggttccagttttccaaaaaatgattatcactaaagtgaatgcagctggtaaagcagttatcacagcaacaaacatgcttgaaacaatgactgaaaaaccacgtgcgacacgttctgaagtatctgacgtcttcaatgctgttatcgatggtactgatgcaacaatgctttcaggagagtcagctaacggtaaatacccggttgaatctgttcgtacaatggcgactattgatcgtaatgcacaaactcttcttaacgaatatggtcgtttagattcatctgccttcccacgtaccaataaaacagatgttattgcttcagctgttaaagatgccactcattcaatggacatcaaacttgttgtgactattactgagacaggtaatacagctcgtgcgatttctaaattccgtccagatgcggatatcttagctgtaacatttgatgaaaaagtacaacgtgctttgatgattaactgggctgttattcctgttcttgctgaaaaacctgcatctactgatgacatgtttgaagtagcagagcgtgttgctgtggaggcaggcttagttcaatctggggataatattgttattgttgctggtgttccagttggtactggtggaacgaatactatgcgtgttcgtacagtaaaataa

SEQ ID NO: 7463 - protein, 500 aa, Streptococcus pyogenes
MNKRVKIVATLGPAVEIRGGKKYGEDGYWAGQLDVEESAKKIAELIEAGANVFRFNFSHGDHKEQGDRMATVRLAEEIARQKVGFLLDTKGPEMRTELFADDAKEFSYVTGEKIRVATTQGIQSTRDVIALNVAGSLDIYDEVEVGHTILIDDGKLGLKVIDKDIATRQFIVEVENDGIIAKQKGVNIPNTKIPFPALAERDNADIRFGLEQGLNFIAISFVRTAKDVEEVREICRETGNDHVQLFAKIENQQGIDNLDEIIEAADGIMIARGDMGIEVPFEMVPVFQKMIITKVNAAGKAVITATNMLETMTEKPRATRSEVSDVFNAVIDGTDATMLSGESANGKYPVESVRTMATIDRNAQTLLNEYGRLDSSAFPRTNKTDVIASAVKDATHSMDIKLVVTITETGNTARAISKFRPDADILAVTFDEKVQRALMINWAVIPVLAEKPASTDDMFEVAERVAVEAGLVQSGDNIVIVAGVPVGTGGTNTMRVRTVK

SEQ ID NO: 7464 - DNA, 1476 bp, Vibrio vulnificus
  CDS (1)..(1476)
atgaagatgtgtaaaaccaaaatcgtcgctacgcttggcccagccagtcagacacgcgaaaaactcactcaactcatccaagcgggcgtgaatgtagtgcgcttaaacttttcgcacggcagcgctgaagagcacatcgcccgtgctgaaatggtacgtgaaatcgcgcaagatcttaacgtcagcgttggcgtactcgttgacctacaaggtccaaaaattcgtatcgcttgctttgagcaaggctcaattcagctcaaagcgggtgatcctttcattctcgacggcacgctcgaccgcgaagcgggcacgcaagaacgcgtcggtttggattatccagagctgatcgatgacctgcaagtcggcaatattctgctgcttgacgatggtcgtatccagctcgaagtaacggccgttgatacacaaactcgcctggtcaacaccattgcattgaacggtggcaaactctcaaaccgcaaaggaattaacttactgggtggtggtctttccgcccccgcgttaaccgacaaagacaagcaagacattcttaccgcggccgaactaaaagcagattttcttgccgtgtcgtttcctcgtaacgctgacgatatcgaatacgcgcgctcccttgctctacaagcaggctgtcacgcacacatcgtcgcgaaagtagaacgtgctgaagtggttgccagcgaagaagcgatggatggtgtgattcgtgcctccgacgtcattatggtggcacgtggcgatttgggcgtggaaattggtgacgcgcgcctgcctggcgtacaaaaagcgctgatcgctcgtgcgaagtacttaggcaaaccagttatcacggcaacccaaatgatggaatcgatgatcgagaacccattgccaacacgcgcggaagtgttggacgttgccaacgcggtactcgatggtaccgacgcggtcatgctctctgctgaatcagcggcggggttgtatccggttgaagcggtagaagccatggttcgaattgcacaaggggtcgaacacgaaaccagttgtgcacaaggctgttgggataagctgcaccacctgtgtaatgacgcgggcaagagctttgctctctcctcgatgatctcggcaacaaaagtacacaaagatcttggagtcgctatcgtgactcaacatggtgaaacaccactgttgatgtcgcgttgccaaagccaagcaaccatttgggcggtctcggacaaacctgagttgctgcgtaagctggcgattctgcgcggcgtaaccccggtttatctacccactttggacaaacgcggtgacattgcacatcagctcgtcagcctactgggtgccgatgctaaacagaaacaaatctcatccatcatgatgacccaattagaatccgttgaaggcgtgggcgatatgaatgtctgccgcttactaaacctgaacgaaacacccataacaaccgccattgcggcataa

SEQ ID NO: 7465 - protein, 491 aa, Vibrio vulnificus
MKMCKTKIVATLGPASQTREKLTQLIQAGVNVVRLNFSHGSAEEHIARAEMVREIAQDLNVSVGVLVDLQGPKIRIACFEQGSIQLKAGDPFILDGTLDREAGTQERVGLDYPELIDDLQVGNILLLDDGRIQLEVTAVDTQTRLVNTIALNGGKLSNRKGINLLGGGLSAPALTDKDKQDILTAAELKADFLAVSFPRNADDIEYARSLALQAGCHAHIVAKVERAEVVASEEAMDGVIRASDVIMVARGDLGVEIGDARLPGVQKALIARAKYLGKPVITATQMMESMIENPLPTRAEVLDVANAVLDGTDAVMLSAESAAGLYPVEAVEAMVRIAQGVEHETSCAQGCWDKLHHLCNDAGKSFALSSMISATKVHKDLGVAIVTQHGETPLLMSRCQSQATIWAVSDKPELLRKLAILRGVTPVYLPTLDKRGDIAHQLVSLLGADAKQKQISSIMMTQLESVEGVGDMNVCRLLNLNETPITTAIAA

SEQ ID NO: 7466 - DNA, 1449 bp, Vibrio vulnificus
  CDS (1)..(1449)
atgactcagccattaagaagaacaaaaatcgtgaccactttaggtccttcaactgacaaagataatgtactagaagaaattattcgagccggcgcgaatgtggtcaggatgaatttttctcacggcagcgcagaggatcataaaactcgcgcagaaaaagtgcgtaatattgccgccagacttggcagacaagtggctattttaggtgatttacaaggcccgaagatccgagtatcaacctttaaagaagggaaaattttcctttcagtgggtgacctcttcactttagacagtgacttgcccaaaggcgaaggcgatcaaaaatcagtgggattagactataaagcactgcctcaggatgtgggaccagaagatattctgctgcttgatgatggacgtgtacaactgcaagtgctgacggtcgatggcaacaaggtgaacactcgtgtgatagtgggcggaccgctgtcaaacaataaaggtatcaataaaaaagggggcggactctctgctgacgctctaacggaaaaagacaaacaagacatcttgctcgccgccgagatcaaagtcgattatctcgcgatctcctttccacgtaatggtgccgacatggactatgctcgtcgcttggccagagatgccggcttggaagccaaacttgttgccaaagttgaacgagcagaaaccgttcgaaacgatgaaaacatcgacgatattatcatggcttccgatgtcattatggttgctcgtggcgatctaggggtagaaatcggcgatccggaattgatcggtgtacagaaaaaactcatcaaacgagccaaagaactcaatcgtgtcgtcatcacggcaacacaaatgatggaatcgatgattgaaaatccaatgcccactcgagcagaagtcatggacgtagccaacgcggtgctggatggcaccgatgccgtgatgctttcaggggaaaccgccgctggtaaatacccagtcgaaacggtgcgctctatggcagaagtctgcattggggcagaaaaaacgtgggaaccgggcagccagaattatcgcatcgataaatcctttgtcaccgccgaagaaaccattgcaatgtcgacaatctacgccgcaaatcatatggaaggcgtcaaagcgatggtgacgttgactgaatcgggaagaaccgcattaatgacgtcaagattgaactcaacactgcccatttttgcgctttcgcctaatgagcgaacccttaatcgctgctctctctatcgtggcgtcactcccgtattttttgataccaaagtagaaactggatttgatgtcgcaatggccgcattgagcacgcttagaaagaaaaaactgctcgattttggggatttagtgatcatcacacagggggacatcatggatgttgaaggctcgactaactgcatgagaatcctgcctgtttttgactaa

SEQ ID NO: 7467 - protein, 482 aa, Vibrio vulnificus
MTQPLRRTKIVTTLGPSTDKDNVLEEIIRAGANVVRMNFSHGSAEDHKTRAEKVRNIAARLGRQVAILGDLQGPKIRVSTFKEGKIFLSVGDLFTLDSDLPKGEGDQKSVGLDYKALPQDVGPEDILLLDDGRVQLQVLTVDGNKVNTRVIVGGPLSNNKGINKKGGGLSADALTEKDKQDILLAAEIKVDYLAISFPRNGADMDYARRLARDAGLEAKLVAKVERAETVRNDENIDDIIMASDVIMVARGDLGVEIGDPELIGVQKKLIKRAKELNRVVITATQMMESMIENPMPTRAEVMDVANAVLDGTDAVMLSGETAAGKYPVETVRSMAEVCIGAEKTWEPGSQNYRIDKSFVTAEETIAMSTIYAANHMEGVKAMVTLTESGRTALMTSRLNSTLPIFALSPNERTLNRCSLYRGVTPVFFDTKVETGFDVAMAALSTLRKKKLLDFGDLVIITQGDIMDVEGSTNCMRILPVFD

SEQ ID NO: 7468 - DNA, 1410 bp, Photorhabdus luminescens
  CDS (1)..(1410)
atgaaaaaaaccaaaattgtttgtactatcggaccaaaaacagaatccgaagaaaaactggccgaactgttgaatgccggcatgaatgttatgcgcctcaacttttcacacggagactatgaagagcacggccagcgtattcaaaatatccattcagttatgactaagacaggtaaacaagccgctattttgctggatactaaaggccctgaaattcgaactatgaagctggaaggcggtaacgatgtctctctaaccgcaggtcagaccttcacttttaccactgacacttccgttatcggtaataaagaccgtgttgctgtcacttaccgcggtttccccgcggatctggctcccggtaataccgtgctagttgatgacggcttgatcggcatgacagttaaagaagtcactaagtcagaggttatttgccaagttttgaataacggtgatttgggggaaaataaaggtgttaatctgccgggtatttccatcagcctgcctgccctggctgaaaaagataagcaagatttgatctttggttgccaacaaggtgttgatttcgtcgccgcttcttttatccgcaagcgctccgatgttctggaaatccgtgaacatctgaaagcgcacggcggtgaaaacattcaaatcatctctaagattgaaaatcaggaaggtctgaacaattttgatgaaattctggaagcttctgacgggatcatggttgctcgtggtgatcttggcgttgaaattccggttgaagaagtgatcttcgcccagaagatgatgattcaaaaatgtaatatcgctcgcaaagttgttatcactgcaactcaaatgctcgattctatgattaaaaacccgcgccctacccgtgcggaagccggtgacgtcgctaacgctattttggatggtactgatgcagttatgctttctggcgaaagtgcaaaaggcaaatatccaatagaagcagtgactatcatggcaacgatttgtgaacgtacagaccgcgttatgccaagccgtatcgaagccgtccattgccgtaacctgcgcgtgaccgaagcggtgtgtcgtggtgccgttgaaacagcagaaaaactggaagcccctctgattgtggtcgcaacctatggcggtaaatctgccaaatccattcgtaagtatttccctgacgcgcccattctggcattaacgactaatgaagtgactgcccgccaattactgcttgttaagggtgtttttacccaaattgttaaagaaatcgcctctaccgacgatttctaccgcattggtaaagaagcggcgctagcaagtggcctagcgaagaaaggtgaaatcgtggttatggtatctggtgccctggttccaagcggcacaaccaacacgtcgtctgttcacgtcctttaa

SEQ ID NO: 7469 - protein, 469 aa, Photorhabdus luminescens
MKKTKIVCTIGPKTESEEKLAELLNAGMNVMRLNFSHGDYEEHGQRIQNIHSVMTKTGKQAAILLDTKGPEIRTMKLEGGNDVSLTAGQTFTFTTDTSVIGNKDRVAVTYRGFPADLAPGNTVLVDDGLIGMTVKEVTKSEVICQVLNNGDLGENKGVNLPGISISLPALAEKDKQDLIFGCQQGVDFVAASFIRKRSDVLEIREHLKAHGGENIQIISKIENQEGLNNFDEILEASDGIMVARGDLGVEIPVEEVIFAQKMMIQKCNIARKVVITATQMLDSMIKNPRPTRAEAGDVANAILDGTDAVMLSGESAKGKYPIEAVTIMATICERTDRVMPSRIEAVHCRNLRVTEAVCRGAVETAEKLEAPLIVVATYGGKSAKSIRKYFPDAPILALTTNEVTARQLLLVKGVFTQIVKEIASTDDFYRIGKEAALASGLAKKGEIVVMVSGALVPSGTTNTSSVHVL

SEQ ID NO: 7470 - DNA, 1443 bp, Photorhabdus luminescens
  CDS (1)..(1443)
atgtccagacggctcagaagaactaagattgttactacacttggtccggctaccgaccgcgataataatcttgaaaagattattgctgcgggtgcaaacgtagtccgccttaacttttcccacggtaccgccgaagatcatctccagcgagccagcaaagtccgcgagattgcagcccgcctggggtgccatgtcgctattcttggcgatcttcaaggacctaaaatccgcgtatcaacgtttaaagagggcaaaattttcctgaatatcggagataaatttctccttgatgccaatcttggtaaaggcgaaggcgataaggagaaagtcggtatcgattacaaaggactacccacggatgttgtaccgggcgatattttgttgctggatgacggacgtgttcaactcaaagtattagacgttcagggaatgaaagtcttcacggaagtcactgtaggcggcccgctatctaacaataaaggcattaacaaactgggtggtggattatccgcagaagccctaactgaaaaagataaagaagatattattacggcggccagaatcggcgttgattaccttgccgtctctttccctcgcaccggtgaagatcttaactatgcccgccgtctggcacgagacgcaggctgtgaaacgcagatcgtggcaaaagttgaacgcgcagaagccgttagcagtgataaaaccatcgatgaaatcattctggcttctgatgtggtcatggttgcccgtggtgaccttggcgtagaaatcggcgatccagagttagttggcgttcagaaaaaattaattcgccgtgcccgccagctaaatcgtgtagttattaccgcgacccagatgatggaatctatgatcaccaatccaatgcccacccgtgcagaagtgatggatgtggcaaatgccgttctcgacggtactgacgccgtaatgctctccgctgaaaccgcagcgggccaataccctgccgaaaccgttgccgcaatggcacgagtctgtctcggagcagaaaaaatgcctggcctcaacgtatcaaaacatcggctagacacaatttttgacagtattgaagaagccattgcgatgtctaccatgtacgcggcaaaccacttaaatggagttaaagccattattgccatgaccgaatcaggccgcaccactcgcatcatgtctcgcattagttctggtctcccgatattctctatgtcccgtcatgagaaaaccttaaaccaaacggcactttaccgtggcgttacaccggtttattgcagtagtcatactgacggcattacggcggccaatgaagcagttaatcgcctgcgtgataaaggttatctagtttccggtgatcttgttctggttactcagggtgatcagatggggacgattggcagtactaacacctgccgtattcttgaagtggaataa

SEQ ID NO: 7471 - protein, 480 aa, Photorhabdus luminescens
MSRRLRRTKIVTTLGPATDRDNNLEKIIAAGANVVRLNFSHGTAEDHLQRASKVREIAARLGCHVAILGDLQGPKIRVSTFKEGKIFLNIGDKFLLDANLGKGEGDKEKVGIDYKGLPTDVVPGDILLLDDGRVQLKVLDVQGMKVFTEVTVGGPLSNNKGINKLGGGLSAEALTEKDKEDIITAARIGVDYLAVSFPRTGEDLNYARRLARDAGCETQIVAKVERAEAVSSDKTIDEIILASDVVMVARGDLGVEIGDPELVGVQKKLIRRARQLNRVVITATQMMESMITNPMPTRAEVMDVANAVLDGTDAVMLSAETAAGQYPAETVAAMARVCLGAEKMPGLNVSKHRLDTIFDSIEEAIAMSTMYAANHLNGVKAIIAMTESGRTTRIMSRISSGLPIFSMSRHEKTLNQTALYRGVTPVYCSSHTDGITAANEAVNRLRDKGYLVSGDLVLVTQGDQMGTIGSTNTCRILEVE

SEQ ID NO: 7472 - DNA, 1527 bp, Mycoplasma gallisepticum
  CDS (1)..(1527)
atgaataagaaacataaagatttcgatttaaactttttaaaaaagacaaagatagtagccacttgtggtccttcaattacatataaactatttagtttagctgatcttgaagatccatcaaaacaagagatcgtgcaaaaagctaaggaaaatttaagacaactgttcttaaatggtgtgagcacagtccgtttaaacttttctcacggaaatcaagaagagcaagctgtaagaatgatcttagctagaagtgtggctaatgaattaaacttaccaatctcaattatgcttgacactaacggtcctgagatcagattaaatcagatctcagaaacagacaataccgttaaaaaagatcagatcgttaagatctatactaatcgcgagatcgttggtaatgccactgagttttctgtctcagattcatctaagaaatacaatatggctaaagatgtttctttaggttcgatcgttttagttgatgatgggaaattaaccttacaagtaattgaggtggctgaagacttttcatacattagagcaatcgctaaaaatgaacataagatcatcaccaaaaagcgtatcaacttaccaaatgctaaatattcgatcccattcttatcacaaaaagattacaacgatattacctttggtctaaagaataaagttgattatattgcagcatcatttgttaatagtgctgatgatatctatgagattaaagcgatcttaaaacaatatggaatggaacacgttcaagtgatcgctaaggttgaaacacgtcacgcaatcaaaaatcttgatgagattattgatgttagtgatggtgtgatggtggctagaggtgatcttggtttagagatcccttattatgaagtaccttactgggaaaaatacattattaaagcttgccgttttaagaataaacgtgtgatcgtagccacccaaatgttagattcactagaaaaaaacgttcaaccaactcgtgctgaagtaactgatgtcttctttgctgttgaacgtggttgtgatgcaacgatgttatcaggtgaaacagcgaatgggatgtatccgattattgctgttgaaacaatgaaaaagatcaacaagcaatcagaactattgtttgactacaaacgtgcaattactcactatttcccaatgacagatgtatgtaagaccgcttttggtgaaagagtcttagatatagctaaaaagatctgtccaaatcgtgagattgaaaacgaagatttctcaacccacttcttagtgcattttaccaacaaccgtgaagagatctttgctttatctaatgctaagttggctgctagtgtaattattgttactgatgatcaaaacgtatatacaggtcatggtgttgattatggggtgttcacttataaggtggatgatcttacaaaagcattaagtaattaccaactagttgctaagaaagcaatcttacactattcagaactatttgaaattaaaccagataataagactaactttgtattactaaaataa

SEQ ID NO: 7473 - protein, 508 aa, Mycoplasma gallisepticum
MNKKHKDFDLNFLKKTKIVATCGPSITYKLFSLADLEDPSKQEIVQKAKENLRQLFLNGVSTVRLNFSHGNQEEQAVRMILARSVANELNLPISIMLDTNGPEIRLNQISETDNTVKKDQIVKIYTNREIVGNATEFSVSDSSKKYNMAKDVSLGSIVLVDDGKLTLQVIEVAEDFSYIRAIAKNEHKIITKKRINLPNAKYSIPFLSQKDYNDITFGLKNKVDYIAASFVNSADDIYEIKAILKQYGMEHVQVIAKVETRHAIKNLDEIIDVSDGVMVARGDLGLEIPYYEVPYWEKYIIKACRFKNKRVIVATQMLDSLEKNVQPTRAEVTDVFFAVERGCDATMLSGETANGMYPIIAVETMKKINKQSELLFDYKRAITHYFPMTDVCKTAFGERVLDIAKKICPNREIENEDFSTHFLVHFTNNREEIFALSNAKLAASVIIVTDDQNVYTGHGVDYGVFTYKVDDLTKALSNYQLVAKKAILHYSELFEIKPDNKTNFVLLK

SEQ ID NO: 7474 - DNA, 1818 bp, Gloeobacter violaceus
  CDS (1)..(1818)
atgcgcgtgggtgccgatgtgttcgttctagatgccaatgcccaacagacaactgccgcgccgagcgagcgggcgcgttttcgccgcaccaagattgtcgccaccatcggtcccgccgtcgacgacccgcaggccctgcgcaagctcatccaggccggggcgacgaccctcagactcaatttttcccacggcaaccacgaggagcaccgccgccgcatcggcctcatccgccagatttcctttgaactcaatcagccggtggccatcctgcaggatctgcaaggtcccaagatccggttgggcaagttcgccgacggaccaatcgtcctcaagcacggcgacccgtttattctgaccagccacgacgtgcccgccaaccagcacatcagtccgatcacctactcgcgacttatccaggaagtgcccaccggcgccacgatcttgctggatgacgggcgggtggaactggtagtcgaacgggtggacctcgaagcccaatacctgcactgccggacggtgggggggggcaagctctccaacagcaaaggcgtcaactttccgggtgtcaccctctcggtgccggcgatgaccgaaaaggaccgcgaggatttgctcttcggtctcaatcagggcgtcgattgggtggccctcagtttcgtgcgcaccccgagcgatttgctcgaactgaaggaactgattgcccaatcgggcaagcgggtgccggtgatcgccaagatcgaaaaattcgaggccttcgagaacctcgatgcggtgattgccgcctgcgacgggctgatggtggcccgtggcgatctgggcgtcgagatgcccgccgaggaagtgcccttgctccaaaagcggctgatcgcttcggccaatcgggccggcaagcctgtgatcaccgccacccagatgctcgattcgatggtgagcaacagccgcccgacccgcgccgaagtttccgatgtggccaacgccatcctggacggcaccgacgcggtgatgctctccaacgagaccgccgtgggcgagcacccgatcttggcggtcgagacgatggcgcgcatcgccgatcgcatcgagcgctcgatgccccagcgcacctgggtagacacgggccgctcgatcccgaacgccatctcccaggcagtgggaagcgtcgcccagcaattgggtgcccaggcgattctcaccctcaccaagtccggcgccaccgcccgcaacgtcagcaagtaccggccgagggtgccgattatcgcgattaccccgagcgtgtcggtggcgcgcgaactgcagatggtctggggggtctacccgctgatggtcctggatctgccttcgacccgccagacctttcaagcggcgatcagcgccgcccaggacgaaaacctcgtcctggaaggcgacctggtggtgatgaccgccggcaccatccaggggctctccggttcgacggacctgatcaaagtcgaggtggtgacggcgattctcggccggggattgggcctgggtcagaacgccgtgagtggacgcgcccgcatcgtccgccacagcgacgaagcggcggccttgagtcccggggacatcctgattgccccgcgcaccgacgccaattttatcgaagcgatcaagctcgcgggcggcatcgtcaccgaggagagcggcctcacctcccacgcagcgattatcgggctgcgcctcggactgccggtactgctcggggtgaaagactgcaccacccgcatcccggacggggtggtgctcaccctcgatccgcaaaaaggggtcatcttctccggggcggcctccgccgtctag

SEQ ID NO: 7475 - protein, 605 aa, Gloeobacter violaceus
MRVGADVFVLDANAQQTTAAPSERARFRRTKIVATIGPAVDDPQALRKLIQAGATTLRLNFSHGNHEEHRRRIGLIRQISFELNQPVAILQDLQGPKIRLGKFADGPIVLKHGDPFILTSHDVPANQHISPITYSRLIQEVPTGATILLDDGRVELVVERVDLEAQYLHCRTVGGGKLSNSKGVNFPGVTLSVPAMTEKDREDLLFGLNQGVDWVALSFVRTPSDLLELKELIAQSGKRVPVIAKIEKFEAFENLDAVIAACDGLMVARGDLGVEMPAEEVPLLQKRLIASANRAGKPVITATQMLDSMVSNSRPTRAEVSDVANAILDGTDAVMLSNETAVGEHPILAVETMARIADRIERSMPQRTWVDTGRSIPNAISQAVGSVAQQLGAQAILTLTKSGATARNVSKYRPRVPIIAITPSVSVARELQMVWGVYPLMVLDLPSTRQTFQAAISAAQDENLVLEGDLVVMTAGTIQGLSGSTDLIKVEVVTAILGRGLGLGQNAVSGRARIVRHSDEAAALSPGDILIAPRTDANFIEAIKLAGGIVTEESGLTSHAAIIGLRLGLPVLLGVKDCTTRIPDGVVLTLDPQKGVIFSGAASAV

SEQ ID NO: 7476 - DNA, 1422 bp, Gloeobacter violaceus
  CDS (1)..(1422)
atgcagcctttagaccgtcgaacgaaagtcgtcgcgacgatcggtcctgcgagcagttcgccggaagtgcttcggcagctggtgaaggcaggaatcaacgtcgcgcgcttgaatttttcccacggcagctacgaagaccacgcgcgcatggtcaagctgctgcgggaggtctccgaggaactcgacaccccgattacgctattgcaggatttgcaggggccgaagatccgcgtgggccagatgcccgagggcgggctggctttaggggagggcgacgagctgacgctgttgccggtggcggaatttgcgggcgaacccggcacggtatccatcgactacccgtatcttgtggaggaggcgacgccgggtacccaggtgctcctggacgacggcttgctcgaatttgccgtggttgaggtgaagggcaacgccgtgcgctgccgggtggtgcgcgggggggtgctcaaaagccgcaagggggtcaacctgcccagtctggatttgcgcctgccctcgatgaccgaaaaggacaagcaagatctcgaatttggactggagcagggggtcgattgggtgtctttgagcttcgtgcgccggggcgaggacattcgcgtgctcaaaggactgctcgctgaacacggggccgccgatgtgccggtgatcgccaagattgagaaaccccaggcgatcgccaatctggaggagattctcgatgaagtgcagggaatcatggtggccaggggcgatctgggcgttgagatgagcccggagaaggtgccgctgctgcaaaagcggatcattcggctttgtaaccggcggggcattccggtgatcaccgccacccagatgctcgacagcatgatccgcaatccccggccgacccgcgctgaggcgagtgatgtcgccaacgccatcctggacggcagcgacgcggtgatgctctcgggcgaatcggcggtgggcgattttccggtgcagtcggtggagatgctcgtgcgcatcgccaaagaagtcgagcgggagtttaccttcgacaacaatccgcccgccaaatccgatgaaatccacgccctgtgcgaatcgctgggcaccatcgacaagatcttggccctgcactgtattgccacttttactaccaccggcttcagcgcttcgatcgcggccgcggagcggccgaaggcgccggtggtcgccttcacccccgacttgaaggtgtatcaccggttgaatctggtctggggcgtgaagcccttgctgttggagcacccggcggcggaactcgaaaaactgatcgagcagatggaaagctgccttgtcgaacgcaacctcgccgcccccggcgaccggatgctggtgctgggaggtagccccgtccagagggcgggcggcacgaattttctgaagatccatacgctgcactaa

SEQ ID NO: 7477 - protein, 473 aa, Gloeobacter violaceus
MQPLDRRTKVVATIGPASSSPEVLRQLVKAGINVARLNFSHGSYEDHARMVKLLREVSEELDTPITLLQDLQGPKIRVGQMPEGGLALGEGDELTLLPVAEFAGEPGTVSIDYPYLVEEATPGTQVLLDDGLLEFAVVEVKGNAVRCRVVRGGVLKSRKGVNLPSLDLRLPSMTEKDKQDLEFGLEQGVDWVSLSFVRRGEDIRVLKGLLAEHGAADVPVIAKIEKPQAIANLEEILDEVQGIMVARGDLGVEMSPEKVPLLQKRIIRLCNRRGIPVITATQMLDSMIRNPRPTRAEASDVANAILDGSDAVMLSGESAVGDFPVQSVEMLVRIAKEVEREFTFDNNPPAKSDEIHALCESLGTIDKILALHCIATFTTTGFSASIAAAERPKAPVVAFTPDLKVYHRLNLVWGVKPLLLEHPAAELEKLIEQMESCLVERNLAAPGDRMLVLGGSPVQRAGGTNFLKIHTLH

SEQ ID NO: 7478 - DNA, 1407 bp, Chromobacterium violaceum
  CDS (1)..(1407)
atgcttcgcaataccaaaatactcgccacgctcggcccctcctccagcgccccggaaaaaatcctggaactggcccgttccggggtcaacatcttccggctcaacatgagccacggcagccatgacgaccatcgcgcgcgcctggcggccatccgcgccgccgaaaaaacgctggatcgcccgatcggcgtgctggtggacctgcagggccccaagctgcgcatcggcaagtttccgcaaccaaccacggtgaaaaccggcgaccgctacgaattcgtgctggatgaaacggaaggcaatgccgaacgcgccaccctgccgcacccggaagcgttcgaggcgctggagcccggccacctgatcctggtgaacgacggcaagctcgccttcgaagtggcggaaatgcatccgcgccgcatcgtcacccgcgtcaccgtcggcggggaactgtccagcaacaagggcttcaacctgcctcacaccgtgctgccgctgtcggccatcaccggcaaggaccgcaaggacgcggagttcgcgctggaagagggcgccgactgggtggcgatgtccttcgtccagaccgcggccgacgtcaaggcgctgcgcgacatcgtcggcaaacgcgtcggcatcgtcgccaagatcgaaaaaccgtcggcggtggacgatctggaagccatcgccgagctggccgacggcgtgatggtggcgcgcggcgacctgggcgtggagctgccgccggaagacgtgccggtggtgcagcgccgcatcgtccaccactgccgccacctgggccgcccggtgatcgtggccacccagatgctggaatcgatgatcaccgcgccgaccccgacccgcgccgaggccaacgacgtggccaccgccgtctacgaaggcgcggacgcggtgatgctgtcggccgaaaccgccgccggccagtacccgctggaggcggtgcagatcatggaccgcatcatccgccgcgtggagaacgcgcccgactaccgcaaggtgatggcgctggattacagcgccgccgacgagccggaccgcaccgacgccatcgccgcctgcgtgcgcaaggtcagcaccctgctgccggtcaccgtggccgtcgccttcaccaccagcggcgccagctgtctgtcgctggcgcgcgagcgcccgtccacccccatcctgggcatctcgcccaggctggaaaccgcgcgccgcctgaccctggtgtggggcgtggtcgcctaccacggcccggacgccgagaacctggaagacatggtggtgaagaccaccttctgcgccaccaagctcagcctggccgagcagggcaagccgatggtgatcatcgccggcgtgcccttcggcacccccggctccaccaacctgctgcgcatcgtctatccataa

SEQ ID NO: 7479 - protein, 468 aa, Chromobacterium violaceum
MLRNTKILATLGPSSSAPEKILELARSGVNIFRLNMSHGSHDDHRARLAAIRAAEKTLDRPIGVLVDLQGPKLRIGKFPQPTTVKTGDRYEFVLDETEGNAERATLPHPEAFEALEPGHLILVNDGKLAFEVAEMHPRRIVTRVTVGGELSSNKGFNLPHTVLPLSAITGKDRKDAEFALEEGADWVAMSFVQTAADVKALRDIVGKRVGIVAKIEKPSAVDDLEAIAELADGVMVARGDLGVELPPEDVPVVQRRIVHHCRHLGRPVIVATQMLESMITAPTPTRAEANDVATAVYEGADAVMLSAETAAGQYPLEAVQIMDRIIRRVENAPDYRKVMALDYSAADEPDRTDAIAACVRKVSTLLPVTVAVAFTTSGASCLSLARERPSTPILGISPRLETARRLTLVWGVVAYHGPDAENLEDMVVKTTFCATKLSLAEQGKPMVIIAGVPFGTPGSTNLLRIVYP

SEQ ID NO: 7480 - DNA, 1662 bp, Giardia lamblia ATCC 50803
  CDS (1)..(1662)
atgcttaacaataagtttacagcaaatcagatcaccgagtacaacctcacaaacctcaagaagctcgtcgagcagggcctcaaaggtgtggataagaatcacccgcacttcaatcgcgtgaagatttgctgcacgctgggcccgtcttcgttcaacgttgaggtcatagcaggaatgatcagggcaggtgccgatattattcgcatcaacttctctcatggcaacacagacgatcatactcaaattttccacaaagtccagcaggcaatgcaactgaccggcaagactgtcgcaataatgggggatatccagggaccgaagctcaggattgccggcttctctaacccagacaactgtatagagctcaaggaaggccaggagttcactttggatcataacaacgtgaacggcgatgagtccagggtgtatcttccccataaagagttctttgctgtctgcgagcctaacgatgacatcatcctcaacgacggctacatccgtttggttgccacgagcgttgatcgtcaagccatgagaatcgtcacgagagtgaaaaccggcgggaagctcggagcccgcaaggggataaccattcccacgcgcattctcccactgagtggactatcacccaaagatctgggagacatcagaaatgcatgcagactcgggatggactggattgccctctcgtttgtgcagactaaggctgacgttattgaagcccgagattacattgcgaagctccacgcagaaaatccggcaagcttctgcccgcgcgtatgcagcaagattgaaaagcccacggcagtccttgacatcgacgacattgcactactttctgacatgctcatggtcgctcgcggggacctggctatcgaaacatgcctatctaaggtttgctctatccagaagtacatctgtgaacgagcgcgttatcacggctgccaggcaatggtcgcgacgcagatggttgagtctcttatcgagaacaccgttcccacaagagcagaggtgacagatgttgcgtcggtgtgctttgacggggctaattctgtgttggtcaccgccgaaaccgcggccggacacgacccggtcaacgttgtcaaggtcctccgttcaatccttactaccacagaacagtctgaggcctttatcaagcaggttctgacagacaactatatcaaccaacgcacctcgaaggagcacaagcgtcctgattccatagcactgggggcgtgtctactcgctcgagagcttggagcgaaactaatcattgttttctcgaagagtggcaactcaactggtcgtgttcttcgtcaactcccgcactgccctgtcctttgcatcacatcggagcagcgatcctaccagtggctccacatgtgctggggatgccgccctgttctccaccccggaaacattgacagcatgaagactctgatcagtgtggctgacacacatgcgcttgaatcagggcaggcggagcgtggagacgcagttgtcctcgtctttggcacgccgttctctgacgtgaaccgcaagggctgcaacaatataatggcgcacgttgttggtgggggctccttcaacaacagtaccgacgtggagtacggtgttacccctcagttggcagagctgactcccgtggtcggggatagttaa

SEQ ID NO: 7481 - protein, 553 aa, Giardia lamblia ATCC 50803
MLNNKFTANQITEYNLTNLKKLVEQGLKGVDKNHPHFNRVKICCTLGPSSFNVEVIAGMIRAGADIIRINFSHGNTDDHTQIFHKVQQAMQLTGKTVAIMGDIQGPKLRIAGFSNPDNCIELKEGQEFTLDHNNVNGDESRVYLPHKEFFAVCEPNDDIILNDGYIRLVATSVDRQAMRIVTRVKTGGKLGARKGITIPTRILPLSGLSPKDLGDIRNACRLGMDWIALSFVQTKADVIEARDYIAKLHAENPASFCPRVCSKIEKPTAVLDIDDIALLSDMLMVARGDLAIETCLSKVCSIQKYICERARYHGCQAMVATQMVESLIENTVPTRAEVTDVASVCFDGANSVLVTAETAAGHDPVNVVKVLRSILTTTEQSEAFIKQVLTDNYINQRTSKEHKRPDSIALGACLLARELGAKLIIVFSKSGNSTGRVLRQLPHCPVLCITSEQRSYQWLHMCWGCRPVLHPGNIDSMKTLISVADTHALESGQAERGDAVVLVFGTPFSDVNRKGCNNIMAHVVGGGSFNNSTDVEYGVTPQLAELTPVVGDS

SEQ ID NO: 7482 - DNA, 1536 bp, Plasmodium yoelii yoelii
  CDS (1)..(1536)
atgaatccttttaaatttaaaaacgcaaccgctggagctagcttacaaagcgcagctaacattactttaaggcaaattttagaacctaataatgtgaatttacgttcaaaaaaaactcacattgtttgtacattaggcccagcatgtaaatctgttgaaacactcgtgcaaatgatagatgcaggaatggatatatgccgttttaacttttctcatggaactcatgatgatcacaagcaaatgtttgaaaatgttttaaaagcacaagcccaaagaccaaattgcacattaggtatgttattagatactaaaggacctgaaataagaacaggtttattaaaaaataaagaagctcatttaaaagaaggaagcaaattaaagttggttactgattattcctatttgggagatgaaacttgtattgcttgttcatacacaaaattaccacaaagtgtaaagccaggaagtattatattaatagctgatggatccgttagttgtagagtattagaaacacacgatgatcatgtaattacagaagtattaaataatgcaacaattggtgagaaaaaaaatatgaacttaccaaatgttaaggttgatttaccaattataagtgaaaaagataaggatgatatacttaactttgctataccaatgggatgcaattttattgctgcatcatttattcaatctgctgaagatgtgcgtttaatcagaaatttgttaggcccacgaggaagacatattaaaattattccaaaaatcgaaaatattgaaggtattataaattttgacaaaatattagctgaagccgatggaattatgattgcaagaggagatcttggtatggaaatatccgcagagaaggttttcttagcccaaaaacttatgatatcaaaatgtaatttacaaggaaagccaatcattacagccactcaaatgcttgaatctatgacaaagaacccaagaccaacaagagcagaagttacagatgtagctaatgcagttttagacggaaccgattgtgttatgctttcaggtgaaacagcaggcggtaaatttccagtagaagcagttactattatgtctaaaatatgtttagaagcagaagcatgcattgattataaattattatatcaatcattagtaaatgccatccaaaccccaataagtgtacaagaagcagtagctagatctgcagttgaaacagcagaatcgattgaagcatctgttattattacattaacagaaaccggatacactgctagactaatagctaaatacaaaccaagctgtactatattagctttaagtgcatctgattcaacagttagatgcttaaatgtacacagaggtgttacatgcattaaagttggatcattccaaggaactgataacgtattaagaaatgcaattgaaattgcaaaagaaagaaatatcgttaaacctggagatagtgccatatgtattcacggaattaaagaagaagtttctggaagtactaacttaatgaaagtaatacaagtagaataa

SEQ ID NO: 7483 - protein, 511 aa, Plasmodium yoelii yoelii
MNPFKFKNATAGASLQSAANITLRQILEPNNVNLRSKKTHIVCTLGPACKSVETLVQMIDAGMDICRFNFSHGTHDDHKQMFENVLKAQAQRPNCTLGMLLDTKGPEIRTGLLKNKEAHLKEGSKLKLVTDYSYLGDETCIACSYTKLPQSVKPGSIILIADGSVSCRVLETHDDHVITEVLNNATIGEKKNMNLPNVKVDLPIISEKDKDDILNFAIPMGCNFIAASFIQSAEDVRLIRNLLGPRGRHIKIIPKIENIEGIINFDKILAEADGIMIARGDLGMEISAEKVFLAQKLMISKCNLQGKPIITATQMLESMTKNPRPTRAEVTDVANAVLDGTDCVMLSGETAGGKFPVEAVTIMSKICLEAEACIDYKLLYQSLVNAIQTPISVQEAVARSAVETAESIEASVIITLTETGYTARLIAKYKPSCTILALSASDSTVRCLNVHRGVTCIKVGSFQGTDNVLRNAIEIAKERNIVKPGDSAICIHGIKEEVSGSTNLMKVIQVE

SEQ ID NO: 7484 - DNA, 1584 bp, Neurospora crassa
  CDS (1)..(1584)
atggccgctactgcgcttgaccatctcagcctcggcggcaagattcagtggctcgctcagcttaacactgagttccagcccgctcgcgagttccgtcgcacttccatcatctgcaccattggtcccaagaccaactcggtcgaggccatcaacaagctccgcgatgctggtctcaacgtcgttcgcatgaacttctcccacggaagctacgagtatcaccagtccgtcattgacaatgctcgccaggctgagaaggttcatcccggccgccctattgccattgcccttgacaccaagggccctgagatccgtaccggcaacaccaagaacgatgaggatattcccatctccgccggtaccatccttaacatcaccactgatgaaaagtacaaggatgagtgcactatcgagcacatgtacgtcgactatgtcaacatcaccaaggtcattgctcctggccgtatcatctacgtcgacgatggtgtcctcgctttcgaggtcctcgagattgtcgatgacaagaccatcaaggttaaggcccgcaacaacggctacatctcctcccgcaagggtgtcaaccttcccaacaccgatgtcgatctccctgctctttccgagaaggataaggccgatctcaggttcggtgtcaagaacaaggtcgacatggtctttgcttcttttatccgtcgcggccaggacatcaaggacattcgtgaggtccttggcgaggatggcaagcagatccagatcattgccaagatcgagaacaggcagggtctcaacaactttgctgagattctcgccgagaccgatggtgtcatggttgcccgtggtgacttgggtattgagatccccgccgccgaggtgttcgctgcccagaagaagatcatcgccatgtgcaacattgccggcaagcccgtcatctgcgctacccagatgctcgagtccatgatcaagaaccccagacccaccagagccgagatcagcgatgtcggtaacgctgttaccgatggtgctgactgcgtcatgctttctggtgagaccgccaagggtgcttaccccaccgaggccgtccgtgagatgagcgaggccgttcttaaggccgagaacaccatcccctacgtcagccacttcgaggagctttgcagcttggccaagcgccccgtctccattgtcgagtcctgcgccatggcctctgtccgcgcctcccttgaccttaacgccgctgccattcttgttctctccacctccggcgagtccgctcgtctcatctccaagtaccgccctgtgtgccccatcatcatgatcaccaggaacgactctgcttcgaggtacgcccacctttaccgtggcgtctaccccttccttttccccgagtccaagcccgactttagcaaggtcaactggcaggaggatgttgatcgtcgcatcaagtggggtctcagccacggtattggcctcaaggtcctcaacgagggcgaaaccgttgtcgttgttcagggctggaagggtggtatgggtaacaccaacaccttccgtatcgttaaggccgatgtcaaccacctcggtcttggccagccttaa

SEQ ID NO: 7485 - protein, 527 aa, Neurospora crassa
MAATALDHLSLGGKIQWLAQLNTEFQPAREFRRTSIICTIGPKTNSVEAINKLRDAGLNVVRMNFSHGSYEYHQSVIDNARQAEKVHPGRPIAIALDTKGPEIRTGNTKNDEDIPISAGTILNITTDEKYKDECTIEHMYVDYVNITKVIAPGRIIYVDDGVLAFEVLEIVDDKTIKVKARNNGYISSRKGVNLPNTDVDLPALSEKDKADLRFGVKNKVDMVFASFIRRGQDIKDIREVLGEDGKQIQIIAKIENRQGLNNFAEILAETDGVMVARGDLGIEIPAAEVFAAQKKIIAMCNIAGKPVICATQMLESMIKNPRPTRAEISDVGNAVTDGADCVMLSGETAKGAYPTEAVREMSEAVLKAENTIPYVSHFEELCSLAKRPVSIVESCAMASVRASLDLNAAAILVLSTSGESARLISKYRPVCPIIMITRNDSASRYAHLYRGVYPFLFPESKPDFSKVNWQEDVDRRIKWGLSHGIGLKVLNEGETVVVVQGWKGGMGNTNTFRIVKADVNHLGLGQP

SEQ ID NO: 7486 - DNA, 1455 bp, Synechococcus sp
  CDS (1)..(1455)
atgggccagttcgatcagaaccgtcggaccaagatcgtggccaccatcggtccagccacggaaagttccgagcgaatcaaggaactggttcaggctggagccaccacctttcggttgaatttctcccacggcgaccacagcgagcatgcggcgcggatttcgaccatccgccaggtgtctgaagagctcgggatcaacatcggcatccttcaagacctgcagggaccaaaaatccgcctgggccgttttgctgagggaccgatcacccttgccaatggcgacagcttctccctgacgtccaggccggtgagttgcaaccaatccatcgccaccgtcacctacgacaaactcgctgacgaagtcaccgcaggaagccgcatccttctcgacgacggccgcgttgagatgaaagtcgagcaggtggatcaggctgaacagaccctgcactgcaccgtcaccgttggcggtgttctctccaacaacaaaggagtgaacttccccgacgtgcagctgtccgtccgcgctctgacggacaaggacaaggtggatctggaattcggtctctcccagggggtcgactgggtggccctgagcttcgtacgcaacccctccgacatggaggaaatccgtggtctgatccgtgagcatggccacgagacccccgtcgtcgccaagattgagaagtttgaggccatcgaccagatcgatgccatccttcccctgtgcgatggcgtgatggtcgccaggggtgacctgggggtagagatgcccgctgaggaggttcctcttctgcagaaggaattgatccggaaagccaacagcctgggcattccgatcatcacggccacccagatgctggattcgatggcctccagcccgcgacccacccgcgctgaagtgagcgatgtggccaacgccattttggatggcaccgatgcagtgatgctctccaacgaaacggccgtcggcgatttcccggtggaagccgttcaaacgatggcgaccatcgcctgccggatcgaaaaggattatccccagcgttccgttgacagccatctggccagcacggtgccgaatgccctgagtggcgccgtcagcaccatcgccagtcagctgaacgcctcggcgatccttcctctcaccaaaagcggagcgacggctaagaacgtcagcaagttccgtcccgcatcgccgattctggccattacccctgatccaaccgtggcctgccgtctgcaactggtttggggagtgaagccgctggtgatcccgcagcacgaactcaccactcacacgttccttgccgcgatgacccaggccaaaacaatggggcttctgaaggaaggtgatctggtcgttcagacggccgggacccacacgggtgtctccggttccaccgatctggtcaaggtgggcatcgtcagttcagaggaagcacccgtcaacatgatctga

SEQ ID NO: 7487 - protein, 484 aa, Synechococcus sp
MGQFDQNRRTKIVATIGPATESSERIKELVQAGATTFRLNFSHGDHSEHAARISTIRQVSEELGINIGILQDLQGPKIRLGRFAEGPITLANGDSFSLTSRPVSCNQSIATVTYDKLADEVTAGSRILLDDGRVEMKVEQVDQAEQTLHCTVTVGGVLSNNKGVNFPDVQLSVRALTDKDKVDLEFGLSQGVDWVALSFVRNPSDMEEIRGLIREHGHETPVVAKIEKFEAIDQIDAILPLCDGVMVARGDLGVEMPAEEVPLLQKELIRKANSLGIPIITATQMLDSMASSPRPTRAEVSDVANAILDGTDAVMLSNETAVGDFPVEAVQTMATIACRIEKDYPQRSVDSHLASTVPNALSGAVSTIASQLNASAILPLTKSGATAKNVSKFRPASPILAITPDPTVACRLQLVWGVKPLVIPQHELTTHTFLAAMTQAKTMGLLKEGDLVVQTAGTHTGVSGSTDLVKVGIVSSEEAPVNMI

SEQ ID NO: 7488 - DNA, 1431 bp, Rhodopirellula baltica
  CDS (1)..(1431)
atgcaggactaccgtcacacaaaaatcattgccacgatcggcccggcaaccgagtcccccgaaaaactagcggcgttgatcgaagcgggcgtcgatgtcatgcgactcaatatggcacacggaacgcctgaatgggtcggcgaaatcgtcgcacggatccgaaaggtttccaaggatattagtcgtcacgttgcggtgatgatggacgtcaaaggcccagagattcgaaccggtgcggtggaggatgcgatcgaattgaaagccggcgacgagctggtcctgttcaccgaagactgcgcggatcaatcggcggtcgaatccgacggaactccgcgggtcagtgtgaactatctgggcctgcccggtgcgatcgacttggacagcacgattttggtcgacagcggtttgttgcattggcatgtactgaagaaagacgccaccaccgttcgctgccgcgtgatcacgcccggcgttctggaatctcgacgtcacatcaacttgcctggcgtccaagtcaacttgcccgcgatcacggacaaagaccgcaccgatttggcggcgggcgtcaaagcgggcatcgacttcgttgcgctttcgtttgttcgccaagcggaagacgtccgcacgctgcgtgcattcttagacgaacacggctcacccgcacgaatcatttcaaagatcgaagaccaagccggtgttcgcaacatgaaggcgatcatccggcaatccgatgcgatcatggtcgctcgtggtgacctcggcgttgaaattgattaccaccgattgccgcttgttcaaaccgatttgattcgtgcctgccaagaagatggcaagcccgtcatcatcgccacgcacctgctcgagtcgatgattcaatcgccggttccaactcgtgcggaagtgtcggacgtctccaacgcaattcgcgaacaagccgatgcggtgatgctgtctggtgaaacgaccacgggtaaatacccgctggagtccgttggtgtgctgcaaaacattgtcgccagcatcgagccaacggtcagccgccaactgaactcaaagatcgtgcttcgagagcccaaatcgatgatgctgcgatcggcgtgcaccttggcacaggagatgggtgattcaggaatcgttgtcttcacccgcagcggttttctcgcttacgtcctgggggccctgaggcctcggggtgtgccaattttcgccttcaccgatgtcgagcatacgttccgtcacttaatgttgccgtggggtgtggagccgttcttcatggagttctccgaagatcacgatcaaaccatcaccaacgcattggaagttctgaaggagagcggttggtgcaaaccgggcgtttggttgggggtcatcaccaacgctttggccgacgaaaaaatcatcgacacgcttcagttgcgtcaggtccagtaa

SEQ ID NO: 7489 - protein, 476 aa, Rhodopirellula baltica
MQDYRHTKIIATIGPATESPEKLAALIEAGVDVMRLNMAHGTPEWVGEIVARIRKVSKDISRHVAVMMDVKGPEIRTGAVEDAIELKAGDELVLFTEDCADQSAVESDGTPRVSVNYLGLPGAIDLDSTILVDSGLLHWHVLKKDATTVRCRVITPGVLESRRHINLPGVQVNLPAITDKDRTDLAAGVKAGIDFVALSFVRQAEDVRTLRAFLDEHGSPARIISKIEDQAGVRNMKAIIRQSDAIMVARGDLGVEIDYHRLPLVQTDLIRACQEDGKPVIIATHLLESMIQSPVPTRAEVSDVSNAIREQADAVMLSGETTTGKYPLESVGVLQNIVASIEPTVSRQLNSKIVLREPKSMMLRSACTLAQEMGDSGIVVFTRSGFLAYVLGALRPRGVPIFAFTDVEHTFRHLMLPWGVEPFFMEFSEDHDQTITNALEVLKESGWCKPGVWLGVITNALADEKIIDTLQLRQVQ

SEQ ID NO: 7490 - DNA, 1791 bp, Prochlorococcus marinus subsp
  CDS (1)..(1791)
atgtcgaatattgatttaaaaaggagaaccaagattgttgcaacaattggaccagctactcaatcagaagaaattattactgatcttattaaggctggagtcacaacatttcgattaaatttttctcatggcgatcataaagatcatcaagaaagaatacaaaccataagaaaagtttctgaaaagctagatctagatattggaatacttcaggatcttcagggtcctaaaataagattaggaagatttaaagatggtcctgtaaaagtaaaaaaaggagataaattctcattaacttccaatgaagttgaatgtacaaaaagtatagctaatgttacctacaacaaacttgcccaggaagtaacttcaggtaaaagaatattgttagatgatggaaaaattgaaatgattgttgaaaaggttgatataggaaataatttattagagtgtaaagtaactgttggaggagtcctttctaacaacaaaggtgtaaattttccagatgtacaattatctgttaaagctttaactgataaagatatagaagatcttgaatttggattaactgctggtgttgattggatagctctgagttttgtaagaaatccgtctgatattaatgaaataaaaaatttaataaataagaatggacattcaattcctgttgtagccaagattgaaaaatttgaagcaatagatcaaatagattcaatattacctttgtgtgatggggttatggttgcacgaggagacttaggagttgaaatgccagcagaagaagtccctcttttacaaaaagagttaattagaaaagcaaatacactagggatccccattattaccgccacacaaatgcttgactcaatggcatcaaatccaaggccaactcgcgctgaagtaagtgatgtagctaatgcaattcttgatggtacagatgctgtaatgctttcaaatgaaacagctgtgggtgattatccagtagaagctgttgagaccatggcgacaattgctagaagaattgaacgtgattatccactaaaagcaattgagagtcaccttcctagtactattccaaatgcaataagcgccgcagtcagcaacattgctagacaacttgatgctggggcaataatccctttaaccaaatccggttcaacagcccgtaatgtgagtaaattcagacctcctactcctattcttgctaccactacagagcgatgtgtcgcgagaagattgcaattagtatggggagtgactcctttattagtcaagaatgacgataggactgcaaaaacattcagtattgcaatgcaaatagcacaagaactagggattcttaagcaaggagacctggtagttcagactgcagggacactaacaggtataagtggttcgactgatctaataaaggttgggttagtaagaaaagtggtaactcgaggaatatcagtaggggagataggtgtaactggcaaagcaagaaatataaagactaatcttgatttatcattgatttctccaggtgaaattttatttgtaccaaaaaatatcttaatggatttacctttcaccaaaataattactggaatagttacggatgaaaatatagatgaatgctataaagtattcaaaaaaaataatattaagatatccactatttgtaatttatctgctattgacaatcttgtatcgaacggggatttaataacgttacaactcaatgaaggggttgtttatatggggcagatagaagacgatgaggatgcactagataaatataagtatgtctag

SEQ ID NO: 7491 - protein, 596 aa, Prochlorococcus marinus subsp
MSNIDLKRRTKIVATIGPATQSEEIITDLIKAGVTTFRLNFSHGDHKDHQERIQTIRKVSEKLDLDIGILQDLQGPKIRLGRFKDGPVKVKKGDKFSLTSNEVECTKSIANVTYNKLAQEVTSGKRILLDDGKIEMIVEKVDIGNNLLECKVTVGGVLSNNKGVNFPDVQLSVKALTDKDIEDLEFGLTAGVDWIALSFVRNPSDINEIKNLINKNGHSIPVVAKIEKFEAIDQIDSILPLCDGVMVARGDLGVEMPAEEVPLLQKELIRKANTLGIPIITATQMLDSMASNPRPTRAEVSDVANAILDGTDAVMLSNETAVGDYPVEAVETMATIARRIERDYPLKAIESHLPSTIPNAISAAVSNIARQLDAGAIIPLTKSGSTARNVSKFRPPTPILATTTERCVARRLQLVWGVTPLLVKNDDRTAKTFSIAMQIAQELGILKQGDLVVQTAGTLTGISGSTDLIKVGLVRKVVTRGISVGEIGVTGKARNIKTNLDLSLISPGEILFVPKNILMDLPFTKIITGIVTDENIDECYKVFKKNNIKISTICNLSAIDNLVSNGDLITLQLNEGVVYMGQIEDDEDALDKYKYV

SEQ ID NO: 7492 - DNA, 1818 bp, Prochlorococcus marinus
  CDS (1)..(1818)
atggtagtttccgcgatgtttcaggtcccgttgatggcccagattgatctgacacgacggaccaaaattgttgccaccataggtccggcaaccgagagcgccgaacgaatccgagaactcgttgaggtaggtgctaccaccttccggctgaatttctcacacggcgaccatgacgagcacgccaagcgcatctccaccatccgtcaggtttctgatgaattgggaatgcacatcggcattcttcaagacttgcaaggccccaaaattcgcctgggtcgttttgataaggggcctatcactctggccaatggcgattccttcgcactgacctccaaacaagttcaatgcaatcagtcagtggcaaccgtcacttacgacaagcttgcagacgaagtcacgaccggcagccgaatcttgcttgatgacggtcgagtggagatgaaagtcttaaaaatcgatcaaagcgaacaaaccttgcactgcatcgtcacggtgggaggggtgctctcaaataacaagggagtgaatttccctgatgtacagctttcggttcgcgcccttacagagaaagatcgccaagatctcgcctttggcctccagcaaggggtggactgggtcgcactgagctttgtgcgaaacccttcggacatgaaagagatccgcaaactcatccgcgatcatgggcacagcaccccagtgatcgcgaagatcgagaaatttgaggcgattgatcaaatcgattcaatccttcctctctgtgatggagtcatggttgcaaggggggacttaggcgttgagatgccagccgaagaagtgcctctactgcaaaaggatttgattcgcaaggccaacagccttggaattccaatcatcacagccacccagatgctcgactcgatggcctcaagcccgaggcccaccagagcagaagtcagtgatgtagcaaatgcgatccttgatggtactgatgcagtgatgctctcgaacgaaaccgctgtaggagactatccagtggaggcggttcaaacgatggccaccattgccagacggattgaacgggactatccacagcgtccaatcgaaacttatctagccagcaccatttccaacgcgattagttcagccgtaagcagcatcgccagtcatctcaacgcggcagcaatcgtgccactaactgaaagtggtgcaactgctcacaacgtcagtaaattccgcccagcagcgccaattttggccgtaaccaacaaattggctgtagcaagaaaacttcaattggcatggggtgttaccccactgcttgtcccaacccaaaaaagtaccactgcaaccttcagtgatgcaattgctgttgcccaggaattgggtcttctcaaagaaggagatctaacaattcaaactgcaggaacccttgctggcgtgagcgggtccacagatcttgtcaaagtaggaattgtcagtgcagtacttggccaagggatcggtattggcaatggaaccgttagcggcaaggtcagatttgctttctccccaaacgactcaacaaaaattgaaccaggcgagattctggtcattcatgaaacaagcgatgactatctcgatgcaatcagaaagtctgcaggagtgattacagaacaagaaggagaggaataccacgcagaaatgatctcaaaacgactagggattccgttcatcattgggatagcacatgccacgagaaacctgcttgaaggagaggtggtaacaatgcagctcagtaatggcaaagttcatcgcggcacaggcggcaagctgccaatgaagctcgactcaatggactga

SEQ ID NO: 7493 - protein, 605 aa, Prochlorococcus marinus
MVVSAMFQVPLMAQIDLTRRTKIVATIGPATESAERIRELVEVGATTFRLNFSHGDHDEHAKRISTIRQVSDELGMHIGILQDLQGPKIRLGRFDKGPITLANGDSFALTSKQVQCNQSVATVTYDKLADEVTTGSRILLDDGRVEMKVLKIDQSEQTLHCIVTVGGVLSNNKGVNFPDVQLSVRALTEKDRQDLAFGLQQGVDWVALSFVRNPSDMKEIRKLIRDHGHSTPVIAKIEKFEAIDQIDSILPLCDGVMVARGDLGVEMPAEEVPLLQKDLIRKANSLGIPIITATQMLDSMASSPRPTRAEVSDVANAILDGTDAVMLSNETAVGDYPVEAVQTMATIARRIERDYPQRPIETYLASTISNAISSAVSSIASHLNAAAIVPLTESGATAHNVSKFRPAAPILAVTNKLAVARKLQLAWGVTPLLVPTQKSTTATFSDAIAVAQELGLLKEGDLTIQTAGTLAGVSGSTDLVKVGIVSAVLGQGIGIGNGTVSGKVRFAFSPNDSTKIEPGEILVIHETSDDYLDAIRKSAGVITEQEGEEYHAEMISKRLGIPFIIGIAHATRNLLEGEVVTMQLSNGKVHRGTGGKLPMKLDSMD

SEQ ID NO: 7494 - DNA, 1785 bp, Prochlorococcus marinus
  CDS (1)..(1785)
atgacaacgatagatctaaaacgtaggacaaagatcgttgcgacaataggccctgcaacagaaagtccagagaaaatcacagagcttattaaagcaggtgctacaacctttagactgaatttctcgcatggagatcatgaagaacatgcaaaacggataaaaaccatcagatctgttgcatcagatttaggagtaaacataggcattcttcaggatttacaaggtcctaaaatcagattaggaagatttaaagagggtccagtcaacctaaaaacaggagatgtatttgccctaacttcagaaaacaaagactgcaatcaggaaatagctaatgtcacctatgaaaaccttgtcaatgaggtggaaaaaggaaaaagaatattattagatgatggaagagtcgaaatgattgtagagaatgtagacaagaaaaacaaatcacttatttgcaaagtcacagttggtggaattctttcaaacaacaaaggggttaatttccctgacgtacaactatcaattaatgctttaactgaaaaagataaaatagacctttcatttggtctaaaacaaggagttgactgggtagctctaagttttgttaggaatccagcggatattcaagaaatcaaggaattaatcagacggcatggttataccactccaatagttgcaaaaatagagaaatttgaagcaatagaccaaatagattcaatactcagcctttgtgatggggtgatggttgcaagaggcgatttgggtgttgaaatggatgcagaagaagtacctttgctgcagaaagaattaattaaaaaggccaatagccttgggataccaattattacagctacccagatgttggattcgatggcctcgagtcctagaccaactagggcagaagttagcgatgtagctaatgcaatacttgatggtacagatgcagtaatgctttctaacgaaacagcagtgggagattatccaatagaagctgtcgaaaccatggcaaaaatagcaagaagaatcgagagggattacccacaaagagctttagaaagccaccttccaagtacaattcctaatgcaattagtgccgcagtaagtactattgcaagacaattaaacgcagcagcaatacttcccctaactaaaagtggtgcaactgctcataatgtgagtaagtttcgtcctgctaccccaattcttgccataacaagtgaaattagcgtcgcaagaagacttcaattggtatggggtgtatctcccttgttgatagatgctcaaaaaagcacaagcaaaacctttggaatagcaatggagcaggcaatggacatgaaattattaaagcccggagatcaagtagtagaaacagcaggaaccctaacaggcataagtggttcaacagatttaattaaagtaggaattgtcagcaagatagtagcgagcggaaaaacaaaaccaatcgttaaagaaggaacaataagtggcaaacttagagttataaataaagcaaccgatctgtcagatttaaaatcaggcgaaatactagtacttgcagaaaatgtacaatataatttggacactaaaactcatatatcagcaatgatatttgaaggcgaatattcattaatcaatacaaataatcaaattgaagataataatataattcctgctatatataatgtagaaggagcatgtactaaatttaaaaatggcgagattgtcacactagatcttaaagatggaaatataataaagggtcttgctcaggacctgaaaacatataattaa

SEQ ID NO: 7495 - protein, 594 aa, Prochlorococcus marinus
MTTIDLKRRTKIVATIGPATESPEKITELIKAGATTFRLNFSHGDHEEHAKRIKTIRSVASDLGVNIGILQDLQGPKIRLGRFKEGPVNLKTGDVFALTSENKDCNQEIANVTYENLVNEVEKGKRILLDDGRVEMIVENVDKKNKSLICKVTVGGILSNNKGVNFPDVQLSINALTEKDKIDLSFGLKQGVDWVALSFVRNPADIQEIKELIRRHGYTTPIVAKIEKFEAIDQIDSILSLCDGVMVARGDLGVEMDAEEVPLLQKELIKKANSLGIPIITATQMLDSMASSPRPTRAEVSDVANAILDGTDAVMLSNETAVGDYPIEAVETMAKIARRIERDYPQRALESHLPSTIPNAISAAVSTIARQLNAAAILPLTKSGATAHNVSKFRPATPILAITSEISVARRLQLVWGVSPLLIDAQKSTSKTFGIAMEQAMDMKLLKPGDQVVETAGTLTGISGSTDLIKVGIVSKIVASGKTKPIVKEGTISGKLRVINKATDLSDLKSGEILVLAENVQYNLDTKTHISAMIFEGEYSLINTNNQIEDNNIIPAIYNVEGACTKFKNGEIVTLDLKDGNIIKGLAQDLKTYN

SEQ ID NO: 7496 - DNA, 1440 bp, Haemophilus ducreyi
  CDS (1)..(1440)
atgtctagaaaacttagaagaaccaaaattgtttgtacaatggggcctgcaactgatcgtagcaataatttggaaagaattatcgctgcaggagcaaacatggttcgtatgaacttctcacacggcgtgcctgaagaccatattgaacgagcaaataaagttcgtgaaatagctgcacgcttgggtaaacatgttgctattttaggtgacttacaaggtccaaaaattcgtgtatcgacgttcaaagaaggaaaaattttcttaaacataggcgataaatttaccttagatgctgatttacctcgtggtgaaggagatcaacaagtggtcggtttagattataaaaacttacccaacgatgtcgtacccggtgatatccttttattagatgatggtaatgtacaattaaaagttatttctgtagagggtgctaaagtacatactgaagtcacgcttggtggccctttatcaaataataaaggcattaataagttaggcggtggtttatctgctcctgcactaacggaaaaagataaagaagatattaaattagctgcgcgtatcggtgtagattatttagcggtttcatttccacaatctagtcaagacttacactatgcacgtcaattagcagaagaagcgggcttagatgccaaaattgtcgccaaagtagaacgtgctgaaactgtagcaactgaagaagcaatggacgatatcattttaggtgctgatgtggtgatggttgcacgtggtgacttaggtgttgagattggtgatgctgcattagttggcgtacaaaaacgattaattcgtcgtgcaagaaagttaaaccgcgtagtgatcaccgcaactcaaatgatggaatcaatgatcaagaaaccaatgccaacacgtgctgaagtaatggatgtggctaatgccgtgttagatggcactgatgccgtaatgttgtcaggcgaaactgcaagcggtgattaccctgtagaaactgttaaatcaatggcagaagtctgtttaggtgcagaaactatgccaagtattaatatttctcgccaccgcatgcaaggcaaattcgccgccattgatgaagccgttgcaatgtctgcgatgtacacggctaaccatctagaaagcgtttctgcaatcattgcattgactcactccggtgaaacggcaaaattaatgagccgtattagttctggcttaccaatttatgcgctatcacgtaatcaacaagcattaaatcgtaccgcactttatcgtggtgtaacgcccgtatactataacgaagaaagccgtacaatcgaaggagctaaaaaaggtattgcattgctcaaagaaaaaggctatttgatgaccggtgatttagtcttattaacacaaggtagcgaatcaaaagatggcggtactaatacttgtcgaattttaaaagtggaataa

SEQ ID NO: 7497 - protein, 479 aa, Haemophilus ducreyi
MSRKLRRTKIVCTMGPATDRSNNLERIIAAGANMVRMNFSHGVPEDHIERANKVREIAARLGKHVAILGDLQGPKIRVSTFKEGKIFLNIGDKFTLDADLPRGEGDQQVVGLDYKNLPNDVVPGDILLLDDGNVQLKVISVEGAKVHTEVTLGGPLSNNKGINKLGGGLSAPALTEKDKEDIKLAARIGVDYLAVSFPQSSQDLHYARQLAEEAGLDAKIVAKVERAETVATEEAMDDIILGADVVMVARGDLGVEIGDAALVGVQKRLIRRARKLNRVVITATQMMESMIKKPMPTRAEVMDVANAVLDGTDAVMLSGETASGDYPVETVKSMAEVCLGAETMPSINISRHRMQGKFAAIDEAVAMSAMYTANHLESVSAIIALTHSGETAKLMSRISSGLPIYALSRNQQALNRTALYRGVTPVYYNEESRTIEGAKKGIALLKEKGYLMTGDLVLLTQGSESKDGGTNTCRILKVE

SEQ ID NO: 7498 - DNA, 1467 bp, Candidatus Blochmannia floridanus
  CDS (1)..(1467)
atgccgcaattattaagaagaactaaaattatcgctactctaggacctgctactgatcaaaaaaatactcttgaaaaaatcattatttcaggagttaatatagtaagattaaatttttcacatggaaattcttcagaacattttttcagagcaaataaagttcgaaaacttgctaatcaactacataaatatatagctattttaggcgacctacaaggccccaaaatcagaatttcaacctttcaaactaataacatatatttacagtctggagatgattttttaatagattctacgttaaaaaatagtcataataatcaaaaatatgtaggagtaaactataaagaattaccacaagatgtttctccaggagattatttattattggatgacggaaaaattcaattaaaagttataaaaattcaaaatacccaaattttcactaaagtagtaattggaggattattatctaataataaaggaatcaacaaattaggcggaggattatctgcaaaagtattaacaaataaagataaattagatattatcactgcagccaaaatcggagtagattatctagcgatatcctttcctcgcaacagtatggatttaaactttgcccgaaaactaattacagatgctggaagcaatgcaaaaattatatctaaaatagaaagagctgaagtagttaaatccgatgacacaatagatgatattattaaagcatctgatgcagttatgatagctagaggagatttaggaatagaaattggagaaccacaattagtaggaatacaaaaaaaaattatacaaagagcacatctcctaaatagagctgttattacagcaacacaaatgatggaatccatgataattaattcggttcctactcgagcagaaatcatggatgtcgccaatgcagtattggatggaacagatgcggttatgttatccgcagaaactgcaaccggacagtatccatctgaaaccgtttcttctatggctgatgtctgtttaggagcagaaaaaactctaaataatactaataatcaattaatatttatcaatcaactacaaaaaaaaattaacaataccaaagaagctattgcagcatcaacaatgcatatagctaattgtttaagtaaaatacgtgcaattatttctataactgattgggaacatattgtattattattatctcgatttaactctcaattacctatttttgctttatccaaacacattcatattcttaacattgttactttatataaaggagtaatacctatttattttaatcgaactggtaataatataatagatgcaagacaggcgagtaacttattgcgagatcaaggttttctaacacctggagaactagtaataataatacaagataatattgtgaatcaatctaatattaataacgtaactcatattcttacaatagaagaacaatgtaaataa

SEQ ID NO: 7499 - protein, 488 aa, Candidatus Blochmannia floridanus
MPQLLRRTKIIATLGPATDQKNTLEKIIISGVNIVRLNFSHGNSSEHFFRANKVRKLANQLHKYIAILGDLQGPKIRISTFQTNNIYLQSGDDFLIDSTLKNSHNNQKYVGVNYKELPQDVSPGDYLLLDDGKIQLKVIKIQNTQIFTKVVIGGLLSNNKGINKLGGGLSAKVLTNKDKLDIITAAKIGVDYLAISFPRNSMDLNFARKLITDAGSNAKIISKIERAEVVKSDDTIDDIIKASDAVMIARGDLGIEIGEPQLVGIQKKIIQRAHLLNRAVITATQMMESMIINSVPTRAEIMDVANAVLDGTDAVMLSAETATGQYPSETVSSMADVCLGAEKTLNNTNNQLIFINQLQKKINNTKEAIAASTMHIANCLSKIRAIISITDWEHIVLLLSRFNSQLPIFALSKHIHILNIVTLYKGVIPIYFNRTGNNIIDARQASNLLRDQGFLTPGELVIIIQDNIVNQSNINNVTHILTIEEQCK

SEQ ID NO: 7500 - DNA, 1443 bp, Bordetella parapertussis
  CDS (1)..(1443)
atgcccgtactgcgccgcaccaaaatcgttgccaccctggggcccgccacgtccacgcccgagcggctcgacgggctgatacgcgccggcatggacgtggcccgcctgaatttctcgcacggcagcgcgcaggaccatcgcgagcgcgtgcggctggtgcgcgagctggcggccgagcaagggcgcttcgtggccctcatgggcgacttgcagggcccgaagatccggatcgcccgcttcaccgaccagcaggtcaccctgcaggccggccagcctttcacgctgtcgcgttcacattccaaggaggccggcgacgcaaccatcgtgggtatcgattatcccgagctggtgcaggactgccgccctggcgacgagctgctgctcgacgatggccgcgtggtgctggtggtcgacagcgtgggggccgaggaggtccacaccaccgtgacggtgggcgggccgctgtcgaacaacaagggcatcaaccggcgcggcggcggcctttcggcgcccagcctcaccgacaaggaccgcaccgacatcaagctggccgccgagatggagctggactacgtggccgtatcgtttccgcgctatggggccgacatcgatgaagcccgcgcgctgctgcgcgcggccggcagccaggcctggatcatcgccaagatcgagcgcgccgaggcggtggccgacgacgacgcgctggatgcgctgatccgcgccagcgacggcgtgatggtggcgcgcggcgacctgggcgtggaagtgggcgacgccgaactggtcggcatccagaagcgcatcatccagcacgcgcgtacgctgaacaaggtggtcatcacggccacccagatgatggagtccatggtggccagccccatgcccacgcgcgccgaggtgtcggacgtggccaacgcggtgctcgactacacggacgccgtcatgctgtcggccgaaagcgcctcgggccagtatccgatcgaggcggtggcggcgatggcacgggtctgtctgggggcggagaagcaccccaccaccacgcattcgcaccatcgcctgggcgagacgttcacgcgctgcgacgagaccatcgcgctggcggccatgtacgcggccaaccatttcccgggcgtgaaggccatcatcgcgctgaccgaaagcgggcacacgccgctgatcatgtcgcgcatccgttcgggcgtgccgatctactgctacagcccgcatggccccacgcagcggcgcgcggcgctgtttcgcggcgtctacacggtgcccttcgcgccggccgaatacgacccggccgacttgagcaacgcggccatcgatgagctgaagaagcgtggccgtgtcgcggcgggcgactgggtcatcctgaccaagggcgatttctaccgcgacagcggcggcaccaacggcctgaagatcctgaaggtggaatag

SEQ ID NO: 7501 - protein, 480 aa, Bordetella parapertussis
MPVLRRTKIVATLGPATSTPERLDGLIRAGMDVARLNFSHGSAQDHRERVRLVRELAAEQGRFVALMGDLQGPKIRIARFTDQQVTLQAGQPFTLSRSHSKEAGDATIVGIDYPELVQDCRPGDELLLDDGRVVLVVDSVGAEEVHTTVTVGGPLSNNKGINRRGGGLSAPSLTDKDRTDIKLAAEMELDYVAVSFPRYGADIDEARALLRAAGSQAWIIAKIERAEAVADDDALDALIRASDGVMVARGDLGVEVGDAELVGIQKRIIQHARTLNKVVITATQMMESMVASPMPTRAEVSDVANAVLDYTDAVMLSAESASGQYPIEAVAAMARVCLGAEKHPTTTHSHHRLGETFTRCDETIALAAMYAANHFPGVKAIIALTESGHTPLIMSRIRSGVPIYCYSPHGPTQRRAALFRGVYTVPFAPAEYDPADLSNAAIDELKKRGRVAAGDWVILTKGDFYRDSGGTNGLKILKVE

SEQ ID NO: 7502 - DNA, 2002 bp, Oryza sativa
  CDS (113)..(1648)
gagccagcacaactcacacaactctctctctctctctctctctctctctctcgtcgtctgcaagcttccgcctcccggatcgcggcgaccaccggaggaggagggagcagccatggcgaacatcgacatggggaagatcctggcggggctggagaacgacgacgcgcgggtgcccaagaccaagctggtctgcacgctcggcccggcctcccgctccgtccccatgctcgagaagctgctccgcgccgggatgaacgtcgcgcgcttcaacttctcccacggcacccacgagtaccaccaggagaccctcgacaacctccgccaggccatgcacaacaccggcgtcctctgcgccgtcatgctcgataccaagggtcctgagattcgtactggatttttgaaggatggcaagccaatcaagctaacaaagggtcaagaactcactgttaccaccgattatgagatcaagggtgatgagaacatgattaccatgagttacaagaaactgccagttgatgtgaagcctggaaatgtcattctctgcgccgatggtacaatctctttgactgttttgtcctgtgatccaaaggctggaactgtgaggtgtaggtgtgagaacacagcaatgcttggcgagagaaagaattgcaatctgccaggaattgttgtggaccttcctacactgactgagaaggataaagaagacattttgggatggggtgtgccaaatgacatagacatgattgctctgtcgtttgtccgtaaaggatcagatttggttaccgtcagacaacttcttggacagcatgcaaagcgcatcaagctgatgtcaaaggttgaaaaccaagagggtgttgtaaacttcgatgagatcttgagggaaacggatgcatttatggttgctagaggtgatcttggaatggagattccagttgagaagatattccttgcacagaagatgatgatttacaagtgcaaccttgctggaaagcctgttgtgactgctactcagatgcttgagtcgatgatcaaatcaccacgtccaactcgtgctgaggcaactgacgttgcaaatgcagttcttgatggaactgactgcgtcatgcttagtggagagagtgctgctggagcataccctgaagtagctgtgaagatcatggcacgtatatgtgttgaggcagagtcttcccttgacaacgaagctgtcttcaaggagatgatcaggtctgcgccccttccgatgagcccattggagtctctcgcatcctctgctgtacgcacagccaacaaggccaaggcagccctgattgttgtcttgactcgtggtggtaccacggcaaagctggttgccaagtatcgtcccagggttccaatcctctctgtggttgtccccgtgttgacaaccgattcattcgactggacaatcagctcggagggcccagcaaggcacagcctaatctacagaggtcttgttcctctcctggctgagggttctgccaaagccaccgattcggagtcgacagaggtcatccttgatgctgctctcaagtcagctgtacagaagcagttgtgcaagcctggtgatgctgttgttgctctgcaccgtattggcgtcgcatccgtgatcaagatctgcatcgtgaagtaatcgctacacggtgtcttcttagcgccattttgctgggttaagtggcaaaacaaaaactgctatgcttgtttttactcccatagtccatctttgggagacaatttaattaccgtatcagcccctgcagttcgcagggtgcctttcgttacatagatttgctggtaaaatgaggagagatagaactccattatgtagagctctatttatcgtcgatgccatgtagtatggcaggtggtttctattccatgcctgcacaattttctggtagctactgtgttgtttgattactgttttttcaggtgatgtcgatggagttgataataatattggcatcattgtcgttgtatacgagtt

SEQ ID NO: 7503 - protein, 511 aa, Oryza sativa
MANIDMGKILAGLENDDARVPKTKLVCTLGPASRSVPMLEKLLRAGMNVARFNFSHGTHEYHQETLDNLRQAMHNTGVLCAVMLDTKGPEIRTGFLKDGKPIKLTKGQELTVTTDYEIKGDENMITMSYKKLPVDVKPGNVILCADGTISLTVLSCDPKAGTVRCRCENTAMLGERKNCNLPGIVVDLPTLTEKDKEDILGWGVPNDIDMIALSFVRKGSDLVTVRQLLGQHAKRIKLMSKVENQEGVVNFDEILRETDAFMVARGDLGMEIPVEKIFLAQKMMIYKCNLAGKPVVTATQMLESMIKSPRPTRAEATDVANAVLDGTDCVMLSGESAAGAYPEVAVKIMARICVEAESSLDNEAVFKEMIRSAPLPMSPLESLASSAVRTANKAKAALIVVLTRGGTTAKLVAKYRPRVPILSVVVPVLTTDSFDWTISSEGPARHSLIYRGLVPLLAEGSAKATDSESTEVILDAALKSAVQKQLCKPGDAVVALHRIGVASVIKICIVK

SEQ ID NO: 7504 - DNA, 1071 bp, Bacillus cereus
  CDS (1)..(1071)
atggtgacaaaaatgacaatcgatcgaatttgtacaattggacccgcaagtaataataaagaaacgttagcacagttaataaagaatggtatgaaaattgttcgactgaatttatcgcatggcacgcatgaaagtcataaagacatcattcgtttagtgaaatcattagatgactctattaaatttttgggtgatgtacaaggtcctaaaataagattaggtgaagtgaagggagagcaaattacacttcaggcaggagattcttttattttacatacacaaccagttacagggagtaatacagaagcaagcgttgattatgaaggaattgcgaatgatgtgaaagtaggcagtagaattttaattaatgatggagaagttgaattaattgttgaaaagataagtacggacaaaatagaaacgaaggtaaaaacaggtggcaatatctcatctcataaaggagttaatttaccagatgcggctgttcgtttaccagctattacagagaaagataaaaaagatattcagtttcttttagaagagaatgttgattttatcgcgtgttctttcgtaagaaaacctagtcatataaaagaaatacgagattttatacaacagtataaagaaacgtcacctaatgtaattgcaaaaatagaaacgatggaagcaatcgagaattttcaagatatatgtaaagaagcagatggaattatgattgcaaggggcgatttaggagtagagttaccgtatcaatgcattccgcttttacagaaaatgatgattcaggaatgtaatcgaacgaatacatatgtcattacagcaacacaaatgcttcaatctatggtagatcattctattccaacaagggcagaggtgactgatgtgtttcaagctgtactggacgggacgaatgcagttatgctttcagctgaaagtgcatcaggagagcatccaatcgaaagtgtgagaacattacgtctcgtttcagaatttgcggaacatgttaaaaaagatggaccttttgcgatgaaagatgtactgcaattactgcgtgagtctctggatgagtaa

SEQ ID NO: 7505 - protein, 356 aa, Bacillus cereus
MVTKMTIDRICTIGPASNNKETLAQLIKNGMKIVRLNLSHGTHESHKDIIRLVKSLDDSIKFLGDVQGPKIRLGEVKGEQITLQAGDSFILHTQPVTGSNTEASVDYEGIANDVKVGSRILINDGEVELIVEKISTDKIETKVKTGGNISSHKGVNLPDAAVRLPAITEKDKKDIQFLLEENVDFIACSFVRKPSHIKEIRDFIQQYKETSPNVIAKIETMEAIENFQDICKEADGIMIARGDLGVELPYQCIPLLQKMMIQECNRTNTYVITATQMLQSMVDHSIPTRAEVTDVFQAVLDGTNAVMLSAESASGEHPIESVRTLRLVSEFAEHVKKDGPFAMKDVLQLLRESLDE

SEQ ID NO: 7506 - DNA, 1059 bp, Bacillus anthracis
  CDS (1)..(1059)
atgacaatcgatcgagtttgtacaattgggccagcaagtaataataaagaaacgttagcgaagttaataaacaatggtatgaaaattgttcgtctaaatttatcacatggtacgcatgaaagtcataaagatattattcgtttagtgaaatcgttagatgattctattaaaattttaggcgatgtacaaggtcctaaaataaggttaggtgaaataaaaggagaacaaattacacttcaggcgggagattcttttatgttacgtacgcaaccagttacagggagtagtacggaagcaagtgttgattatgaaggaatcgcgaatgatgtgaaagttggaagtagaattttaatgaatgatggcgaagttgagttaattgttgagaaggtaagtacggataaaatagaaacaaaggtcaaaacaggtggtaatatctcatcacataaaggagtgaacttaccaggggcaatcgttagtttaccagctattacagagaaagataaaaaagatattcagtttcttttagaagaggatgttgattttattgcgtgttctttcgtaagaaaacctagtcatataaaagaaatacgagattttatacaacagtataaagaaacgtcacctaatttaattgcaaaaatagaaacgatggaagcaatcgagaattttcaagatatatgtaaagaagcagacggaattatgattgcaaggggcgatttaggagttgagttgccgtatcaatttattccgctcttgcagaaaatgatgattcaggaatgtaatcgaacgaatacatatgttattacagcgacacaaatgcttcaatctatggtagatcattcgattccaacaagggctgaggtaactgatgtgtttcaagctgtactggatggaacgaatgctgttatgctttctgctgaaagtgcttcaggagagcatccggttgaaagtgtgagtacactacgtctcgtttctgaatttgctgagcatgtaaaaaaagacggtccttttgtgatgaaagatgtactggaattgctgcataaatctttggatgagtga

SEQ ID NO: 7507 - protein, 352 aa, Bacillus anthracis
MTIDRVCTIGPASNNKETLAKLINNGMKIVRLNLSHGTHESHKDIIRLVKSLDDSIKILGDVQGPKIRLGEIKGEQITLQAGDSFMLRTQPVTGSSTEASVDYEGIANDVKVGSRILMNDGEVELIVEKVSTDKIETKVKTGGNISSHKGVNLPGAIVSLPAITEKDKKDIQFLLEEDVDFIACSFVRKPSHIKEIRDFIQQYKETSPNLIAKIETMEAIENFQDICKEADGIMIARGDLGVELPYQFIPLLQKMMIQECNRTNTYVITATQMLQSMVDHSIPTRAEVTDVFQAVLDGTNAVMLSAESASGEHPVESVSTLRLVSEFAEHVKKDGPFVMKDVLELLHKSLDE

SEQ ID NO: 7508 - DNA, 1446 bp, Chlamydophila caviae
  CDS (1)..(1446)
atgatcgcaagaacgaaaatcatttgtactataggtccagcaacaaacactccagaaatgcttgagaagcttttagatgcgggtatgaatgttgctaggttgaattttagtcatggtactcatgaaagtcatggtgagacaattcgtcttcttaaggaattgcgagaaaagaaaggggctcctttagcgattatgttggataccaagggtccagaaattcgtttagggaatattcccacaccaattcaggtatctcgaggtcagaaaattaccttagtaggaaaagaggtagagggatctgccgaaggtggcgttaccttacatcctcaatgtgttttcccttatgtgcgtgagggtgttgatgtcttgatagacgatggttatattcaagctgttgtgacctctgttggtgaggatcatctagaattagagtttattaactctggagaattaaagtcgcacaagtctttaagcataagagaaattgatttagctcttccttttatgacggataaggatatcaatgatcttcagtttggcgttgcgcagggcgttgatgttattgctgcttcttttgtccgttatgctgaggatatcgaaagtatgcgcaagtgcttagcagatgctggccgtccggatatgcccattattgctaagatagaaaatcgtttgggagtagagaatttttctcagattgctaaagcttccgatgggattatgattgcccgtggagatttagggattgagctttctgttgttgaggtccctaatttacagaagtttatggcaaagatgtctcgtgaaatgggacgtttttgcattaccgctacgcaaatgttagaatctatgattcgcaatgttttaccgacacgagcagaagtttctgatgttgctaatgctatttatgatggtacctcagcagtaatgttatctggggaaacggcctcgggaagttatcctgtcgcggctgtgaaaattatgcgttctgtgattcaagagacagaaaaaaatcttaattataagtctttcttagaacttagcgatagtgaatgtgctgttaaggtatccccttatcttaagtctataggtttatcaggaattcaaattgctgagaaagctgatgctaaagccattatcgtttacacggaatccggaggatcacccattttcctttctaaataccgtccgcgttttccaattattgctgttacaccaaatctatctgtgtattacaggcttgctttagagtggggagtctatcctatgcttacgcaagagtcagaccgtgcagtatggagacatcaagcttgtatttatggaatcgaaagaggaattttatcaaattatgataagattttagttttgagtcgtggcgctcaaatgaaagatactaataatcttaccttaacaacggtaaatgatatcatcacagcatcagctaaataa

SEQ ID NO: 7509 - protein, 481 aa, Chlamydophila caviae
MIARTKIICTIGPATNTPEMLEKLLDAGMNVARLNFSHGTHESHGETIRLLKELREKKGAPLAIMLDTKGPEIRLGNIPTPIQVSRGQKITLVGKEVEGSAEGGVTLHPQCVFPYVREGVDVLIDDGYIQAVVTSVGEDHLELEFINSGELKSHKSLSIREIDLALPFMTDKDINDLQFGVAQGVDVIAASFVRYAEDIESMRKCLADAGRPDMPIIAKIENRLGVENFSQIAKASDGIMIARGDLGIELSVVEVPNLQKFMAKMSREMGRFCITATQMLESMIRNVLPTRAEVSDVANAIYDGTSAVMLSGETASGSYPVAAVKIMRSVIQETEKNLNYKSFLELSDSECAVKVSPYLKSIGLSGIQIAEKADAKAIIVYTESGGSPIFLSKYRPRFPIIAVTPNLSVYYRLALEWGVYPMLTQESDRAVWRHQACIYGIERGILSNYDKILVLSRGAQMKDTNNLTLTTVNDIITASAK

SEQ ID NO: 7510 - DNA, 1437 bp, Streptomyces avermitilis
  CDS (1)..(1437)
atgcgccgagcaaagatcgtctgtactctgggccccgccaccgactcgtacgaccagatcaaggcactggtcgaggccggaatggacgtagcccgcttcaacctcagccacggcacctacgccgagcacgaggagcgttaccagcacgtccgcaaggcctccgacgagaccgggcgcagcgtcggagtcctcggcgaccttcaaggtccgaagatccgcctcggccgcttcaacgaaggacccgtactccttgaacgcggcgacaccttcaccatcaccgtcgaggaaggcgtcgaaggcgaccgccagacctgcggcaccacctacgccggcctcgccgccgacgtcactcccggtgagcgcatcctcgtcgacgacggcaaggtctgcctcgaagtcacctccgtcgacggcccccgcgtccacaccaccgtcgtcgaaggcggcatggtctccgaccacaagggcctgaacctgcccggcgtggccgtctcggtccccgccctctccgacaaggacgaggccgacctccgctgggccctccgtcagggcttcgacgtcatcgcgctgtccttcgtacgcagcggcaaggacatcaaggacgtccaccggatcatggacgaagaaggccgccggctccccgtcatcgccaaggtggaaaagccccaggccgtcgagaacatcgacgacatcgtcgccgccttcgacggaatcatggtcgcccgcggagacctcggcgtggaaatgccgctcgaacaggtcccgatcgtccagaagcgcgccatcaaactcgccaggcgcaacgcgaagccggtcatcgtcgcgacgcagatgctggactccatgatcgacaactcccgcccgacccgcgcggaggcctcggacgtcgccaacgccgtcatcgacggcaccgacgcggtgatgctgtccggcgagacgagcgtgggcaagtaccccgtcgaaacggtccgcaccatgtcccgcatcgtggaagcggcggaagaggacatcctggccacgggcctgccgccgctgaccgaacgcaacaagccccgcacccagggcggcgcggtggcccgcgcggcggccgagatgggcgacttcctcggcgccaagttcctggtggcgttcacgcagtccggagacacggtccgccgcctctcgcgctaccgttccccgatcccgctcctggccttcaccccgatgccggcgacgcgctcccagctcaacctgacatggggcgtggagacgttcctgggcccgcacgtggattcgacggacgcgatggtggaccaggtcgacgagctgctgctcaagtacggccgctgcgagaagggcgacgtggtggtcatcacggcgggctcaccccccggcgtctcgggctcgacgaacctggtccgagtccaccacatcggcgaggacgacagccccaagtag

SEQ ID NO: 7511 - protein, 478 aa, Streptomyces avermitilis
MRRAKIVCTLGPATDSYDQIKALVEAGMDVARFNLSHGTYAEHEERYQHVRKASDETGRSVGVLGDLQGPKIRLGRFNEGPVLLERGDTFTITVEEGVEGDRQTCGTTYAGLAADVTPGERILVDDGKVCLEVTSVDGPRVHTTVVEGGMVSDHKGLNLPGVAVSVPALSDKDEADLRWALRQGFDVIALSFVRSGKDIKDVHRIMDEEGRRLPVIAKVEKPQAVENIDDIVAAFDGIMVARGDLGVEMPLEQVPIVQKRAIKLARRNAKPVIVATQMLDSMIDNSRPTRAEASDVANAVIDGTDAVMLSGETSVGKYPVETVRTMSRIVEAAEEDILATGLPPLTERNKPRTQGGAVARAAAEMGDFLGAKFLVAFTQSGDTVRRLSRYRSPIPLLAFTPMPATRSQLNLTWGVETFLGPHVDSTDAMVDQVDELLLKYGRCEKGDVVVITAGSPPGVSGSTNLVRVHHIGEDDSPK

SEQ ID NO: 7512 - DNA, 1431 bp, Streptomyces avermitilis
  CDS (1)..(1431)
atgcgccgttcgaaaatcgtctgtactctcggccccgcggtcgactcccacgagcagctcgtcacgctgatcgaggccggcatgaacgtggcccgcttcaacttcagccacggcacgcacgccgagcaccagggccggtacgaccgggtccgggccgcggccgccgagaccggcaaggccatcggtgtcctcgcggacctccagggcccgaagatccggctggagaccttcgccgagggtcccgtcgagctggtgcgcggtgacgagttcatcatcaccaccgaggacgtgccgggcgacaagcacatctgcggcacgacgtacaagggcctgcccggggacgtctccaagggcgaccagatcctcatcaacgacggcaacgtcgagctgcgggtcgtcgaggtcgacgggccgcgggtcaagacggtcgtcatcgagggcggcgtgatctccgaccacaagggcatcaacctgcccggcgcggccgtgaacgtgcccgcgctgtccgacaaggacatcgaggacctgcgcttcgccctgaagatgggctgcgacctggtcgcgctgtccttcgtgcgcgacgcgagcgacgtgaaggacgtccacaaggtgatggacgaggagggccgccgggtccccgtcatcgccaaggtggagaagccgcaggcggtggagaacatggaggccgtcgtcgcggccttcgacggcgtgatggtggcgcgcggcgacctggccgtcgagtacccgctcgagaaggtcccgatggtgcagaagcgcctcgtggagctgtgccgccgcaacgccaagccggtgatcgtcgcgacccagatgatggagtcgatgatcaccaactcccgcccgacgcgcgccgaggcgtccgacgtggccaacgcgatcctcgacggcgcggacgcggtgatgctgtccgccgagtcgtcggtcggcgcctacccgatcgagacggtcaagacgatgtcgaagatcgtcacggcggcggaggaagagctgctgtcgaagggcctgcagccgctggtccccggcaagaagccccgtacgcagggtggttcggtcgcccgcgcggcctgcgagatcgccgacttcctgggcggcaagggcctggtggccttcaccaagtcgggcgacaccgcccgtcggctctcccgctatcgcgcggcccagccgatcctggccttcaccacggacgagggcacgcgcaaccagctcgcactgagctggggcgtcgagtcccacgtcgtgccgttcgtgaacagcaccgacgagatggtcgacctggtcgactccgagctgcagaacctgaagcggttcaacgacggcgacgtcgtcgtgatgaccgccggctcgccccccggcgtcccgggcacgacgaacatggtgcgagtgcaccacctgggcgagggcaagcgcgcctga

SEQ ID NO: 7513 - protein, 476 aa, Streptomyces avermitilis
MRRSKIVCTLGPAVDSHEQLVTLIEAGMNVARFNFSHGTHAEHQGRYDRVRAAAAETGKAIGVLADLQGPKIRLETFAEGPVELVRGDEFIITTEDVPGDKHICGTTYKGLPGDVSKGDQILINDGNVELRVVEVDGPRVKTVVIEGGVISDHKGINLPGAAVNVPALSDKDIEDLRFALKMGCDLVALSFVRDASDVKDVHKVMDEEGRRVPVIAKVEKPQAVENMEAVVAAFDGVMVARGDLAVEYPLEKVPMVQKRLVELCRRNAKPVIVATQMMESMITNSRPTRAEASDVANAILDGADAVMLSAESSVGAYPIETVKTMSKIVTAAEEELLSKGLQPLVPGKKPRTQGGSVARAACEIADFLGGKGLVAFTKSGDTARRLSRYRAAQPILAFTTDEGTRNQLALSWGVESHVVPFVNSTDEMVDLVDSELQNLKRFNDGDVVVMTAGSPPGVPGTTNMVRVHHLGEGKRA

SEQ ID NO: 7514 - DNA, 1491 bp, Nitrosomonas europaea
  CDS (1)..(1491)
atgatgcgaagaacaaaaattgtagcaacgttaggaccggcttccagtaatgctgaagttctggggcgaatgctcgaagctggtgtcgatgttatccgtatcaatttctcacacggaacaaaagatgagcacatcgcttccgtagaactggttcgttcgctcgcccgctcgcttggccgtacagtcggtgtactggctgatttacaggggccaaaaattcgtatcggtaagtttgaacagggaaaaattcgactcaaaaccggggatgaattcatactcgatgcagaatgccagctgggaaaccaggaacgggtcggactggattatcgggaacttcctaatgatgtcgaagcaggcgccacgctcttattggatgatggacgtatcgttctgacggtggccaaagtcagagaaagtgaaatcttttgtgaagtgttgcagggcgggattctttccaacaataaaggtattaaccggaaaggcggagggttgagcgcacctgcactcactgcgaaagatttactggatatcaagacttccgcagtcattcgagcagattatctcgcagtatccttccctcgctccggtgacgatatcagacgcgcgcgcgcactgatgcaggaagctcaggggcatagtttgctcatggcaaaaatcgagcgctcagaagccattctggcactggatgatattctggaagcgtctgatgccatcatggtggcccgtggagatctggcagtcgaagtaggagatgccgctgttcccgccttgcaaaaacgcatgatacgatctgcacgtgaagcaaataagctggtaattaccgctacgcaaatgatggaatccatgatttccaaccctattccgacacgcgcagaagtatcagatgttgccaatgccgtactggatggtaccgatgcagtcatgctgtccgctgagtcggccgcagggcaatacccggttgaagccgtcgaagccatggccagagtttgtctcgaagcagaaaaggaatatacacccagtttgagagcacgccgttcccccgatacacagtcaatcagtattgaagatgccattgcgcgcgctaccatgtacgcagccggttcactcaatatccaggcaattgcagcattgacacaaagtggtgtaacagcgttgttcatgtcacgcagaagttcgaaagcacccatctttgcactcagcccgcaagaagataccctgggtaaagtcacccttttccgaggcgtttatcccatagaattcggacaaggactgtgtgatcccgaaatcatcctaggcatggctgaagacgagttactcaagcgtggtgcggtacgcgacgaagatctgataatcatgacgatcggtgaaccggttggcaaagctggcgggacgaacaccatgaagatcatcaaagtaggcagttccaagaaagctgcacaagcagtaagagaagtggcgcaacaacccttttctgatccgcagaatctgtaa

SEQ ID NO: 7515 - protein, 496 aa, Nitrosomonas europaea
MMRRTKIVATLGPASSNAEVLGRMLEAGVDVIRINFSHGTKDEHIASVELVRSLARSLGRTVGVLADLQGPKIRIGKFEQGKIRLKTGDEFILDAECQLGNQERVGLDYRELPNDVEAGATLLLDDGRIVLTVAKVRESEIFCEVLQGGILSNNKGINRKGGGLSAPALTAKDLLDIKTSAVIRADYLAVSFPRSGDDIRRARALMQEAQGHSLLMAKIERSEAILALDDILEASDAIMVARGDLAVEVGDAAVPALQKRMIRSAREANKLVITATQMMESMISNPIPTRAEVSDVANAVLDGTDAVMLSAESAAGQYPVEAVEAMARVCLEAEKEYTPSLRARRSPDTQSISIEDAIARATMYAAGSLNIQAIAALTQSGVTALFMSRRSSKAPIFALSPQEDTLGKVTLFRGVYPIEFGQGLCDPEIILGMAEDELLKRGAVRDEDLIIMTIGEPVGKAGGTNTMKIIKVGSSKKAAQAVREVAQQPFSDPQNL

SEQ ID NO: 7516 - DNA, 1758 bp, Enterococcus faecalis
  CDS (1)..(1758)
atgaaaaaaacgaaaatcgtatgtacgattggaccagctagtgaatccgttgatatgctagtaaacttaattaatgcaggtatgaatgtttgccgtttgaacttttcacatggtgactacgaagagcatggtgctcgtattaaaaacattcgtgaagctgtaaaaattacagggaaacgcgtagcgatcttactagatacaaaaggtcctgaaatccgcacaaatgacatggaaaatggcgcaatcacaatgaaaattggtgactcagtacgtatttctatgacagaagttttaggaacaaatgaaaaattctcaatcacttatccagaattaatcaatgatgtaaacgtaggttcacacattcttttagatgatggtttaatcgatttagaagtaactgatatcgaccgtgatgcaaacgaaatcgtaacagttgttaaaaacgaaggcgtcttgaaaaacaaaaaaggcgttaacgtaccaggcgtttctgtaaacttaccagggatcactgaaaaagatgctaacgatatccgtttcggaattggtcaaggaattgactttatcgcagctagcttcgttcgtcgtgcttctgacgttttagaaatcactaaaattttagaagaagaaaacgcaacacacatccaaatcattcctaaaatcgaaaaccaagaaggtatcgataatatcgatgaaatcttaaaagtttctgatggtttaatggttgctcgtggtgacatgggtgttgaaattccaacagaagatgttccagttgtccaaaaagctttaattaaaaaatgtaatgctttaggtaaaccagttatcactgcaacacaaatgttagattcaatgcaacgtaacccacgtccaacacgtgcggaagcaaatgacgtagcaaacgcaatctacgatggaacagatgcagtaatgttatcaggcgaaactgcagcaggggattacccattagaagctgttcaaacaatggctcgtattgcagttcgtacagaagaaacattagttaaccaagattcattcgcattgaaattatatagcaaaacagatatgactgaagcaatcggacaatctgttggccatacagcacgtaacttgggtatccaaacaatcgttgcggcaacagaatcaggccatacagcacgtatgatctctaaataccgtccaaaagcacatatcgttgcaattacgttctcagaacaaaaagcacgtagcttgtcattatcatggggtgtttacgcaacagttgctgacaaaccatcaagcacagatgaaatgtttaatttagcttcaaaagtatcacaagaagaaggttatgcttcagaaggtgatttaatcattatcactgctggtgttccagttggcgaaaaagggacaacaaacttaatgaaaattcaaatgatcggttctaaattagttcaaggtcaaggtgtcggcgaagaagcaattattgcaaaagccgttgtggcagcaactgctgaagaagcagttgctaaagcgactgaaggagctattttagttacaaaaacaacagataaagaatacatgccagcaattgaaaaagcatcagcattagttgttgaagaaggtggtttaacttctcatgcagctgttgtagcgattgcgcaaaatattccagttatcgtaggtgctgcagatgcaacatcattaattaataatgacgaagtgattactgttgatcctcgtcgtggtattgtttaccgcggagcaacaacagctatctaa

SEQ ID NO: 7517 - protein, 585 aa, Enterococcus faecalis
MKKTKIVCTIGPASESVDMLVNLINAGMNVCRLNFSHGDYEEHGARIKNIREAVKITGKRVAILLDTKGPEIRTNDMENGAITMKIGDSVRISMTEVLGTNEKFSITYPELINDVNVGSHILLDDGLIDLEVTDIDRDANEIVTVVKNEGVLKNKKGVNVPGVSVNLPGITEKDANDIRFGIGQGIDFIAASFVRRASDVLEITKILEEENATHIQIIPKIENQEGIDNIDEILKVSDGLMVARGDMGVEIPTEDVPVVQKALIKKCNALGKPVITATQMLDSMQRNPRPTRAEANDVANAIYDGTDAVMLSGETAAGDYPLEAVQTMARIAVRTEETLVNQDSFALKLYSKTDMTEAIGQSVGHTARNLGIQTIVAATESGHTARMISKYRPKAHIVAITFSEQKARSLSLSWGVYATVADKPSSTDEMFNLASKVSQEEGYASEGDLIIITAGVPVGEKGTTNLMKIQMIGSKLVQGQGVGEEAIIAKAVVAATAEEAVAKATEGAILVTKTTDKEYMPAIEKASALVVEEGGLTSHAAVVAIAQNIPVIVGAADATSLINNDEVITVDPRRGIVYRGATTAI

SEQ ID NO: 7518 - DNA, 1434 bp, Coxiella burnetii
  CDS (1)..(1434)
atgttacgcagcaccaaaattattgccactttagggccggcaaccgatgatctttctatacttgaggaaattattcacgagggggttgacattattcgcttgaatttctcgcacggcactcacgagaaacacaaacaacggattgaaatggttcgcaaggcggcgaaaaaacaagaacgggtaatcggaattttagcggatttgcaagggcctaaaattcgcatatccagttttaaaactggcaaaattaatttaaaaaaaggcgagttatttattttggacgccgggctcccgcccgaagaaggtacagagaaaagcgttgggattgattataaaaatttgccgaaggacgtaaaagccgaagatattttattgttggatgatgggcgccttaccttaaaggtgcaaaacgtcaagggagaacaaattatttgtcgcgttgttgaaggcggcgcgttgtcagatcacaaaggcattaatcgattaggcggcgggctttcagcggaagcgatgacggaaaaagatatcaacgatttgaaatttgcagttgattttgatgtggattatgtggctatttcatttccccgcgatgcgcaggatattttaaaagccaagcatctggtgcaaggttacaaaggaaaggcgggtatcattgctaaaattgaacgtactgaagcggttaaaaatatcgacgccattattgaagcgagcgacggcgtcatggtggcgcgaggcgatttagcggtcgaaattggcgatgcacaagtgcctttggtgcaaaaagatattattcatcgcgctcgttccatggataaacccgtcattatcgcgactcaaatgatggagtccatgattcacgcgaccgtgcccacacgggctgaagtgtctgatgtggcaaatgccgtactcgataataccgatgccgttatgttgtcagcggaaaccgctgttggcgattatcccgttttagccgtagccgcgatggcgcgaacgtgcgttgtttcggaatctcagccgcgttcgcatatttctcgtcatcgcgttgaatgccgtttcaaacggattgatgaagccattgcgatggcaactatgtatgcagctaatcatctcgatatcaaagccatcatcaccttaaccgaatcgggaatcacccccttgtggatgtcgcgtatccgtacggctatccctatttatggtctcagtcgattcgataaatcgctcgggcgaatgacactttatcgcggtgtttaccctattaaatttgatccaactcaatacacgcgcgacgaaattaatgtaaaagccgttgaaacgttgcaaagtcaggacttattgaaaaacggcgatttagtggtcttaaccaaaggcgattacatgggcgtgggtggcgggtctaacgcaatgaaaattatggtggtggggaaagtcgtttaa

SEQ ID NO: 7519 - protein, 477 aa, Coxiella burnetii
MLRSTKIIATLGPATDDLSILEEIIHEGVDIIRLNFSHGTHEKHKQRIEMVRKAAKKQERVIGILADLQGPKIRISSFKTGKINLKKGELFILDAGLPPEEGTEKSVGIDYKNLPKDVKAEDILLLDDGRLTLKVQNVKGEQIICRVVEGGALSDHKGINRLGGGLSAEAMTEKDINDLKFAVDFDVDYVAISFPRDAQDILKAKHLVQGYKGKAGIIAKIERTEAVKNIDAIIEASDGVMVARGDLAVEIGDAQVPLVQKDIIHRARSMDKPVIIATQMMESMIHATVPTRAEVSDVANAVLDNTDAVMLSAETAVGDYPVLAVAAMARTCVVSESQPRSHISRHRVECRFKRIDEAIAMATMYAANHLDIKAIITLTESGITPLWMSRIRTAIPIYGLSRFDKSLGRMTLYRGVYPIKFDPTQYTRDEINVKAVETLQSQDLLKNGDLVVLTKGDYMGVGGGSNAMKIMVVGKVV

SEQ ID NO: 7520 - DNA, 1422 bp, Tropheryma whipplei
  CDS (1)..(1422)
atgtttatgcgtagggccaagattgttgttactctcggtccggcagtatcagatcttgattctgtgagagatcttatatccgctggtgccgacgtctttcgcatgaatctcagccacggatcgttggattttcacagggaggtatttctgaatgttaggacggctgctgctgagctagacaggcatattgctatatttgctgatcttcagggtccaaaaatacgtttagggcgttttgcttctgggccgtataccctacaagagggtgatatctttacaatcacaaccgagcaggtgttgggaacgaaagagctttccagcacaactttgccgacattaccagataatgtctcagagggggatttgcttttaattgatgatggcaaagttgccctgagggcgattgggaatgacggggttcggatcactacacgtgttgaagttccgggaaaggtctcgaataataagggtattaaccttccgggtgttggagttaaagttccggccttatctgaaaaggatattgactcactccgctgggccctttctcttccagttgatatgattgccttgagttttgtgcgctgcgcatcagatgtggatgctgtgcacaaggttatggatgaagagggtattcgccttcctgttattgcaaagatagaaaagcctcaagcagtatctgccatagaggagattgcactgcggtttgatgcgattatggtagcaaggggtgatcttggggttgaactgccgcttgaagatgtgccggtagcccagaaggaaattgttaaggttgcacgcaggtttgctcggccggttattatcgcaacccagatgcttgagtcaatgatctcttcctcgcggcccaccagggctgaggcgagtgatgttgcaaacgctgttcttgatggagccgatgcactgatgctaagcggtgagacaagtgttggtgagtggcccgttgaagctgtgcgggtcatgtcgagggttattgaaaaaacagaggaaaaggcaatttcacaaatagtcggttttggtacaactccaaaaacacagggtggtgccctcgcctgggccgcagcaaaggttgctgagtttatcgatgcgcgttatctgtgtgtctttagtgaaagtggagattcaataagacgggtgtcgcgactgcgtcatgatatacccattattggatttagtccggttgggtccgttgtccgacaggtctctctctcttggggtgttcgatgttttttgatagagaggctccatcagactgatcagatgatgcgtaaggctgaacatgttctcctcacaaacaatttggccgagattggagagaagattgtgattatttcaggatcaccagttggggtgccggggagtacaaaccatatgagaatccacgagcttggaagcacgtcctag

SEQ ID NO: 7521 - protein, 473 aa, Tropheryma whipplei
MFMRRAKIVVTLGPAVSDLDSVRDLISAGADVFRMNLSHGSLDFHREVFLNVRTAAAELDRHIAIFADLQGPKIRLGRFASGPYTLQEGDIFTITTEQVLGTKELSSTTLPTLPDNVSEGDLLLIDDGKVALRAIGNDGVRITTRVEVPGKVSNNKGINLPGVGVKVPALSEKDIDSLRWALSLPVDMIALSFVRCASDVDAVHKVMDEEGIRLPVIAKIEKPQAVSAIEEIALRFDAIMVARGDLGVELPLEDVPVAQKEIVKVARRFARPVIIATQMLESMISSSRPTRAEASDVANAVLDGADALMLSGETSVGEWPVEAVRVMSRVIEKTEEKAISQIVGFGTTPKTQGGALAWAAAKVAEFIDARYLCVFSESGDSIRRVSRLRHDIPIIGFSPVGSVVRQVSLSWGVRCFLIERLHQTDQMMRKAEHVLLTNNLAEIGEKIVIISGSPVGVPGSTNHMRIHELGSTS

SEQ ID NO: 7522 - DNA, 1416 bp, Tropheryma whipplei
  CDS (1)..(1416)
atgcgtagggccaagattgttgttactctcggtccggcagtatcagatcttgattctgtgagagatcttatatccgctggtgccgacgtctttcgcatgaatctcagccacggatcgttggattttcacagggaggtatttctgaatgttaggacggctgctgctgagctagacaggcatattgctatatttgctgatcttcagggtccaaaaatacgtttagggcgttttgcttctgggccgtataccctacaagagggtgatatctttacaatcacaaccgagcaggtgttgggaacgaaagagctttccagcacaactttgccgacattaccagataatgtctcagagggggatttgcttttaattgatgatggcaaagttgccctgagggcgattgggaatgacggggttcggatcactacacgtgttgaagttccgggaaaggtctcgaataataagggtattaaccttccgggtgttggagttaaagttccggccttatctgaaaaggatattgactcactccgctgggccctttctcttccagttgatatgattgccttgagttttgtgcgctgcgcatcagatgtggatgctgtgcacaaggttatggatgaagagggtattcgccttcctgttattgcaaagatagaaaagcctcaagcagtatctgccatagaggagattgcactgcggtttgatgcgattatggtagcaaggggtgatcttggggttgaactgccgcttgaagatgtgccggtagcccagaaggaaattgttaaggttgcacgcaggtttgctcggccggttattatcgcaacccagatgcttgagtcaatgatctcttcctcgcggcccaccagggctgaggcgagtgatgttgcaaacgctgttcttgatggagccgatgcactgatgctaagcggtgagacaagtgttggtgagtggcccgttgaagctgtgcgggtcatgtcgagggttattgaaaaaacagaggaaaaggcaatttcacaaatagtcggttttggtacaactccaaaaacacagggtggtgccctcgcctgggccgcagcaaaggttgctgagtttatcgatgcgcgttatctgtgtgtctttagtgaaagtggagattcaataagacgggtgtcgcgactgcgtcatgatatacccattattggatttagtccggttgagtccgttgtccgacaggtctctctctcttggggtgttcgatgttttttgatagagaggctccatcagactgatcagatgatgcgtaaggctgaacatgttctcctcacaaacaatttggccgagattggagagaagattgtgattatttcaggatcaccagttggggtgccggggagtacaaaccatatgagaatccacgagcttggaagcacgtcctag

SEQ ID NO: 7523 - protein, 471 aa, Tropheryma whipplei
MRRAKIVVTLGPAVSDLDSVRDLISAGADVFRMNLSHGSLDFHREVFLNVRTAAAELDRHIAIFADLQGPKIRLGRFASGPYTLQEGDIFTITTEQVLGTKELSSTTLPTLPDNVSEGDLLLIDDGKVALRAIGNDGVRITTRVEVPGKVSNNKGINLPGVGVKVPALSEKDIDSLRWALSLPVDMIALSFVRCASDVDAVHKVMDEEGIRLPVIAKIEKPQAVSAIEEIALRFDAIMVARGDLGVELPLEDVPVAQKEIVKVARRFARPVIIATQMLESMISSSRPTRAEASDVANAVLDGADALMLSGETSVGEWPVEAVRVMSRVIEKTEEKAISQIVGFGTTPKTQGGALAWAAAKVAEFIDARYLCVFSESGDSIRRVSRLRHDIPIIGFSPVESVVRQVSLSWGVRCFLIERLHQTDQMMRKAEHVLLTNNLAEIGEKIVIISGSPVGVPGSTNHMRIHELGSTS

SEQ ID NO: 7524 - DNA, 1584 bp, Shigella flexneri
  CDS (1)..(1584)
atgacgatcgctaaaagcgactgtcactgtcctaatcttatacgacatccgaatgagattaatttatcgccatcgcggcgttatttcattcggatttcatgttcaagcaacacctggttgtttcagtcaacggagtattacatgtccaaaaggcttcgcagaacaaaaatcgttaccacgttaggcccagcaacagatcgcgataataatcttgaaaaagttatcgcggcgggtgccaacgttgtacgtatgaacttttctcacggctcgcctgaagatcacaaaatgcgcgcggataaagttcgtgagattgccgcaaaactggggcgtcatgtggctattctgggtgacctccaggggcccaaaatccgtgtatccacctttaaagaaggcaaagttttcctcaatattggggataaattcctgctcgacgccaacctgggtaaaggtgaaggcgacaaagaaaaagtcggtatcgactacaaaggcctgcctactgacgtcgtgcctggtgacatcctgctgctggacgatggtcgcgtccagttaaaagtactggaagttcagggcatgaaagtgttcaccgaagtcaccgtcggtggtcccctctccaacaataaaggtatcaacaaacttggcggcggtttgtcggctgaagcgctgaccgaaaaagacaaagcagacattaagactgcggcgttgattggcgtagattacctggctgtctccttcccacgctgtggcgaagatctgaactatgcccgtcgcctggcacgcgatgcaggatgtgatgcgaaaattgttgccaaggttgaacgtgcggaagccgtttgcagccaggatgcaatggatgacatcatcctcgcctctgacgtggtaatggttgcacgtggcgacctcggtgtggaaattggcgacccggaactggtcggcattcagaaagcgttgatccgtcgtgcgcgtcagctaaaccgagcggtaatcacggcgacccagatgatggagtcaatgattactaacccgatgccgacgcgtgcagaagtcatggacgtagcaaacgccgttctggatggtactgacgctgtgatgctgtctgcagaaactgccgctgggcagtatccgtcagaaactgttgcagccatggcgcgcgtttgcctgggtgcggaaaaaatcccgagcatcaacgtttctaaacaccgtctggacgttcagttcgacaatgtggaagaagctattgccatgtcggcaatgtacgcagctaaccacctgaagggcgttacggcgatcattaccatgaccgaatcgggtcgtaccgcgctgatgacctcccgtatcagctctggtctaccaattttcgccatgtcgcgccatgaacgtacgctgaacctgactgctctctatcgtggcgttacgccggtgccctttgatagcgctaatgacggcgtagcagctgccagcgaagcggttaatctgctgcgcgataaaggttacttgatgtctggtgacctggtgattgtcacccaaggcgacgtgatgagtaccgtgggttctactaataccacgcgtattttaacggtagagtaa

SEQ ID NO: 7525 - protein, 527 aa, Shigella flexneri
MTIAKSDCHCPNLIRHPNEINLSPSRRYFIRISCSSNTWLFQSTEYYMSKRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGIDYKGLPTDVVPGDILLLDDGRVQLKVLEVQGMKVFTEVTVGGPLSNNKGINKLGGGLSAEALTEKDKADIKTAALIGVDYLAVSFPRCGEDLNYARRLARDAGCDAKIVAKVERAEAVCSQDAMDDIILASDVVMVARGDLGVEIGDPELVGIQKALIRRARQLNRAVITATQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVPFDSANDGVAAASEAVNLLRDKGYLMSGDLVIVTQGDVMSTVGSTNTTRILTVE

SEQ ID NO: 7526 - DNA, 1425 bp, Microbispora rosea subsp
  CDS (1)..(1425)
atgagtcgtcgagcaaagatcgtctgtaccctcgggcccgccacctcctccccggagcgcctacgcgagctcatcaaggcgggaatgaacgtcgcccgcttcaacctctcgcacggcagccacgagctgcacaaggaggtgttcgaccgggtcagggccgccgccgacgagctgggctgcgccgtcggcgtcctcgccgacctgcagggccccaagatccgtgtcggacgcttcgcctccggtcccgtacggctcggctacggcgacgtcttcacgatcactaccgaggacgtccccggtgaccgggacatcgtctccaccacgtacgagggcctgccgggcgatgtgaagcccggcgacacgatcctcgtggacgacggccggctgaacctcgaagtgaccgcagtggacgggccgcgcgtcgtcaccaaggtcgtcatcggaggcatgatctccgacaacaagggcctcaacctccccggcgtcgccgtcagcgccccggcgctcacggagaaggacgaggaggacctgcgctgggcgctgcgcaccggcttcgacatgatcgccctgtcgttcgtccggtgcccggacgcgctcgtccgcgcgatcatggaggaggagggcgtccggctcccgcttctcgcgaagatcgaaaagccgcaggccgtcgaacgcctcgaggagatcgtggacaccttcgacggcgtcatggtcgcccgcggcgacctcggcgtcgagctgccgctggagcaggtgccgatcgtccagcgccgcatcatcgacctgtgccgggagaaggcccaccccgtcatcgtggccacccagatgctcgactcgatgatgagctcaccccgccccacccgcgccgaggcctccgacgtcgcgtacgccgtcatggacggcgcggacgcggtcatgctgtccggcgagacctcggtcggcaactaccccgtcgaggcggtctccacgatggcccgcatcgcgtcgccgcggagagcaacacgctgcaggccacccacaccctggaccgcctgcccgagaccaccggcggcgcatcgcccgcgcggcgccgaggtcggcgcgatcgtcggggccaaggccctggtggcgtacacgatgtccggcgagaccgcccggcgcctggcccgctaccgctcgcccatcccgctgctggccttcacctccaacccgctggtgcgcggccagctcgcgctgacctggggcgtggagacgttcgaggtgccgttcgtgcaccacaccgacgacatggtccgccaggtcgaggcctcgctgctgtcgctcggcatctgcgagaagggcgacaaggtcgtcgtcgtcgccggctccccgcccggcaaccacggctccaccaactcgctgcgcgtccacaccatcggctcggcggtcgcccacccggcggtctga

SEQ ID NO: 7527 - protein, 474 aa, Microbispora rosea subsp
MSRRAKIVCTLGPATSSPERLRELIKAGMNVARFNLSHGSHELHKEVFDRVRAAADELGCAVGVLADLQGPKIRVGRFASGPVRLGYGDVFTITTEDVPGDRDIVSTTYEGLPGDVKPGDTILVDDGRLNLEVTAVDGPRVVTKVVIGGMISDNKGLNLPGVAVSAPALTEKDEEDLRWALRTGFDMIALSFVRCPDALVRAIMEEEGVRLPLLAKIEKPQAVERLEEIVDTFDGVMVARGDLGVELPLEQVPIVQRRIIDLCREKAHPVIVATQMLDSMMSSPRPTRAEASDVAYAVMDGADAVMLSGETSVGNYPVEAVSTMARIASPRRATRCRPPTPWTACPRPPAAHRPRGAEVGAIVGAKALVAYTMSGETARRLARYRSPIPLLAFTSNPLVRGQLALTWGVETFEVPFVHHTDDMVRQVEASLLSLGICEKGDKVVVVAGSPPGNHGSTNSLRVHTIGSAVAHPAV

SEQ ID NO: 7528 - DNA, 1806 bp, Oryza sativa
  CDS (75)..(1721)
gcatcgcatcctccgccgccgccgccgccatcaccctcctctccgccgcattagcagtagaatcctaagccataatggcaacctccgccgccgccgccgcgagcaccttgccttacctcgtcgccgccgcctcctcctccgcggcggcgcgccgccgcggggcccaccggatccgggcgtcgtcggcggcggcggaggtggagggggcgatggacgtggtgtcggaggcggagctgcgggagaaggggttcatggggctccggaagacgaagctggtgtgcacggtggggcccgcttgcgtgggggctttgccggcgctggcgcgcggcgggatgggcgtggcgcgggtcaacctgtgccacgggggccgcggctggcaccgcgccgtgatgcgcgaggtgcggaggctcaacgaggaggaaggcttctgcgtctccctcatggtcgacaccgaggggtcccagctcctcgtcgccgaccacggcggcgccgcctccgtcaaggccgaggatggctctgaatggctatttacaagtaaaagaaccgatgaatctcatccattcacaatgcatgttaactttgataagttttctgaagacattctagttggtgatgagcttgtaattgatggaggaatggcaacatttgaagttattgagaaggtcggaaatgatttgcgctgtaagtgcacagacccaggtttgcttcttcctcgagccaaactgtcattctggaggaatggaaaattagttgaaaggaactttgggcttcctacattgtcagcaaaggattgggctgacattgaatttgggatagctgaaggagttgattgcatcgctctttcatttgtaaaagatgctaatgacatcaagtatctcaagacttacctctccagaaaatcattagaacacatcaaaatattcgcgaaggttgagagtcttgaatcactcaagaaccttaaagacatcatagaggcatctgatggagttatggtagcacgtggtgatcttggagttcagattcctttagaacaaatcccagccatccaagaggcaattgttgatctttgtcgacggttgaacaagccagtgatagttgcctctcagcttcttgaatcaatggttgagtatccaacaccaactcgtgcagaggtagcagacgtttctgaagcagtacggcaatatgctgatgccgtaatgttatcggcagagtcagctataggtgcatatccccagaaagctctagcagtcctccgtgctgctagtgagaggatggaatcatggagccgtgaggaaaacatgcagaaacttcttccacaacatcagcttgcaatagctttgcctgataggatctcagagcaaatttgcaccagtgctgcagaaatggcaaacaaccttgcggtggatgccatctttgtttacacaaagtatggtcacatggcgtcgcttctttcgcgcaaccggcccaaccctcccatttttgctttcactgataatgccaactcaagaaagagcatgaacctctactggggagtaattccacttcagctaccactgtcaaataacatggaagataacttcaatcaaaccatcaagcttatgaagtcgaagggttcagtgaaatctggagacacagtcttggtcgtcgccgactctgatctgaaccgaccccgtgctgctacctcagttttccaatccattcaagttcgaatagtggactaggttagtcattgctgagctagttgctagcagctgcagatctggatggatatttacaaattatacgatgattcttgaaattgttctg

SEQ ID NO: 7529 - protein, 548 aa, Oryza sativa
MATSAAAAASTLPYLVAAASSSAAARRRGAHRIRASSAAAEVEGAMDVVSEAELREKGFMGLRKTKLVCTVGPACVGALPALARGGMGVARVNLCHGGRGWHRAVMREVRRLNEEEGFCVSLMVDTEGSQLLVADHGGAASVKAEDGSEWLFTSKRTDESHPFTMHVNFDKFSEDILVGDELVIDGGMATFEVIEKVGNDLRCKCTDPGLLLPRAKLSFWRNGKLVERNFGLPTLSAKDWADIEFGIAEGVDCIALSFVKDANDIKYLKTYLSRKSLEHIKIFAKVESLESLKNLKDIIEASDGVMVARGDLGVQIPLEQIPAIQEAIVDLCRRLNKPVIVASQLLESMVEYPTPTRAEVADVSEAVRQYADAVMLSAESAIGAYPQKALAVLRAASERMESWSREENMQKLLPQHQLAIALPDRISEQICTSAAEMANNLAVDAIFVYTKYGHMASLLSRNRPNPPIFAFTDNANSRKSMNLYWGVIPLQLPLSNNMEDNFNQTIKLMKSKGSVKSGDTVLVVADSDLNRPRAATSVFQSIQVRIVD

SEQ ID NO: 7530 - DNA, 1506 bp, Kluyveromyces lactis
  CDS (1)..(1506)
atggaatctagattaggctggttgaccgatttgagtaccgaaactggtaccaacttgagaagaacctcaattatttgtaccattggtccaaagaccaacaacccagaaactttggttgaattgagaaaggctggtatgaacattgttcgtatgaacttctcccacggttcttacgaataccatcaatctgtcattgacaacgccagaaaatctgaagaactataccaaggtagacctctggctattgcattggacactaagggtcctgaaatcagaactggtaccaccactaacgatgtggattacccaattcctccaaaccacgaaatgatcttcactactgatgacaagtacgctaaggcttgtgacgacaaaaccatgtacgttgattacaagaacatcaccaaggtcattgaagctggtagaattatctacgtcgatgatggtgttttgtcattcgaagttttggaagttattgatgacaacaccttgaaggttaagtctttgaacgccggtaagatttgttctcacaagggtgtcaacttgccaggtaccgatgtcgatttgccagctttgtccgaaaaggacaagtctgacttgaaattcggtgtcaagaacggtgtccacatggtcttcgcctctttcatcagaaccgctcaagatgttttgactatcagagaagttttgggtgagcaaggtaaggatatcaagatcattgttaagattgaaaaccaacaaggtgtcaacaactttgacgatatcttgaaggtcactgacggtgttatggttgctagaggtgatttgggtattgaaattccagctcctcaagtgtttgctgtgcaaaagaagttgattgctaagtgtaacttggctggtaagccagttatctgtgctacccaaatgttggaatccatgacctacaacccaagaccaaccagagctgaagtctctgatgttggtaacgccgttcttgatggtgctgactgtgttatgttgtctggtgaaactgccaagggtaactacccaatcaatgccgttaagaccatggctgaaactgctttgattgctgaacaagccatcccatacatcccaacttacgatgacttaagaaacttgactccaaagccaacctcaaccactgaaactatcgctgctgcttctgtttctgctgtatttgaacaaaaggccagagctttgattgtcctatccaccaccggtgacactccaagattggttgccaagtacaagccaaatgtcccaattgttatggttactagaaacccaagagctgctagattctctcatctatatagaggtgtcttcccattcgtatacgatgaatcctctgactccgaatggactgtcgatgttgaaaagagaatcaacttcggtgtcaagaaggccaaggaattcggaattttggttgacggtgacaccattgtcaccattcaaggtttcgccgctggtgtcggtaactccaacactctacgtgtcttgaccgtttaa

SEQ ID NO: 7531 - protein, 501 aa, Kluyveromyces lactis
MESRLGWLTDLSTETGTNLRRTSIICTIGPKTNNPETLVELRKAGMNIVRMNFSHGSYEYHQSVIDNARKSEELYQGRPLAIALDTKGPEIRTGTTTNDVDYPIPPNHEMIFTTDDKYAKACDDKTMYVDYKNITKVIEAGRIIYVDDGVLSFEVLEVIDDNTLKVKSLNAGKICSHKGVNLPGTDVDLPALSEKDKSDLKFGVKNGVHMVFASFIRTAQDVLTIREVLGEQGKDIKIIVKIENQQGVNNFDDILKVTDGVMVARGDLGIEIPAPQVFAVQKKLIAKCNLAGKPVICATQMLESMTYNPRPTRAEVSDVGNAVLDGADCVMLSGETAKGNYPINAVKTMAETALIAEQAIPYIPTYDDLRNLTPKPTSTTETIAAASVSAVFEQKARALIVLSTTGDTPRLVAKYKPNVPIVMVTRNPRAARFSHLYRGVFPFVYDESSDSEWTVDVEKRINFGVKKAKEFGILVDGDTIVTIQGFAAGVGNSNTLRVLTV

SEQ ID NO: 7532 - DNA, 1506 bp, Saccharomyces kluyveri
  CDS (1)..(1506)
atggaatctagactaggttggttaactgaattgcaaactgaaaccggtgctaacttgagaagaacctctatcatcggtaccattggtccaaagaccaacaacccagaaaccttggttgccttgagaaaggctggtttgaacattgttcgtatgaacttctctcacggttcttacgaataccaccaatctgtcattgacaacgctagaaagtctgaagagctatatccaggtagaccattggctattgctttggacaccaagggtccagaaatcagaactggtaccaccactaacgaagtcgactacccaatcccaccaaaccacgaaatgatcttctccattgacgacaaatacgccaaggcttgtgatgacaaggttatgtacattgactacaagaacatcaccaaggttatcgaaaagggtaagatcatctacgttgatgacggtgtcttgtctttcgaagttttggaagtcgttgacgaacaaactttgaaggttaagtccttgaacgctggtaagatctgctcccacaagggtgttaacttgccaggtaccgatgtcgacttgccagctttgtccgaaaaggacaagtctgacttgagattcggtgtcaagaacggtgtccacatggtcttcgcttctttcatcagaaccgctcaagatgttttgaccatcagagaagttttgggtgaagacggtaaggacgtcaagatcattgtcaagattgaaaaccaacaaggtgttaacaactttgacgaaatcttgaaggttactgacggtgtcatggttgccagaggtgacttgggtatcgaaatcccagctccacaagttttcgctgtccaaaagaagttgattgctaagtgtaacttggccggtaagccagttatctgtgccacccaaatgttggaatctatgacttacaacccaagaccaaccagagctgaagtttccgatgtcggtaacgctgttttggacggtgctgactgtgtcatgttgtctggtgaaaccgctaagggtaactacccaattaacgccgttaccatcatggctgaaaccgctttgattgctgaacaagctatcccatacgtcgccacttacgacgacttgagaaacttcactccaaagccaacttctaccactgaaaccatcgctgccgccgctgtctcttctgttttcgaacaaaaggccaaggctatcattgtcttgtctaccaccggtgacaccccaagattggtctccaaatacaagccaaacgttccaattgttatggttaccagaaacccaagagctgctagattctctcacttgtacagaggtgtcttcccattcgtctacgaatctgacactgaatccgaatggaccaaggatgttgaaagccgtttgaacttcggtattgccaaggccaaggaattcggtatgttgaaggaaggtgacaccattgtcactatccaaggtttcgctgctggtgttggtcactctaacactttgcgtgtcttgaccgtctaa

SEQ ID NO: 7533 - protein, 501 aa, Saccharomyces kluyveri
MESRLGWLTELQTETGANLRRTSIIGTIGPKTNNPETLVALRKAGLNIVRMNFSHGSYEYHQSVIDNARKSEELYPGRPLAIALDTKGPEIRTGTTTNEVDYPIPPNHEMIFSIDDKYAKACDDKVMYIDYKNITKVIEKGKIIYVDDGVLSFEVLEVVDEQTLKVKSLNAGKICSHKGVNLPGTDVDLPALSEKDKSDLRFGVKNGVHMVFASFIRTAQDVLTIREVLGEDGKDVKIIVKIENQQGVNNFDEILKVTDGVMVARGDLGIEIPAPQVFAVQKKLIAKCNLAGKPVICATQMLESMTYNPRPTRAEVSDVGNAVLDGADCVMLSGETAKGNYPINAVTIMAETALIAEQAIPYVATYDDLRNFTPKPTSTTETIAAAAVSSVFEQKAKAIIVLSTTGDTPRLVSKYKPNVPIVMVTRNPRAARFSHLYRGVFPFVYESDTESEWTKDVESRLNFGIAKAKEFGMLKEGDTIVTIQGFAAGVGHSNTLRVLTV

SEQ ID NO: 7534 - DNA, 1506 bp, Saccharomyces castellii
  CDS (1)..(1506)
atggaatccagattagccagattaaccactttacaagttaccgccggtgacaacttaagaagaacctctattattggtactattggtccaaagaccaacaacccagaagtcttggttgctctaagaaaggctggtttgaacattgtccgtatgaacttctctcacggttcttacgaataccatcaatccgttattgaaaacgccagaaagtctgaagaactttacccaggtagaccattagctattgctttggacaccaagggtccagaaatcagaactggtaccaccaccggtgaagttgactacccaattccaccaaaccacgaaatgatcttctctactgatgaaaagtacgctaaggcttgtgatgacaaggttatgttcgtcgactacgctaacatcaccaaggttatctccaagggtaagatcatctacgtcgatgacggtgtgttgtctttcgaagttttggaagtcgttgatggtaagactttgaaggttaagtccttgaacgccggtaagatctgttctcacaagggtgttaacttaccaggtaccgatgtcgatttgccagctttgtccgaaaaggataaggctgatttgagattcggtgttaagaacggtgtccacatggtcttcgcttctttcattagaaccgctcaagatgttttgaccatcagagaagtcttaggtgaagatggtaaggacatcaagattgttgtcaagattgaaaaccaacaaggtgttaacaacttcgacgaaatcttgaaggtcactgatgccgttatggttgccagaggtgatttaggtattgaaattccagccccagaagtcttagctgtccaaaagaaattgattgctaagtctaacttggccggtaagccagttatctgtgctacccaaatgttggagtctatgacttacaacccaagaccaaccagagctgaagtttccgatgtcggtaacgctatcttggatggtgctgactgtgttatgttgtctggtgaaaccgccaagggtaactacccaatcaatgctgtcaccaccatggctgacactgctttgattgctgaacaagccattgcttaccaaccattgtacgatgacttgagaaacttgactccaaagccaacttctaccactgaaaccgttgctgcttccgctgttgccgctgtctacgaacaaaaggccaaggctatcattgtcttgtctacttccggtaccactccaagattggtctccaagtacagaccagactgtccaattatcttggttaccagaaacccaagagctgctagattctctcacttgtctagaggtgttttcccattcgtctacgaagctgactccgttgctgactggactgaagatgtcgaattgagattgaagttcggtattgaaaaggccatcgaaatgggtgtcatgaagaagggtgacacttacgtctccattcaaggtttcaaggctggtgaaggtcactccaacactttgcaagtctctaacgcttaa

SEQ ID NO: 7535 - protein, 501 aa, Saccharomyces castellii
MESRLARLTTLQVTAGDNLRRTSIIGTIGPKTNNPEVLVALRKAGLNIVRMNFSHGSYEYHQSVIENARKSEELYPGRPLAIALDTKGPEIRTGTTTGEVDYPIPPNHEMIFSTDEKYAKACDDKVMFVDYANITKVISKGKIIYVDDGVLSFEVLEVVDGKTLKVKSLNAGKICSHKGVNLPGTDVDLPALSEKDKADLRFGVKNGVHMVFASFIRTAQDVLTIREVLGEDGKDIKIVVKIENQQGVNNFDEILKVTDAVMVARGDLGIEIPAPEVLAVQKKLIAKSNLAGKPVICATQMLESMTYNPRPTRAEVSDVGNAILDGADCVMLSGETAKGNYPINAVTTMADTALIAEQAIAYQPLYDDLRNLTPKPTSTTETVAASAVAAVYEQKAKAIIVLSTSGTTPRLVSKYRPDCPIILVTRNPRAARFSHLSRGVFPFVYEADSVADWTEDVELRLKFGIEKAIEMGVMKKGDTYVSIQGFKAGEGHSNTLQVSNA

SEQ ID NO: 7536 - DNA, 1521 bp, Saccharomyces bayanus
  CDS (1)..(1521)
atgccagaatcaagactgcagagactagccaacttgaaaataggcactccgcaagagcttagacggacctccattataggcaccatcgggcccaagactaatagctgcgaggcaatcaccgctttgaggaaggctgggctgaacatcatccgaatgaacttctcccacggctcttatgaattccaccaatcggtgatagacaatgccttgaagtcggaacagcaattccccggaagaccgcttgccattgctctggacaccaagggccctgagattaggacaggccgcaccccgaacgaccaggacttccacatcctcgttgaccaccagatgatcttcaccaccgacgcgaagttcgaacactcctctaatgacaaaatcatgtatatagactatgccaatttgacaaaggtaattgtgcccgggaaactcatctacgtcgatgacgggattctgtcttttaaagtgctccagatcatggacgatgccaacataagggtccaagctctcaattcgggctatatctcatcccgtaaaggtgtcaacttacccaataccgacgtggatttgccccctctttccgcaaaggatattcaggacttgcaattcggcatgcggaatggaatccacatggtgtttgcctctttcattagggcccccgaagacgtcttgaccattaggaaagtcctgggcaccgaaggcgaggacatcaaaatcatctccaagatcgaaaatcaacaaggcctggataatttcgacgaaatcctgcaagtcacagatggtgtcatgatagccaggggtgatctgggcattgagatcctggcaccagaagtgctggccattcagaaaaaactcattgccaaatgtaacgtggcgggcaaacctgtcatttgcgcgacccaaatgctggagtcaatgacctacaacccaagacccacaagggctgaagtctctgatgtcggaaacgccgttttggatggtgccgattgtgttatgttgtctggcgaaacggcaaagggcgattatccagttaatgcagtcaagataatggcggccacagctctaattgcagagagtactattgcgcatttggctctatacgatgatcttagagacgccacttctaagcccacctccactacagaaaccgttgcagccgcagccactgcagcgatcttggagcaaaatggtaaagccatcgttgtattatccactacgggaaacacagcaaggctgttgtctaagtacagaccaagttgtcctatcatactagtgacgaggcacgcaagaacggcaagaatcgcacatttatacagaggtgtttttccatttgtctttgagccaaaacggctgtacgattggggtgaagacgttcacagacgcttaaagtttggcgtggaaatggcaagatcttttggaatggttgaaagtggtgataccgttgtatccatccaaggcttcagaggcggtattggtcattcaaacaccttgcgtgtttctaccgttggtgaagagttttag

SEQ ID NO: 7537 - protein, 506 aa, Saccharomyces bayanus
MPESRLQRLANLKIGTPQELRRTSIIGTIGPKTNSCEAITALRKAGLNIIRMNFSHGSYEFHQSVIDNALKSEQQFPGRPLAIALDTKGPEIRTGRTPNDQDFHILVDHQMIFTTDAKFEHSSNDKIMYIDYANLTKVIVPGKLIYVDDGILSFKVLQIMDDANIRVQALNSGYISSRKGVNLPNTDVDLPPLSAKDIQDLQFGMRNGIHMVFASFIRAPEDVLTIRKVLGTEGEDIKIISKIENQQGLDNFDEILQVTDGVMIARGDLGIEILAPEVLAIQKKLIAKCNVAGKPVICATQMLESMTYNPRPTRAEVSDVGNAVLDGADCVMLSGETAKGDYPVNAVKIMAATALIAESTIAHLALYDDLRDATSKPTSTTETVAAAATAAILEQNGKAIVVLSTTGNTARLLSKYRPSCPIILVTRHARTARIAHLYRGVFPFVFEPKRLYDWGEDVHRRLKFGVEMARSFGMVESGDTVVSIQGFRGGIGHSNTLRVSTVGEEF

SEQ ID NO: 7538 - DNA, 1467 bp, Xylella fastidiosa
  CDS (1)..(1467)
atgtctgaacgccagcgccgtaccaggattcttgccactcttgggccagcgacagatccgcctggtgtgcttgatgcgctgtttaaggcgggagttaatgtggtgcggctgaatttcagccatggcgatgtttcggatcaggccaggcgtgttgctgaagtgcgtgcggcggcggcgcatgtgggcgttgagattggcattcttgcggatctacccggcccgaagatccgtattggacgttttaccgggggaaaagtgcggcttgtggctggtgcgcgctttgatctgcttgccgatagcaatgcgtcgctgggggatacgactcaagttggggtcagttatctggggttgccgcaggatgtcgccgccggagatgtgttgttactggatgatggcctcatgcaattgcaagtggtgcaagtgcagggtgcgcggattgtgacgacggttcttaacgatggtgtgttgtccgaccgtaaggggctgaataagcaaggtggcggtttgtcgctgggtgcgctgacggatcgtgatcgcgaactgattggtatcgttgccaggatggggatcgactttattgcagtttcgttttgtcgtcatgctgaagagatgcatgaggcgcgtcgcattgctcgggagtgcggctgtgatgctgcgttggtgtctaagatcgagcgtgctgaggctatcgtgaatcttgccgagattgttgcggcttcggatgtggtgatggttgcgcgtggtgatttaggtgtggagattggtgacgctcaattgccgggcttgcaaaaaaagatcatcaaagaagcgttgttacagaacaaggtggtgattactgccacgcagatgctgcaatcaatggttgaaagtccgataccgacccgtgctgaggtgctggatgtggccaatgcggtgattgatgggaccgatgcggtgatgctgtcggctgaaacggcgacaggtgattatccagtcaaggcagtagaggcgatggcgcgtatctgtctgggagcggaacaccagtttgagtttgatactgattatgagatggcgcagcgtaatttgcagcgtgcagatcatgcgattgcaatggcaacgatgttcttatctgagcacatttgccttggtggtgtggttgcgttgacggagtccggtacgacgccacggtttctctcgcggttccggtcgcacgtcccgatctatgcgtttacgcgtcacgaggatgtgcggcggcgcatggtgctgatgcgtggtgtatttccgatgcgttttgacagccgtggtttaacgccgcgtgaggcagctagggcgacaatccgtcttttggtggaatgtggttgtatgagtccgggtgatcgtgtggtgttcacgagcggcgagcatatggaaacgcttggcgcaaccaatacactgcgtttacttgaagtaggcgctgatgggtgtgtcagtggtctgtgggaactctaa

SEQ ID NO: 7539 - protein, 488 aa, Xylella fastidiosa
MSERQRRTRILATLGPATDPPGVLDALFKAGVNVVRLNFSHGDVSDQARRVAEVRAAAAHVGVEIGILADLPGPKIRIGRFTGGKVRLVAGARFDLLADSNASLGDTTQVGVSYLGLPQDVAAGDVLLLDDGLMQLQVVQVQGARIVTTVLNDGVLSDRKGLNKQGGGLSLGALTDRDRELIGIVARMGIDFIAVSFCRHAEEMHEARRIARECGCDAALVSKIERAEAIVNLAEIVAASDVVMVARGDLGVEIGDAQLPGLQKKIIKEALLQNKVVITATQMLQSMVESPIPTRAEVLDVANAVIDGTDAVMLSAETATGDYPVKAVEAMARICLGAEHQFEFDTDYEMAQRNLQRADHAIAMATMFLSEHICLGGVVALTESGTTPRFLSRFRSHVPIYAFTRHEDVRRRMVLMRGVFPMRFDSRGLTPREAARATIRLLVECGCMSPGDRVVFTSGEHMETLGATNTLRLLEVGADGCVSGLWEL

SEQ ID NO: 7540 - DNA, 1479 bp, Vibrio parahaemolyticus
  CDS (1)..(1479)
atgtgtaaaaccaaaattgtggctacgctaggcccagcaagtgaaagccgcgaaacactaactaagttgattcgagcaggcgcgaacgtagtcagactcaacttttctcacggaacggcgcaagaacacattgcccgcgcgaatttagttcgtgaaattgcggctgaactcgacacttatgttggtgtgttagtcgatttacaaggccctaagattcgtatttcttgcttcgaaaatggcgcagttctactcaatcaaggcgacgtattcaccctgagcggcacacttgacgcacaatctggaacccaagaaatggttgggcttgattacccagagctgattcaagacgtgaacgaaggcgatattctgctgctagatgatggccgcattcagctaaaagtaagccaattacaccgtgacgagcagtggattaaaaccacggtattgaacagcggtaaattgtctaaccgtaaaggcattaacttgttaggtggaggtctttccgctccggctcttaccgcgaaagacattcaagacatcgacaccgcagctaaacttcgagccgacttccttgccatttctttcccgcgcaatgcacaagatatcgaatacgctcgcagcttggcgcaaaaagcaggttgtcacgccaagattgtcgcgaaggtagaacgcgcagaagtggttgaaaccaaagaagccatggatgatgtcattaaagcatcagacatcattatggttgctcgcggcgatttgggcgtagagattggcgacgcacgactgccaatggtgcaaaagtcattgatcaatcgttctaaacattggggtaagcctgtcattaccgcgacccagatgttggaatcgatgatcgagaatcctctcccaactcgcgctgaagtgttagacgtggcaaacgcgattatcgacggaacagacgccgtgatgctgtcggcggaatcggcggcgggcaaatacccaatcgaagcggtcgaagccatggttcgcatcgcacaaggtgcagagcacgagctggaatgcaaccatgactgctgggatactctgcaacacttatgttctaacccaggcaaaagtttcgcgctttcatcaatgatttcggcttctcgcgttcatcaagaccttggcgttgcgattttaacccaacatggtgaaacacccctgttgatgtctcgctgccaaagtaaaactaagatttgggctctgagcgacaacccagctttacttgcacaaatgaccattctacgcggtgttgaacctttgtatttcaaagcagcagaaagccacgttgatctcgcgccacaattagtggaatgcttacgtcaaaaggccaacgaagcacatatttcctccattttgatgacccagctcgattccatcgaaggcatgggtgaaatcaacgcttgtcgcttgcttagcttgaatgtgtcatctcacatgaagccagcggaagaaatcgcagcttag

SEQ ID NO: 7541 - protein, 492 aa, Vibrio parahaemolyticus
MCKTKIVATLGPASESRETLTKLIRAGANVVRLNFSHGTAQEHIARANLVREIAAELDTYVGVLVDLQGPKIRISCFENGAVLLNQGDVFTLSGTLDAQSGTQEMVGLDYPELIQDVNEGDILLLDDGRIQLKVSQLHRDEQWIKTTVLNSGKLSNRKGINLLGGGLSAPALTAKDIQDIDTAAKLRADFLAISFPRNAQDIEYARSLAQKAGCHAKIVAKVERAEVVETKEAMDDVIKASDIIMVARGDLGVEIGDARLPMVQKSLINRSKHWGKPVITATQMLESMIENPLPTRAEVLDVANAIIDGTDAVMLSAESAAGKYPIEAVEAMVRIAQGAEHELECNHDCWDTLQHLCSNPGKSFALSSMISASRVHQDLGVAILTQHGETPLLMSRCQSKTKIWALSDNPALLAQMTILRGVEPLYFKAAESHVDLAPQLVECLRQKANEAHISSILMTQLDSIEGMGEINACRLLSLNVSSHMKPAEEIAA

SEQ ID NO: 7542 - DNA, 1443 bp, Vibrio parahaemolyticus
  CDS (1)..(1443)
atgacttccaaattaagaagaacgaaaattgtcaccactcttggcccttcaactgataaagacaatgtactggaggaaatcattaaagctggagcgaacgtcgttcgtatgaacttttctcacggtacaagtgaagaccacattcaacgcgctaaaaaagtacgcgcgattgccgcaagattagggcgtcaggttgccattcttggcgatttacagggacctaaaattcgtgtttcgacctttaaagacggtaaaatcacactcaaagtcggcgataaattcacactagatagcgacttaccaaaaggcgaagggaaccaagaatccgttggtttggattacaaagaactgcctcaagatgtttcaccgaacgacattctactgcttgatgatggcagagttcaattgcaagtcaccagcgtagaaggaaataaagtccatacccgtgtgaccgttggtggcccattatccaataacaagggcatcaacaaaaaaggcggtggcttatcagccgatgcactcacggaaaaagacaaagctgacataatcacagccgcagaaattaaggtcgactatttggccatttctttcccacgcaatggcgaggacatgcactatgccagacgcttggcccgggatgccggcttagaagcaaaactcgtcgcaaaagtagaacgtgcagaaaccgtcgccacgagcgagtcgattgacgatatcatcctagcttctgacgtcgtgatggtcgctcgcggcgatttaggcgttgagattggcgatcctgagctgatcggtgttcagaaaaaactcattcgtcgagctcgcagtttgaaccgcgtcgtcattactgcaactcaaatgatggaatccatgatcaatagcccaatgccaacgcgtgcagaagtcatggacgtagcaaacgccgttttggatggcaccgatgccgtgatgctgtctggagagaccgctgccggtcaatatccggtagagaccgtgaaatcaatggcggatgtctgtattggcgcagaaaagatgtctgaagcaagtctatcgacctaccgtctcgaccgcacctttgaaacagcagaagagaccattgcaatggcaaccatgtactcagcgaatcacatggaaggcattaaagcgatgattgcattaacagagtcaggaagaacagctttgatgatgtcacgcctaagctctggtttgccgatttttgctttatcgcgtaacgaatcgacgctcaaccgcgcagcgttatatcgtggcgtgacgccagtgtactttgatgcgaaatgcgatgcgggcttaccaaccgctcaagccgcaatttctagcctcaaagatcaaggttacttacatgaaggtgacttagtgatcatcactcaaggtgacgtgatggacgtcgttggttcaaccaactgcatgcgtattctgccagtctaa

SEQ ID NO: 7543 - protein, 480 aa, Vibrio parahaemolyticus
MTSKLRRTKIVTTLGPSTDKDNVLEEIIKAGANVVRMNFSHGTSEDHIQRAKKVRAIAARLGRQVAILGDLQGPKIRVSTFKDGKITLKVGDKFTLDSDLPKGEGNQESVGLDYKELPQDVSPNDILLLDDGRVQLQVTSVEGNKVHTRVTVGGPLSNNKGINKKGGGLSADALTEKDKADIITAAEIKVDYLAISFPRNGEDMHYARRLARDAGLEAKLVAKVERAETVATSESIDDIILASDVVMVARGDLGVEIGDPELIGVQKKLIRRARSLNRVVITATQMMESMINSPMPTRAEVMDVANAVLDGTDAVMLSGETAAGQYPVETVKSMADVCIGAEKMSEASLSTYRLDRTFETAEETIAMATMYSANHMEGIKAMIALTESGRTALMMSRLSSGLPIFALSRNESTLNRAALYRGVTPVYFDAKCDAGLPTAQAAISSLKDQGYLHEGDLVIITQGDVMDVVGSTNCMRILPV

SEQ ID NO: 7544 - DNA, 1413 bp, Vibrio parahaemolyticus
  CDS (1)..(1413)
atgaaaaagaccaaaatcgtttgtacgattggccctaaaactgaatctgtagagaagctaactgaactagtaaacgcaggcatgaacgtaatgcgtcttaacttctctcacggtgactacgaagaacacggcactcgtatcgcgaacttccgcaaagtaatggaagctactggcaaacaactagcaatccttctagatactaaaggtccagaaatccgcactatcaaactagaaggcggtaacgacgttgatctagtagctggtcaagaattcactttcacaactgacacttcagttgtaggtaacaaagacaaagttgcagtaacttacgctggcttcgcagctgacctaaacgttggtaacactatcctagtagacgacggtctaatcgagatggaagttatcgcaacaactgacactgaagttaaatgtaaagttcttaacaacggtgctctaggcgaaaacaaaggtgttaaccttcctggcgtttctgtaaacctacctgctctatctgaaaaagataagaacgaccttaaattcggttgtgagcaaggcgttgatttcgtagctgcatctttcatccgtaaagcttctgacgttcaagaaatccgtgaagttctagctgcaaacggcggcgagaacatccacatcatctctaagatcgaaaaccaagaaggtgttgataacttcgatgagatcctagaactttctgacggcatcatggttgctcgtggcgacctaggtgttgaaatcccagctgaagaagtaatcttcgctcagaaaatgatgatcgagaagtgtaaccgtgcacgtaagatggttatcactgcaactcaaatgcttgattctatgatcaacaacccacgtcctactcgtgcggaagcaggcgacgttgcaaacgcagtaatggacggcacagacgcagtaatgctttctggcgaaacagcaaaaggtaaataccctgttgaagcggtaactatcatggctcaaatcgctaagcgtactgactctgtacttaaagctgaactaggttctcgtctagacagcccacgtctacgcatcactgaagcagtatgtaaaggcgcagtagacacagctgaaaaactggctgctccactgatcgttgttgcaactgaaggcggtaagtctgcacgttcagtacgtaagtacttcccaactgcaaacatcctagcgctaacaactaacaagaaaactgcagcacaactagttctaactaagggtgttactccagttgttgttgacgctatcgaaagcactgacgcattctacgtagcaggtaaagaacttgctctagaatctggtctaggtaacaaaggcgatatcgtagtaatggtttctggtgctctagtcgcttcaggtactacgaacacagcttctgtacacgtactataa

SEQ ID NO: 7545 - protein, 470 aa, Vibrio parahaemolyticus
MKKTKIVCTIGPKTESVEKLTELVNAGMNVMRLNFSHGDYEEHGTRIANFRKVMEATGKQLAILLDTKGPEIRTIKLEGGNDVDLVAGQEFTFTTDTSVVGNKDKVAVTYAGFAADLNVGNTILVDDGLIEMEVIATTDTEVKCKVLNNGALGENKGVNLPGVSVNLPALSEKDKNDLKFGCEQGVDFVAASFIRKASDVQEIREVLAANGGENIHIISKIENQEGVDNFDEILELSDGIMVARGDLGVEIPAEEVIFAQKMMIEKCNRARKMVITATQMLDSMINNPRPTRAEAGDVANAVMDGTDAVMLSGETAKGKYPVEAVTIMAQIAKRTDSVLKAELGSRLDSPRLRITEAVCKGAVDTAEKLAAPLIVVATEGGKSARSVRKYFPTANILALTTNKKTAAQLVLTKGVTPVVVDAIESTDAFYVAGKELALESGLGNKGDIVVMVSGALVASGTTNTASVHVL

SEQ ID NO: 7546 - DNA, 1452 bp, Pseudomonas syringae
  CDS (1)..(1452)
atgaccgttcgccgcaccaaaatcgtcgccacacttggccctgccagcaactcgccggaagtcatcgaacaactgatcctctcgggtctggacgttgctcgtctgaacttctctcacggtactccggatgagcacaaggcacgcgccaaactcatccgcgaaatcgccgccagacacgggcgcttcgtcgctctgctgggcgacctgcagggtcctaaaatccgtatcgcaaagttcaccgacaagcgaatcgagctgaaggtcggtgacaagttcaccttctcgactgctcacccgctgaccagtggcaaccagcagatcgtgggtatcgactacccggatctggtcaaggattgcggcgtaggcgacgagctgttgctcgacgacggtcgcgtggtcatgcgcgtcgacacccagaccgcacacgaactgcactgcaccgtgctgatcggcggtccgctgtccgaccacaaaggcatcaaccgtcgtggtggtggccttaccgctccggcgttgaccgaaaaagacaagcaggacatcaagctcgctgccgaaatggacctggattacctggccgtttccttcccgcgcgatgccgccgacatggaatatgctcgccagctgcgtgacgaatccggtggcactgcctggctggttgccaagatcgaacgcgctgaagcggtcgccaacgacgaagtgctcgatgcactgatccgtgccagtgacgctgtgatggttgcccgtggcgacctgggcgttgaaatcggcgacgccgaactggtcggtgttcaaaaacgcatcattctgcacgcacgtcgccacaacaaggcggtgatcgtcgccacgcagatgatggagtcgatgatctcaagccccatgccgacccgcgccgaagtgtccgatgtggccaacgccgtgctcgattacaccgacgccgtcatgctctcggcagaaagtgcggcaggttcctacccggtcgaagccgtacaggccatggcacgtatctgcgtaggcgctgaaaagcacccgaccggcaaaacgtccagccaccgtatcggtcactcgttcacgcgttgcgacgaaagcatcgcgctggccgccatgtacaccgccaaccacttccctggcgtgaaggcgatcatcgcactgaccgaaagcggctacaccccgctgatcatgtcgcgcatccgctcctcggtgccgatctacgcgttctctccgcaccgtggcactcaagcgcgcgctgcgatgttccgtggtgtctacaccgtgccgttcgacccgggagccctgccgccaggtcaggtcagccaggccgccgtcgacgaactgctcaagcgtggcctggtcgagcaaggtgactgggtcatcctgaccaagggcgacagctaccacaccatcggtggcaccaacggcatgaagatcctgcacgttggcgacccattggtctga

SEQ ID NO: 7547 - protein, 483 aa, Pseudomonas syringae
MTVRRTKIVATLGPASNSPEVIEQLILSGLDVARLNFSHGTPDEHKARAKLIREIAARHGRFVALLGDLQGPKIRIAKFTDKRIELKVGDKFTFSTAHPLTSGNQQIVGIDYPDLVKDCGVGDELLLDDGRVVMRVDTQTAHELHCTVLIGGPLSDHKGINRRGGGLTAPALTEKDKQDIKLAAEMDLDYLAVSFPRDAADMEYARQLRDESGGTAWLVAKIERAEAVANDEVLDALIRASDAVMVARGDLGVEIGDAELVGVQKRIILHARRHNKAVIVATQMMESMISSPMPTRAEVSDVANAVLDYTDAVMLSAESAAGSYPVEAVQAMARICVGAEKHPTGKTSSHRIGHSFTRCDESIALAAMYTANHFPGVKAIIALTESGYTPLIMSRIRSSVPIYAFSPHRGTQARAAMFRGVYTVPFDPGALPPGQVSQAAVDELLKRGLVEQGDWVILTKGDSYHTIGGTNGMKILHVGDPLV

SEQ ID NO: 7548 - DNA, 1416 bp, Pseudomonas putida
  CDS (1)..(1416)
atgacgcctgataaaaaagttaagatccttgccacccttggccctgcgatcaacggcatcgacgatatccgccagctggtcgaagccggggtgaacatcttccgcctcaacttcagccacggcgaacatgccgaccacgccctgcgctaccagtggatccgcgaagtcgagcaacagctgaactacccgctgggcatcctcatggacctgcaagggccgaagctgcgcgttggccgcttcgccgaaggcaaggtgcagttgcaacgcgggcaggccctgcgcctggatctggacaagaccccgggcgacagccgccgggtcaacctgccgcaccccgaaatcatcgccgccctcgaacccggcatggacctgctgctggacgacggcaagctgcgcctgcgcgtgaccgccaagcacagcgacgccatcgacaccgaggtgctgaatggtggcgagctttccgaccgcaagggcgtcaacgtaccgcaagcggtgctcgacctctccccgctcaccgaaaaagaccgccgcgacctggcctttggcctggagctgggtgtggactgggtcgccctgtcgttcgtgcagcgccctgaggacatcgtcgaagcgcgccagctgattggcgaccgcgcctacctgatggccaaaatcgagaaaccatcggcagtcgagcaactgcaagccatcgccgagctggcagacgcgatcatggtggcccgtggtgacctgggcgtggaagtaccggccgagagcgtgccgcagatccagaagcgcatcatcggcacctgccgccagctaggcaaacccgtggtggtggccacgcagatgctcgagtcgatgcgtttctcgccagcgccaacccgcgccgaagtcacggacgtggccaacgcggtggccgaaggtgccgatgcagtgatgctgtcggccgaaaccgcctcgggtgattacccgctggaagccgtgcagatgatgagcaagatcatccgccaggttgagaacggcccggactaccaggcccagctcgacgtcggccggccaaaggccgaagccaccgtgtcggatgccatcagctgcgccatccgccgcatcagcggcatcctgccagtggcggtgctggtcaactacagcgagtcgggtgcctcgaccctgcgcgcggcacgtgaacggccacgggcaccgatcctcaacctgacgccgaacctgaacaccgcgcgccgcctgagcgtggcttggggtgtgcattcggtggtcaacgaccgcctgcgtcaggtcgacgaggtggtttccaccgccctggagattgcccaggcgcaaggcatggccagccgtggcgacacgctgctgatcaccgctggcgtgcctttcggcaagccgggtacgactaacacgctgcggatcgagactttgatctag

SEQ ID NO: 7549 - protein, 471 aa, Pseudomonas putida
MTPDKKVKILATLGPAINGIDDIRQLVEAGVNIFRLNFSHGEHADHALRYQWIREVEQQLNYPLGILMDLQGPKLRVGRFAEGKVQLQRGQALRLDLDKTPGDSRRVNLPHPEIIAALEPGMDLLLDDGKLRLRVTAKHSDAIDTEVLNGGELSDRKGVNVPQAVLDLSPLTEKDRRDLAFGLELGVDWVALSFVQRPEDIVEARQLIGDRAYLMAKIEKPSAVEQLQAIAELADAIMVARGDLGVEVPAESVPQIQKRIIGTCRQLGKPVVVATQMLESMRFSPAPTRAEVTDVANAVAEGADAVMLSAETASGDYPLEAVQMMSKIIRQVENGPDYQAQLDVGRPKAEATVSDAISCAIRRISGILPVAVLVNYSESGASTLRAARERPRAPILNLTPNLNTARRLSVAWGVHSVVNDRLRQVDEVVSTALEIAQAQGMASRGDTLLITAGVPFGKPGTTNTLRIETLI

SEQ ID NO: 7550 - DNA, 1455 bp, Pseudomonas putida
  CDS (1)..(1455)
atgagcatccgccgcaccaaaatcgtcgccacccttggccccgccagcaactcgccggaagtgatcgaacaactgatcctcgccggcctggacgtggcacgtctgaacttctcccacggcacgccggacgagcacaaggcccgcgcgcgcctgatccgtgacatcgccgccaagaatggccgccatgttgcactgctgggcgacctgcagggtccgaagatccgcatcgccaagttcgccaacaagcgcatcgaactgaagatcggtgacaagttcaccttctccaccgcccacccgctgaccgaaggcaaccaggacatcgtcggtatcgactaccccgacctggtcaaggactgcggcgttggtgacgaactgctgctcgacgatggccgcgtggtcatgcgcgtcgaaaccgccactgcagatgccctgcactgcgtggtgatcatcggtggcccactgtcggaccacaaaggcatcaaccgtaaaggtggcggcctgaccgcaccggccctgaccgaaaaagacaaggccgacatcaaactggctgcggaaatggacctggactacctggccgtatccttcccgcgtgacgccagcgatatggaatacgcgcgcaagctgcgtgacgaagccggcggcagcgcctggctggtagccaagatcgaacgcgccgaagcggtggccgatgacgagaccctcgacaagctgatcgccgcctccgacgctgtgatggttgcccgtggtgacctgggcgtggaaatcggcgacgccgagctgatcgctatccagaagaagatcatccagcacgcccgccgcaacaacaaggccgtgatcgtggcgacccagatgatggagtcgatgatccagaacccgatgccgacccgcgcggaagtgtccgacgtggccaacgccgtgctggacaacaccgatgcggtgatgctgtcggccgaaagcgccgccggttcctacccgatcgaagctgtccaggccatggcacgcatctgcctgggtgccgaaaagcacccgaccagccagaagtccagccatcgcctgcacaccaccttccagcgctgcgacgaaagcatcgccttggcggccatgtacactgccaaccacttcccgggcgtaaaggcgatcatcgccctgaccgaaagcggctacaccccgctgatcatgtcgcgcctgcgttcgcatgtaccgatcttcgccctgtcgccgcaccgcgccacccaggcgcgcgcctcgatgttccgtggcgtgtacccgattgccttcgacccggccgcgctgccggccgataaggtgagccaggcggcggtcgacgaactgctcaaacgtggcctggtggagcaaggtgactgggtgatcctgaccaagggtgacagctaccacaccatcggtggcaccaatggcatgaagatcctgcacgtcggtgatccgctggtcggttag

SEQ ID NO: 7551 - protein, 484 aa, Pseudomonas putida
MSIRRTKIVATLGPASNSPEVIEQLILAGLDVARLNFSHGTPDEHKARARLIRDIAAKNGRHVALLGDLQGPKIRIAKFANKRIELKIGDKFTFSTAHPLTEGNQDIVGIDYPDLVKDCGVGDELLLDDGRVVMRVETATADALHCVVIIGGPLSDHKGINRKGGGLTAPALTEKDKADIKLAAEMDLDYLAVSFPRDASDMEYARKLRDEAGGSAWLVAKIERAEAVADDETLDKLIAASDAVMVARGDLGVEIGDAELIAIQKKIIQHARRNNKAVIVATQMMESMIQNPMPTRAEVSDVANAVLDNTDAVMLSAESAAGSYPIEAVQAMARICLGAEKHPTSQKSSHRLHTTFQRCDESIALAAMYTANHFPGVKAIIALTESGYTPLIMSRLRSHVPIFALSPHRATQARASMFRGVYPIAFDPAALPADKVSQAAVDELLKRGLVEQGDWVILTKGDSYHTIGGTNGMKILHVGDPLVG

SEQ ID NO: 7552 - DNA, 1761 bp, Lactobacillus plantarum
  CDS (1)..(1761)
atgaaaaaaaccaagattgtttcaacacttggtcctgccagcaccgatactgacactattgttaaattaatcgaagccggcgcaaatattttccgctttaacttttcacatggtgatcatgaagaacatttagatcgcttaaacaaagttcacgaagcagaaaagattacgggtaagaccgttggtatcatgcttgatactaagggtgctgaaattcggacgaccgttcaagctaacggaaaatctgaatacaagatcggtgacaaggttcgtatcaccatggatgattcattagatacgacccatgataagattgccgttacttacaagaacctctatgatgatgttcatgtaggtggccatgtcctctttgatgatggtttattagatatgaagatcgacgaaaaggacgaagctaaccgcgaattggttacaactgttcaaaacgccggcgttttaggctcacgtaagggtgttaacgctcctggcgtttcaatcaacttacctgggatcactgaaaaagactcaagtgatattcgctttggtttggatcatgaaatcaactacatcgctgcttcattcgttcgtaagccacaagatgtcttagacattcgtgaattacttgaagaaaagcacatggaacacgttcaaatcttccctaagatcgaatcacaagaaggtatcgacaacgccgatgaaattcttaaggtttgtgatggtttgatggttgctcgtggtgacatgggtgttgaaattcctgctgaaaatgtgccattggtacaaaagagtttaatcaagaagtgtaatgctttaggtatgcctgttatcacggctactcaaatgttagactcaatgcaagaaaacccacgtcctactcgtgccgaagcttctgacgttgccaacgctgtctttgatggtactgacgcaacgatgctttctggtgaaagtgctaacggtctttaccctgttgaatctgttgccatgatggctaagattgacgaaaaggctgaaaacactttggctgaaaacggtacgttacaattaaaccgtttcgacaagactagtgttactgaaacaatcggtattgcgattgctcgggcagctaagaacttgaacattaagacgattgttgctgcgactgaatctggctacactgctaagatgatttcgaagtaccgtccaaatgctgatatcttagcaatcacttttgacgaacggactcaacgtggcttaatggttaactggggtgttcaaccaatcgtggctgaaaaaccagaaaccactgatgacatgtttgatttagctgcttctaaggctgttgaacttggctttgccaaggaaggcgacttaatcttgattactgccggtgtgccagttggcgaacgcggtacgactaacatcatgaagatccaattaattggttctaagttagctgatggtcaaggtgtcggtgatgaaacggttatcggtaaagccgtaatcgcaacgtctgctcaagaagctatcgacaaggccgttgaaggtggcgtcttagttactaagacgactgacaaagactacttaccagcaatcgaaaagtctagtgctttagttgttgaaaacggtggtttaacttcacacgctgctgttgttggtatctcaatgggaattcctgttatcgttggtgttaaggacgctactagtgttattgctgatggtcaattgatcacagttgattcacgtcgtggccttgtataccgcggtgcttcaaacgccctttaa

SEQ ID NO: 7553 - protein, 586 aa, Lactobacillus plantarum
MKKTKIVSTLGPASTDTDTIVKLIEAGANIFRFNFSHGDHEEHLDRLNKVHEAEKITGKTVGIMLDTKGAEIRTTVQANGKSEYKIGDKVRITMDDSLDTTHDKIAVTYKNLYDDVHVGGHVLFDDGLLDMKIDEKDEANRELVTTVQNAGVLGSRKGVNAPGVSINLPGITEKDSSDIRFGLDHEINYIAASFVRKPQDVLDIRELLEEKHMEHVQIFPKIESQEGIDNADEILKVCDGLMVARGDMGVEIPAENVPLVQKSLIKKCNALGMPVITATQMLDSMQENPRPTRAEASDVANAVFDGTDATMLSGESANGLYPVESVAMMAKIDEKAENTLAENGTLQLNRFDKTSVTETIGIAIARAAKNLNIKTIVAATESGYTAKMISKYRPNADILAITFDERTQRGLMVNWGVQPIVAEKPETTDDMFDLAASKAVELGFAKEGDLILITAGVPVGERGTTNIMKIQLIGSKLADGQGVGDETVIGKAVIATSAQEAIDKAVEGGVLVTKTTDKDYLPAIEKSSALVVENGGLTSHAAVVGISMGIPVIVGVKDATSVIADGQLITVDSRRGLVYRGASNAL

SEQ ID NO: 7554 - DNA, 1755 bp, Clostridium tetani
  CDS (1)..(1755)
atgcaaaaaactaaaatggtgtttaccataggaccagctagtgatagcgaagaagtattaagtgagttaataaaagcaggaatgagtgcatcaaggcataacttttcacatgggacccatgaagaacataaaataaggattgatttaataagaaaattaagtgacaaatttaataagaatattgctgtaatattagacacaaaaggacctgaaataagaacaggagattttaaagataaaactgtacaattaaaagaaggaaataaattcactatatactgtggggaagaaattttaggagatgaaacaaagtgttctataacttataatgatttgcataatgatgtaaaaacaggagattccatactaatagatgatggacttgtaggattagaagttgaagaagtagagggaagtaaagtacattgtgtagttaaaaatagtggtgctgtaagtaaccataagggtgtaaatgtacctggagtagatgtttcattaccttcattaacagaaaaagataaaagtgatcttgaatttggatgtaaagtaggagtagattttattgcagcatcttttattagaaaaggttcagacgtattggaaataagaaaggttctagaagaaaacggcggtacagatatacaaatattttctaaaatagaaaatcaacaaggggtagaaaatatagatgaaataataaagttttctgatggaataatggtagctagaggagatatgggtgtagaattacaaatggaacaagtacctataattcaaaaaatgattatagagaaatgtaacaaagctggcaaacctgttatcacagctactcaaatgttagactctatgattagaaatccaagaccaacaagagcagaagtttcagatgtagccaatgctatatttgatggaactgatgcggtaatgttaagtggtgaaacagcaggaggaaaatatcctatagaagctgctaaagctatggctaagattgctagaactgcagaagaaacaatggattatgatgaaatatttaacagaaaaagagaagcgcgtgtattaagtgtggctaatgcgataagcatagcaacctgtacaacagcttcagagttaaatgcatctgctatattaacagctactcaaacaggatatacagctagagcagtttccaaatatagaccagcatgtcctattatagcgattacaccaagtaagaatgtagcaagaaagttagcattgagttggggtgtgttcccaatacttactactaaatttacatccacagatgctttaatagaaaactctgttgatatagcattgacagcagaatatataagaaaaggagatttggttgtaatagcagctggaatacctgtaagttattcaggaacaactaacatgctaaaggttcatgtagttggagatatccttgttcagggaagaggtgctggaaatagtgcaggttatggtatagctaaagttgtaaatagtacagaagaagcagaaagggttatagaaagtggagatatattagttgtaaaagatgcagatatagattatgtttctatactaaatagagtatcaggagttataactgaaagaggaggattgacttctcacttagcaatagaatgtataaccaatgaaataccatttatatgtggggcaggtggggcaacagatgtattaaaaagtggatatttcataaccatggatgtaaaaagaggaatagtatataacggtaggattactatataa

SEQ ID NO: 7555 - protein, 584 aa, Clostridium tetani
MQKTKMVFTIGPASDSEEVLSELIKAGMSASRHNFSHGTHEEHKIRIDLIRKLSDKFNKNIAVILDTKGPEIRTGDFKDKTVQLKEGNKFTIYCGEEILGDETKCSITYNDLHNDVKTGDSILIDDGLVGLEVEEVEGSKVHCVVKNSGAVSNHKGVNVPGVDVSLPSLTEKDKSDLEFGCKVGVDFIAASFIRKGSDVLEIRKVLEENGGTDIQIFSKIENQQGVENIDEIIKFSDGIMVARGDMGVELQMEQVPIIQKMIIEKCNKAGKPVITATQMLDSMIRNPRPTRAEVSDVANAIFDGTDAVMLSGETAGGKYPIEAAKAMAKIARTAEETMDYDEIFNRKREARVLSVANAISIATCTTASELNASAILTATQTGYTARAVSKYRPACPIIAITPSKNVARKLALSWGVFPILTTKFTSTDALIENSVDIALTAEYIRKGDLVVIAAGIPVSYSGTTNMLKVHVVGDILVQGRGAGNSAGYGIAKVVNSTEEAERVIESGDILVVKDADIDYVSILNRVSGVITERGGLTSHLAIECITNEIPFICGAGGATDVLKSGYFITMDVKRGIVYNGRITI

SEQ ID NO: 7556 - DNA, 1437 bp, Bradyrhizobium japonicum
  CDS (1)..(1437)
atgaggcgtcttcgccgtatcaagattctcgcgacccttggacctgcctcttcggacctcgcgatgatccgccgcctgttcgaggccggcgccgacctgttccgcatcaacatgagccacaccccgcatgacaagatgcgggagctggtggcgacgatccgcaatgtcgagagcagctacggccggccgatcggcatcctggtcgaccttcagggaccgaagctcaggctcggcgccttcgccgaaggctcggtccagctccagaacggccagaccttcacgctcgattccgacaaggcgccgggcgatgccacgcgcgtcaatctcccgcatccggagatcctcgccgcgctgcggcccggccatgcgctgctgctggacgacggcaaggtccggctgatcgcggaggagacctcgaaagagcacgcggtgacgcgcgtcgtggtcggcggacggatgtccgaccgcaagggcgtcagcctgcccgacaccgacctgccggtctcggcgatgacgccgaaggaccgcgccgacctcgaggcggcgctggtcaccggcgtcgactggatcgcgctgtccttcgtgcagcgcgccgacgacgtgatcgaggccaagaagatgatccgcggccgcgccgctgtcatggccaagatcgagaagccgcaggcgatcgaccgcctcgccgacatcatcgaggcctccgacgcgctgatggtggcgcgcggcgatctcggtgtcgagctgccgctggagcgcgtgccgagcctccagaagcagatgacgcgcatggcgcgccgcgccggcaagccggtggtgatcgcgacccagatgctggaatcgatgatccagtcgccggtgccgacacgcgccgaggtctcggacgtcgccaccgccgtctatgaaggcgccgacgccatcatgctgtcggcggaatcggcggccggaaaattcccggtcgaggcggtctcgaccatgaaccgcatcggcgaagaggtcgagcgcgacccgatttatcggtccgtgctgaccgcgcagcgccccgcgccggaatccaccgcaggcgacgccatcgcggacgccgcccgccagatcgccgagacgctcgacctgccggccctgatctgctggaccagctcgggctcgaccgcggtgcgcgtcgcgcgcgagcggccgaagccgccgatcgtggcgatcacgccgaacatcgcggccggacgccggctggcggtggtctggggcgtgcattgcgtggtggcggaagatgcgcgcgaccaggacgacatggtgagccgcgccggccagatcgcgttccgcgacggcttcgtccgcgccggccagcgcgtgatcatcgtcgccggcgtgccgctcggcattcccggcaccaccaacatggtgcgcatcgcctccgtcggccccgagggcggcgcggatatctag

SEQ ID NO: 7557 - protein, 478 aa, Bradyrhizobium japonicum
MRRLRRIKILATLGPASSDLAMIRRLFEAGADLFRINMSHTPHDKMRELVATIRNVESSYGRPIGILVDLQGPKLRLGAFAEGSVQLQNGQTFTLDSDKAPGDATRVNLPHPEILAALRPGHALLLDDGKVRLIAEETSKEHAVTRVVVGGRMSDRKGVSLPDTDLPVSAMTPKDRADLEAALVTGVDWIALSFVQRADDVIEAKKMIRGRAAVMAKIEKPQAIDRLADIIEASDALMVARGDLGVELPLERVPSLQKQMTRMARRAGKPVVIATQMLESMIQSPVPTRAEVSDVATAVYEGADAIMLSAESAAGKFPVEAVSTMNRIGEEVERDPIYRSVLTAQRPAPESTAGDAIADAARQIAETLDLPALICWTSSGSTAVRVARERPKPPIVAITPNIAAGRRLAVVWGVHCVVAEDARDQDDMVSRAGQIAFRDGFVRAGQRVIIVAGVPLGIPGTTNMVRIASVGPEGGADI

SEQ ID NO: 7558 - DNA, 1458 bp, Bacteroides thetaiotaomicron
  CDS (1)..(1458)
atgttactgaaacagacaaaaatcgtcgcatccatttcggacagacgttgcgatgtggactttataaaacagctgtttgaagctgggatgaatgtggtacgtatgaatacggctcacgctagccgtgaaggttttgaagcgttgattgccaatgtacgttccgtatccaaccggattgcaatcctcatggataccaaaggaccggaagtacgtacaactgccaatgcggaaccgattccatatcagataggtgataaagtaaagattgtcggcaatcctgatcaggagacgactcgtgaatgtatcgctgtttcgtatcctaactttgtgaacgatttgaatatcggaggtctggttctgattgacgatggtgatcttgaactggaagtaatcgataagacagccgattatctgctttgcgaagtgaaaaacgatgcaacgttgggaagccgcaagagcgtgaacgtcccgggtgttcgtatcaatcttccttcattgacagagaaagaccgtaacaatatactttacgcgattgaaaaggatatcgatttcatcgctcactctttcgtgcgcaaccgtcaggacgtacttgatatccgtgaaattctggatgctcacaatagtgatatccggattattgccaagattgagaatcaggaaggggtggacaacatcgacgagattcttgaagtggcggacggcgtgatggtagcccgtggtgacctgggtatcgaagtgccgcaggaacgtattccgggtatccagcgtgtgctgatccgcaaatgtatcctggcaaagaaaccggtgatcgttgcgactcagatgcttcataccatgatcaacaatcctcgtccgacccgcgcggaagtgaccgatatcgcgaatgcaatctactatcgtacggatgctctgatgttgagcggtgagactgcttatggcaaatatccggtagatgcagtcaagacaatgaccaagatcgcggcccaggctgaaaaagataaactggaagagaatgatatccgtatcccgttgaacgaaaacagtaacgatgtaacggccttccttgctaaacaggcagtgaaagctacatcgaaactgaagatacgtgccatcatcacagacagctatagcggacggaccgcccgtaatctggcagctttccgtggtaagttcccggtattggctatctgctataaagaaaagaccatgcgtcatctggcactttcttatggagtggaagcaatctatatgccggagctggccaacggacaggaatattattttgccgctttgcgccgcctgttgaaggaaggacgtttgcagccgactgatatggtaggatatctgagtagcggtaaggcaggtacacaaacttcattcctcgaaatcaatgtcgtggaagatgcgttgaaacatgcgggagaaactgtattgcctaacaacaatcgttatctctaa

SEQ ID NO: 7559 - protein, 485 aa, Bacteroides thetaiotaomicron
MLLKQTKIVASISDRRCDVDFIKQLFEAGMNVVRMNTAHASREGFEALIANVRSVSNRIAILMDTKGPEVRTTANAEPIPYQIGDKVKIVGNPDQETTRECIAVSYPNFVNDLNIGGLVLIDDGDLELEVIDKTADYLLCEVKNDATLGSRKSVNVPGVRINLPSLTEKDRNNILYAIEKDIDFIAHSFVRNRQDVLDIREILDAHNSDIRIIAKIENQEGVDNIDEILEVADGVMVARGDLGIEVPQERIPGIQRVLIRKCILAKKPVIVATQMLHTMINNPRPTRAEVTDIANAIYYRTDALMLSGETAYGKYPVDAVKTMTKIAAQAEKDKLEENDIRIPLNENSNDVTAFLAKQAVKATSKLKIRAIITDSYSGRTARNLAAFRGKFPVLAICYKEKTMRHLALSYGVEAIYMPELANGQEYYFAALRRLLKEGRLQPTDMVGYLSSGKAGTQTSFLEINVVEDALKHAGETVLPNNNRYL

SEQ ID NO: 7560 - DNA, 2797 bp, Staphylococcus epidermidis
  CDS (854)..(2611)
atgatattcataagcttgaattgggttcagtaggggatacaattcaacgaggaggaactttcctcttttccgcaaggtgccctcagttcaaagaagaggatgtacgtaagaaagctattgagaatttacgtaagcgtggtatcgaaggtttagttgttattggaggagatggcagctatagaggggcacaacgaattagtgaggaatgtaaagaaattcaaacaattggtattcctggtacaattgataatgatattaatggtacagattttacaattggttttgatactgcattaaacactattattgaatcagtcgataagattagagatacggcatcaagtcacgcaagaacgtttattgttgaagttatggggcgtgattgtggagatttagctttatgggctggattatctgtaggtgctgaaacgattgttttaccagaagtcaatacagatattaaggatgtagctgaaaagattgaacagggtattaaaagagggaaaaaacattctatcgttatggttgcagaaggttgtatgagcggccaagaatgtgcagatgagttaacgaagtatattaacattgatacacgagtttcagtgttaggtcacattcaacgtggcggtagcccatctggtgctgatcgagtattagcttctcgacttggtggatatgctgttgaactattaaaacaaggcgagacagctaaaggtgttggcattaggaataatcaattaacctctacgccgtttgatgaaatttttgctgaaagtgatcgcaaatttaatagtcaaatgtatgaattagcaaaagaattatcaatttaaatttatttgggaggattataaaaatgagaaagactaaaattgtatgtacaataggaccagcttcagaatcagaggaaatgctcgaaaaactaatgaatgcaggaatgaacgttgcgcgtttaaatttctcacatggtagtcatgaagaacataaagcaagaattgatacaattcgtaaagttgctaaacgtttaaataaaacaattggcttgttattggatactaaagggccagaaattcgtacgcacaatatgaaagatggacttattgttttagaaaaaggcaaagaagtcattgtcagtatgaatgaagttgaaggaacacctgaaaaattctctgtaacatatgaaaatctaatcaatgatgtcaatattggatcatatatactattagatgatggtttagttgaacttcaagtcaaagaaattaacaaagataaaggcgaagttaaatgtgatatcttaaatactggtgaattaaaaaataaaaaaggtgttaacttacctggtgttaaagttaatttacctggtatcactgataaagatgccgatgatatcagatttggtataaaggaaaatgtagactttatagctgcaagttttgtaagacgtccaagtgatgttttagatatccgtcaaattcttgaagaagaaaaagcagaaataacaattttccctaaaatcgaaaaccaagaaggtatcgataatattgaagaaattcttgaagtatctgatggattaatggtagcacgtggtgatatgggtgttgaaattccaccagaaagcgtaccaatggttcaaaaagatttaattagaaaatgtaataaattaggaaaacctgtaattactgcgactcaaatgcttgattctatgcaacgtaatccacgtgcgacacgtgcagaagcaagtgacgtagctaatgcaatatacgatggtactgacgctgtaatgttatcaggcgaaactgcagcaggtcaatatcctgaagaagctgttaaaactatgcgtaatattgcagtttctgctgaagcagcgcaagactataaaaaattattaagtgatcgtactaaattagttgaaacttcattagtaaatgcaattggtgtttctgttgcacatactgccttaaacttaaatgtaaaagctattgtagcagcaactgaaagtggttcaacagcacgtacgatttctaaatatcgtccacattcagatatcattgctgtaacacctagcgaaaaaactgctagacaatgtgcaattgtatggggagtaaatccggtcgttaaagaaggacgtaaaacaactgatgctttactaaataatgctgtagcaacagcagtagaaactggtagagtttcaaacggagatttaattattattactgctggtgtacctactggagaaaaaggaactacaaatatgatgaaaatccacttagtaggtgatgagattgctaaaggccaaggtgttggtagaggatctgttgtaggccatgcaattgtcgcagatagtgctagtgatttagaaggtaaagatttatctgataaagttattattacaaattctgttgatgaaacattagtaccatatgttgaaaaagctataggtctaattacagaagaaaatggtattacttcaccaagcgcaattataggtttagaaaaaggcatacctactgttgttggtgtagaacaagcaactaaagaaattaaaaatgatatgttagtgactttagatgcgtcacaaggtaaagtgtttgaaggttatgctaacgtcctttaatttaacaaatgataaattaaaaaagaggatttgataatcacaaagctttaaagctattcataagagagcctggaacattgatttatgttccaggctcttattatttagggtagttgattattgaaattaaaaatgattaaatcaaccttttataacactagttattgattttaaagtagaacacca

SEQ ID NO: 7561 - protein, 585 aa, Staphylococcus epidermidis
MRKTKIVCTIGPASESEEMLEKLMNAGMNVARLNFSHGSHEEHKARIDTIRKVAKRLNKTIGLLLDTKGPEIRTHNMKDGLIVLEKGKEVIVSMNEVEGTPEKFSVTYENLINDVNIGSYILLDDGLVELQVKEINKDKGEVKCDILNTGELKNKKGVNLPGVKVNLPGITDKDADDIRFGIKENVDFIAASFVRRPSDVLDIRQILEEEKAEITIFPKIENQEGIDNIEEILEVSDGLMVARGDMGVEIPPESVPMVQKDLIRKCNKLGKPVITATQMLDSMQRNPRATRAEASDVANAIYDGTDAVMLSGETAAGQYPEEAVKTMRNIAVSAEAAQDYKKLLSDRTKLVETSLVNAIGVSVAHTALNLNVKAIVAATESGSTARTISKYRPHSDIIAVTPSEKTARQCAIVWGVNPVVKEGRKTTDALLNNAVATAVETGRVSNGDLIIITAGVPTGEKGTTNMMKIHLVGDEIAKGQGVGRGSVVGHAIVADSASDLEGKDLSDKVIITNSVDETLVPYVEKAIGLITEENGITSPSAIIGLEKGIPTVVGVEQATKEIKNDMLVTLDASQGKVFEGYANVL

SEQ ID NO: 7562 - DNA, 1440 bp, Wigglesworthia glossinidia brevipalpis
  CDS (1)..(1440)
atgcatagaataataagaagaacaaaaatagttgctacattaggaccatcaacagatttaaataataatttagaaaaaatgatattagctggagctaatatggttcgtatgaatttttctcatggaaatttttacgatcatgcaagaagaacaaaacaagtgagaaacatttctcataaactaggtaaaaatattgctattttaggagatttacaaggaccaaaaataagaatatctacttttatgacaggcaaagtatttttatcaccaggagatcaattcatactagatgcatcattaagcaaggatcttggaacagttgaaagtgttggaattgattataaatatcttccaaaagatgtatttccaggagatgttttattattagatgacggaaggatacagctaaaagtcaaaaaaattgtaaataaaaaaatttttacaactgtatatataggaggatatttatataataataaaggtattaataaattaggaggaggtttatcggctaattctttgacagaaaaagacaaaaaagatattatttgcgcagctaaaataggaatagattatttagctgtttcttttcctagaacaggaaaagacttaaaatatgcaagaaatttattaaataatgtagaaagtcatgcaaaaattatttcaaaaatagaaagagcagaagcggtagcaaataatgatattatagatgaaataataacagaatcagatgctattatggtagctagaggagatttgggaatagaaattggagatccagaattagtaggagtgcaaaaaaaattaatacaaagagctagagatttaaatcgtgcggtaattactgcaactcaaatgatggaatccatggtttataaccctatgccaaccagagcagaagttatggatgttgctaatgcagtattggatggcacagatgcagttatgttatcagcagaaacagctattggaaaatatccagtagaaactgtagaatctatgtctaatgtatgcataggagctgaaaaaatttctaatattaattctttgaagaatagattaaacattaaatttaaaaccgtagaagaatcaatggcggtatctgcaatgtatattgcaaatcatttaaatatgataaaagctataatttctcttacagaatctggtaaaactccattaattatgtctcgtataagttctggattaccaatttttgctctttcaaaacatgaacatactttaaatttaacagctttatatagaggggttactcctgtttattttaaaaataatgaaaaaggaatttcagctgctgattctgctattaatttgcttaaagaaaaaaaatttttattctctggagattttgtagtaattactcaaggagatgtcatggggactattggaaaaacaaataccagccgtatattaattgtataa

SEQ ID NO: 7563 - protein, 479 aa, Wigglesworthia glossinidia brevipalpis
MHRIIRRTKIVATLGPSTDLNNNLEKMILAGANMVRMNFSHGNFYDHARRTKQVRNISHKLGKNIAILGDLQGPKIRISTFMTGKVFLSPGDQFILDASLSKDLGTVESVGIDYKYLPKDVFPGDVLLLDDGRIQLKVKKIVNKKIFTTVYIGGYLYNNKGINKLGGGLSANSLTEKDKKDIICAAKIGIDYLAVSFPRTGKDLKYARNLLNNVESHAKIISKIERAEAVANNDIIDEIITESDAIMVARGDLGIEIGDPELVGVQKKLIQRARDLNRAVITATQMMESMVYNPMPTRAEVMDVANAVLDGTDAVMLSAETAIGKYPVETVESMSNVCIGAEKISNINSLKNRLNIKFKTVEESMAVSAMYIANHLNMIKAIISLTESGKTPLIMSRISSGLPIFALSKHEHTLNLTALYRGVTPVYFKNNEKGISAADSAINLLKEKKFLFSGDFVVITQGDVMGTIGKTNTSRILIV

SEQ ID NO: 7564 - DNA, 1413 bp, Vibrio vulnificus
  CDS (1)..(1413)
atgaaaaagaccaaaatcgtatgtacgattggcccaaaaactgagtctgtagagaaactgactgaactagtcaactcaggtatgaacgtaatgcgcctgaacttttctcacggtgactacgtagagcacggcactcgtatcgcgaacttccgccaagtaatggaaaacacaggtaagcaacttgctatcttactagacactaaaggtccagaaatccgcactatcaaactagaaaacggcgacgacgttgatctagtagctggtcaagaattcactttcacgactgatacttctgttgttggtaacaaagacatcgtagcagtaacttacccaggttttgctgcggatctatctgctggtaacactatcctagttgacgatggtctaatcgagatggaagttatcgcaacgactgcgactgaagttaagtgtaaagtactgaacaacggtgctctaggcgaaaacaaaggtgttaacctaccaggcgtttctgtaaacctacctgcactatctgaaaaagacaaaaacgaccttaaatttggttgtgagcaaggcgttgacttcgttgcagcatctttcatccgtaaagcatctgacgtaaaagaaatccgtgaagttctagcagcaaacggcggcgcgaacattcagatcatttctaagattgaaaaccaagaaggtgttgataacttcgacgaaatcctagagctttctgacggtatcatggttgctcgtggtgacctaggtgtagaaatccctgcagaagaagttatcttcgcacagaagatgatgatcgaaaaatgtaaccgcgcacgtaaagtggttatcactgcaactcaaatgctagattctatgatcaagaacccacgtccaactcgtgctgaagcgggtgacgttgcgaacgcaatcatggatggtactgatgcagtcatgctttctggcgaaacagcgaaaggtaaataccctgttgaagcggtaactatcatggcgcaaatcgctaaccgtactgattctgtactaaaagcagagctaggctctcgtctagacagcccacgcctacgtatcactgaagcggtatgtaaaggtgcagtagacacagctgagaaactagcagcaccactgatcatcgttgcaactgaaggtggtaagtctgcacgctctgtacgtaagtacttcccaactgcaaacattcttgcgctaacgacgaacaagaagacagcagctcaacttgtactgactaaaggtgttacacctgttgttgttgattcaatcgacaacacggatgcgttctacgtaaccggtaaagagcttgctcttgaatctggcctaggtagcaaaggcgacatcgttgtgatggtatctggtgctcttgttgcatctggtacaacgaatactgcgtcagtacacgtactataa

SEQ ID NO: 7565 - protein, 470 aa, Vibrio vulnificus
MKKTKIVCTIGPKTESVEKLTELVNSGMNVMRLNFSHGDYVEHGTRIANFRQVMENTGKQLAILLDTKGPEIRTIKLENGDDVDLVAGQEFTFTTDTSVVGNKDIVAVTYPGFAADLSAGNTILVDDGLIEMEVIATTATEVKCKVLNNGALGENKGVNLPGVSVNLPALSEKDKNDLKFGCEQGVDFVAASFIRKASDVKEIREVLAANGGANIQIISKIENQEGVDNFDEILELSDGIMVARGDLGVEIPAEEVIFAQKMMIEKCNRARKVVITATQMLDSMIKNPRPTRAEAGDVANAIMDGTDAVMLSGETAKGKYPVEAVTIMAQIANRTDSVLKAELGSRLDSPRLRITEAVCKGAVDTAEKLAAPLIIVATEGGKSARSVRKYFPTANILALTTNKKTAAQLVLTKGVTPVVVDSIDNTDAFYVTGKELALESGLGSKGDIVVMVSGALVASGTTNTASVHVL

SEQ ID NO: 7566 - DNA, 1785 bp, Synechococcus elongatus
  CDS (1)..(1785)
atgtcgaaccagccgttgcaacgccgcaccaaaattgtcgccaccattggtccagcagtcagtcaccccgacaaattgcgcgccattattcaagcgggagcaaccaccctgcgtctaaacttttcccatggcacccatgacgatcaccagcgcagcattcgcctcattcgccaaatttcctatgaactcgggcaaccggtggggattttgcaggacttgcaaggccccaagattcgccttgggcggtttgagcatggctccatttccctcaagcggggcgatcgctttaccctcacgagtcgccctatcctgggcaatcagcacattagctcaattacctatccccccttggcccaagaggtgcccgccggtgccacgattttgctcgacgatggccgcgtggaaatgctcgtggaagaagtggataaagaggcgggggagctccattgccaagtgattgttgggggtaccctctccaatgccaagggtgtgaactttccgggggtttacctttcgattaaagccctaacagagaaagatcgcgaagatctgatgtttggcctcaatcaaggggtggattgggtggccctcagcttcgttcgcaatccccaagatgtactggagatcaaagaactgattgccaacgctgggaagcaggtgccagtcattgccaaaatcgaaaagcacgaggcgatcgagcagatggatgccattctctccctctgtgatggcgtcatggtggcacggggtgatttgggggttgaattgcccgccgaagatgtaccgattctgcaaaaacggctgatcgctgctgccaaccgcttgggcattccggtcattacggccacacaaatgctcgacagcatggtgaaaagccctcgtcctacccgggccgagatttccgatgtcgccaatgccattctcgatggcactgatgccgtgatgctctccaatgaaacggcgatgggggaataccccgtcgaggcggtcaagatgatggccaccattgccgcccgcattgacaatcaacctcaactgcggcaacctcccggggctgagtctacggcggtgcgttctattcccagtgccattagtcaagcggtgggacaggtggcggcgcagctgcatgccaaagcgatcattacccaaactaaaacaggcgcaacggcgcggaatgtttccaagtttcgtccccaaattcctattttggcggcaacaccccatatcgaagtggcccgtcgcctccagttggtctggggcgtcgaaccgctgctgacattggatcatccctcgatgcgcgaatccttccaggcggcgattaatgctgcccaggagcggggcttccttgaggagggggatctggtggtcatgacggcgggcaccctacaaggggtttctggctccacggatatgatcaaggtggaactggttacctcagtgatgggacggggttgtggcattggccatggatctgttagtggtcctgcgcgggtggtacgccaagggatgccggtgcgtacgtttaatcgtggggaaattttggtggctgagcgcaccagtgctgagttggtggaagtgattcgcaaagcggcaggcattattaccgaggaggacagcctcacaagccatgccgccgtcttggggttgcggctgggtattcctgtgattgtgggcgtcaaaaatgccactcgcctgatccgtgagggcaccattctgacgatggatgtggaacggggcgtggtttattccggtgcccgcaatggcggcgagcgatcgccagagtag

SEQ ID NO: 7567 - protein, 594 aa, Synechococcus elongatus
MSNQPLQRRTKIVATIGPAVSHPDKLRAIIQAGATTLRLNFSHGTHDDHQRSIRLIRQISYELGQPVGILQDLQGPKIRLGRFEHGSISLKRGDRFTLTSRPILGNQHISSITYPPLAQEVPAGATILLDDGRVEMLVEEVDKEAGELHCQVIVGGTLSNAKGVNFPGVYLSIKALTEKDREDLMFGLNQGVDWVALSFVRNPQDVLEIKELIANAGKQVPVIAKIEKHEAIEQMDAILSLCDGVMVARGDLGVELPAEDVPILQKRLIAAANRLGIPVITATQMLDSMVKSPRPTRAEISDVANAILDGTDAVMLSNETAMGEYPVEAVKMMATIAARIDNQPQLRQPPGAESTAVRSIPSAISQAVGQVAAQLHAKAIITQTKTGATARNVSKFRPQIPILAATPHIEVARRLQLVWGVEPLLTLDHPSMRESFQAAINAAQERGFLEEGDLVVMTAGTLQGVSGSTDMIKVELVTSVMGRGCGIGHGSVSGPARVVRQGMPVRTFNRGEILVAERTSAELVEVIRKAAGIITEEDSLTSHAAVLGLRLGIPVIVGVKNATRLIREGTILTMDVERGVVYSGARNGGERSPE

SEQ ID NO: 7568 - DNA, 1503 bp, Streptococcus mutans
  CDS (1)..(1503)
atgaataaacgcgtaaaaattgttgcaactttaggtccagcggtagaaatccgtggtggtaaaaaatttggtgaagatggctattggggtgaaaagcttgatgttgaagcttcagcagcaaaaattgctgaattgattacagaaggagccaatgtttttcgttttaacttttcacatggtgaccatgctgagcaaggtgaacgtatggcgactgtacgtcgcgcggaagaattggcacgtcaaaaggttggattccttcttgatactaaaggacctgaaatgcgtacagaattgtttgcagatggtgtcaaagaatatgaatataagactggtgataaacttcgtatagcaactaaacaaggcattgaatcaactaaggatgtcattgctttaaatgttgcaggcggtcttgatatttatgatgatgttgctgtcggtcagactattcttattgatgatgggaaacttggccttacagtaaccgctaaagatattacaactcgcgagtttgaagtaaccgttgaaaatgatggcattattgctaaacaaaaaggtgtcaatattcctaatactaaaattcctttcccagcacttgctgagcgtgataatgcagatattcgctttggtttggaacaaggtcttaactttattgctatttcttttgttcgtactgctaaggatgttaatgaagttcgtcaaatttgtaaagaaacaggtaacgagcacgtaaaactttttgctaaaattgaaaatcaacaaggtattgataacattgatgaaatcattgatgcagctgacggtatcatgattgctcgcggtgacatgggtattgaagtgccgtttgaaatggttccagtttatcaaaaaatgattatcacgaaagttaatgcagcagggaagtcagctatcacagcaacaaatatgcttgaaacaatgactgacaaaccacgtgcaacacgttccgaagtctctgatgtctttaatgctgtcattgatggtactgatgcaacaatgctttctggtgaatcagctaatggtaagtatccagttgaagctgttcgtaccatggcaacaattgataagaatgctcaaacacttcttaatgaatatggccgtttgaattcagataatttgccacgtaccaacaagactgaggttgtcgcttcagctgttaaagatgcgactaaatcaatggatattaaattggttgttacaattacagaatctggtaacacagctcgtttaatttcaaaataccgtccggatgcagatatcttagctttaacatttgatgaaaaagtccaaaaatcattgatgattaactggggagttattccaatcttaacagaaaaacctgcatctactgatgatatgtttgaaattgcagaaaaagcagctcttaaatcaggtttggtagagtctggtgacaacatcgttattgttgctggtgtaccggttggatctggtggtaccaatactatgcgtgttcgtaccgttcaataa

SEQ ID NO: 7569 - protein, 500 aa, Streptococcus mutans
MNKRVKIVATLGPAVEIRGGKKFGEDGYWGEKLDVEASAAKIAELITEGANVFRFNFSHGDHAEQGERMATVRRAEELARQKVGFLLDTKGPEMRTELFADGVKEYEYKTGDKLRIATKQGIESTKDVIALNVAGGLDIYDDVAVGQTILIDDGKLGLTVTAKDITTREFEVTVENDGIIAKQKGVNIPNTKIPFPALAERDNADIRFGLEQGLNFIAISFVRTAKDVNEVRQICKETGNEHVKLFAKIENQQGIDNIDEIIDAADGIMIARGDMGIEVPFEMVPVYQKMIITKVNAAGKSAITATNMLETMTDKPRATRSEVSDVFNAVIDGTDATMLSGESANGKYPVEAVRTMATIDKNAQTLLNEYGRLNSDNLPRTNKTEVVASAVKDATKSMDIKLVVTITESGNTARLISKYRPDADILALTFDEKVQKSLMINWGVIPILTEKPASTDDMFEIAEKAALKSGLVESGDNIVIVAGVPVGSGGTNTMRVRTVQ

SEQ ID NO: 7570 - DNA, 1503 bp, Streptococcus agalactiae
  CDS (1)..(1503)
atgaataaacgcgtaaaaatcgttgcaacacttggtcctgcggtagaattccgtggtggtaagaagtttggtgagtctggatactggggtgaaagccttgacgtagaagcttcagcagaaaaaattgctcaattgattaaagaaggtgctaacgttttccgtttcaacttctcacatggagatcatgctgagcaaggagctcgtatggctactgttcgtaaagcagaagagattgcaggacaaaaagttggcttcctccttgatactaaaggacctgaaattcgtacagaactttttgaagatggttcagatttccattcatatacaacaggtacaaaattacgtgttgctactaagcaaggtatcaaatcaactccagaagtgattgcattgaatgttgctggtggacttgacatctttgatgacgttgaagttggtaagcaaatccttgttgatgatggtaaactaggtcttactgtgtttgcaaaagataaagacactcgtgaatttgaagtagttgttgagaatgatggccttattggtaaacaaaaaggtgtaaacatcccttatactaaaattcctttcccagcacttgcagaacgcgataatgctgatatccgttttggacttgagcaaggacttaactttattgctatctcatttgtacgtactgctaaagatgttaatgaagttcgtgctatttgtgaagaaactggcaatggacatgttaagttgtttgctaaaattgaaaatcaacaaggtatcgataatattgatgagattatcgaagcagcagatggtattatgattgctcgtggtgatatgggtatcgaagttccatttgaaatggttccagtttaccaaaaaatgatcattactaaagttaatgcagctggtaaagcagttattacagcaacaaatatgcttgaaacaatgactgataaaccacgtgcgactcgttcagaagtatctgatgtcttcaatgctgttattgatggtactgatgctacaatgctttcaggtgagtcagctaatggtaaatacccagttgagtcagttcgtacaatggctactattgataaaaatgctcaaacattactcaatgagtatggtcgcttagactcatctgcattcccacgtaataacaaaactgatgttattgcatctgcggttaaagatgcaacacactcaatggatatcaaacttgttgtgacaattactgaaacaggtaatacagctcgtgccatttctaaattccgtccagatgcagacattttggctgttacatttgatgaaaaagtacaacgttcattgatgattaactggggtgttatccctgtccttgcagacaaaccagcatctacagatgatatgtttgaggttgcagaacgtgtagcacttgaagcaggacttgttgaatcaggcgataatatcgttatcgttgcaggtgttcctgtaggtacaggtggaactaacacaatgcgtgttcgtactgttaaataa

SEQ ID NO: 7571 - protein, 500 aa, Streptococcus agalactiae
MNKRVKIVATLGPAVEFRGGKKFGESGYWGESLDVEASAEKIAQLIKEGANVFRFNFSHGDHAEQGARMATVRKAEEIAGQKVGFLLDTKGPEIRTELFEDGSDFHSYTTGTKLRVATKQGIKSTPEVIALNVAGGLDIFDDVEVGKQILVDDGKLGLTVFAKDKDTREFEVVVENDGLIGKQKGVNIPYTKIPFPALAERDNADIRFGLEQGLNFIAISFVRTAKDVNEVRAICEETGNGHVKLFAKIENQQGIDNIDEIIEAADGIMIARGDMGIEVPFEMVPVYQKMIITKVNAAGKAVITATNMLETMTDKPRATRSEVSDVFNAVIDGTDATMLSGESANGKYPVESVRTMATIDKNAQTLLNEYGRLDSSAFPRNNKTDVIASAVKDATHSMDIKLVVTITETGNTARAISKFRPDADILAVTFDEKVQRSLMINWGVIPVLADKPASTDDMFEVAERVALEAGLVESGDNIVIVAGVPVGTGGTNTMRVRTVK

SEQ ID NO: 7572 - DNA, 1440 bp, Shewanella oneidensis
  CDS (1)..(1440)
atgttccgcagaaccaaaatcgtcaccacactgggtcccgccactgaccgtgacgataacttacgccgtattattgcggcaggtgcaaacgttgttcgtcttaacttctcccacggctcccccgaagatcatctcaaacgcgctactcaagctcgcgaaatcgcaaaagaattaggtgtacatgttgctattttaggtgacctacaaggccctaaaatccgtgtgtctacctttaaagacaacaagaaaattcaactgaaattaggccaaacctatattcttgacgccgaacttgctaaaggtgaaggcgatgagaatcaagtcggtatcgactataagcaattgcctgatgatgtgaatgttggcgacatcctgatgctcgatgacggccgagtacaactgcgtgttgagcgcgttgaaggtcgtaaagtccatactactgtgacggttgcaggtcctttatcgaacaataaagggatcaacaagcaaggtggtggtttgtcggctgcggcactaactgaaaaagacaaggcagacattctcaccgcagctatgatccaagtggattacttagccgtgtcattcccacgtagcggtgcagatctcgaatatgcacgctctttagcgcagcaggctggcagtaacgcactgatcgtcgcgaaggttgaacgtgcagaagcggttgccagtgatgaagcaatggatgatgtgattttagcctctgatgttgtgatggttgcccgcggtgatttaggggttgagattggtgatgctgcactggtagcagtacaaaagaaactcatcgcccgttcacgtcagctcaataaaatcgtcatcaccgcgacccaaatgatggaatcgatgatctcgagcccaatgccaacccgtgcagaagtgatggacgtggcaaacgccgtgcttgatggtaccgacgctgtgatgttatcagccgaaaccgcagcgggtgacttcccagaagaaactgttaaagcaatggcgaatgtgtgtgtcggtgcagaatctcacccaagtgtgaaagtttctaagcacagattagatgcacgtttcacgtcggttgaagaaaccatcgccctatcgactatgtatgcggcaaaccacctagaaggtgttaaagcgattatcgctttaacagagtcaggtgcgacacctaaactgatgtcgcgtatcagttcatctttaccaatccttggcctatctcgccatgacacaacactggcgaagatggctctgtaccgtggtgtactaccgatttacttcgactcaacgatctatccagccgatgagcttgcacaaaaagcattggaatcattaaccaaagcgggttacttgcacagcggtgacttagtgttaatgaccaaaggtgatgcgatggaaaccatcggtggcacgaacacttgtaaagtgctgattgtcgcttaa

SEQ ID NO: 7573 - protein, 479 aa, Shewanella oneidensis
MFRRTKIVTTLGPATDRDDNLRRIIAAGANVVRLNFSHGSPEDHLKRATQAREIAKELGVHVAILGDLQGPKIRVSTFKDNKKIQLKLGQTYILDAELAKGEGDENQVGIDYKQLPDDVNVGDILMLDDGRVQLRVERVEGRKVHTTVTVAGPLSNNKGINKQGGGLSAAALTEKDKADILTAAMIQVDYLAVSFPRSGADLEYARSLAQQAGSNALIVAKVERAEAVASDEAMDDVILASDVVMVARGDLGVEIGDAALVAVQKKLIARSRQLNKIVITATQMMESMISSPMPTRAEVMDVANAVLDGTDAVMLSAETAAGDFPEETVKAMANVCVGAESHPSVKVSKHRLDARFTSVEETIALSTMYAANHLEGVKAIIALTESGATPKLMSRISSSLPILGLSRHDTTLAKMALYRGVLPIYFDSTIYPADELAQKALESLTKAGYLHSGDLVLMTKGDAMETIGGTNTCKVLIVA

SEQ ID NO: 7574 - DNA, 1761 bp, Oceanobacillus iheyensis
  CDS (1)..(1761)
atgagaaacacaaaaatcgtatgtacaattggtcctgcatcagaatcaattgaaaagttagagcaacttattgaagcaggaatgaacgtagctcgtctcaacttttctcatggagattatgcagagcatggcgcacggattgaaaatatccgaaaagcagctaaaaataaaaataaaacagtagcaattcttttagatactaaaggaccagagattcgtactggtagctttaaagaaggtagagcagatcttatgcagggcaaccctgtaacaatcgctatggatgaagtagaggggactgctgagaaattctctgttacataccaagggctaatcaatgatgtacatgaaggttcaaagattcttttggatgatggacttattgaattagaagtaaaatctattgataaaagtaaaggtgaaattgaaactattgcacttaactctggggaaataaagaataaaaaaggtgttaacgttcctaatgtttctgtaaatctacccggtataacagaaaaagacaccaatgatattatctttggaattgaacagggtgttgattttattgctgcatcttttgtgcgtcgagcttcggatattttagaaattaaagaagtgctagatcagcatcaggcacagtatataaaaatcatccctaaaattgagaaccaagaaggtgtcgataatatcgatagtattcttgaggtaagtgatggattaatggtagctcgtggtgatttaggagtggagatcccagctgaagatgtaccattggtacagaaaaaattaattaagcaatgtaataatgctggaaagccagtaattactgctacacaaatgttagattcgatgcagcgtaatccacgacctacacgtgcagaagcatcagacgttgctaatgcgatttttgatggcacagatgcaattatgctttctggagaaactgctgcgggaacctacccagtagaatctgtacaaacaatgagtaatattgcactaaaagctgaatctgcattagatcataaacaaatgttagaagaacgttcacaatatgtcgatatgactataacagaagcaattagtcaatccgttacgcacacagcatccaatttaaatgttgatacaattatcacaccgacagaaagcggacatacagctagaatgatttctaaataccgtccgaaagcttccattctagcagttacttttaacgaagtagtaaatcgtcaactatccttagtttggggagtgcatgctgttctgggtaaaccagcgacgtctactgacgaaatgctagaaattgcagttgataaaggattaaatacaggaatctgcagtagaggaagccgtgtcattattacggctggtgtacctgttggagagagtggaacaactaacctgttaaaagttcatgtgattggtgatgtgattgctaaaggacaaggaattggaagaagaagtgcatatggacatgccgtatttgctaaaacgaataaagaagctttagaaaaagtacaagacggtgatattttagtaacctatgcaacagaaaaagaaatgatgcctgcaattgaaaaagcatcagctattattacagaagaaggtggattaacttctcatgcagctgttgtcggattaagtcttggaattccagtaattgttggggttgacaatgtatttgaaattcttcaagatggacaagatattactgtagatggtaaccgtggagatatctacgctggccatgcaggtgtattgtaa

SEQ ID NO: 7575 - protein, 586 aa, Oceanobacillus iheyensis
MRNTKIVCTIGPASESIEKLEQLIEAGMNVARLNFSHGDYAEHGARIENIRKAAKNKNKTVAILLDTKGPEIRTGSFKEGRADLMQGNPVTIAMDEVEGTAEKFSVTYQGLINDVHEGSKILLDDGLIELEVKSIDKSKGEIETIALNSGEIKNKKGVNVPNVSVNLPGITEKDTNDIIFGIEQGVDFIAASFVRRASDILEIKEVLDQHQAQYIKIIPKIENQEGVDNIDSILEVSDGLMVARGDLGVEIPAEDVPLVQKKLIKQCNNAGKPVITATQMLDSMQRNPRPTRAEASDVANAIFDGTDAIMLSGETAAGTYPVESVQTMSNIALKAESALDHKQMLEERSQYVDMTITEAISQSVTHTASNLNVDTIITPTESGHTARMISKYRPKASILAVTFNEVVNRQLSLVWGVHAVLGKPATSTDEMLEIAVDKGLNTGICSRGSRVIITAGVPVGESGTTNLLKVHVIGDVIAKGQGIGRRSAYGHAVFAKTNKEALEKVQDGDILVTYATEKEMMPAIEKASAIITEEGGLTSHAAVVGLSLGIPVIVGVDNVFEILQDGQDITVDGNRGDIYAGHAGVL

SEQ ID NO: 7576 - DNA, 1497 bp, Mycoplasma penetrans
  CDS (1)..(1497): transl_table=4
atgaaaatgattaaaaaaactaaaattactgcaactttaggaccatcaattactggaaaaattttcacattagcagattttaacaaacctgaaaacaagggagttattgaaactgctaagaaaaatttagcagctttatttgatgcaggtgtgaatgtagtaagatttaacttttctcatggtgattatgaagaacaaacaattagattaaacctagttagagaagttgctaaagaaaaaggtgttaacatttctacaatgttagacacaaaaggaccagaaatccgtgtttacaaaacaagtgaaaaagaagttgaaattaaatcagatagtaaagtaagaatttatacaactaaaaaagaaattggtacaagtgaaaaattctctgttttagattctactggtacatacaacatggcaaaagatgttcaaccaggaaatacaatttttgtagatgatggaaaattgaaattagaagtaatttcatcaaatgttgaagaaggaattattgaaacaattgcacgtaacacttgaattcttagagaaaacaaaagaattaatttaccagactctaattattcaattccttttatgtctgataaagatagaaatgatattatttttgcaattaaaaataaatttgattacattgcagcatcatttgtaaatacaggtgataatgtaagagaaattaaaaaaatcttaaaagaacatggtggagaacacatccaaatcatttctaaaattgaaactatgactggaattaaatcattagatgacattatcgatgaatcagattcaataatggttgctagaggtgatctaggattagaagtaccttactatgatgtaccaacatatgaaaaatacattattaaagattgtagacataaaggtaaaactgtaattgttgcaactcaaatgttagattcattagaaactaaaatccaaccaacaagagcagaagttactgacgtgttttttgcagttgaaagaggaacagactgtactatgctttctggagaaactgcaaatgggatgtatccaattaatgcagtagaagtaatggctaaaattgatgtttcatctgaaaatttctttgactatggaagagcaattgatgtttatttcaaagaaactccatttatgaaagaaaaagttggaactttagctactactatagcaactcttgttgctccaaaaagagtaattgataaccatggttttgactactcttcaattgtggtatttggaaatgatacaagattaatccaagcattatctaatataagatgtgcagctccaattttctttgttactgataaaaaagaatatgctacaagatttgggcttaactatggggtatttgtaaaagttgttgataatgttgaacatgcaattgcaaataaaactgaaattatagatgcaattaatagccaacttcctgaagttaaaaaaacagttgttgttataaatgattcaatttataaacattaa

SEQ ID NO: 7577 - protein, 498 aa, Mycoplasma penetrans
MKMIKKTKITATLGPSITGKIFTLADFNKPENKGVIETAKKNLAALFDAGVNVVRFNFSHGDYEEQTIRLNLVREVAKEKGVNISTMLDTKGPEIRVYKTSEKEVEIKSDSKVRIYTTKKEIGTSEKFSVLDSTGTYNMAKDVQPGNTIFVDDGKLKLEVISSNVEEGIIETIARNTWILRENKRINLPDSNYSIPFMSDKDRNDIIFAIKNKFDYIAASFVNTGDNVREIKKILKEHGGEHIQIISKIETMTGIKSLDDIIDESDSIMVARGDLGLEVPYYDVPTYEKYIIKDCRHKGKTVIVATQMLDSLETKIQPTRAEVTDVFFAVERGTDCTMLSGETANGMYPINAVEVMAKIDVSSENFFDYGRAIDVYFKETPFMKEKVGTLATTIATLVAPKRVIDNHGFDYSSIVVFGNDTRLIQALSNIRCAAPIFFVTDKKEYATRFGLNYGVFVKVVDNVEHAIANKTEIIDAINSQLPEVKKTVVVINDSIYKH

SEQ ID NO: 7578 - DNA, 1584 bp, Escherichia coli O6
  CDS (1)..(1584)
atgacgatcgctaaaaacgactgtcactgtcctaatcttatacgacatccgaatgagattaatttatcgccatcgcggcgttatttcattcggatttcatgttcaagcaacacctggttgtttcagtcaacggagtattacatgtccagaaggcttcgcagaactaaaatcgttaccacgttaggcccggcaacagatcgcgataataaccttgaaaaagttatcgcggcgggtgccaacgttgtacgtatgaatttttctcacggctcgcctgaagatcacaaaatgcgcgcggataaagttcgtgagattgccgcaaaactggggcgtcatgtggctattctgggtgacctccaggggcccaaaatccgtgtatccacctttaaagaaggcaaagttttcctcaatattggggataaattcctgctcgacgccaacctgggtaaaggtgaaggcgacaaagaaaaagtcggtatcgactacaaaggcctgcctgctgacgttgtgcctggtgacatcctgctgctggacgatggtcgcgtccagttaaaagtactggaagtccagggcatgaaagtgttcaccgaagtgaccgtcggtggtcccctctccaacaataaaggtatcaacaaacttggcggcggtttgtcagctgaagcgctgaccgaaaaagacaaagcagacattaagactgcggcgttgattggcgtagattacctggctgtctccttcccacgctgcggcgaagatctgaactatgcccgtcgtctggcacgcgatgcaggatgtgatgcgaaaattgttgccaaggttgaacgtgcggaagccgtttgcagccaggaggcaatggatgacatcatcctcgcctctgacgtggtaatggttgctcgcggcgacctcggtgtggaaattggcgatccggaactggtcggcattcagaaagcgttgatccgtcgtgcgcgtcagcttaaccgcgcggtaatcacggcgacccagatgatggagtcaatgattactaacccgatgccgacgcgtgcagaagtcatggacgtagcaaacgccgttctggatggtactgacgctgtgatgctgtcggcagaaactgctgctggtcaatacccgtcagaaactgttgcagccatggcgcgcgtttgcctgggggcggaaaaaatcccgagcatcaacgtttctaaacaccgtctggacgttcagttcgacaatgtggaagaagctattgccatgtcagcaatgtacgcggctaaccacctgaaaggcgttacggcgatcatcaccatgaccgaatcgggtcgtaccgcgctgatgacctcccgtatcagctctggtctgccaattttcgccatgtcacgccatgaacgtacgctgaacctgactgctctctatcgcggcgttacgccggtgcactttgatagcgctaatgacggtgtagcagctgccagcgaagcggttaatctgctgcgtgataaaggttacttgatgtctggtgacctggtgattgtcacccagggcgacgtgatgagtaccgtgggttctactaataccacgcgtattttaacggtagagtaa

SEQ ID NO: 7579 - protein, 527 aa, Escherichia coli O6
MTIAKNDCHCPNLIRHPNEINLSPSRRYFIRISCSSNTWLFQSTEYYMSRRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGIDYKGLPADVVPGDILLLDDGRVQLKVLEVQGMKVFTEVTVGGPLSNNKGINKLGGGLSAEALTEKDKADIKTAALIGVDYLAVSFPRCGEDLNYARRLARDAGCDAKIVAKVERAEAVCSQEAMDDIILASDVVMVARGDLGVEIGDPELVGIQKALIRRARQLNRAVITATQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVHFDSANDGVAAASEAVNLLRDKGYLMSGDLVIVTQGDVMSTVGSTNTTRILTVE

SEQ ID NO: 7580 - DNA, 1437 bp, Brucella suis
  CDS (1)..(1437)
atgaagcgcaaccgcaaggtcaagattctcgccacgctaggtccagcctctggcgaggaagccgtcatccgcaagctctttgaagcaggagcggatgtcttccgcatcaatatgagtcacgccgaccatgacctgatgcgaaccttggtcaagcgcattcgcaatgtagaaaaggaactgggacgccccatcggcattctggccgatcttcaggggccgaagctgcgcgttggcaagttcaaggatggcaaggtcgatctcgttcccggccagaccttcaccctcgacaataacgaggcgctgggcgatgaaacccgcgttttcctgccgcatcctgaaattctggaagctgtcgagccgggccatcgcctgttgatcgatgacggaaaactgcatctggtggctgaagcctgcgacggcaagtcgatccgctgcaaggttgtttccggcacccgcatttccgaccgcaagggggtcagccttcccgacacgacgctcggcgttggcgcgctgacggagaaagaccgctgcgatcttgatgccgtgctgaaggaagagatcgattgggtggcgctttcctttatccagcgcccggaagatctggccgaagtgcgcaaggtttcgcgcggcaaggtcggcctcatgtccaagatcgaaaagccgcaggctgttacccgtcttgatgaaattatcgagctttccgacgccttgatggttgcccgcggcgatctcggtgttgaagtgccgcttgaaaacgttcccggcattcaaaagcagattacccgcaaggcgcgtcgcgccggcaagccggtcgttgtcgcaacccagatgctggaatcgatgattaccgcgccggtgcccacccgcgctgaagtgtccgacgtggcgactgcggtgtttgaaggtgcggatgcaatcatgctttcggcggaatctgcttccggccaatatccggtcgaagctgttgcaaccatgaaccgcatcgccgagcaggtggagcgcgagccgacctattcgaccatcattgacgcacagcgcgccatgccggagccgactggcgccgacgctatctcgctcgccgcgcgtcagattgctgaaacgttgaaactctcggccatcgtgacctatacggcttccggcacgaccggcctgcgcgctgcccgcgagcgtccgcgcacacccattatcgcgctgtcgcccgttgttgataccgcccgtaaactgtccctcgtatggggcctgcattgcgtcgtcacagatgatgcccatgatcttgaagacatggtcaatcatgcctgcgaaatcgtgttccatgaggaattcggcaaagctggcgatcgcgtcatcatcacggcaggcgttcccttcggaacgccgggtgcaaccaatatgctgcgtatcgcctatataggcgctgacggaaaatccggcatttag

SEQ ID NO: 7581 - protein, 478 aa, Brucella suis
MKRNRKVKILATLGPASGEEAVIRKLFEAGADVFRINMSHADHDLMRTLVKRIRNVEKELGRPIGILADLQGPKLRVGKFKDGKVDLVPGQTFTLDNNEALGDETRVFLPHPEILEAVEPGHRLLIDDGKLHLVAEACDGKSIRCKVVSGTRISDRKGVSLPDTTLGVGALTEKDRCDLDAVLKEEIDWVALSFIQRPEDLAEVRKVSRGKVGLMSKIEKPQAVTRLDEIIELSDALMVARGDLGVEVPLENVPGIQKQITRKARRAGKPVVVATQMLESMITAPVPTRAEVSDVATAVFEGADAIMLSAESASGQYPVEAVATMNRIAEQVEREPTYSTIIDAQRAMPEPTGADAISLAARQIAETLKLSAIVTYTASGTTGLRAARERPRTPIIALSPVVDTARKLSLVWGLHCVVTDDAHDLEDMVNHACEIVFHEEFGKAGDRVIITAGVPFGTPGATNMLRIAYIGADGKSGI

SEQ ID NO: 7582 - DNA, 1530 bp, Bifidobacterium longum
  CDS (1)..(1530)
atgagtcggctcgcgctagtagactgggtttcggcaaatggggcaatcgcgcctcgaaccaaattgaacaagaataggcaggcattcatgcgtaaagccaagatcgtagacaccatcggtccttccaccgaggattacgacaacctcctgaagctcgttgaagctggtatggacgttgctcgtctgaaccgctcccacggcacccccgaggatcacctcaaggtctacaacaacgtgcgcaaggccagcgaagccactggtcgcaacgttgccgcgctcgttgatttgcagggcccgaagattcgctgcggttggttcaagaagaacgccgatggcgaagacaaggttcagctgcagctcggccaggaattcgtcatcaccactgatgacgtcgagggcgacgagcacatcacctccaccaccttcaagggcctgccgggcgattgccacccgggcgacccgatcctgatcgatgacggcaaggtccgtcttgaggtcaccaaggtcgagggcaacaacgtgtacaccaaggtcgtcgtggccggtcctgtgtcctcccacaagggcatcaacctgccgggcgtcgccgtctccctgccggctctgaccgagaaggatgaggccgacctgcgttgggccatccgcaccggtgccgacatcatcgccatgtccttcgtgcgtttcgccaccgacatcgaccgcgcccacgagatcatggacgaggaaggccgtcgcatcccgatcatcgccaagatcgagaagccgcaggctctggagaacctcgaagagatcgtcaagaccttcgacggcgtcatggccgcccgtggcgacatggccgttgagtgcccgctggaagaggtcccgctggccactaagcgcatcatcgagctggctcgccagtacgccaagccggtcatcgtggctaccgaagtcctcggctccatggtgaactccccggttccgactcgtgcagaggcttccgactgcgccaacgccatcctcgacggctccgacgccaccatgacctccaacgagaccgccgttggtaagtacccggatgtgaccgtggccaccatggcccgtatctccggctacgccaccgaccacggcttcgaccgtatcccggagctcaagaaccttgacatgtcctccaccggcgctgtctcctccgccgctgtggacctggccgacaagctcaacgccaaggccatcgttgcttacacccagaccggtgccaccgtgcaccgcgtctcccgtgagcgtccggccgccccgatctacggcctgaccagcaacgagcacacctaccactggctggctctgtcctggggcaccgaagccttcctgctcaaggaggactaccacgacaagtcccgcaaggatctcatggtctacacggacaaggtcctcaaggatgctggcaaggttgctgacggcgacaagatcgtcatcctgagctctgctcagggcgatcaccagccgggccgcactgactccatctacgtgcacaccgttggcgcttgcgactga

SEQ ID NO: 7583 - protein, 509 aa, Bifidobacterium longum
MSRLALVDWVSANGAIAPRTKLNKNRQAFMRKAKIVDTIGPSTEDYDNLLKLVEAGMDVARLNRSHGTPEDHLKVYNNVRKASEATGRNVAALVDLQGPKIRCGWFKKNADGEDKVQLQLGQEFVITTDDVEGDEHITSTTFKGLPGDCHPGDPILIDDGKVRLEVTKVEGNNVYTKVVVAGPVSSHKGINLPGVAVSLPALTEKDEADLRWAIRTGADIIAMSFVRFATDIDRAHEIMDEEGRRIPIIAKIEKPQALENLEEIVKTFDGVMAARGDMAVECPLEEVPLATKRIIELARQYAKPVIVATEVLGSMVNSPVPTRAEASDCANAILDGSDATMTSNETAVGKYPDVTVATMARISGYATDHGFDRIPELKNLDMSSTGAVSSAAVDLADKLNAKAIVAYTQTGATVHRVSRERPAAPIYGLTSNEHTYHWLALSWGTEAFLLKEDYHDKSRKDLMVYTDKVLKDAGKVADGDKIVILSSAQGDHQPGRTDSIYVHTVGACD

SEQ ID NO: 7584 - DNA, 1890 bp, Lactobacillus delbrueckii
  CDS (1)..(1770)
atgaaaaaaacaaagattgttagtactttaggaccagcttcaaacgatattgaaactattaccaagttagccgaagcaggcgcaaacgtattccgtttcaacttctcacacggcgaccacgaagaacacttggcaagaatgaacatggttcgtgaagttgaaaagaagactggcaagcttttgggcatcgctttggacaccaagggtgctgaaatcagaaccactgaccaagaaggcggcaagttcactatcaacactggtgacgaaatccgcgtgtcaatggacgcaactaaggccggcaacaaggacatgatccacgttacctacccaggtctgttcgacgacactcacgtaggcggcactgtattgatcgacgacggtgctgttggtttgactatcaaggccaaggacgaagaaaagcgcgaattgatttgtgaagctcaaaacactggtgtcatcggctcaaagaagggtgttaacgctccaggtgttgaaatccgcctcccagggattactgaaaaggacactgacgacatccgctttggtttgaagcacggtattaacttcatctttgcttcttttgtacgtaaggctcaagacgttcttgacattcgcgcactttgcgaagaagctaacgcaccatacgttaagatcttcccaaagattgaatcacaagaaggtattgacaacatcgacgaaatcttgcaagtttcagatggtttgatggttgcccgtggtgacatgggtgttgaaatcccattcatcaacgtgccatttgttcaaaagactttgatcaagaagtgcaacgctttgggcaagccagttatcactgctactcaaatgctggactcaatgcaagaaaacccacgtccaacccgtgccgaagtaactgacgttgctaacgccgttcttgacggtactgacgcaactatgctgtcaggcgaatcagcaaacggtttgtacccagtagaatcagttcaagctatgcacgacatcaatgttcggactgaaaaggaaatggacacccggaacactctggctctgcaacgctttgaagaatacaagggctcaaacgttactgaagctatcggcgaatcagttgtccgcactgctcaagaactgggcgttaagactatcatcactgctactagctccggctacacagctcgtatgatctccaagtaccgtccagacgcaaccatcgttgccttgactttcgacgaaaagatccaacactcattgggtatcgtttggggcgttgaaccagttttggcaaagcaaccttcaaacactgacgaaatgttcgaagaagctgcccgcgtagctaaggaacacggtttcgttaaggatggcgacctggtaatcatcgttgccggcgtaccattcggccaatcaggtactactaacttgatgaagctgcaaatcatcggcaaccaacttgctcaaggtttgggcgtaggcactggctcagttatcggcaaggctgttgttgcgaacagcgctgaagaagccaacaataaggttcacgaaggcgacatcctggtagctaagactactgacaaggactacatgccagctatcaagaaggccagcggtatgatcgttgaagcttccggcttgaccagccacgcagctgttgtcggcgtatcactcggcattccagttgttgtcggtgctgctgacgcaacttcaaagatcgctgacggctcaactttgactgttgacgcacgtcgcggcgcaatttaccaaggtgaagtttcaaacctgtaatctaggattgcaagtctgacaaccacagaagaaagagttcaatcaatcgattgagctctttttctttgccaattttttctctgctttctttaatgattgccttgaatatagctaaggcaa

SEQ ID NO: 7585 - protein, 589 aa, Lactobacillus delbrueckii
MKKTKIVSTLGPASNDIETITKLAEAGANVFRFNFSHGDHEEHLARMNMVREVEKKTGKLLGIALDTKGAEIRTTDQEGGKFTINTGDEIRVSMDATKAGNKDMIHVTYPGLFDDTHVGGTVLIDDGAVGLTIKAKDEEKRELICEAQNTGVIGSKKGVNAPGVEIRLPGITEKDTDDIRFGLKHGINFIFASFVRKAQDVLDIRALCEEANAPYVKIFPKIESQEGIDNIDEILQVSDGLMVARGDMGVEIPFINVPFVQKTLIKKCNALGKPVITATQMLDSMQENPRPTRAEVTDVANAVLDGTDATMLSGESANGLYPVESVQAMHDINVRTEKEMDTRNTLALQRFEEYKGSNVTEAIGESVVRTAQELGVKTIITATSSGYTARMISKYRPDATIVALTFDEKIQHSLGIVWGVEPVLAKQPSNTDEMFEEAARVAKEHGFVKDGDLVIIVAGVPFGQSGTTNLMKLQIIGNQLAQGLGVGTGSVIGKAVVANSAEEANNKVHEGDILVAKTTDKDYMPAIKKASGMIVEASGLTSHAAVVGVSLGIPVVVGAADATSKIADGSTLTVDARRGAIYQGEVSNL

SEQ ID NO: 7586 - DNA, 2043 bp, Stigmatella aurantiaca
  CDS (463)..(1896)
ctgcagcgcctcttcgacacggtgaaccggctgtacttccaggatggcatccaggcccggatcggctggggccgcatgccgccccggcgccgccggaagtccattcgtttgggtgtctatgatcatcagacgcgggagatccgcatccacccggcgctggaccggccggaggtgcccgcgttctttgtggagttcatcgtcttccacgaaatgctccaccagttgtttcccagcacgggccggggcgggcgccgggtgcaccacccgcgcgcgttccgggagcgggagaaggccttcccccactacggcctggcgctgcggtgggagcgggagaatctgggcgtgctgctccggggctgaagccctgggccgcctggaggcccttttaccgttttaccgggcggtggacgtgcgcagcatgcttgaccgagcgcggtgcgcgcccccatcctccgtgcccttatgcgacgagcaaagattgtctgcacccttggtcccgccagccagagccaggacatgttagaggccctcatcgaggccggcatggacgtggcccggttgaacttctcccacggcagtcacgagcagcacgcggagaacatcgccaaactccgcgcggcttcgctgaagcttcgcaaggcggtgggcatcctcggagacctgcaaggaccgaagatccgcacgggccgcttcatcaccggcagcacggtgctgaaggaaggcgccatcttttccatcaccaccgacgagagcgtgaagggcaacgacgacatcgtgtccaccacgtacgcgcacctggcggcggacgtgaatcccggggaccgcatcctcttggatgacggcctgctggagctcaaggtcctcgagacggacaagaagcagctcctgcgcacgcaggtcgtcatcggcggcacgctgaagaacaacaagggcatcaacctgccgggcgtggcggtgcgcgccgacgcgctgacgccgaaggaccgcgaggacctcgtcttcggcatcaaggaaggcgtggacttcctggcgctgtccttcgttcgccagccggcggacatcgagctggcgcgccaggccatggcggaggcgggccggcaggtgcccatcgtcgccaagctggagaagccggaggccatcgcgcggctggacgccatcctggacaagacggacggggtgatggtggcgcgcggcgacctgggcgtggagattccccccgaggaggtgccggccgtccagaaggacatcatccggcgctccaaccagcgcggcctgccggtcatcgtggccacgcagatgctcaactcgatgatcgagaacccccgccccacgcgcgcggaggccagcgacgtggccaacgccgtgttcgacggggcggacgcggtcatgctctcgggcgagacggccagcggccgctaccccatcgagtcggtgcagatgatggaccgcatcgtcctggcggccgagtcggcgggtcgggcgcagtcgtcgctgggccggatcccggatgggcccatcggcgtgccctcgcacttcccggacgtgattgcccgggtggcgtgccaggcggcgcaggcgagcggcgcttcgctcatcgcggcgttcacgctgtcgggcgtgacggcgcggctgctggcgcactaccggccggcggtccccatcgtggcgttcagcccgaaccaggaagtgcgccgccgcctggcgctgctctggggcgtggtgccgcgggtgctggagcccatccaggagaccgaggcgatggtgaagcgcgtggaggaggaactgctggcgcgcggactggcgcgcaagggcgagcgcatcgtcatcgtctttggcgcgcccgtgggacagccagggaagatcaacagcctgcgcctgcacaccatccagggctgaggcgagggggcccgagggccccgggccgcgcgagggaggctacttcgcgcggttcatcaccttgcggacgatctccgcctcgttgaacaccgtgaggaggtcccggtcgagctggccggaggaggcctcccgggagaggatgtcgac

SEQ ID NO: 7587 - protein, 477 aa, Stigmatella aurantiaca
MRRAKIVCTLGPASQSQDMLEALIEAGMDVARLNFSHGSHEQHAENIAKLRAASLKLRKAVGILGDLQGPKIRTGRFITGSTVLKEGAIFSITTDESVKGNDDIVSTTYAHLAADVNPGDRILLDDGLLELKVLETDKKQLLRTQVVIGGTLKNNKGINLPGVAVRADALTPKDREDLVFGIKEGVDFLALSFVRQPADIELARQAMAEAGRQVPIVAKLEKPEAIARLDAILDKTDGVMVARGDLGVEIPPEEVPAVQKDIIRRSNQRGLPVIVATQMLNSMIENPRPTRAEASDVANAVFDGADAVMLSGETASGRYPIESVQMMDRIVLAAESAGRAQSSLGRIPDGPIGVPSHFPDVIARVACQAAQASGASLIAAFTLSGVTARLLAHYRPAVPIVAFSPNQEVRRRLALLWGVVPRVLEPIQETEAMVKRVEEELLARGLARKGERIVIVFGAPVGQPGKINSLRLHTIQG

SEQ ID NO: 7588 - DNA, 1584 bp, Arabidopsis thaliana
  CDS (1)..(1584)
atgcattcaagtcatctccttctcgaggaaccgatcaggatgacttcaatcctcgaaccttctaaatcaagtttcttcccggctttgactaagattgttgggactctaggtccgaaatctcgatccgtcgaggtgattgctggttgtctcaaagctggaatgtccgtggctcgattcgatttctcttggtgcgatgctgattatcaccaggagacgctggagaatctgaagatagctgtgaagagcactaagaagctttgtgctgttatgctagacactgtaggacctgagttgcaagttattaacaagactgagaaagctatttctcttaaagctgatggccttgtaactttgactccgagtcaagatcaagaagcctcctctgaagtccttcccattaattttgatgggttagcgaaggcggttaagaaaggagacactatctttgttggacaatacctcttcactggtagtgaaacaacttcagtttggcttgaggttgaagaagttaaaggagatgatgtcatttgtatttcaaggaatgctgctactctgggtggtccgttattcacattgcacgtctctcaagttcacattgatatgccaaccctaactgagaaggataaggaggttataagtacatggggagttcagaataagatcgactttctctcattatcttattgtcgacatgcagaagatgttcgccaggcccgtgagttgcttaacagttgtggtgacctctctcaaacacaaatatttgcgaagattgagaatgaagagggactaacccactttgacgaaattctacaagaagcagatggcattattctttctcgtgggaatttgggtatcgatctacctccggaaaaggtgtttttgttccaaaaggctgctctttacaagtgtaacatggctggaaagcctgccgttcttactcgtgttgtagacagtatgacagacaatctgcggccaactcgtgcaggggcaactgatgttgctaatgctgttttagatggaagtgatgcaattcttcttggtgctgagactcttcgtggattgtaccctgttgaaaccatatcaactgttggtagaatctgttgtgaggcagagaaagttttcaaccaagatttgttctttaagaagactgtcaagtatgttggagaaccaatgactcacttggaatctattgcttcttctgctgtacgggcagcaatcaaggttaaggcatccgtaattatatgcttcacctcgtctggcagagcagcaaggttgattgccaaataccgtccaactatgcccgttctctctgttgtcattccccgacttacgacaaatcagctgaagtggagctttagcggagcctttgaggcaaggcagtcacttattgtcagaggtcttttccccatgcttgctgatcctcgtcaccctgcggaatcaacaagtgcaacaaatgagtcggttcttaaagtggctctagaccatgggaagcaagccggagtgatcaagtcacatgacagagttgtggtctgtcagaaagtgggagatgcgtccgtggtcaaaatcatcgagctagaggattag

SEQ ID NO: 7589 - protein, 527 aa, Arabidopsis thaliana
MHSSHLLLEEPIRMTSILEPSKSSFFPALTKIVGTLGPKSRSVEVIAGCLKAGMSVARFDFSWCDADYHQETLENLKIAVKSTKKLCAVMLDTVGPELQVINKTEKAISLKADGLVTLTPSQDQEASSEVLPINFDGLAKAVKKGDTIFVGQYLFTGSETTSVWLEVEEVKGDDVICISRNAATLGGPLFTLHVSQVHIDMPTLTEKDKEVISTWGVQNKIDFLSLSYCRHAEDVRQARELLNSCGDLSQTQIFAKIENEEGLTHFDEILQEADGIILSRGNLGIDLPPEKVFLFQKAALYKCNMAGKPAVLTRVVDSMTDNLRPTRAGATDVANAVLDGSDAILLGAETLRGLYPVETISTVGRICCEAEKVFNQDLFFKKTVKYVGEPMTHLESIASSAVRAAIKVKASVIICFTSSGRAARLIAKYRPTMPVLSVVIPRLTTNQLKWSFSGAFEARQSLIVRGLFPMLADPRHPAESTSATNESVLKVALDHGKQAGVIKSHDRVVVCQKVGDASVVKIIELED

SEQ ID NO: 7590 - DNA, 1437 bp, Bartonella henselae
  CDS (1)..(1437)
atgaagcgtgcacgtaaagtaaaaattatagccactcttggcccttcttcgttttctatttccatgattgagaagctttttatggcgggagcagatgtttttcgtttgaatatgagccatactgaccgtgaaacaatggttgatttggttcagcgcatacggaaggttgaaaaaactgttcgccggccaatcggtattttagtagatctccagggaccaaaattacgcgtcggctgttttgataaagggcaagaagatttgcgtattgggcaaagttttaccttggatgatcgtgatattcttggtgatgcgcagcgtgttttttttccgcacggggaggtgctggcagctattaaacccggtgatcggttgttaattgatgatggaaagttggaactgcttgcacaggtgtgtgatggtcattctgtgcagtgccttgtggttgctgggaaccgtatttctgatcgaaaaggggtaagtcttcccgatacagttttgccttttgggccaatgactctcaaggataaagccgatcttcaggcagttttggagcagcctgttgattgggttgctctgtcttttatccagcgtccggaagatattatagcagtgcgtgcgttgaccaaaagcaaagtgtctttgatggctaagatcgaaaaacctcaagctttggagcatatagaagagattattgatgttgccgatggtattatgattgcacgcggagatctgggggtagaaatgcccttggagagggttcctgccattcagatggaacttataaaagcttgtcgtttagctggaaagcccgtcgtggtggccacgcaaatgctcgagtcaatgattacgtcatctgttcctacaagggcagaagtttctgatgttgcgacagcagtttatacgggaactgacgctgtcatgttgtctgcggaatctgcctctggtcgttatcctgaagaagctgtgctgatgatggatcgaatcgcacaacaaattgaacaagatcagacttatgcggctcaagttggcgcacagcatcctgctccagaatcaacggggaccgatgcgatttctctcgctgcgcgtcagatcgccgaaacactgcaattgacagctatcgttgcttatactgcttcaggcacaacgggtgtgcgcacatcacgggagcgtccaaacaggcccattattgccttatcgcctattgtaaaaacagcaagacgtttggctttggtctggggacttcattgtgtggtcactgaagacgcgcgggatttggaggatatggttgatcgtgcggctgcgattgcttttcaagaaggcttttgccaagggggagatcgcttccttgtgacagctggtgttcctcttggtacacctggtgctaccaatctcttgcgtatcgcttctgtttctcaagatggaacaaagggtgtttaa

SEQ ID NO: 7591 - protein, 478 aa, Bartonella henselae
MKRARKVKIIATLGPSSFSISMIEKLFMAGADVFRLNMSHTDRETMVDLVQRIRKVEKTVRRPIGILVDLQGPKLRVGCFDKGQEDLRIGQSFTLDDRDILGDAQRVFFPHGEVLAAIKPGDRLLIDDGKLELLAQVCDGHSVQCLVVAGNRISDRKGVSLPDTVLPFGPMTLKDKADLQAVLEQPVDWVALSFIQRPEDIIAVRALTKSKVSLMAKIEKPQALEHIEEIIDVADGIMIARGDLGVEMPLERVPAIQMELIKACRLAGKPVVVATQMLESMITSSVPTRAEVSDVATAVYTGTDAVMLSAESASGRYPEEAVLMMDRIAQQIEQDQTYAAQVGAQHPAPESTGTDAISLAARQIAETLQLTAIVAYTASGTTGVRTSRERPNRPIIALSPIVKTARRLALVWGLHCVVTEDARDLEDMVDRAAAIAFQEGFCQGGDRFLVTAGVPLGTPGATNLLRIASVSQDGTKGV

SEQ ID NO: 7592 - DNA, 1533 bp, Glycine max
  CDS (1)..(1533)
atggcgaacatagacatcgaagggatcttgaagcagcagcctgatgatgggcgcgttccgaagacgaaaatagtgtgtactttgggccccgcttctcgatccgtggaaatgactgagaagcttcttagggctgggatgaacgttgctcgtttcaatttctctcatggcacccacgactatcatcaggaaaccctcaacaatctcaagactgctatgcacaacactggtatactctgtgccgtcatgcttgacactaagggacctgagattcggactggttttctgaaagatggaaaacctattcaacttaaggaaggacaagaaatcaccataactactgattatgacattaagggggatcaggagatgatatccatgagttacaagaagctgcctgtccacttgaagcctggaaacaccatattgtgctctgatgggacgattactctcactgtcttatcttgtgatcctgatgctggtactgttagatgtcgttgtgaaaacactgctacgttgggtgagagaaaaaatgttaaccttcctggtgttgttgttgatctccccacacttactgagaaggataaggaagatattcttcaatggggtgtacccaacaagattgacatgattgctctttcatttgttcgcaaaggctcagatcttgttaatgtccgcaaggttctcgagccacatgcaaagactattcagttgatgtctaaggttgagaatcaggaaggagtcctgaattttgacgaaatcctgcgcgagactgatgcattcatggtggcacgaggtgatcttggaatggagatcccagttgaaaagatattcctggcgcagaagatgatgatatacaagtgtaatctggttgggaagccagtggtgactgctacccaaatgcttgaatcaatgataaagtctcccaggccaacccgagctgaagcaactgacgtagccaatgcagttcttgatggaacagattgtgtgatgcttagtggtgaaagtgctgctggggcatacccagaacttgctgtgaaaatcatggctcgtatctgcattgaagcagaatcatcccttgactatggtgccatcttcaaagagatgataaggtctacaccattgccaatgagtccattggagagccttgcatcatctgctgtccgcacagcaaacaaggccaaagcaaaactcattgttgtactgacacgtggcgggtctacagctaagttggttgctaagtataggccagcggttccaatattatcggtggtggttccagtgttgagcacagactcatttgattggacatgcagtgatgagacgccagcaaggcacagcttgatatataggggcttgattccaatattgggggagggatccgccaaggctactgatgcagaatctacagaggtcattctcgaagctgctcttaagtccgcaacacaaaggggcctttgtaagcctggtgatgcagttgttgccctgcatcgtattggcactgcctctgtcataaagatctgcatagtcaaataa

SEQ ID NO: 7593 - protein, 510 aa, Glycine max
MANIDIEGILKQQPDDGRVPKTKIVCTLGPASRSVEMTEKLLRAGMNVARFNFSHGTHDYHQETLNNLKTAMHNTGILCAVMLDTKGPEIRTGFLKDGKPIQLKEGQEITITTDYDIKGDQEMISMSYKKLPVHLKPGNTILCSDGTITLTVLSCDPDAGTVRCRCENTATLGERKNVNLPGVVVDLPTLTEKDKEDILQWGVPNKIDMIALSFVRKGSDLVNVRKVLEPHAKTIQLMSKVENQEGVLNFDEILRETDAFMVARGDLGMEIPVEKIFLAQKMMIYKCNLVGKPVVTATQMLESMIKSPRPTRAEATDVANAVLDGTDCVMLSGESAAGAYPELAVKIMARICIEAESSLDYGAIFKEMIRSTPLPMSPLESLASSAVRTANKAKAKLIVVLTRGGSTAKLVAKYRPAVPILSVVVPVLSTDSFDWTCSDETPARHSLIYRGLIPILGEGSAKATDAESTEVILEAALKSATQRGLCKPGDAVVALHRIGTASVIKICIVK

SEQ ID NO: 7594 - DNA, 1536 bp, Glycine max
  CDS (1)..(1536)
atggcgaacatagacatcgaagggatcttgaagcagcagcagccttatgatgggcgcgttccgaagacgaagatagtgtgtactttgggccctgcttctcgatccgtagaaatgaccgagaagcttctgagggcagggatgaacgttgctcgtttcaatttctctcatggcacccacgactatcaccaggaaaccctcaacaatctcaagactgccatgcacaacactggcatactctgtgccgtcatgcttgacactaagggacctgagattcggactggttttctgaaagatggaaaacctattcaacttaaagaaggccaagaagtcaccataactactgattatgacattaagggggatccggagatgatatccatgagttacaagaagctgcctgtccacttgaagcctggaaataccatactgtgctctgacgggacgattactctcactgtcttgtcttgtgaccctgatgctggtactgttagatgtcgttgtgaaaacactgcaacgttgggtgagagaaaaaatgttaaccttcctggtgttgtggtggatctacccacacttactgagaaggataaggaagacattcttggatggggtgtacccaacaagattgacatgattgctctttcatttgttcgtaaaggctcggatcttgttaatgtccgcaaggttctggggccacatgcaaagaatattcagttgatgtcaaaggttgagaatcaggagggagtcctgaattttgacgaaatcctgcgggagactgatgcattcatggtggcacgtggtgatcttggaatggagatcccagtagaaaagattttcctggcacagaagatgatgatatacaagtgtaatcttgttgggaagccagtggtgactgctacccaaatgcttgaatcaatgataaagtctcccaggccaacccgagctgaagcaactgatgtagctaatgcagttcttgatggaacagattgtgtgatgcttagtggtgaaagtgctgctggggcatacccagaacttgctgtgaaaatcatggctcgcatttgcattgaagcagaatcatcccttgactatggtgccatcttcaaagagatgataaggtctaccccattgcctatgagtccattggagagccttgcatcatctgctgtccgcacagcaaacaaggccaaagcaaaactcattgttgtactgacacgtggcgggtctacagctaagttggttgctaagtataggccagcggttccaatattatcggtggtggttccagtgttgagcacagactcatttgattggacatgcagtgatgagacgccagcaaggcacagcttgatatataggggcttgattccaatattgggggagggatccgccaaggctactgatgcagaatctacagaggtcattctcgaagctgctcttaagtccgcaacacaaaggggcctttgtaagcctggtgatgcagttgttgccctgcatcgtattggcactgcctctgtcataaagatctgcatagtcaaataa

SEQ ID NO: 7595 - protein, 511 aa, Glycine max
MANIDIEGILKQQQPYDGRVPKTKIVCTLGPASRSVEMTEKLLRAGMNVARFNFSHGTHDYHQETLNNLKTAMHNTGILCAVMLDTKGPEIRTGFLKDGKPIQLKEGQEVTITTDYDIKGDPEMISMSYKKLPVHLKPGNTILCSDGTITLTVLSCDPDAGTVRCRCENTATLGERKNVNLPGVVVDLPTLTEKDKEDILGWGVPNKIDMIALSFVRKGSDLVNVRKVLGPHAKNIQLMSKVENQEGVLNFDEILRETDAFMVARGDLGMEIPVEKIFLAQKMMIYKCNLVGKPVVTATQMLESMIKSPRPTRAEATDVANAVLDGTDCVMLSGESAAGAYPELAVKIMARICIEAESSLDYGAIFKEMIRSTPLPMSPLESLASSAVRTANKAKAKLIVVLTRGGSTAKLVAKYRPAVPILSVVVPVLSTDSFDWTCSDETPARHSLIYRGLIPILGEGSAKATDAESTEVILEAALKSATQRGLCKPGDAVVALHRIGTASVIKICIVK

SEQ ID NO: 7596 - DNA, 1527 bp, Xanthomonas campestris
  CDS (1)..(1527)
atgccatcctcggtacgtgacgcgtgtgttaagtttcgcggcttttacagggaggccatcatgaaagaacgtcaacgccgcaccaagatcctcgccacgctgggaccggccacggatccgcctggtgtgctggacgccttgttcaaggcgggcgtcaacgtggtgcgcctcaacttcagccacggcgacccgtccggccaggccaagcgcgctgccgaagtgcgtgccgccgccgtccgcgtcggcgccgaagtgggcatcctggccgacctgccgggcccgaagatccgcatcgagcgctttgccggaggcaagatcaagctgaccatgggcgatcgtttcgacctggtggccgatatcaatgcgccggccggcgatcagcatcaggtgggcgtgagctacctgggcctgccgcaggatgtcaccgccggtgacgtgctgctgctcgacgatggcctggtgcagctgcaggtcaccgacgtgcagggcgcgcgcatcgtcaccaccgtgctcaacgatggtgtgttgtccgaccgcaagggcctcaacaagcagggcggcggtctgtcgctgggcgcgttgaccgagcgcgacaaggagctgatcggcatcgtggccaagatcggcgtggacttcatcgcggtgtcgttctgccgtaacgcgcaggacatgcacgacgcccgccagatcgcccagcagcacggctgcgatgcgcagttggtgtccaagatcgagcgcaccgaagcgatcgagaacctggtcgaaatcgtcgaagcctccgacgtggtgatggtggcgcgtggcgatctgggcgtggaaatcggcgatgccgaattgccgggcctgcagaagaagatcattcgcgagtcgctggcgcagaacaaggtggtgatcacggccacccagatgctgcagtcgatggtggaaagcccgatcccgacccgcgccgaagtactcgacgtggccaacgcggtcatcgacggcaccgatgcggtgatgctctcggccgaaaccgctgccggtgcgtatccggtgcgtgcagtggaagcgatggcgcgcatctgcctgggcgccgagcaccagttcgagttcgataccgacttcgaagcggcgcaacgcaacctgcagcgcgccgaccaggcgatcgcaatggcgaccatgttcctgtccgagcacatcggtctgggcggcgtggtggcgttgaccgaatccggcggcacgccgcgttacctgtcgcgcttccgttccaatatgccgatctatgcattcacccgtcatgacggcgcgcgtcgccagatggcgatgatgcgtggcgtgttcccgatcggtttcgacagccgtggcctgaccccacgcgaagccgcgcgcgcagcgatccgcctgctggtggagaacgagcgcatggggcctggcgaccgcgtggtgttcaccagcggcgagcacatggaaacccatggcgccaccaacacgctgcgtctgctggaagtgggcgaagacggccgcgccagcggtctgggcgagctgtag

SEQ ID NO: 7597 - protein, 508 aa, Xanthomonas campestris
MPSSVRDACVKFRGFYREAIMKERQRRTKILATLGPATDPPGVLDALFKAGVNVVRLNFSHGDPSGQAKRAAEVRAAAVRVGAEVGILADLPGPKIRIERFAGGKIKLTMGDRFDLVADINAPAGDQHQVGVSYLGLPQDVTAGDVLLLDDGLVQLQVTDVQGARIVTTVLNDGVLSDRKGLNKQGGGLSLGALTERDKELIGIVAKIGVDFIAVSFCRNAQDMHDARQIAQQHGCDAQLVSKIERTEAIENLVEIVEASDVVMVARGDLGVEIGDAELPGLQKKIIRESLAQNKVVITATQMLQSMVESPIPTRAEVLDVANAVIDGTDAVMLSAETAAGAYPVRAVEAMARICLGAEHQFEFDTDFEAAQRNLQRADQAIAMATMFLSEHIGLGGVVALTESGGTPRYLSRFRSNMPIYAFTRHDGARRQMAMMRGVFPIGFDSRGLTPREAARAAIRLLVENERMGPGDRVVFTSGEHMETHGATNTLRLLEVGEDGRASGLGEL

SEQ ID NO: 7598 - DNA, 1506 bp, Xanthomonas axonopodis
  CDS (1)..(1506)
atgtgtgttaagtttcgcggcttttacagggaggccatcatgaaagaacgtcaacgccgcaccaagatcctcgccaccctcggaccggcaacggatgcgcccggtgtgctggatacgctgttcaaggcgggcgtcaacgtggtgcgcctcaacttcagccatggcgacccctccggccaggccaagcgtgccgccgaagtgcgtgccgctgcggcccgcgtcggtgccgaagtcggcatcctggccgacttgccgggcccgaagatccgtatcgaacgttttgccgaaggcaagatcaagctgaccatgggcgatcgcttcgacctggtggccgatgccaacgcgccggctggcgaccagacacaggttggcgtcagctatctgggtctgccgcaggacgtgaccgccggcgacgtcctgctgctcgacgatggcctgatgcagttgcaggtcaccgatgtgcagggcgcgcgcatcgtcaccaaggtgttgaacgatggcgtgctgtccgaccgcaagggcctcaacaagcagggcggtggtctgtcgctgggcgcgttgaccgaacgcgacaaggaactgatcggcatcgttgccaagatcggcgtggacttcatcgcggtgtcgttctgtcgtaacgcgcaggacatgcacgacgcacgtcagatcgcccagcagcatggctgcgatgcgcaactggtgtccaagatcgagcgcaccgaggcgatcgaaaacctggtcgagatcgtcgaagcctccgatgtggtgatggtggcgcgtggcgacctgggcgttgaaatcggcgacgccgaattgccgggcctgcagaagaagatcattcgcgaatcgctggcgcagaacaaggtggtgatcaccgccacgcagatgctgcagtcgatggtcgaaagcccgatccccacccgcgccgaagtgctggacgtggccaacgcggtcatcgacggcaccgacgcggtgatgctctcggccgagaccgccgccggcgcctacccggtgcgtgcggtggaagcgatggcgcgcatctgtctgggggccgaacaccagttcgagttcgataccgacttcgaagcggcgcaacgcaatctgcagcgcgccgaccaggcgattgcgatggcgaccatgttcctgtccgagcacatcggcctgggcggcgtggtggcgttgaccgaatccggcggcacgccgcgcttcctgtcgcgcttccgctccaatatgccgatctacgccttcacccgtcacgatggcgcacgccgccagatggcgatgatgcgtggcgtgttcccgatcagcttcgacagccgcggcctgaccccgcgcgaggccgcacgtgcggcgatccgcctgctggtggagaacgagcgcatggggcctggcgaccgcgtggtctttaccagtggcgagcacatggaaacccacggcgccaccaacacgctgcgcctgctggaagtgggcgaagacggccgcgccaccggtctgggcgagctgtaa

SEQ ID NO: 7599 - protein, 501 aa, Xanthomonas axonopodis
MCVKFRGFYREAIMKERQRRTKILATLGPATDAPGVLDTLFKAGVNVVRLNFSHGDPSGQAKRAAEVRAAAARVGAEVGILADLPGPKIRIERFAEGKIKLTMGDRFDLVADANAPAGDQTQVGVSYLGLPQDVTAGDVLLLDDGLMQLQVTDVQGARIVTKVLNDGVLSDRKGLNKQGGGLSLGALTERDKELIGIVAKIGVDFIAVSFCRNAQDMHDARQIAQQHGCDAQLVSKIERTEAIENLVEIVEASDVVMVARGDLGVEIGDAELPGLQKKIIRESLAQNKVVITATQMLQSMVESPIPTRAEVLDVANAVIDGTDAVMLSAETAAGAYPVRAVEAMARICLGAEHQFEFDTDFEAAQRNLQRADQAIAMATMFLSEHIGLGGVVALTESGGTPRFLSRFRSNMPIYAFTRHDGARRQMAMMRGVFPISFDSRGLTPREAARAAIRLLVENERMGPGDRVVFTSGEHMETHGATNTLRLLEVGEDGRATGLGEL

SEQ ID NO: 7600 - DNA, 1434 bp, Methanosarcina mazei
  CDS (1)..(1434)
atggaaatcccggatcataaaacaaagatcgtctgtacaataggacctgcctcttcttctgaagagatgataaggaagcttatgcttgcgggcatgaacgtggcaaggataaatttttctcacggagactttgagagccactcaagggttgtccgaattatccgtaaggttgcagatgaacttggcaggacaattgcaatccttgcagacctgcctggcccgaaaatacgcataggcaaactcgaaaaagagcctgttatgctccataaagggaacccgataacccttacaattgacgacactccgggaaacgaagagagaatccctgtcagttacaaacagcttccggaaagcgtaacccctgggagccttatctacctcagtgacgggttcatacagctcctctgcaaggaggttacaggaaaagacgttctctgtgaagtccttatcggaggagagctttattcgcacaaagggctgaaccttccaggggcaaagatctttcttgacgctgtgactgaaaaagatttcaggatcctggaatttgcccttgaagaggacattgacactttcagcatctcttttgtagaaaatgcagaagatatccgaaaagtaagaaattttgccgcttccagaggaaagcaggtaaatatagtatcaaaaatagaacgcaggcaggctgtagaaaatataggagaaatccttgacgagaccgatgcccttatggttgcaaggggagacctgggagttgaaattcctatccaggaagtcccttcggtccagaaagaacttatccagagggcaaagctccttggggttcctgtgattactgcaacccatatgctggcttccatgacagataatataagacccacgcgtgccgaagccacggatgttgcaaacgctatccttgacggcacggatgctgttatgctctcggaagaaacagcagtcggaaactaccccgtggaagctgtcgagatgatggcaaagattgcaaagaccactgaaaactggcgctcccggactaaatgggggcttgacacaatgatcaaatccataactgccagggagatgtcagtggatgaggtaatcaccttacaggtttatgaagccctgcagaaactgcctgttgcagccgtacttaccccgacaaggagcggagcgactccccgcaggatttcgcgctttaatcctgacccctggattctggctttcagccgcgttcctaagacctgcaggttcctttccctgtcttacggggtttatcctgttgccgtaaacgaatctattgaaagctgggaaaaagagacaacggaaagaacaaaagaattgggatttgcgaaaagtaaagatctcgtgatttttacccagggccctgcttccggaaaacccggaggtacgaatatgctcaagatcctgacccttgactga

SEQ ID NO: 7601 - protein, 477 aa, Methanosarcina mazei
MEIPDHKTKIVCTIGPASSSEEMIRKLMLAGMNVARINFSHGDFESHSRVVRIIRKVADELGRTIAILADLPGPKIRIGKLEKEPVMLHKGNPITLTIDDTPGNEERIPVSYKQLPESVTPGSLIYLSDGFIQLLCKEVTGKDVLCEVLIGGELYSHKGLNLPGAKIFLDAVTEKDFRILEFALEEDIDTFSISFVENAEDIRKVRNFAASRGKQVNIVSKIERRQAVENIGEILDETDALMVARGDLGVEIPIQEVPSVQKELIQRAKLLGVPVITATHMLASMTDNIRPTRAEATDVANAILDGTDAVMLSEETAVGNYPVEAVEMMAKIAKTTENWRSRTKWGLDTMIKSITAREMSVDEVITLQVYEALQKLPVAAVLTPTRSGATPRRISRFNPDPWILAFSRVPKTCRFLSLSYGVYPVAVNESIESWEKETTERTKELGFAKSKDLVIFTQGPASGKPGGTNMLKILTLD

SEQ ID NO: 7602 - DNA, 1752 bp, Thermoanaerobacter tengcongensis
  CDS (1)..(1752)
atgaggagaacaaaaatagtctgtacaattggacctgctagtgaggactacaatatactgagaaagttaatagaaaaaggaatgaatgtagcaaggcttaatttttcccatggagattttgaagagcacggagcgaggattgacaacataaaaaagataagggaagaattaggtcttcctgtagctattttgctggacacaaaaggacccgagattagaacgggaaagtttaaaaacggcggagtagagttaaaggaaggccagacttttacattaactacaagggatgtaataggagatgaaacggtagtcagtgtttcctacaaaggtttgcctcaagatgtttcaagaggtacccaaattttgattgatgacggattgatctcactaagggttgtggatgtcaaaggggaagacataatctgtgtagttgaaaattcgggatttcttggagaccacaaaggagtaaatgttcctggagtgaaattgaatctcccggctttgacacaaaaagacatagaagatatagagtttggcataaagaaaggtattgacatgatagctgcttcttttgtcaggaaagcggcagatgtgcttgctataaggaggcttcttgaggacaataaagcagaccacattcagataattgctaaaatagaaaaccgcgaaggagtagaaaatatagacgaaataataagggtatctgacgggataatggtggccagaggagatttgggcgttgagatacctctggaggaaataccgatagtgcagaagatgataataaagaagtgcaatgaagctggaaagccagttattactgcaacccaaatgctggattccatgatgagaaatccgcgtcctactcgtgctgaagttacggatgttgctaatgctattttggatggaacggatgccataatgctgtcaggtgagacggcccagggcaaatatcctgtcgaagcttttgagacaatggccaggattgcggaaaagacagaggtttacgtccagtacagagatatagtaggtgtaggtacagagagaaatgtttccattactaatgcgataagccatgctacctgcacgactgcgagagatataggcgcttcagctatcataacctgtacaaaatcaggttatacggctaggatggtttcaaggtataggccttcctctcctatcatagctactactcctagcgagcaggtggcaagaaagctttccatcgtgtggggagtatatcctttagtgacaaaagaagtgtcaaccacagacgaaatgatagatgttgcaatagaaagtgcgttaaaagctgggcttataaggaatggagatattgtggtgatttctgcgggaatacctgttgccatgactggcaccacaaacatgctcaaagttcacatagttggagatgtgattttaagaggtattggtataggttcaaaatctactactggcactgtgtgcataattcatgacattggcaaggacagagacaagtttagagaaggagatataattgttacaaccaagacagagagagattttatgcctcttattgaaaaagcttctgccataataacagaagaaggcgggctcacctcccacgctgctattgttgggcttaacttggggatccctgtgattgtagggtgtgaaggagctacttcaaaacttcaggatgggatgacagtcactgttgacaccacgagaggactggtgtataaaggaattgtaaacataaaatga

SEQ ID NO: 7603 - protein, 583 aa, Thermoanaerobacter tengcongensis
MRRTKIVCTIGPASEDYNILRKLIEKGMNVARLNFSHGDFEEHGARIDNIKKIREELGLPVAILLDTKGPEIRTGKFKNGGVELKEGQTFTLTTRDVIGDETVVSVSYKGLPQDVSRGTQILIDDGLISLRVVDVKGEDIICVVENSGFLGDHKGVNVPGVKLNLPALTQKDIEDIEFGIKKGIDMIAASFVRKAADVLAIRRLLEDNKADHIQIIAKIENREGVENIDEIIRVSDGIMVARGDLGVEIPLEEIPIVQKMIIKKCNEAGKPVITATQMLDSMMRNPRPTRAEVTDVANAILDGTDAIMLSGETAQGKYPVEAFETMARIAEKTEVYVQYRDIVGVGTERNVSITNAISHATCTTARDIGASAIITCTKSGYTARMVSRYRPSSPIIATTPSEQVARKLSIVWGVYPLVTKEVSTTDEMIDVAIESALKAGLIRNGDIVVISAGIPVAMTGTTNMLKVHIVGDVILRGIGIGSKSTTGTVCIIHDIGKDRDKFREGDIIVTTKTERDFMPLIEKASAIITEEGGLTSHAAIVGLNLGIPVIVGCEGATSKLQDGMTVTVDTTRGLVYKGIVNIK

SEQ ID NO: 7604 - DNA, 1428 bp, Fusobacterium nucleatum
  CDS (1)..(1428)
atgaggagtttgaaaaaaacaaaaatagtttgtactattggtcctgtgactgaatcagtagaaactttaaaagaattactaaataggggaatgaatgtaatgagattgaatttctctcatggtgattatgaagaacatggaatgagaatgaagaattttagacaagcaatgtctgaaactggaattagaggaggaatacttcttgatactaagggtccagaaataagaacaatgactttaaaagatggaaaagatgtaagtattaaggctggacaaaaatttactttcacaacagatcaatcggttgttggagataatgaaagagtagcagtaacttatgaaaattttgcaaaagatttaaaagttggaaatatggttcttgttgatgatggattattagaactagatgttgtggaaataaaaggaaatgaagttatatgtatagccagaaataatggagatctaggacaaaagaaaggaataaatttacctaatgtttctgttaatttaccagcattatctgagaaagatatagaagatctaaaatttggttgtcaaaataatgttgattttgtggcagcatcatttataagaaaagctgatgatgtaagacaagtaagaaaagttcttagagaaaatgatggagaaagaatacaaataatttctaagatagaaagccaggaagggcttgataattttgatgaaattttagcagaatctgatggtataatggtagcaagaggagacttaggtgtagaaatccctgttgaagaagttccttgtgcgcaaaaaatgatgataagaaaatgtaatagagtaggaaaaactgttattacagcaactcaaatgctagattcaatgattaaaaatccaagacctacaagagcagaagcaaatgatgttgccaatgctatattagatggtacagatgcagtaatgctttcaggtgaaactgcaaagggaaaatatccattagcagctgttgaagttatgaataaaatagctaaaaaagttgatgctacaataccaccattttacatagaaggtgttataaataaaaatgatataacttctgctgttgcagaaggaagtgctgacataagcgaaaggttaaatgcaaaacttatagttgttggtacagaatctggaagagctgcaagagacatgagaagatatttccctagagcacatattttagcaataactaataatgaaaaaactgcaaatcaattagttttatcaagagggataatttcatatgtagatgcttcaccaaaaactttagaagaattctttgttgtagcagaatctgttgcaaaaaaattaaatttagttaaaaataatgatataattatagcaacttgtggagaaagtgtatttatacaaggaacaactaactcaataaaagtaatacaagtaaaagcatag

SEQ ID NO: 7605 - protein, 475 aa, Fusobacterium nucleatum
MRSLKKTKIVCTIGPVTESVETLKELLNRGMNVMRLNFSHGDYEEHGMRMKNFRQAMSETGIRGGILLDTKGPEIRTMTLKDGKDVSIKAGQKFTFTTDQSVVGDNERVAVTYENFAKDLKVGNMVLVDDGLLELDVVEIKGNEVICIARNNGDLGQKKGINLPNVSVNLPALSEKDIEDLKFGCQNNVDFVAASFIRKADDVRQVRKVLRENDGERIQIISKIESQEGLDNFDEILAESDGIMVARGDLGVEIPVEEVPCAQKMMIRKCNRVGKTVITATQMLDSMIKNPRPTRAEANDVANAILDGTDAVMLSGETAKGKYPLAAVEVMNKIAKKVDATIPPFYIEGVINKNDITSAVAEGSADISERLNAKLIVVGTESGRAARDMRRYFPRAHILAITNNEKTANQLVLSRGIISYVDASPKTLEEFFVVAESVAKKLNLVKNNDIIIATCGESVFIQGTTNSIKVIQVKA

SEQ ID NO: 7606 - DNA, 1713 bp, Oryza sativa
  CDS (1)..(1713)
atggcggcggcggcggctgagatcgtggggtccgcggcggcgcgcatggcggcgccggcagtgaggccggctccgcccgcggcggcggcggcggcggcgcccccgcagccgaggagggccgtggcggcgcgctccctcaggacctccacctccgacagggtggcggcggatctcgcgctcgggagcaacggctccctctccgctcagaacattgctgagaataccgctgacgctacttcgcaagtggtctctgcgaattcccgtaggaagacaaagattgtttgcaccataggcccctcaaccaacacacgcgagatgatatggaaacttgctgagactggaatgaacgtcgcacgcatgaatatgtcccatggtgaccaccagtcgcaccagaaggtgattgatttggtgaaggagtacaatgcgaagaatactgatggcaatgtcattgctattatgctggataccaagggtccagaagtgagaagtggggatgttccagaaccaatcatgctcgaggaaggtcaagagttcaattttactattaaaagaggggtgagcaccaaagacaccgtcagtgtgaattacgatgacttcataaacgatgttgaagttggggacatactgttggtggatggaggaatgatgtcactcgctgtcaagtctaaaacagctgatacggttaagtgtgaagtagttgatggtggggaactgaaatcaaggcgccacctaaatgtccgtggaaagagtgcgactttgccatctattacagagaaagattgggaggacataaagtttggtgttgaaaatggtgttgatttctatgccgtttcctttgtgaaggatgcaaaagttattcatgaactgaaggactaccttaaaagtgctaatgcagatatacatgtcattccaaagattgaaagtgcagattcaataccaaacctccagtccattattgctgcttcagatggggcgatggtggcaagaggggatcttggtgctgaacttccaattgaggaagttcctttgctgcaggaggagattgtcagaacatgccgaagcatgcagaaaccagttattgttgccacgaatatgttagagagcatgatagaccatcccactccaacaagagcagaagtttctgatatagcaattgcagttcgtgaaggttctgatgccatcatgctgtctggtgaaactgcccatggaaagttcccactgaaggcagtcaaggtgatgcacacagtggcacagagaacagaatccagcctgtataacccaactacatctcctagtcttgttgcacatcctcaggctctgctcaacgaggaattttcgcaaagccaactaagcaaaatgtttggatctcatgctacaatgatggcgaacaccctttgcaccccaattattgtgtttacacgaaccggctccatggcagtccttctcagccactaccggccctcgtctacaatttttgcatttacaaatgaggaacgagtgaagcaacgtctggcactctaccagggtgtggttcccatttacatgaagttttctgatgatgcagaggaaactttctctagagcaattagtagcttgctgaacgcccaattcgtgaaagaaggggactacgtgacccttgttcagagtggagtgaagtcgatctggagagaggagtctactcaccacattcaagtgaggaaagtccagggctaa

SEQ ID NO: 7607 - protein, 570 aa, Oryza sativa
MAAAAAEIVGSAAARMAAPAVRPAPPAAAAAAAPPQPRRAVAARSLRTSTSDRVAADLALGSNGSLSAQNIAENTADATSQVVSANSRRKTKIVCTIGPSTNTREMIWKLAETGMNVARMNMSHGDHQSHQKVIDLVKEYNAKNTDGNVIAIMLDTKGPEVRSGDVPEPIMLEEGQEFNFTIKRGVSTKDTVSVNYDDFINDVEVGDILLVDGGMMSLAVKSKTADTVKCEVVDGGELKSRRHLNVRGKSATLPSITEKDWEDIKFGVENGVDFYAVSFVKDAKVIHELKDYLKSANADIHVIPKIESADSIPNLQSIIAASDGAMVARGDLGAELPIEEVPLLQEEIVRTCRSMQKPVIVATNMLESMIDHPTPTRAEVSDIAIAVREGSDAIMLSGETAHGKFPLKAVKVMHTVAQRTESSLYNPTTSPSLVAHPQALLNEEFSQSQLSKMFGSHATMMANTLCTPIIVFTRTGSMAVLLSHYRPSSTIFAFTNEERVKQRLALYQGVVPIYMKFSDDAEETFSRAISSLLNAQFVKEGDYVTLVQSGVKSIWREESTHHIQVRKVQG

SEQ ID NO: 7608 - DNA, 1872 bp, Oryza sativa
  CDS (1)..(1872)
atggcgcaggtggtggctgcggcagggacggcggcggcggtggcggcggtggggaggccgctgggtggcggcggatctggggccgacgcgctccgcccggcggcgaggctgtcgttcgcgccgcgctggtgcggtgggagcgcgggggcagcaagggcgcgccgcgagtccgccgtcacgtccgtgattagccgcgccccgcgtctcgacgccgaggtgctgccggtgtcggccgacgacgacgcggacgaagaagaaaacttccagcatctcaaggccattcagcaacttgcaacatcagccaatggtgtgtggtctaaaccaaatgtgagacgcaagacaaagatcgtgtgcaccattggtccttcaactaacacaaaggagatgatatggaaacttgctgaggctggcatgaatgtggctcggcttaatatgtcacatggagaccatgcatcacaccagaaagttattgacttagtaaaggaatataatgctcaaacaaaggataacgtgattgctattatgcttgacacgaagggaccagaagttaggagtggagatttgcctcaaccaataatgttggaaactggccaggagttcactttcacaattaagagaggagttgggactgagacatgtgttagcgttaactatgatgactttgttaatgatgtagaagtgggtgacatgctcctcgtagatggtggaatgatgtcgttgttggtcaagtccaaaactgaagattcggtaaaatgtgaagttattgatggaggtgaactgaaatccaggcgtcacctgaatgttcgtggaaagagcgcaaccttgccatcaataactgacaaggattgggatgatattaagtttggtgtggagaatcaagttgactactatgccgtttcttttgtcaaagatgctcaagttgtgcatgaattgaaggattatctcagaagctccaatgccgatatacatgtaattgtaaagattgaaagtgcagattccattccaaacctacactcaatcatcacagcatcggatggggctatggttgccagaggtgacttgggagctgaactccctattgaggaggtaccgctgctgcaggaagaaattattagaatgtgcaggagcatgggaaaagctgttattgttgccactaatatgctagaaagtatgattgttcatccaactccaacccgagcagaagtttcagacattgctatagctgttcgagaaggttctgatggcattatgctttctggggaaactgcacacggaaagtttcctttgaaagctgttaaggtcatgcatactgttgccctgagaactgaagccactatgtctggtggggaaacaccggctaaccttggtcaggtgttcaagaatcacatgagtgaaatgtttgcataccattcaacaatgatgtccaacactcttggaacatcaattgtggttttcaccaggacaggatttatggctatcctacttagtcattaccgcccttctggcaccatttttgcctttacggaccaggagagagttagacaacgattggctttgtaccaaggtgtatgtccagtccagatggaattttctgatgatgctgagaagacatttggtgacgctttgtcatacttgctgaaacatggtatggtgaaggaaggcgaggaggttgcacttgttcaaagtggcaggcaacctatctggcggtcgcagtccacccataatattcagcaaaaccttaggcctgatgataataccacgctggcattactggcatcatttaactgtgagcttagtgagttgtgtgcaagacatgagagagccattgttgtgattctatattcgttgctaaatatgttaccttgcatgtaa

SEQ ID NO: 7609 - protein, 623 aa, Oryza sativa
MAQVVAAAGTAAAVAAVGRPLGGGGSGADALRPAARLSFAPRWCGGSAGAARARRESAVTSVISRAPRLDAEVLPVSADDDADEEENFQHLKAIQQLATSANGVWSKPNVRRKTKIVCTIGPSTNTKEMIWKLAEAGMNVARLNMSHGDHASHQKVIDLVKEYNAQTKDNVIAIMLDTKGPEVRSGDLPQPIMLETGQEFTFTIKRGVGTETCVSVNYDDFVNDVEVGDMLLVDGGMMSLLVKSKTEDSVKCEVIDGGELKSRRHLNVRGKSATLPSITDKDWDDIKFGVENQVDYYAVSFVKDAQVVHELKDYLRSSNADIHVIVKIESADSIPNLHSIITASDGAMVARGDLGAELPIEEVPLLQEEIIRMCRSMGKAVIVATNMLESMIVHPTPTRAEVSDIAIAVREGSDGIMLSGETAHGKFPLKAVKVMHTVALRTEATMSGGETPANLGQVFKNHMSEMFAYHSTMMSNTLGTSIVVFTRTGFMAILLSHYRPSGTIFAFTDQERVRQRLALYQGVCPVQMEFSDDAEKTFGDALSYLLKHGMVKEGEEVALVQSGRQPIWRSQSTHNIQQNLRPDDNTTLALLASFNCELSELCARHERAIVVILYSLLNMLPCM

SEQ ID NO: 7610 - DNA, 1560 bp, Encephalitozoon cuniculi
  CDS (1)..(1560)
atgtggctcgttgaagagaaatatcttgttcctttctatgaatatcattacgacatgctttgccgaccctatcaatgcacctgttgccagatccttggtggatgggattttgtcatccagagacctcatcacaacggctatagtcttcatgcggcccgtggctgcatgctggattatatctactcctttgggcaggattacgtctcctatctgcagagcacctatcattggtctcaaaagcttgataaatttggaaagtgtttggcgcaagcaatgagaatggtgctgacaaagatagtctgcacgattggacccagaacatcttctagggagaagatcaaggagctgatagatgctgggatgtcgattgcaagactgaacttcagccatggatcaagggaagcacatctggaagtgattaggaacatcagagactccagaagtggtgcagggaggcatgtttcaatagcactggacacaagggggcctgaggtgaggcttaggacaccggagatgaaggatatcaaggtggagggtggagaagttctccggttctcccttctttcttctgaaaaggacatctggatacccggtgttgaccttaagtctctgggtgtagacaacagggtgtttattgacgacggggcaatcgaactgagggtagtcaatgtggaagaagatggatttgaatgcgaggtgctgaacagtggcatgatcaagagcaataagtccatgaacttccctggcacggacattggagatagggctctgggggatgaggacaagaatgatatcgcctttgggttggagaatgggatagatatggtttttgcatcttttgtgagctgccgggcggatgtcgaggagataagaaggcttgtcggaagcaaggtcccggttgtatccaagatagagtcgtgtctagggatgaggaatctgaaggaaatagccctatgctctgacggggtgatgatagcaaggggagatcttggagttgagattgggctggaaaacatgttcagtgcccagaagagaatactttacgaagtgaagagggaggggaggcctgtgatctgtgcaacacaaatgatggagagcatgactttgaagaatgcgccgaaccggtcagaaatttctgatgttggaaatgcagttcttgatggatgcgactgtgtgatgttgagtgcagagtcggctgttgggatgttccctgtcgagactgttaaattcatgaggagcatctgtgctgatgcagagagatatgacatggagagcaggaagggggcaggggcttgcggggtgtcttcctatgtggatggagttgtgatatgctctggtacggagtcacagatagagaagatctacctgagcaagcctgaaactcccattattgtgatttccgagtccctgtggattctcaggaggttcagcatctatcgaggaatcattcctgtgtatggtaaggggtctgaggacgcggaagctactctgcgaaggctaggactgaggggaagattcctagctgtcggcagagaagatgtgaggatggtgagtgtttga

SEQ ID NO: 7611 - protein, 519 aa, Encephalitozoon cuniculi
MWLVEEKYLVPFYEYHYDMLCRPYQCTCCQILGGWDFVIQRPHHNGYSLHAARGCMLDYIYSFGQDYVSYLQSTYHWSQKLDKFGKCLAQAMRMVLTKIVCTIGPRTSSREKIKELIDAGMSIARLNFSHGSREAHLEVIRNIRDSRSGAGRHVSIALDTRGPEVRLRTPEMKDIKVEGGEVLRFSLLSSEKDIWIPGVDLKSLGVDNRVFIDDGAIELRVVNVEEDGFECEVLNSGMIKSNKSMNFPGTDIGDRALGDEDKNDIAFGLENGIDMVFASFVSCRADVEEIRRLVGSKVPVVSKIESCLGMRNLKEIALCSDGVMIARGDLGVEIGLENMFSAQKRILYEVKREGRPVICATQMMESMTLKNAPNRSEISDVGNAVLDGCDCVMLSAESAVGMFPVETVKFMRSICADAERYDMESRKGAGACGVSSYVDGVVICSGTESQIEKIYLSKPETPIIVISESLWILRRFSIYRGIIPVYGKGSEDAEATLRRLGLRGRFLAVGREDVRMVSV

SEQ ID NO: 7612 - DNA, 1470 bp, Methanosarcina acetivorans
  CDS (1)..(1470)
atgaatataaacgtgaatataaacggccgtgaaaatatgcaaatccctgaccataaaacaaagatcgtctgcaccataggccctgcttccttctccgaggaagtcctcaggaaactggtgcttgcgggaatgaacgttgcaaggattaacttttcccacggagacttcgagagccacggaaaagttatccggagggtccgaaaggttgcagaagagcttgacaggacagttgctatccttgccgacctcccaggcccgaaaattcgcgtaggcaagctcaaaaaagagccgcttatgctccataaagggaaccgaataacccttaccactgacgagacttctggaagcgaggaccgcatcccggtcaactacaaacagctccctgagagcgtctccccgggaagccttatctacctgagtgacggatttatccagctcctctgcctggaaatctcgggaaaagatgtagtctgcgaagttatggtcggaggacaactctactcccataaagggctgaacctgccaggggcaaaaatttacctggactctgtgacggaacatgacttcaaaatccttgagtttgccctgaacgaagaagttgacgcagtcagcatctcttttgtggaaaaagccgaagatatccgaaaagtccggaattttgcttcaaccatgggaaaacctgtatacgttgtctcaaaaatcgaacggagccaggcggtccagaatatagaagagatccttgaggaaaccgatgccctgatggttgccagaggagacctgggagttgagattcctatccaagaagtaccttcggtccagaaagaactcatccggagtgcaaagctcctgagcatccccgtaattactgcaacccacatgctggcctccatgaccgacaacatcaggcctacaagggcggaggctacagacgttgccaacgccatccttgacgggacggacgcggtcatgctctcggaagaaaccgcagttgggaactatcccgtggaaactgtggagatgatggcaaaaattgcaaaaacaacagaaaactggcgctcccgaacgaagtggggacttgacacaatgctcaagggaattacggcacagaaaatgtcagtggacgaggtaatcgctctccaggtacacgaagccctgcaaaagcttcctgtagccgttgtactcaccccaacccgaagcggagcaaccccgcgcaggctttcccgcttcaagcctgaaccctggatcctggctttcacccgcttcccgaaaacctgtagctcccttgccttgtcctatggggtttatccgataatagtaaaagaagtctctgaaaactgggaaacggagaccacggaaaaggcaaaggaactgggatttgcaaaaagcggagagctcgtagttttcacccagggacctgcttccggaaaaccaggaggcacaaacatgctcaagatcctgactctggactga

SEQ ID NO: 7613 - protein, 489 aa, Methanosarcina acetivorans
MNINVNINGRENMQIPDHKTKIVCTIGPASFSEEVLRKLVLAGMNVARINFSHGDFESHGKVIRRVRKVAEELDRTVAILADLPGPKIRVGKLKKEPLMLHKGNRITLTTDETSGSEDRIPVNYKQLPESVSPGSLIYLSDGFIQLLCLEISGKDVVCEVMVGGQLYSHKGLNLPGAKIYLDSVTEHDFKILEFALNEEVDAVSISFVEKAEDIRKVRNFASTMGKPVYVVSKIERSQAVQNIEEILEETDALMVARGDLGVEIPIQEVPSVQKELIRSAKLLSIPVITATHMLASMTDNIRPTRAEATDVANAILDGTDAVMLSEETAVGNYPVETVEMMAKIAKTTENWRSRTKWGLDTMLKGITAQKMSVDEVIALQVHEALQKLPVAVVLTPTRSGATPRRLSRFKPEPWILAFTRFPKTCSSLALSYGVYPIIVKEVSENWETETTEKAKELGFAKSGELVVFTQGPASGKPGGTNMLKILTLD

SEQ ID NO: 7614 - DNA, 1434 bp, Pyrococcus furiosus
  CDS (1)..(1434)
atgagaagggtgaagctcccatctcacaagacaaaaattgtagctacaatagggccagcgactaattcgagaaaaatgataaaacaactcattaaggcggggatgaatgttgcaagaataaacttctcccatggaagttttgaagagcatgcaagagtcatagaaataataagagaggaggcacaaaaattagacaggagagttgcaatacttgcagatctacctggattgaaaataagagtcggtgagataaaagggggttacgtagagctaaagagaggagaaaaggtaatattaacaacaaaggatgttgagggtgatgaaactacgataccagtggattataaaggctttccaaatttggtatcgaagggagacatcatataccttaatgacggatacatagtcttaaaggtggagaacgttagggagaacgaagttgaagcagttgttctttcaggaggaaagctcttctcgagaaagggcgtcaatatacccaaggcctacctcccagtcgaagccataactccaaaagactttgaaattatgaaatttgcaattgagcatggggtggatgcaataggattgagcttcgttgggagcgtttatgatgttctaaaggccaagagtttccttgagaaaaataatgccgaggatgtatttgtaattgcaaagatcgaaagacctgacgccgtgaggaattttgacgagattcttaatgccgctgatggaattatgattgctagaggagatttaggggtagagatgccgatagagcagctaccaattcttcagaagaaattgatcaggaaagccaatatggaagggaaaccagtgattacggcaacacaaatgcttgtgtcaatgacaacggaaaaagtgccaacaagggccgaagttacggacgttgcaaacgcaattcttgatggaacggatgcagttatgctatcagaagaaacggccataggaaaattccccattgagaccgtagagatgatgggaaagatagctaaggtcactgaagaatatagggaaagttttgggttaagcagaataagggagtttatggagatcaaaaagggaacaataaaagaggctatcactagaagtataattgacgcaatatgcacaatagacattaagtttatactaacacccaccagaacgggaagaactgctaggctaatctcaagatttaagcccaagcagtggattttagccttctcaacaaatgaaagggtgtgcaacaatctcatgttcagctatggagtttatcccttctgcctagaagagggattcgatgagaacgatatagttaggttgataaaaggactgggccttgtggaaagcgatgatatggttttaatgacggaaggaaagccaattgaaaaaacagttggaactaactcaattaagatattccaaatagcttga

SEQ ID NO: 7615 - protein, 477 aa, Pyrococcus furiosus
MRRVKLPSHKTKIVATIGPATNSRKMIKQLIKAGMNVARINFSHGSFEEHARVIEIIREEAQKLDRRVAILADLPGLKIRVGEIKGGYVELKRGEKVILTTKDVEGDETTIPVDYKGFPNLVSKGDIIYLNDGYIVLKVENVRENEVEAVVLSGGKLFSRKGVNIPKAYLPVEAITPKDFEIMKFAIEHGVDAIGLSFVGSVYDVLKAKSFLEKNNAEDVFVIAKIERPDAVRNFDEILNAADGIMIARGDLGVEMPIEQLPILQKKLIRKANMEGKPVITATQMLVSMTTEKVPTRAEVTDVANAILDGTDAVMLSEETAIGKFPIETVEMMGKIAKVTEEYRESFGLSRIREFMEIKKGTIKEAITRSIIDAICTIDIKFILTPTRTGRTARLISRFKPKQWILAFSTNERVCNNLMFSYGVYPFCLEEGFDENDIVRLIKGLGLVESDDMVLMTEGKPIEKTVGTNSIKIFQIA

SEQ ID NO: 7616 - DNA, 1404 bp, Clostridium perfringens
  CDS (1)..(1404)
atgagaagaacaaaattagtatgcactatcggaccagctagtgaaaacgaagaaatcttaacaaaaataatcgaagcaggtatgaacgcttcaagacacaatttctcacatggtgaccatgaagaacataaaggaagaatggttaaagtaagagaaatatcaaaaaaattaggtaaagaagtagctatattattagatactaaaggacctgaaataagaactggaaaattcgagccaagcaaagttgaattaactgctggaactgaatttactatatatgctggagcagaagacgtaataggagacactactaagtgttcagttacatatgctggattagctaaagacgttaaagctggagatactatcttaatagacgacggtttagttggattagaagttgtatctgtagaaggaaacgctgttaaatgtgtagtaagaaacactggattagttggaactcacaaaggagttaacgttcctggagtatcaataaaattaccagctatgactgataaagatagagctgacttaatattcggttgtgaaatgggcgttaacatggttgctgcttcattcataagaaaagcagaagacgttaaagctataagagaagtattagttgctaacggtggagctgatatacaaatattctcaaaaatcgaaaaccaagaaggtgttgataacatagatgctatcatcgaagcttcagacggtatcatggtagctagaggagaccttggtgttgaaataccaatggaagacgttccttcagttcaaaaaatgatcatcgaaaaatgtaacaatgctggaaaaccagttataactgctactcaaatgttagactcaatgatgagaaacccaagaccaacaagagctgaggtttcagacgtaactaacgctatcttagatggtactgatgctatcatgttaagtggtgagtcagctaacggaagctggccagtagaagctgttgaaactatggttaaaatagctactaaatcagaagaaatgttaagctacgaattagcttcatcaaaagctaaaaaacatataccagctgtaccaggagttatctcaagagctgcttgtaatgctgcacacgagttaaaatcagctgctatagtttcattaactcaatcaggagctactgctaagagaatatctcaatgcagaccagatgcaccaatcgttactgtaactccaaacgaaagagttgctaagaaagttgctttatgcttcggtgtttacccagttgttgctgaaaatgctacaatggaaaacgctgttgaaatagctaaaaatgctggattcgttaaagctaatgacactgctgtagttgttgcaggtgtaccagctaacgaaggaaacactaacatagtaaaagttgaagttgtaaaataa

SEQ ID NO: 7617 - protein, 467 aa, Clostridium perfringens
MRRTKLVCTIGPASENEEILTKIIEAGMNASRHNFSHGDHEEHKGRMVKVREISKKLGKEVAILLDTKGPEIRTGKFEPSKVELTAGTEFTIYAGAEDVIGDTTKCSVTYAGLAKDVKAGDTILIDDGLVGLEVVSVEGNAVKCVVRNTGLVGTHKGVNVPGVSIKLPAMTDKDRADLIFGCEMGVNMVAASFIRKAEDVKAIREVLVANGGADIQIFSKIENQEGVDNIDAIIEASDGIMVARGDLGVEIPMEDVPSVQKMIIEKCNNAGKPVITATQMLDSMMRNPRPTRAEVSDVTNAILDGTDAIMLSGESANGSWPVEAVETMVKIATKSEEMLSYELASSKAKKHIPAVPGVISRAACNAAHELKSAAIVSLTQSGATAKRISQCRPDAPIVTVTPNERVAKKVALCFGVYPVVAENATMENAVEIAKNAGFVKANDTAVVVAGVPANEGNTNIVKVEVVK

SEQ ID NO: 7618 - DNA, 1419 bp, Ralstonia solanacearum
  CDS (1)..(1419)
atgcaacgttccagccatgccaagatcgtcgccacgctgggtccggccagcgacgaccacgccacgatcgaagcgctcgcgcgtgcgggcgcggatgtcttccgcctgaatttcagccacggcgcgcatgccgatcatcaacggcggctcgaacggatccgcgcggtggaggccgcgctcggccggcccctcggtgtgctgctcgatctgcaaggccccaagctgcgcgtgggcaccttcgccgagggccgggtgcggctggacgatggcgcgccattccggctcgacctggagaccggccgccccggcgacgcgacgcgcgtcgcgctgccgcatccggaaatcttcgcggccatccggcccggcgtggcgctgctgctggacgacggcaagctgcggctcgaagtcgtggcctgcggcccggaccacgccgagacgcgcgtcgtcaacggcggcatgctgtccgaccgcaagggcgtcaacgtgccgggcgtggtgctgcccctgtcggcgctgacggagaaggaccgcgccgacctggccttcggcctggcgctcggtgtcgactggatcgcgctgtcgttcgtgcagcgcgccgccgacatcgccgagatccggcagctcgtgcacggccgcgcgggcattgtcgccaagctggaaaagccggccgccatcgacagcctggatgccatcctggccgagacggacgcggtgatggtcgcgcggggcgacctgggcgtcgagctgccggccgagcaggtgcccgccatccagaagcgcatcgtgcgggcctgccgccggctgggcaagccggtcatcgtggccacgcagatgctggagtcgatgatcggcgcgccggtgcccacccgcgccgaggcctcggacgtggccactgccgtctacgatggcgccgatgcggtcatgctgtccgccgagaccgcttccggccagttcccggtcgaagccgtcgccatgatgcggcggatcatcgcgcagaccgaagccgacccgcactatcgcgccgccatcgacgcctcgcacacgccgcccggcgccaatacgccggatgcgatcggctgcgccgcgcactcggtggccggcctgctggacgtggcggccatggttgcctacacgagctcgggcgcctcggcgctgcgcatggcgcgcgagcggccccgcgccgccatcctgggcatgacgccgcgcccggaaaccgcgcgccggctggcgctggtgtggggcgtccatccggtgatctgcgacggcgtgctcgacgtcgaggcgatgaccgacgtggcgcggcagacggccgtgcagcggcggttcgcgcaagcggggcagaccctcgtcatcgcggcgggcctgccattcggcacgccgggatcgaccaacctgctgcgcatcgcgcaggtggaatga

SEQ ID NO: 7619 - protein, 472 aa, Ralstonia solanacearum
MQRSSHAKIVATLGPASDDHATIEALARAGADVFRLNFSHGAHADHQRRLERIRAVEAALGRPLGVLLDLQGPKLRVGTFAEGRVRLDDGAPFRLDLETGRPGDATRVALPHPEIFAAIRPGVALLLDDGKLRLEVVACGPDHAETRVVNGGMLSDRKGVNVPGVVLPLSALTEKDRADLAFGLALGVDWIALSFVQRAADIAEIRQLVHGRAGIVAKLEKPAAIDSLDAILAETDAVMVARGDLGVELPAEQVPAIQKRIVRACRRLGKPVIVATQMLESMIGAPVPTRAEASDVATAVYDGADAVMLSAETASGQFPVEAVAMMRRIIAQTEADPHYRAAIDASHTPPGANTPDAIGCAAHSVAGLLDVAAMVAYTSSGASALRMARERPRAAILGMTPRPETARRLALVWGVHPVICDGVLDVEAMTDVARQTAVQRRFAQAGQTLVIAAGLPFGTPGSTNLLRIAQVE

SEQ ID NO: 7620 - DNA, 1440 bp, Ralstonia solanacearum
  CDS (1)..(1440)
atgactcgcgccaccaagatcgtcgccacactcggcccttcgtccaatacgctggagatcctgacgcgcatgatcgcggcgggggtggacgtggtgcggctgaacttctcgcacggcaccgcgcaggaccacgtggcgcgcgccgagctggtgcgcgagacggcgcgcgcggtgggccgcgaggtcggcatcatggccgacctgcagggcccgaagatccgcgtcggcaagttcgagagcggcaagatcaccctgagcccgggcgagcgcttcacgctggatgcccgctgcgagctgggcaaccaggagcgcgtcggcctggactacaaggagctgccgcgcgacgtcggccccggtgacctgctgctgctcaacgacggcctgatcgtgctgcaggtcgagcgcgtggtgggcgaggagatcgagaccgtcgtcaaggtcggcggcgatctgtccaacaacaagggcatcaaccgccagggcggcgggctgtcggcgccggcgctgacggccaaggacatggaagacatcaagaccgcgatggcgctgggcgccgactacatcgcggtcagcttccccaagaacgccaccgacatggaaatggcgcgccagctggccgccgtggccggcgcgccgcacagccacaagaccaagatgatcgccaagatcgagcgtgccgaggccatccgcccgggcgtgctggaagagatcctggcggcgtccgacggcatcatggtggcgcgcggcgacctcgcggtggaggtcggcaacgcggccgtgccggcgctgcagaagcgcatgatcaagctcgcgcgcgaggccaacaagctggccatcacggccacgcagatgatggagtcgatgatcgtcaacccggtgccgacgcgcgccgaggtgtcggacgtcgccaacgccgtgctcgacggcaccgatgcggtgatgctgtcggccgagaccgccgccggccgctacccggtcgagaccatcgaggccatggccgccatctgcgtggaggccgagaagtcgcagccggtgcacctcgacacggatttcctcgaccagaccttcagccgcatcgaccagtcgatcgccatgggggcgctgtttacggcctaccatctgcaggtcaaggcgattgccgcgctgaccgactcaggtgccaccgcgctgtggatgagccgccacggcatcaatgtgccgatctatgcgatcacgcccaacgtcgcgtcgcagcgcaagatggccctgtaccgcaacgtgcagccgctgccgctggccatcagcctggaccgcgacgaggcgctgcggcaggccgaggagctgctggtcgcgcgcggcgtggtgcagcgcggcgacttcatcgtcctgaccgtcggcgagccgatggggcaggcgggcgggaccaacacactcaagatcgtgcgcgtcggcatgcactga

SEQ ID NO: 7621 - protein, 479 aa, Ralstonia solanacearum
MTRATKIVATLGPSSNTLEILTRMIAAGVDVVRLNFSHGTAQDHVARAELVRETARAVGREVGIMADLQGPKIRVGKFESGKITLSPGERFTLDARCELGNQERVGLDYKELPRDVGPGDLLLLNDGLIVLQVERVVGEEIETVVKVGGDLSNNKGINRQGGGLSAPALTAKDMEDIKTAMALGADYIAVSFPKNATDMEMARQLAAVAGAPHSHKTKMIAKIERAEAIRPGVLEEILAASDGIMVARGDLAVEVGNAAVPALQKRMIKLAREANKLAITATQMMESMIVNPVPTRAEVSDVANAVLDGTDAVMLSAETAAGRYPVETIEAMAAICVEAEKSQPVHLDTDFLDQTFSRIDQSIAMGALFTAYHLQVKAIAALTDSGATALWMSRHGINVPIYAITPNVASQRKMALYRNVQPLPLAISLDRDEALRQAEELLVARGVVQRGDFIVLTVGEPMGQAGGTNTLKIVRVGMH

SEQ ID NO: 7622 - DNA, 1443 bp, Salmonella typhimurium
  CDS (1)..(1443)
atgtccagaaggcttcgcagaaccaaaatcgttaccacgttaggcccggcaactgaccgcgataacaaccttgagaaggttatcgccgcgggcgcaaacgtagtacgtatgaacttctctcacggctcgccggaagatcataaaatgcgtgctgataaagtccgtgagattgccgccaaactggggcgtcatgtggctattttaggcgacctgcaagggccaaaaattcgcgtttccacttttaaagaaggcaaagtgttcctcaacatcggggacaaatttctgttagacgctaacctgggtaaaggcgaaggcgacaaagaaaaagtcggcattgattacaaagggttgccggcagacgtcgttcctggcgatatcctgctgcttgacgatggtcgagtgcagttgaaagtgcttgaagtccagggcatgaaagtctttaccgaggtcaccgtcggcggcccgctgtctaacaataaaggcattaacaagctcggcggcgggctttctgctgaagcgctgaccgaaaaagacaaagccgatattcaaaccgctgcgctgataggtgttgactatctggccgtctccttcccgcgctgcggcgaagatctgaactatgcacgccgcctggcgcgcgacgccggctgcgacgcgaaaattgtggctaaggtcgaacgcgccgaagcggtatgcgaccaaaacgccatggacgatatcattctggcctctgacgttgtgatggtcgcacgtggcgatctgggcgttgaaatcggcgatccggagctggttggtatccagaaagcgctgattcgccgtgcgcgtcagctaaaccgcgcagtcatcaccgcaacgcaaatgatggagtcgatgatcaccaacccgatgccgacccgtgcggaagtgatggacgtggcgaacgccgtcctggatggcacggatgcggttatgctgtctgccgaaaccgcagccggtcagtatccttctgaaaccgttgccgcaatggcgcgcgtctgcctgggcgcagaaaaaatccccagcatcaatgtgtctaaacaccgtctcgacgtgcagttcgacaacgttgaagaagccattgccatgtctgcgatgtatgcggcaaaccatctgaaaggcgttaccgcgatcatcaccatgacggaatccggtcgtaccgcgctaatgacttcccgtatcagctccggcctgccgattttcgccatgtcgcgccatgaacgcacgctgaacctgaccgcgctctatcgcggagtaacgccggtgcattttgatagcgcggctgatggcgttgtcgcggcacatgaagctgttaatctgctgcgcgataaagggtatctggtttccggcgacctggttatcgtgacccagggcgatgtcatgagcaccgtcggttcaaccaataccacgcgtattttgaccgttgagtaa

SEQ ID NO: 7623 - protein, 480 aa, Salmonella typhimurium
MSRRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGIDYKGLPADVVPGDILLLDDGRVQLKVLEVQGMKVFTEVTVGGPLSNNKGINKLGGGLSAEALTEKDKADIQTAALIGVDYLAVSFPRCGEDLNYARRLARDAGCDAKIVAKVERAEAVCDQNAMDDIILASDVVMVARGDLGVEIGDPELVGIQKALIRRARQLNRAVITATQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVHFDSAADGVVAAHEAVNLLRDKGYLVSGDLVIVTQGDVMSTVGSTNTTRILTVE

SEQ ID NO: 7624 - DNA, 1386 bp, Pyrobaculum aerophilum
  CDS (1)..(1386)
atgagcgctcccagaggagatcacgccattctgcgcgcgcgtaatctcactaagagagttgcaacgctgggcccgtctacagacgttttacggccagacgagttgattaaatttctggacttagttgacggcgttaggattaacctagcccacgcatctcccaatgaagtcaaattcagaatagaggcagtgcgctcttatgaaaaggcaaagaataggccgctggctgtaattgtggatctcaaggggcccagcatcagagtgggcagtacctcgcctattaacgtgcaagaaggggaagtggtcaagtttaaactgagcgataaatctgacggcacgtatatccccgtgcctaacaaggcctttttcagcgcagtggaacaaaacgatgttattttaatgcttgatggaaggctgaggctaaaggtaacaaataccggctctgattggattgaggctgtggccgaatccagcggagttataactggcggcaaagctattgtcgttgagggcaaggattacgacatatccacgcctgcggaggaagacgtagaggcgttaaaggccatttctcccattagggataatattgactacgtggcgataagtctcgcgaaaagttgtaaagacgtagacagcgtaagatctctactcacggagctcggctttcaaagccaagtggcagtaaaaatagagactaaaggcgctgttaataatttagaagagcttgtccagtgtagcgattacgtagtagtggctagaggcgacttggggctacactacggccttgacgctctgcctatagtacagaggaggatagtgcacacgtcgcttaaatacggcaagccaattgccgtggccactcagcttttagactccatgcagagctctccaattcccacaagagctgagataaacgacgtctttacaactgcgtctatgggagtagacagcttgtggttaactaatgagactgccagcgggaaatatcctctagccgctgttagctggctttcaagaattttaatgaacgtcgaatatcaaataccacaatccccattgttgcaaaattccagagaccgcttcgccaagggactcgtggagctggcgcaggacttaggggctaacattctcgttttcagcatgagcgggacgttggcgagaagaatcgcgaaatttagacctcgaggcgtggtttacgtcgggacgcctaatgttagagtcgcccgctctctgtcaattgtctgggctctagagcctttatatatacccgctgagaattacgaggaggggcttgagaagttaatatcgcttaaaggaactacgccgtttgtggccacgtacggaatcagagggggtgtccactcggtaaaggtgaagctctag

SEQ ID NO: 7625 - protein, 461 aa, Pyrobaculum aerophilum
MSAPRGDHAILRARNLTKRVATLGPSTDVLRPDELIKFLDLVDGVRINLAHASPNEVKFRIEAVRSYEKAKNRPLAVIVDLKGPSIRVGSTSPINVQEGEVVKFKLSDKSDGTYIPVPNKAFFSAVEQNDVILMLDGRLRLKVTNTGSDWIEAVAESSGVITGGKAIVVEGKDYDISTPAEEDVEALKAISPIRDNIDYVAISLAKSCKDVDSVRSLLTELGFQSQVAVKIETKGAVNNLEELVQCSDYVVVARGDLGLHYGLDALPIVQRRIVHTSLKYGKPIAVATQLLDSMQSSPIPTRAEINDVFTTASMGVDSLWLTNETASGKYPLAAVSWLSRILMNVEYQIPQSPLLQNSRDRFAKGLVELAQDLGANILVFSMSGTLARRIAKFRPRGVVYVGTPNVRVARSLSIVWALEPLYIPAENYEEGLEKLISLKGTTPFVATYGIRGGVHSVKVKL

SEQ ID NO: 7626 - DNA, 1440 bp, Rhizobium meliloti
  CDS (1)..(1440)
atgagacggaacaggaaagtcaaaatcctcgcgacgctcgggccggcatcggccgacgagcaaatgattcagaagctgcacgaggcgggggccgatctgttccgtatcaacatgagccatgcaagccatgaggtcatgcgcacgctgatcgagcggatccgtgtggtcgaggcgcgctgcggccgtccgatcggcatcctcgccgatctgcaggggccgaagctgcgcgtcggaaagttcgccgaaggcaaggtcgagctcaagatcggccagacattcacgctcgacaaccgcgacgtgcccggcgacagccgccgcgtctatcttccgcatccggagatcctcgaagcggtgaagcccggccatcgcctgctcatcgacgatggcaagctgcatctgcgcgccgaaaagaccgatggcaagagcatcgtcaccacggtcgtttccggcacgcggatttcggatcgcaagggcgtcagcctgcccgataccctgcttggcgtcggcgcgctgacggacaaggaccgcgtcgacctcgacgccgtgctggcgacaggagaggtcgattgggtggcgctttccttcatccagcgccctgaggaccttgccgaggttcgcaagatcgcccgcggccgcgttggactgatgtcgaagatcgagaagccgcaggcgatcgagcggatagacgagatcatcgagctttcggatgcgctgatggtggcacgcggcgacctgggcgtcgaaatgccgctcgaatccgtaccgggacttcagaagcaactgacgcgtgcctgccggcgagccggcaagccggtcgtcgtcgccacgcagatgctcgaatcgatgatctcctcgcctgtgccgacgcgcgcagaagtgtcggacgtggctaccgccgtgttcgagggtgccgatgcggtgatgctttcggccgaatccgcctccggcgagtaccccgtcgaggcggtttctaccatggcgtcgatcgccagcaacgtcgagcgcgatccgcattatccggggatcatctacgctcagcgcacgccgccggaggcaacgggcgcggacgccatttcgcttgccgctcaccagatcgccgagacgctcaagcttgccgcaatcgtgacctacacctcctctggcaccaccggcctgcgcgcggcgcgcgagcgcccccaggtgcctgtcatcgcgctttcgccgatcgtccagacggcccgtcgcctttccgtggtctgggggctgcactgtgtcgtcacagaggacgcgaccgacctcgacgatatggtcaaccgcgcctgtcgaatcgtctcgacggaaggcttcggcaagccgggagaccgcatcatcgttaccgccggcgtgccgctcggtacccccggcgccaccaacatgctgcgcatcgcctatatcggctcggacggccaatcgggcatctga

SEQ ID NO: 7627 - protein, 479 aa, Rhizobium meliloti
MRRNRKVKILATLGPASADEQMIQKLHEAGADLFRINMSHASHEVMRTLIERIRVVEARCGRPIGILADLQGPKLRVGKFAEGKVELKIGQTFTLDNRDVPGDSRRVYLPHPEILEAVKPGHRLLIDDGKLHLRAEKTDGKSIVTTVVSGTRISDRKGVSLPDTLLGVGALTDKDRVDLDAVLATGEVDWVALSFIQRPEDLAEVRKIARGRVGLMSKIEKPQAIERIDEIIELSDALMVARGDLGVEMPLESVPGLQKQLTRACRRAGKPVVVATQMLESMISSPVPTRAEVSDVATAVFEGADAVMLSAESASGEYPVEAVSTMASIASNVERDPHYPGIIYAQRTPPEATGADAISLAAHQIAETLKLAAIVTYTSSGTTGLRAARERPQVPVIALSPIVQTARRLSVVWGLHCVVTEDATDLDDMVNRACRIVSTEGFGKPGDRIIVTAGVPLGTPGATNMLRIAYIGSDGQSGI

SEQ ID NO: 7628 - DNA, 1745 bp, Mastigamoeba balamuthi
  CDS (36)..(1541)
gaaacgcacgaggcacctcctcctccgcagcaaacatggcccagaagaccgtccgccccgccaagctcaccaagatcgttgcgaccgtcagcgatctgcgctgccaggttgagaccctgcgccagctgtggatgaccggcgtcgatgtgatccgcctgaacacggcgcaccagaccgaggccgacaccctcctcgtcgtcgagaacgcccgcgccgtcggccggacgatccccctgatgctcgacaccaagggccccgaggtgcgcactgcgctcctgacggccgagaaggtcatcgacgtcaagaccggcgacaaggtcttcgtctgccccagcgaggccatcctcaacgagtacaaggccaagggccagaacgccttcacgaccaactacgcgcgtttcaccgacgaggtcggcatgaacaaccgcgtcctgatcgacgacggcctgctgggcatgcacgtcgttgccaaggacgaggccaggcgcgtcctggagctcgtcgtcgagaacgacggtgtcatcaagggccgcaagtcggtcaacacccccgacgtcaagctccagctcgagtcggtcaccgagcgcgacaagaccttcctcaggttcgccgccaagcacgacctcgagttcgtcgcccactcgttcgtccgctgccgcaaggacatcgaggacgtccgcgccatcctcagcgagaacggctcgcacgcccagatcatcgccaagatcgagaaccgtgagggcatcgacaacatcgacgagatcctcgacgttgccgacggcatcatggttgcccgtggcgacctcggcatcgaggttcccttcgaggaggtccccatgatgcagaagatgctcatccgcaagtgcaacgagcgcgccaagcccgtcatcactgccacccagatgctccacacgatgatggagaaccctcgcccgacccgcgccgaggtctcggacatcgccaacgccatcctcgacggcactgacgcgattatgctgtcgggcgagaccgcctcgggcaagtacccgttcgagtctgtcgagaccatggtcaagatcgccatgcgcatcgagagcgagcgcgccaagaacaaggagctgtggactcgcacgctctgcaagagcatcaacaccccccgcgcggtgctctgctcggcggccatgtcggccatccagacgctgcccgtcaaggcgctcgtctgcgacaccctcaccggccgctcggcccgcatcatcgcgacgtacaaggcgcccgtccccgtgtacgcgcagtgccacgactcgcgcatcagccgcatgctggcgctgtcgtacggtgtctactcgcgctacgtgcccctccccaactcgaccgacgcgctcatcgtcgagtcgctgacggcgctctcggagcccgccactgtcggcaaggacgacctgatcgtcttcgtcgcgggcacccccggcaaccagaagggctcgaacatcatcgagatcaacactgtcgacctgatcctccagggccacagcgcgcactgcgtcaaggctgaggagcgcatctagagcggcttcctctccctctttactagctactgcccccgcatgaaccacctccctaatgcatccccttaaccctccttcgtctgtcgcacacgggacgcacgaagggtcgtttcattaatcggctgcaacaacggaaacttctgagttcgcgttcataagacaaacaaaccttctgccttgttctccaaaaaaaaaaaaaaaaaa

SEQ ID NO: 7629 - protein, 501 aa, Mastigamoeba balamuthi
MAQKTVRPAKLTKIVATVSDLRCQVETLRQLWMTGVDVIRLNTAHQTEADTLLVVENARAVGRTIPLMLDTKGPEVRTALLTAEKVIDVKTGDKVFVCPSEAILNEYKAKGQNAFTTNYARFTDEVGMNNRVLIDDGLLGMHVVAKDEARRVLELVVENDGVIKGRKSVNTPDVKLQLESVTERDKTFLRFAAKHDLEFVAHSFVRCRKDIEDVRAILSENGSHAQIIAKIENREGIDNIDEILDVADGIMVARGDLGIEVPFEEVPMMQKMLIRKCNERAKPVITATQMLHTMMENPRPTRAEVSDIANAILDGTDAIMLSGETASGKYPFESVETMVKIAMRIESERAKNKELWTRTLCKSINTPRAVLCSAAMSAIQTLPVKALVCDTLTGRSARIIATYKAPVPVYAQCHDSRISRMLALSYGVYSRYVPLPNSTDALIVESLTALSEPATVGKDDLIVFVAGTPGNQKGSNIIEINTVDLILQGHSAHCVKAEERI

SEQ ID NO: 7630 - DNA, 2207 bp, Toxoplasma gondii
  CDS (225)..(1820)
ggcacgagcccgtgtgctacccttttttccgtttctcgcctgtgtgcggaatctggtgcttttacccgtaacgaacactttcgaatgcgagcgtctgtcgtcactgaggtttgttcacctgtccgtgtcggttcgtgtgtgtgacgctttctgcgttttttctgttcctgccacaactgtttgcttgggctttttgactttttacctgctctcctcttatcacaatggcatctaaacaaccgcagacactgagcgccggcgccgtcgagagcggccgcgttgcccgcctcgtgtccgccagttctgtgatgactcagcagctgggaaaaagcacgaacatccgcatgtcccagattctggagccgcgctccgaagaagactggactgcccaccgcactcgcattgtctgcaccatgggccccgcatgctggaacgtagacaccctcgtcaaaatgatcgacgctggcatgaacgtctgccgcttgaacttctcgcacggcgaccacgaaacacacgcacgcactgtccagaacatccaggaagccatgaagcaaagacctgaagcgcgcttggcgattctcctggacaccaagggacccgaaatccgcactggattcttgaaggaccacaagcccatcactctgcagcaaggcgccactctgaagatcgtgacggactacaacttgattggcgacgagacaacgattgcatgctcctacggtgccctccctcaatcggtgaagcccggcaacaccattctcattgccgacggttccctctccgtcaaggtcgttgaagttgggagcgattacgttattacccaggctcagaacaccgctaccatcggcgaacgcaagaacatgaacctacccaacgtcaaagtccagctgcccgtcattggcgagaaggacaagcacgacatcctgaactttggcattcccatgggatgcaactttattgctgcttccttcgtccaaagcgcggatgatgtccggtacattcgcggtctgcttggcccccgtggccgccacatccgcattattccgaagatcgagaatgtcgagggtctcgtcaacttcgacgaaattctcgcggaagccgacggtatcatgatcgcgcgtggtgacttgggaatggaaatcccccccgaaaaggttttcctggctcagaagatgatgattgctaagtgcaacgtcgtgggcaagcccgttattacagcgacccagatgctggagagtatgatcaagaacccgcgcccgacacgtgcggaggccgccgatgtggcgaacgcggtgttggacggcacagattgcgtgatgctttctggagagactgctaacggagaattcccggttatcaccgttgagacaatggcccgcatctgctacgaggcggaaacctgcgtggactaccctgcgctgtaccgtgccatgtgcctggcagttcccccacccatttcgactcaggaagctgttgcgagagcagctgtcgagacggccgagtgcgtcaacgcagcgatcatcctggctttgaccgagaccggtcagactgcgcgtctgatcgccaagtaccgcccgatgcagccgattctggccctgagtgcttcagaaagcaccatcaagcacctgcaggtgatccgcggtgtgacgacgatgcaggttccctcgttccagggaaccgaccacgtgatcagaaacgcgattgtcgtggccaaggagagagaactcgttactgagggcgagagcatcgtcgctgtgcacggcatgaaagaggaagtcgctggctccagcaaccttctcaaggttcttactgtggagtaaactgcagaacagagcaggtgcgaaggaatagacgcaggagcaagaaggagagagcttctatgtagacgatgtcggaatcgagtttttggcagttggttacggtttttttttatgtccctccaaccagaatcgagtagcaccttccacagtggacgcatgtggtaattttccacggagggcagtggcgtgcgacgaaaaggttgccgcctgcgaccgtgcctgatttttttttgcgttggtgaaactttctgcattttgcctttttctgttccccacaagattcgactcgcaagtgaccagcgtttttaccgtagttcgttgctgcgaccttgacgtgaactgaaagaggatagcgtaaacctctgcctcctcgaaaaaaaaaaaaaa

SEQ ID NO: 7631 - protein, 531 aa, Toxoplasma gondii
MASKQPQTLSAGAVESGRVARLVSASSVMTQQLGKSTNIRMSQILEPRSEEDWTAHRTRIVCTMGPACWNVDTLVKMIDAGMNVCRLNFSHGDHETHARTVQNIQEAMKQRPEARLAILLDTKGPEIRTGFLKDHKPITLQQGATLKIVTDYNLIGDETTIACSYGALPQSVKPGNTILIADGSLSVKVVEVGSDYVITQAQNTATIGERKNMNLPNVKVQLPVIGEKDKHDILNFGIPMGCNFIAASFVQSADDVRYIRGLLGPRGRHIRIIPKIENVEGLVNFDEILAEADGIMIARGDLGMEIPPEKVFLAQKMMIAKCNVVGKPVITATQMLESMIKNPRPTRAEAADVANAVLDGTDCVMLSGETANGEFPVITVETMARICYEAETCVDYPALYRAMCLAVPPPISTQEAVARAAVETAECVNAAIILALTETGQTARLIAKYRPMQPILALSASESTIKHLQVIRGVTTMQVPSFQGTDHVIRNAIVVAKERELVTEGESIVAVHGMKEEVAGSSNLLKVLTVE

SEQ ID NO: 7632 - DNA, 1317 bp, Sulfolobus tokodaii
  CDS (1)..(1317)
atgtttagaaagaccaaaattatcgcgactttgggacctagtagtgaaaatcacattgatgaattagtaaagtatgtagacgtaataaggttaaatttcgcgcatggagataaagaacagcatgaaaagtactttaatctagtaaaaaatagagttcctattctagtagatttgccagggccaaagcttaggatcggtgatttagggaaaaatatgatattacttaaacctggagataccatagaatttggaactcaaatccccgtagatgatattttattctttaaacttatcagaaaaggttcagaggtactaatatctgatggaagaattagagtaaaaataatagaggctggaaacaattacgctaagggattagtagaagaaggaggtattttaacatccagaaagggtataaacatcccagattccgaaataccagtaggattgactgatagggatttagagttattaaaatatgctttagaaatgggagcaacatttattggactctcatttgtaacttcaccagaggagattagaaaagctaaagaaattgttaaagaccaagcctggataatagctaaaatagagaaaaaatctgcgttaaagaagttgaaagagataataagggaagccgatggtgtaatggttgctagaggcgatttgggagtagaagtaggtttagctaatttaccacaaactcagagaagaattgttagactgactagattatatggtaagcccgtaattttggccacacaagtgcttgagtcaatggttacttctccaattccaactagagctgaagtgattgatgttgcaaattcaataattcaaggtgttgatgcgataatgcttagtgatgaaactgccatgggccaatatcctatagatgctgtaaggactttgcatgagctaatattaagtgttgagagatcttttaaacccagacctccaccaccactaaaaaatatagatgatgcaatagcatattcagctgtatctgcttcaaatctggcttcttcatctggtatagtagtttatactaggactggtgcttcagcactaaggatatctaggttaagaccagtagttccaataatagtattaactcaaaatcaaagggtctacgagagactaaaactttgttatggaatctactcttttatttcagaagaattaaatagtctagataatattgttgaaaagagcaaaaacatagctagacaagtaggtttaaagaacactataataataattgctggtggaatagaagaagggtcaactagatttttaaaagttgaggagatctaa

SEQ ID NO: 7633 - protein, 438 aa, Sulfolobus tokodaii
MFRKTKIIATLGPSSENHIDELVKYVDVIRLNFAHGDKEQHEKYFNLVKNRVPILVDLPGPKLRIGDLGKNMILLKPGDTIEFGTQIPVDDILFFKLIRKGSEVLISDGRIRVKIIEAGNNYAKGLVEEGGILTSRKGINIPDSEIPVGLTDRDLELLKYALEMGATFIGLSFVTSPEEIRKAKEIVKDQAWIIAKIEKKSALKKLKEIIREADGVMVARGDLGVEVGLANLPQTQRRIVRLTRLYGKPVILATQVLESMVTSPIPTRAEVIDVANSIIQGVDAIMLSDETAMGQYPIDAVRTLHELILSVERSFKPRPPPPLKNIDDAIAYSAVSASNLASSSGIVVYTRTGASALRISRLRPVVPIIVLTQNQRVYERLKLCYGIYSFISEELNSLDNIVEKSKNIARQVGLKNTIIIIAGGIEEGSTRFLKVEEI

SEQ ID NO: 7634 - DNA, 1626 bp, Thermoplasma volcanium
  CDS (1)..(1626)
atgaagaccaagatcgtagcaacggtaggacctgcaagtgaagatccgtcgatacttaagcaaatggtaaaaaatggattatccttaatcagaatcaactccgcacacgctgaaatttcctatgtagcaaaaatagtaaaagagatgcgcgatataaatccagatgtaggtgtaatggtcgatctcaagggcccagagcttaggactggaacctttcctggcggttcactgcgcatatctaaaggaaataaatacaccataggaaaagaaatcacgctgaataatgaaaaagccattggaaatattcagactggcgacaaagtcctgatgagcgatggtgaggtggaatttaccgttgatagcacttcgcctatagtgctaatagcagaaaatgatggtgttctacgagacaggagcagagtgaatgtccctgggagatacgttgaaattgggtccataaccgaaagagataagagtttcgtaattgagggtataaaacaaggcgtagacttctttgccttatctttcgtacaaaatgctgaaaatgtgaacagccttagggatttcataatagagaatggcggtaaccagtacataatagcgaaaattgagacaaagagcggccttgataacattgagagcatagttcaggcatcagacggaataatggtagcgagaggcgatctcggagtcgaactccccctgaaagaagttgttatggcgcagaagaagataataaagatctctcatgaggatggggatttcacaatagtcgctacacaggtactggagtctatggttaacaatgcatttccaacaagggcggagatatcagatataaccaatgctataatagacaatgccgatgccctcatgctgtctgaagagagtgcgataggcaaatacccagcacttgctgtacagacactgcgtgacgtatccgattatgtggaaaatctcgttgattttcaatcgtcttacacctttaaaggcaacaaaatagcttattcagtcgcgaaggcagcaaaagtgctttccgatgatataaacagcaatggaattgttgcactgacacacaccggatcgactgtaaaaatgatctcttcgcttaggccaaaggcgctggtctatgctgggactgttgatgactcgctgtctaggaagcttaatatttacttcggagttgttcctctgcatctaaaaagagattcagaatctctcagttttgccgatctgacagaatacatcttaaaatctgcatttttcaagagtggggataagatcgtagtaacaagcggcgatccgtattttacctttggcggcacgaatgacgtccgtgttatggctataggtgaattcctgggccgtggatatcctcaaggcaaagatgccttcggaacagcaacatacgggaaaaatggaaatattctaatttcaaatagcaaggatgtacctgacgggaacttcgacgcgtatatatttacggctgatgtaaagccatcagaagttaaaaagatcaacggtaaaactgcggtttttaaaacgaggcttgcaaggaccatcaacgaaggtgagaggatctatatagatggaaatacaggtataatattaaaatatgaaaaataa

SEQ ID NO: 7635 - protein, 541 aa, Thermoplasma volcanium
MKTKIVATVGPASEDPSILKQMVKNGLSLIRINSAHAEISYVAKIVKEMRDINPDVGVMVDLKGPELRTGTFPGGSLRISKGNKYTIGKEITLNNEKAIGNIQTGDKVLMSDGEVEFTVDSTSPIVLIAENDGVLRDRSRVNVPGRYVEIGSITERDKSFVIEGIKQGVDFFALSFVQNAENVNSLRDFIIENGGNQYIIAKIETKSGLDNIESIVQASDGIMVARGDLGVELPLKEVVMAQKKIIKISHEDGDFTIVATQVLESMVNNAFPTRAEISDITNAIIDNADALMLSEESAIGKYPALAVQTLRDVSDYVENLVDFQSSYTFKGNKIAYSVAKAAKVLSDDINSNGIVALTHTGSTVKMISSLRPKALVYAGTVDDSLSRKLNIYFGVVPLHLKRDSESLSFADLTEYILKSAFFKSGDKIVVTSGDPYFTFGGTNDVRVMAIGEFLGRGYPQGKDAFGTATYGKNGNILISNSKDVPDGNFDAYIFTADVKPSEVKKINGKTAVFKTRLARTINEGERIYIDGNTGIILKYEK

SEQ ID NO: 7636 - DNA, 1437 bp, Rhizobium loti
  CDS (1)..(1437)
atgagacgcagccgcaaggtcaagatcctagccacaatcggtccggcctcctcctccgaggagatgctgcagaagctgttcgaagcgggcgccgatgtgttccgcatcaacatgagccataccgaccacgaactgatgcgcacgctggtcgggcgcatccgcgccgtcgaggaaaaggtcggccggccgatcggcatcctcgccgacctgcaaggccccaagctgcgcgtcggcaagttcgccaatggcaaggaggtgctgacgccaggccagaccttcacgctcgacgacaatcccgagcccggcacgtcgagcagggtctatctgccgcatccggaaatcctgagttcggtcgagcccggtcaccgtcttttgatcgacgacggcaagctcgagctgaaggcggtgaagagcgatggcaagtcgatcgtctgcacggtcgtcgccggcaccacgatttccgacaagaagggcgtcagcctgcccgataccgacctgccggtcggcgctctgaccgaaaaggaccgcaaggatctcgacgcggtgctcgccacgggcgtcgactggatcgcgctgtccttcgtgcagcgccccgaggatctggccgaggcgcgcaagatcgcgcggggccgggcgctgatcatggccaagatcgaaaagccgcaggccgtcgcccgcttggccgagatcatcgaactgtccgacgcgctgatggtcgcccgtggcgatctcggcgtcgaaatgccgctggaagccgttcccggcatccagaagcagatcacgcgcgccgcgcgccgcgccggcaagccggtggtggtcgccacgcaaatgctggaatcgatgatcaccgccccggtgccgacccgcgccgaagtctccgacgtctcgatcgccgtcttcgagggcgccgacgccatcatgctgtcggcggaatcggcggcgggtgcctatcccgtcgaagccgtggcgatgatggaccgcatcgccaccaaggtcgaaaccgatccgacctatgccggcatcatcaacgcccagcgctccgagccggaagcgaccggagccgacgcgatctcgctggctgcccgcgaaatcgccgagactctgaaactgtcggcgatcatcacctacacggcgtccggcaccaccgggctgcgcgccgcgcgcgaacggccacaggtgccgatcatcgctctgtcgccgatcctcaacaccgcacggcggctgtcgcttctgtggggcacgcactgtgtcgtttcgcccgatgccaccgatctcgacgacatggtcaaccgcgcctgccgcattgcgctggaagaagagttcggcaagccgggcgaccgcgtcatcatcacggccggtgtgccgctgaggacgcccggctcgaccaacatgctgcgcattgcctatgtcgggtcggaaaagcagggcagccggtaa

SEQ ID NO: 7637 - protein, 478 aa, Rhizobium loti
MRRSRKVKILATIGPASSSEEMLQKLFEAGADVFRINMSHTDHELMRTLVGRIRAVEEKVGRPIGILADLQGPKLRVGKFANGKEVLTPGQTFTLDDNPEPGTSSRVYLPHPEILSSVEPGHRLLIDDGKLELKAVKSDGKSIVCTVVAGTTISDKKGVSLPDTDLPVGALTEKDRKDLDAVLATGVDWIALSFVQRPEDLAEARKIARGRALIMAKIEKPQAVARLAEIIELSDALMVARGDLGVEMPLEAVPGIQKQITRAARRAGKPVVVATQMLESMITAPVPTRAEVSDVSIAVFEGADAIMLSAESAAGAYPVEAVAMMDRIATKVETDPTYAGIINAQRSEPEATGADAISLAAREIAETLKLSAIITYTASGTTGLRAARERPQVPIIALSPILNTARRLSLLWGTHCVVSPDATDLDDMVNRACRIALEEEFGKPGDRVIITAGVPLRTPGSTNMLRIAYVGSEKQGSR

SEQ ID NO: 7638 - DNA, 1440 bp, Pasteurella multocida
  CDS (1)..(1440)
atgtctagaagactaagaagaacgaagattgtatgtacaatgggaccgtcaacagagcgtgggaataatcttgaaaaaattatcatggctggcgcgaatgttgttcgtatgaacttttctcatggcacaccagaagatcatatcggtcgcgcggagaaagtacgtgaagtggcaaaaaaacttggaaaaaccgttgctattttaggtgatttacaaggccctaaaatccgtgtctcaactttcaaagatggtaaaattttcttaaatattggtgataaatttgtgcttgatgccgatttaccaaaaggtgaaggtacgcaagaaggtgttggtttagactacaaaacattaccacaagacgttgtgccaggcgatattttattgttagatgatggtcgtgttcaattaaaagtcttatctacagaaggtaataaagtttttactgaagtcactgttggtggtccattatcgaacaataaaggtattaacaagttaggcggaggtttatctgctgatgcattaactgaaaaagataaaaatgatattttattggcagcaaaaatcggtgtagattatttagcggtttctttccctcgttcaagtgcagatttaaactatgcgcgtgagttagctgaagctgcaggcttaaaagcaaaaatcgtggcaaaagtagaacgtgcagaaactgttgcaaccactgaagcaatggatgatattattttagcatcagatgtcatcatggtagcacgtggtgacttaggggttgaaattggtgaccctgaattagtgggtgtacagaaaaaattaatccgtcgcgcacgccaattaaaccgtgttgttattacagcaacacaaatgatggaatctatgattagcaatccaatgccgactcgtgcggaagtgatggacgtagcgaatgccgtattagatggtacagacgccgtgatgctttctgcagaaacagcggcagggcaatatccagcagaaacagtggctaccatggcaaaagtgtgtttaggtgctgaaaaaatgccaagcatcaatgtttctcgtcaccgtatggatatcacttttgattctatcgaagaatccgttgcaatgtctgcaatgtatgctgcaaaccacatgaaaggtgttgctgcaattattgcaatgacacatactggacgtaccgcgttattaatgtcacgtattagttctggtttaccgatttttgccttatctcgtaaccaagatgcattaaatctttgtgcattataccgtggtgttacacctgttcattttgatgaagtcagccgtaattcaaaaggtgcagctgcagcgattcgtttgttaaaagagaaaggtttcttagtatcgggtgatttagttcttttaactcaaggtgatgaattgttagcaagtggtacaaatacttgccgtacactagttgtagaataa

SEQ ID NO: 7639 - protein, 479 aa, Pasteurella multocida
MSRRLRRTKIVCTMGPSTERGNNLEKIIMAGANVVRMNFSHGTPEDHIGRAEKVREVAKKLGKTVAILGDLQGPKIRVSTFKDGKIFLNIGDKFVLDADLPKGEGTQEGVGLDYKTLPQDVVPGDILLLDDGRVQLKVLSTEGNKVFTEVTVGGPLSNNKGINKLGGGLSADALTEKDKNDILLAAKIGVDYLAVSFPRSSADLNYARELAEAAGLKAKIVAKVERAETVATTEAMDDIILASDVIMVARGDLGVEIGDPELVGVQKKLIRRARQLNRVVITATQMMESMISNPMPTRAEVMDVANAVLDGTDAVMLSAETAAGQYPAETVATMAKVCLGAEKMPSINVSRHRMDITFDSIEESVAMSAMYAANHMKGVAAIIAMTHTGRTALLMSRISSGLPIFALSRNQDALNLCALYRGVTPVHFDEVSRNSKGAAAAIRLLKEKGFLVSGDLVLLTQGDELLASGTNTCRTLVVE

SEQ ID NO: 7640 - DNA, 1880 bp, Arabidopsis thaliana
  CDS (126)..(1658)
ctgttcgtcgatataaaactttcttcgttaccattttgagtctccggcggctttcacactccagaaaaaaaacacagaagctacgtttttcaggactttgattaggtttttggagatttacaaaaatgtcgaacatagacatagaaggaatattgaaggagctacctaatgatgggaggactcctaagactaagatcgtttgtacattaggtcctgcgtctaggtctgtgacaatgattgagaagcttcttaaagcaggcatgaatgtagctcgattcaatttctctcacggaagccatgagtaccatcaggagactcttgacaatctccgcaccgctatgcagaataccggcattctcgctgctgttatgcttgatacaaaggggcctgagattcgtaccggtttcttgaaagatgggaaccctatacaactaaaggaaggccaagagatcacaattaccactgattatgacatcaagggcgatgagaaaacgatttccatgagctacaaaaagctcccagtggatgtgaagcccggaaataccatactatgtgcagatggaagcataagtcttgctgtcgtgtcatgtgatccaaacgctgggactgttatatgtcgatgtgaaaatacagccatgctaggtgaaagaaaaaatgtgaatctcccaggtgttgttgttgatctccccacattgactgacaaggatgtagaagatattcttaaatggggtgttccaaacaacatcgatatgattgctctttcatttgttcgcaaaggttcagatcttgttaatgtccggaaagtccttggatcacattccaagagtataatgttgatgtcgaaggttgagaaccaagaaggagtcctgaatttcgatgagattttgcgtgaaactgatgcattcatggttgctcgtggtgatcttgggatggagattccgatagagaagatcttcttggctcagaagatgatgatctacaagtgtaaccttgcaggtaaaccggtggtcacagccactcaaatgctcgagtcgatgatcaaatcaccacggccaacacgagcagaagccacagatgtagcaaacgcagttctcgatggcactgactgtgtgatgcttagcggagaaagtgctgcaggagcttaccctgaaatagcagtgaaaacaatggctaaaatctgcatcgaggcggaatcatcgcttgactacaacacaatcttcaaggagatgattagagcaactccacttccaatgagcactcttgagagtcttgcatcatcagctgtacgaacggcaaacaaagccaaagccaaactcatcatcgtgttgaccagaggaggtacaacagctaaactggtggccaagtatagaccggctgttccaattctatcggtggttgttccggtcttcaccagcgatacgtttaactggagttgcagcgatgagtcaccggcgaggcatagtttgatatatagaggtctgataccggttttgggtgaaggatctgcaaaagcaactgatagtgaatccacagaggagattattgaatctgctttgaagtcagcgacagagaaaggactgtgtaaccatggtgatgctgtggtggctctgcaccgtattggagctgcttcggttatcaagatctgtgtggtgaagtgatttttctactaaatatcttgaattttattcttggttaatgtttcttgatgaaataatccaataaagaaccagggaataggttcctgaaagtgttttgtgtggggcatttcttctctttcttttgctgttttagcttataagattatgaatgcactaatgactcttgctcatattattatagtttaattagccaataataacaatttttaaggctcgttttct

SEQ ID NO: 7641 - protein, 510 aa, Arabidopsis thaliana
MSNIDIEGILKELPNDGRTPKTKIVCTLGPASRSVTMIEKLLKAGMNVARFNFSHGSHEYHQETLDNLRTAMQNTGILAAVMLDTKGPEIRTGFLKDGNPIQLKEGQEITITTDYDIKGDEKTISMSYKKLPVDVKPGNTILCADGSISLAVVSCDPNAGTVICRCENTAMLGERKNVNLPGVVVDLPTLTDKDVEDILKWGVPNNIDMIALSFVRKGSDLVNVRKVLGSHSKSIMLMSKVENQEGVLNFDEILRETDAFMVARGDLGMEIPIEKIFLAQKMMIYKCNLAGKPVVTATQMLESMIKSPRPTRAEATDVANAVLDGTDCVMLSGESAAGAYPEIAVKTMAKICIEAESSLDYNTIFKEMIRATPLPMSTLESLASSAVRTANKAKAKLIIVLTRGGTTAKLVAKYRPAVPILSVVVPVFTSDTFNWSCSDESPARHSLIYRGLIPVLGEGSAKATDSESTEEIIESALKSATEKGLCNHGDAVVALHRIGAASVIKICVVK

SEQ ID NO: 7642 - DNA, 1517 bp, Arabidopsis thaliana
  CDS (1)..(1497)
atggcgatgatagagcaaaggccgaagacgaagatcgtttgtactctaggtccagcttccagatctgttccgatggtcgagaagcttcttagggctggtatgaacgttgctcgtttcaatttctctcatggatctcatgaataccatcaagagactctcgataatcttcatcaagctatgcttaacactgggattctctgtgccgtcatgctcgacaccaagggtccagaaatccgaaccgggttcttgaaagatgggaaaccaatccagctgaaacaaggacaagagatcactatttcgactgactatgacttgaagggtgacgagaacacgatttgcatgagctacaaaaagttggctgttgatgtgaacccaggaatggtcattctttgtgctgatggtacaatctccttactggttctctcttgtgacaaagagaacggtacagtccgttgccggtgtgagaactctgcgatgctcggtgagagaaagaacgttaatctcccaggtgttgttgtggatctcccaactctaactgagaaagacaaagaagacatcatgcaatggggagtcccgaatcaaatcgacatgattgctctgtcttttgtcaggaaaggttcagacttggttcaagtccggaaacttctaggaaagcacgccaaaaacattcttctcatgtctaaggtcgagaaccaagaaggtgtggcaaattttgatgacattttggtcaattcagacgctttcatgattgctagaggagatctgggcatggaaatcccgattgagaagatcttcttagctcagaaggtgatgatctacaaatgcaacatccagggaaaacctgtggtcacagcaactcagatgctcgagtccatgatcaaatctcctagacccacaagagccgaagctacggatgtagcaaacgcagtccttgatggtacagactgtgtcatgctcagtggtgaaactgcagctggagcataccctgaactagccgtccgtacaatggctaagatctgcgtggaagccgagagcacccttgactacggtgatgtcttcaagaggatcatgctgtactctccagttccaatgagtccactcgagtcacttgcatcttcagctgtcagaactgctaactcagctagagccactctcatcatggtcctaaccagaggaggaagcacagcaagacttgtggctaagtacagaccaggaatgcctattctatccgtcgttgttcctgagatcaaaaccgacttctttgactggtcttgcagcgatgaatcccccgcgagacacagccttatcttccgtggtctgatcccagtgctctacgctggatccgcaagagcctcacacgatgaatcaacagaagaagctatcgagtttgctactcagtacgggaaagagaaagagctatgcaagactggagattccgttgttgctctactccgagtcggtaatgcttccgtgatcaagatcttgaccgtcaagtgatgattccactcaaaaattca

SEQ ID NO: 7643 - protein, 498 aa, Arabidopsis thaliana
MAMIEQRPKTKIVCTLGPASRSVPMVEKLLRAGMNVARFNFSHGSHEYHQETLDNLHQAMLNTGILCAVMLDTKGPEIRTGFLKDGKPIQLKQGQEITISTDYDLKGDENTICMSYKKLAVDVNPGMVILCADGTISLLVLSCDKENGTVRCRCENSAMLGERKNVNLPGVVVDLPTLTEKDKEDIMQWGVPNQIDMIALSFVRKGSDLVQVRKLLGKHAKNILLMSKVENQEGVANFDDILVNSDAFMIARGDLGMEIPIEKIFLAQKVMIYKCNIQGKPVVTATQMLESMIKSPRPTRAEATDVANAVLDGTDCVMLSGETAAGAYPELAVRTMAKICVEAESTLDYGDVFKRIMLYSPVPMSPLESLASSAVRTANSARATLIMVLTRGGSTARLVAKYRPGMPILSVVVPEIKTDFFDWSCSDESPARHSLIFRGLIPVLYAGSARASHDESTEEAIEFATQYGKEKELCKTGDSVVALLRVGNASVIKILTVK

SEQ ID NO: 7644 - DNA, 1564 bp, Arabidopsis thaliana
  CDS (1)..(1533)
atgtcgaacatagacatagaagggatcttgaaggagctacctaatgatgggaggatcccaaagacgaagatagtttgcacattaggaccagcttctcgcactgtttccatgatcgaaaagcttttgaaagccggtatgaatgtggctcgcttcaacttctcacatggaagccatgaataccatcaagagacactcgacaacctccgctctgctatgcataataccggcattctcgctgctgtcatgcttgatactaaggggcctgagattcgtactggtttcttgaaagatgggaaccctatacaactgaaggaaggtcaagagattactataaccactgattatgacattcaaggagacgaatcaacgatatccatgagctataaaaagctgcctttggatgtgaagcccggaaacaccatactctgtgcagatggaagcataagtctagctgtcttgtcatgtgatcctgagtctggaactgttaggtgccggtgtgaaaactcggcgatgcttggtgaaagaaagaatgtgaatcttcctggcgttgttgttgatcttcccactttgacagataaggatattgaagatattctcggttggggtgttccgaacagcattgatatgattgctctttcgtttgtccgtaaaggttcggatcttgttaatgtccgcaaggttcttggatctcatgctaaaagcataatgctcatgtcaaaggttgagaaccaggaaggtgtgattaactttgatgagatcttgcgtgaaacagatgcgttcatggttgcccgtggtgatctcgggatggagattccgatagagaagatcttcttggctcaaaagttgatgatctacaagtgtaaccttgcgggtaaaccggtggtcacagccactcagatgctggagtcaatgatcaaatcacctcggccaacccgagctgaagccacagatgttgcaaatgctgttcttgatggtactgactgtgtgatgcttagcggtgagagtgcagcaggagcttatccggaaatagctgtgaaagtcatggctaagatctgcattgaagccgaatcctcgcttgattacaacacaatctttaaagagatgatccgagcaactccacttccaatgagcccactcgagagtcttgcatcatccgctgtacggactgctaacaaagcgagggcaaaactcatcattgtgttgacacgtggaggttcaactgctaatctcgtggctaaatacagaccggctgttccgattctgtcagtggttgtcccggttatgaccactgattcctttgactggtcttgtagtgacgagtcacctgcaaggcatagtctgatatacagaggtctaatccctatgttggctgaaggatctgcaaaggcaacagatagtgaagccaccgaagttatcattgaagctgctctgaagtcggctactcagagaggactgtgcaaccgtggtgatgcaatcgtggcgctgcaccgtattggagctgcctcagttattaagatctgtgtggttaagtgagattacagacttctttcaatacctcaaatct

SEQ ID NO: 7645 - protein, 510 aa, Arabidopsis thaliana
MSNIDIEGILKELPNDGRIPKTKIVCTLGPASRTVSMIEKLLKAGMNVARFNFSHGSHEYHQETLDNLRSAMHNTGILAAVMLDTKGPEIRTGFLKDGNPIQLKEGQEITITTDYDIQGDESTISMSYKKLPLDVKPGNTILCADGSISLAVLSCDPESGTVRCRCENSAMLGERKNVNLPGVVVDLPTLTDKDIEDILGWGVPNSIDMIALSFVRKGSDLVNVRKVLGSHAKSIMLMSKVENQEGVINFDEILRETDAFMVARGDLGMEIPIEKIFLAQKLMIYKCNLAGKPVVTATQMLESMIKSPRPTRAEATDVANAVLDGTDCVMLSGESAAGAYPEIAVKVMAKICIEAESSLDYNTIFKEMIRATPLPMSPLESLASSAVRTANKARAKLIIVLTRGGSTANLVAKYRPAVPILSVVVPVMTTDSFDWSCSDESPARHSLIYRGLIPMLAEGSAKATDSEATEVIIEAALKSATQRGLCNRGDAIVALHRIGAASVIKICVVK

SEQ ID NO: 7646 - DNA, 1581 bp, Aspergillus oryzae
  CDS (1)..(1581)
atggccgccagcagttctctcgaccatttgagcaaccgtatgaagctggagtggcactccaagctgaacacggagatggtgcccgcgaagaacttccgccgcacctccatcattggcaccattggccctaagaccaactcggtggagaagatcaacgctctccgcagatccggtctcaatgttgttcgtatgaacttctcccacggttcgtatgagtaccaccagtccgttatcgacaacgcccgtgaggccgccagagtccagaccggacgtcccctcgccattgctcttgataccaaaggacctgaaatccgtactggaaacactaccgatgataaggatatccccatcaaggagggtcacgagctcaacatcaccactgatgagaagtacgctaatgctagcgacgaccagaacatgtacctggactataagaacattaccaatgtgatcgctcccggaaagctcatctatgtcgacgatggtatcctctccttccaggttctggaggtcgttgacgacaagaccctgcgcgtcaagtgtcttaacaatggcaacatctcctctcgcaagggtgttaacctgcccggcaccgatgttgaccttcccgccctttccgagaaggatatcagtgatctcaagttcggtgtcaagaacggcgtcgacatgatctttgcctcgttcattcgtcggggaagtgacatccgccacattcgtgacgtgttgggtgaagagggtaaggagattcagatcatcgccaagattgagaaccagcagggtgtcaacaacttcgacgagattctcgaggagactgacggtgttatggtcgcccgtggtgatcttggtatcgaaatccccgcccccaaggtcttcatcgctcagaagatgatgatcgccaagtgcaacatcaagggcaagcctgtcatctgtgccactcaaatgctcgagtccatgacatacaaccctcgccccactcgtgccgaggtgtccgatgtcgctaacgctgttcttgacggagccgactgtgtcatgctttctggtgagaccgctaagggctcatacccttgtgaggctgttaagatgatgagcgagacctgtttgctcgccgaggttgccattccccacttcaatgtctttgacgagttgcgcaacctcgctccccgccccactgatactgtggaatccatcgccatggctgccgttagcgccagtcttgagcttaacgccggtgccattgttgtcttgaccaccagtggtaacactgctcgccttctttccaagtaccgccctgtgtgccccatcctgatggtcacccgtaaccctagagcttcgaggtattctcacctctaccgtggtgtctggcccttcctcttccccgagaacaagcccgacttcaacgtcaagatctggcaggaggacgttgaccgccgtctcaagtgggctatctcccacggtatcaagctcggtatcatcaacaagggagacaacattgtctgtgtccagggttggcgcggaggccagggccacaccaacaccgtccgtgtggtcccagctgaggagaaccttggtctgattgagtaa

SEQ ID NO: 7647 - protein, 526 aa, Aspergillus oryzae
MAASSSLDHLSNRMKLEWHSKLNTEMVPAKNFRRTSIIGTIGPKTNSVEKINALRRSGLNVVRMNFSHGSYEYHQSVIDNAREAARVQTGRPLAIALDTKGPEIRTGNTTDDKDIPIKEGHELNITTDEKYANASDDQNMYLDYKNITNVIAPGKLIYVDDGILSFQVLEVVDDKTLRVKCLNNGNISSRKGVNLPGTDVDLPALSEKDISDLKFGVKNGVDMIFASFIRRGSDIRHIRDVLGEEGKEIQIIAKIENQQGVNNFDEILEETDGVMVARGDLGIEIPAPKVFIAQKMMIAKCNIKGKPVICATQMLESMTYNPRPTRAEVSDVANAVLDGADCVMLSGETAKGSYPCEAVKMMSETCLLAEVAIPHFNVFDELRNLAPRPTDTVESIAMAAVSASLELNAGAIVVLTTSGNTARLLSKYRPVCPILMVTRNPRASRYSHLYRGVWPFLFPENKPDFNVKIWQEDVDRRLKWAISHGIKLGIINKGDNIVCVQGWRGGQGHTNTVRVVPAEENLGLIE

SEQ ID NO: 7648 - DNA, 1431 bp, Streptomyces coelicolor
  CDS (1)..(1431)
atgcgccgttcgaaaatcgtctgtactctcggccccgcggtcgactcccacgagcagctcgtcacgctgatcgaagccggcatgaacgtggcccgcttcaacttcagccatggcacccacgccgagcaccagggtcgttacgaccgggtccgggccgccgccaaggagaccggccgggccatcggcgtcctcgccgacctccagggcccgaagatccgcctggagaccttcgcggagggccccgtcgagctggtgcgcggtgacgagttcaccatcaccgccgaggacgtcccgggcgacaggacgatctgcggcacgacctacaagggcctgcccggtgacgtcaccaagggcgaccaggtgctcatcaacgacggcaacgtcgagctgaaggtcaccgaggtcgagggcccccgggtgaagacgatcgtcatcgagggcggcgtcatctccgaccacaagggcatcaacctgccgggcgcggcggtcaacgtccccgcgctgagcgagaaggacgtcgaggacctccggttcgcgctgcgcatgggctgcgacctggtcgccctctccttcgtccgggacgccaaggacgtcgccgacgtgcaccgcgtcatggacgaggagggccgccgggtcccggtgatcgccaaggtcgagaagccccaggcggtcgacaacatggaggacgtcgtgatggcgttcgacggcgtgatggtcgcccgtggcgacctggccgtcgagtacccgctcgagaaggtccccatggtgcagaagcgcctgatcgagctgtgccggcgcaacgccaagccggtgatcgtggcgacccagatgatggagtcgatgatcacgaactcccggccgacccgcgccgaggcctccgacgtggccaacgcgatcctggacggcgccgacgcggtcatgctgtccgccgagtcgagcgtgggcgcctacccgatcgagaccgtcaagacgatgtcgaagatcgtcaccgccgccgagcaggagctgctctccaagggcctccagccgctggtgccgggcaagaagccgcgcacgcagggcggttcggtggcccgtgcggccgccgagatcgccgacttcctgggcggcaagggcctggtcgccttcacccagtccggcgacaccgcccgccggctctcccgctatcgcgcggcccagccgatcctcgccttcaccaccgacgagtccacccgcaaccagctggcgctcagctggggagtggagccgcacgtggtgccgttcgtgaacaccacggacgagatggtggacctggtggaccaggagacggcccgcctcggccggttcagcgacggcgacaccgtcgtgatcaccgccggttcgccccccggcgtgtccggcaccaccaacatggtgcgggtcctccacctgggcgagacacggcgcggctga

SEQ ID NO: 7649 - protein, 476 aa, Streptomyces coelicolor
MRRSKIVCTLGPAVDSHEQLVTLIEAGMNVARFNFSHGTHAEHQGRYDRVRAAAKETGRAIGVLADLQGPKIRLETFAEGPVELVRGDEFTITAEDVPGDRTICGTTYKGLPGDVTKGDQVLINDGNVELKVTEVEGPRVKTIVIEGGVISDHKGINLPGAAVNVPALSEKDVEDLRFALRMGCDLVALSFVRDAKDVADVHRVMDEEGRRVPVIAKVEKPQAVDNMEDVVMAFDGVMVARGDLAVEYPLEKVPMVQKRLIELCRRNAKPVIVATQMMESMITNSRPTRAEASDVANAILDGADAVMLSAESSVGAYPIETVKTMSKIVTAAEQELLSKGLQPLVPGKKPRTQGGSVARAAAEIADFLGGKGLVAFTQSGDTARRLSRYRAAQPILAFTTDESTRNQLALSWGVEPHVVPFVNTTDEMVDLVDQETARLGRFSDGDTVVITAGSPPGVSGTTNMVRVLHLGETRRG

SEQ ID NO: 7650 - DNA, 1503 bp, Streptococcus thermophilus
  CDS (1)..(1503)
atgaataaacgcgtaaaaatagttgctacacttggtcctgcggttgaaatccgtggtggcaagaaatttggtgaagatggttactggagtgaaaaacttgaccctgatgcatctgctaaaaacattgctcaattgatcgaggaaggtgctaacgttttccgtttcaacttctcacatggtaaccacgctgagcaaggtgaacgtatggatgtcgtacgtatggctgaatctattgctggtcaaaaagtaggtttccttcttgacactaagggacctgaaatccgtactgaattgtttgaaggtgatgctaaagagtatgcatacaaaactggtgaacaaatccgtattgctactaaacaaggtctcaaatcaactcgcgacgttattgctttgaacgttgctggtgcacttgacattttcgacgatgtagaagttggtaaacaagttcttgtggatgatggtaaacttggtcttcgtgttgtagacaaggatgctgaaaaacgtgaattcatcgttgaagttgaaaatgatggtattattgctaaacaaaaaggtgtaaacatcccttacactaaaattcctttcccagcacttgctgaacgtgataatgctgatattcgttttggtctcgaacaaggtattaactttatcgcaatctcatttgtacgtactgcgaaagacgtacaagaagtacgtgctatctgtgaagaaactggaaacggccacgttaaattgttggctaaaatcgaaaaccaacaaggtatcgataatatcgatgaaatcattgaagctgctgatggtatcatgatcgctcgtggtgacatgggtatcgaagtaccattcgaaatggttccagtttaccaaaaaatgattatcactaaagtaaatgctgctggtaaaattgttgttacagctacaaacatgcttgaaacaatgacagaaaaaccacgtgcaactcgttctgaagtatctgacgtgtttaacgcagttatcgacggtactgatgcgacaatgctttctggtgagtctgcaaatggtccatatcccgttgaatcagttcgtacaatggccacaattcataaaaacgctcaaactcttcttaaagagtacggtcgtcttaattcatcaacatttgatcgctcaagtaacactgaagtcgttgcatctgcagttaaagatgctactaactcaatgcatatccaacttattgttgcacttactgaatctggtaacacagctagcttgatcgatacataccgtccagaagctgacatctgggcaataacattcgatgaacttactcaaaaatcattgatgcttaactggggtgttattccagttgttactgaaacaccttcatctactgatgatatgtttgaagttgctgagcgtgttgctcttgaatcaggtcttgtagaatcaggtgataacattgttattgttgctggtgttccagttggttctggtaatacaaatactatgcgtatccgcacagttaaataa

SEQ ID NO: 7651 - protein, 500 aa, Streptococcus thermophilus
MNKRVKIVATLGPAVEIRGGKKFGEDGYWSEKLDPDASAKNIAQLIEEGANVFRFNFSHGNHAEQGERMDVVRMAESIAGQKVGFLLDTKGPEIRTELFEGDAKEYAYKTGEQIRIATKQGLKSTRDVIALNVAGALDIFDDVEVGKQVLVDDGKLGLRVVDKDAEKREFIVEVENDGIIAKQKGVNIPYTKIPFPALAERDNADIRFGLEQGINFIAISFVRTAKDVQEVRAICEETGNGHVKLLAKIENQQGIDNIDEIIEAADGIMIARGDMGIEVPFEMVPVYQKMIITKVNAAGKIVVTATNMLETMTEKPRATRSEVSDVFNAVIDGTDATMLSGESANGPYPVESVRTMATIHKNAQTLLKEYGRLNSSTFDRSSNTEVVASAVKDATNSMHIQLIVALTESGNTASLIDTYRPEADIWAITFDELTQKSLMLNWGVIPVVTETPSSTDDMFEVAERVALESGLVESGDNIVIVAGVPVGSGNTNTMRIRTVK

SEQ ID NO: 7652 - DNA, 2150 bp, Pseudomonas hydrogenothermophila
  CDS (16)..(1437)
ttacggaaacggaagatgcgccacaccaaaatcgtcgcgacgctaggccccgcttcgagcgatcccgccacgctcgaacggctgctccttgccggcgtcgacgtcgttcgcctcaacttttcgcacggaaccgcggacgagcaccgcgcccgggcgtcgctcgtgcgtgcgctcgcacagcagacccaacgccccgttggcatcctgggcgacctccaaggaccgaaaatccgcatcggccggttcaccaccaacgctgttactctgagcaaagggcaacgctttcggctcgactgcgacctcgccccgggtgacgccacccgggttgggctcgactacccggaactgatcgacgacgtcgaggtcggcgacatcttgctcctcgacgacggcaaaattcgcttgcagatcgtcgaaaagtgcgcagacgcgctcatcacgcaggtgcttgttggcggcaccctctcgaaccacaaagggatcaacaaactgggtggcgggctttcggcgccagcgctcactgcgaaagaccgtgccgtgccgatatcgcgctcgctgccgaaatcggcgtcgattaccgtcgcggtctctttcgtcaagcacgccgaagagatgcacgaagcgcggcacttggcgcgcgctgccgggagccgcgcccgtttgatcgccaaaatcgaacgggtcgaagcgatcgctaacctcgacgcgattctggaggcgagcgacggcgtgatggtcgcgcgtggggatctcgcggtcgaggtgggcgatgctgctgtgccggcgttacaaaagcgcattttgcgccgcgcacgggaaatgaaccgcctgtcgatcaccgccacccaaatgatggaatcgatggtgcatagccccgtcccgacccgggccgaggtctccgacgtcgcgaacgcggtgctcgacggcaccgacgcggtgatgctctcggccgaaaccgcagcgggccagtacccggtcgaggcagtcgaagcgatggcgcgcgtctgcgccgaagccgacgcgtcgaacgacgcccacctcgaccaggagctcctggggcggcgttttcaccgcgtcgacgaagcgatcgcggtctccgccgtctggtcgggctaccacctaggggtgaaagcgatcgtcgcgctcacccaatcgggcgcgaccgcactctggatgagccgcatcgcaagcattctccccatctacgccctcacccccgacccggtgaccttcggccacctcaccctcttccgccaagtcacgccagttcgcttcgacctgaaccccgcgtccgacccggcaatgctcctcacacagatacgcacgctccttgtgtcgaacggctgggctgcaccaggggaaacgatcgcggtcactttcggcgaaccgatgggacaacccggcggcagcaacacgttgaagatcgttaccctctagcctgagggatacggggatggtagcattgggcaagattccaatcgtaccaggaggaggaaaaaccgtgtcagcgcaacaacaaaacccgatcagccgcttccccgtccccgaaaccctcgacgcgctccctgccgatatccgcgaacggatcgaaaaggtcgcggaaaaatcgggcttcatccccaacgtcttcttggcgctggcggcgcgtcccgaagaatttcgcgccttcttcgcctaccacgatgcgctgatggagcgcccctcgaacctcagcaaagcggaaaaagagatgatcgtcgtcgccacctccgcggcgaacgactgcctctattgcgtggtcgcccacggtgcgatcctgcgcgtgcgcagcaaaaatccgcgcctttcggagcagatcgccaccaactaccgtcgtgccgagatcaccccacggcagcgggcgatgctcgactacgcgatgaaagtggcgctcgactccgcgcgcatcaccgaagccgactgggagccgctcatcgcccacgggttcacccaagacgacatttgggaaatcggtgcgattgccgccttttttgcgatgagcaaccgcttggcgaacatgagcgcgatgcggccgaacgacgagttctacagtctggggcggtagcgtaccgtctggggcggtagcgtaccgcttgcttttttgtgccctaggccgcccccaacctttcgca

SEQ ID NO: 7653 - protein, 473 aa, Pseudomonas hydrogenothermophila
MRHTKIVATLGPASSDPATLERLLLAGVDVVRLNFSHGTADEHRARASLVRALAQQTQRPVGILGDLQGPKIRIGRFTTNAVTLSKGQRFRLDCDLAPGDATRVGLDYPELIDDVEVGDILLLDDGKIRLQIVEKCADALITQVLVGGTLSNHKGINKLGGGLSAPALTAKDRAVPISRSLPKSASITVAVSFVKHAEEMHEARHLARAAGSRARLIAKIERVEAIANLDAILEASDGVMVARGDLAVEVGDAAVPALQKRILRRAREMNRLSITATQMMESMVHSPVPTRAEVSDVANAVLDGTDAVMLSAETAAGQYPVEAVEAMARVCAEADASNDAHLDQELLGRRFHRVDEAIAVSAVWSGYHLGVKAIVALTQSGATALWMSRIASILPIYALTPDPVTFGHLTLFRQVTPVRFDLNPASDPAMLLTQIRTLLVSNGWAAPGETIAVTFGEPMGQPGGSNTLKIVTL

SEQ ID NO: 7654 - DNA, 1413 bp, Selenomonas ruminantium
  CDS (1)..(1413)
atgttaaaaaagacgaaaatcgtttgcacgcagggtccgtccacagagaaaccgggcgtaattgatgcactgattgccaatggcatgaactgcgcacgcttcaatttctcccatggtgaccacgaagaacatcttggccgtatcaatatggttcgtgaagctgccaagaaggctggcaaggttatctctttaatcctcgataccaaaggtccggaaatgcgtctgggcgagttcaaagatggcaaagttatgctcgaaaagggcaacaagttcactttgacctatgacgatgaaccgggtgatgaaactcatgtttccgtaaaccacaaaggtctttacacggaagttaagccgggcgacaccctgctcctctccgatggcctcgtagctctcaaagttgatgaaatcaagggcaaggatatcgttacgacgattcagaacagcggtaagatgagcacgcgcaagcgcgtagctgctccgggcgtaccccttggtctgcctcctatctccgaacaggatgctaaggacatcatctttggctgcgaacaggatatggatttcgtagctgcttccttcatccagcgtccggatgatgttatcgccatccgcaagctcatcgaagagcacaatggccacatggaaattctgccgaagatcgaaaacctcgaaggtgttaagaacttcgatgcaatcctggaagtttccgacggcatcatggttgcccgtggtgacctgggcgtagaagttccggcagaagatgtgccccttattcagaaggaaatcatccgcaagtgcaacgctgctggcaagccggttatcgttgctacgcagatgctcgactccatggaacgcaacccgcgtccgacccgtgcagaagtttctgacgttggtaacgccatcctcgatggtacggatgccatcatgctgtccggcgaaacggcttccggtgactatccggtagaagcagttgccacgatgaaccgcattgcacagcgcatggaaagctcccttgaatacaaggaactctatgtagaacgtggtctgcagcacatggaatcccgtacgcgtgctatcgctcatgctacggttcagatggcttatgagctcgatgctccggctattatcacgccgaccgaatccggttacacgacgaaggtcgtttccaagtatcgtccgaaggctgctatcgtagcttacacgccgagcgaaaaagttctgcgtcagctgaacctgcgttggggcgtatatccggtactcggcacccagtggagcgatgtggatgaaatgatcagcaatgcaacggctgctgctgttaaggaagacctcgtacagcgcggcgacctcaccatcatcacctccggtgtgaagatggaatcccgtacgcgtgctatcgctcatgctacggacatctaa

SEQ ID NO: 7655 - protein, 470 aa, Selenomonas ruminantium
MLKKTKIVCTQGPSTEKPGVIDALIANGMNCARFNFSHGDHEEHLGRINMVREAAKKAGKVISLILDTKGPEMRLGEFKDGKVMLEKGNKFTLTYDDEPGDETHVSVNHKGLYTEVKPGDTLLLSDGLVALKVDEIKGKDIVTTIQNSGKMSTRKRVAAPGVPLGLPPISEQDAKDIIFGCEQDMDFVAASFIQRPDDVIAIRKLIEEHNGHMEILPKIENLEGVKNFDAILEVSDGIMVARGDLGVEVPAEDVPLIQKEIIRKCNAAGKPVIVATQMLDSMERNPRPTRAEVSDVGNAILDGTDAIMLSGETASGDYPVEAVATMNRIAQRMESSLEYKELYVERGLQHMESRTRAIAHATVQMAYELDAPAIITPTESGYTTKVVSKYRPKAAIVAYTPSEKVLRQLNLRWGVYPVLGTQWSDVDEMISNATAAAVKEDLVQRGDLTIITSGVKMESRTRAIAHATDI

SEQ ID NO: 7656 - DNA, 1822 bp, Arabidopsis thaliana
  CDS (1)..(1791)
atgtctcagtctattcaattctccactccttcacacactcctcaccttctccatctccctcactcacaattcaaccgtcctctctcctctatctccttccgtcgcttccctctaacaaccatcaaatacacttccatcagagcctcctcgtcatcatctccttcaccggatctcgattcatcgtcctcatcatcatcctcgcaagtacttctctcacctaacggtactggtgctgtgaagtctgatgagagatccgttgtcgctacggcggttacgactgatacgtctgggattgaggttgatactgtgacggaagctgagcttaaggagaatggatttagaagtacgaggaggacgaagctgatctgtacgatcggaccggcgacttgtggatttgagcagcttgaggcgcttgctgtgggaggtatgaatgtggcaaggcttaatatgtgtcacggtacgcgtgattggcaccgcggtgtgattcgtagtgttcggaggcttaatgaggagaaaggctttgcggttgctattatgatggatactgaaggtagtgagattcatatgggagatcttggtggtgaagcttcagctaaagcagaggatggtgaggtttggactttcactgttagagcttttgattcttctcgtcctgaacgtaccattagtgttagctacgatggtttcgctgaagatgtaagagttggggatgaacttttggttgatggtgggatggtgagatttgaagtgattgagaagattggtcctgatgttaagtgtctatgtaccgatcctggattgttgcttcctcgagctaacttgacgttttggagagatggaagtcttgtacgagagcgtaatgccatgcttccaacaatttcttccaaggactggttggatattgattttggaattgctgaaggtgtggatttcattgctgtatcgtttgtcaagtcggctgaagtcattaatcaccttaaaagttatcttgctgctcgttcccgtggaggggaaattggagtgattgcaaagatcgagagtatcgattcactgaccaatttggaagaaattattctagcatcagatggggccatggttgcaagaggagatctgggagctcagatacctcttgagcaagttccagcagctcaacagagaatcgtccaagtatgcagagctcttaacaaacccgtcattgtcgcttcacagctattggagtccatgattgagtacccaactccaaccagagcagaagttgccgacgtgtctgaagcagtaagacaaagatcagatgcattgatgctctctggagaatcagctatgggacaattcccagacaaggcgctcacggttctaaggactgtcagtttaagaatcgagagatggtggagggaagagaaacgccatgagtctgtaccgcttcaagccataggctcttcattttcagacaaaatctcagaagagatctgtaactcagctgctaaaatggctaacaatcttggagtggacgcggttttcgtttacacaacgagcggacacatggcatcactggtctcccgatgtcgcccggactgcccgatctttgctttcacaaccacaacctcagtgagaagacgcttaaacctacaatggggacttatcccattccgtctcagcttctcagacgacatggaaagcaacttgaacaaaacattctcgttactgaaatcaagaggtatgatcaaatctggtgacctcgtgatcgcagtctcggacatgctgcaatcaatccaggtaatgaacgtcccgtaattctctctctttatacaatttcgcaatcccg

SEQ ID NO: 7657 - protein, 596 aa, Arabidopsis thaliana
MSQSIQFSTPSHTPHLLHLPHSQFNRPLSSISFRRFPLTTIKYTSIRASSSSSPSPDLDSSSSSSSSQVLLSPNGTGAVKSDERSVVATAVTTDTSGIEVDTVTEAELKENGFRSTRRTKLICTIGPATCGFEQLEALAVGGMNVARLNMCHGTRDWHRGVIRSVRRLNEEKGFAVAIMMDTEGSEIHMGDLGGEASAKAEDGEVWTFTVRAFDSSRPERTISVSYDGFAEDVRVGDELLVDGGMVRFEVIEKIGPDVKCLCTDPGLLLPRANLTFWRDGSLVRERNAMLPTISSKDWLDIDFGIAEGVDFIAVSFVKSAEVINHLKSYLAARSRGGEIGVIAKIESIDSLTNLEEIILASDGAMVARGDLGAQIPLEQVPAAQQRIVQVCRALNKPVIVASQLLESMIEYPTPTRAEVADVSEAVRQRSDALMLSGESAMGQFPDKALTVLRTVSLRIERWWREEKRHESVPLQAIGSSFSDKISEEICNSAAKMANNLGVDAVFVYTTSGHMASLVSRCRPDCPIFAFTTTTSVRRRLNLQWGLIPFRLSFSDDMESNLNKTFSLLKSRGMIKSGDLVIAVSDMLQSIQVMNVP

SEQ ID NO: 7658 - DNA, 1494 bp, Arabidopsis thaliana
  CDS (1)..(1494)
atggagatgttacttggtggacaagcaaccaatggagctcttcgttcaaagacgaagatagtttgtactcttggaccagcttcaagatcggtggagatgattgagaagcttctcaaggctggtatgaacgtagcccggttcaatttctcccatggttctcactcttaccatcaagaaactctcgataatctcagaaccgccatggacaacactggtatcctctgcgccgtcatgctcgacacaaagagtcctgtgatacgaaccgggtttctcaaagaaggcaaaccgatacagctaaagcaaggtcaagagatcaccatctcaattgattacaagatacaaggagattccaacactatctccatgagctacaagaaacttgcagaggatctcaaacctggtgacgtgatcctttgttcagacggaacaatctctctaaatgtcttgtcctgtgacaagtatctcggtcttgttcgttgccgatgcgagaactctgctcttcttggagaaagaaaaaacgttaatcttcctggaattgtagttgatctcccaacactcactgagaaagataaagaagatattatgcaatggggagttccgaacaaaatcgacattatcgctctctcttttgttcgtaaaggatctgacctaatccaagtaaggaaattacttggagagcactcaaagagcatcatgcttatgtcaaaggtggagaatcaagaaggagtaatgaatttcgataagatcctggagaattctgatgctttcatggtggctagaggagatcttgggatggagataccaatcgaaaagatgtttcttgctcagaaaacaatgatcaacaaggctaatgctcatgggaaaccagtggtcacagccacacagatgcttgaatccatgacagtctctcctcgcccgactagagctgaagctaccgacgtagcaaacgcggttcttgacgggacagattgcgttatgcttagcggagaaactgctgctggagctcaccctgagactgccgtgttaacaatgtcaaggatctgcaaagaagcagaggatttcatagattacgacattctccacaagaaaaccctaggaatggtttcgttaccgttatctccaatcgagagcttagctgcttcagctgtttcgactgcgcggagtgttttcgcgtccgcgatcgttgttctcactagaggcggttacacggcggagcttgtggctaaatacaggccaagcgttccgattctgtcggtgattatgccagagattgctgaatgctcggactcggtagctcatgtggcgagacgtggtttgatttaccgtgggattattccggtggtgggatgttcagctagagattcaacggaggagatgattagattagctataggatttgccaagacgaagggaatttgtaagactggagattccattgtggctttgcacaagattgatggttcatctattgtcaggatagtgagcgtcgagtaa

SEQ ID NO: 7659 - protein, 497 aa, Arabidopsis thaliana
MEMLLGGQATNGALRSKTKIVCTLGPASRSVEMIEKLLKAGMNVARFNFSHGSHSYHQETLDNLRTAMDNTGILCAVMLDTKSPVIRTGFLKEGKPIQLKQGQEITISIDYKIQGDSNTISMSYKKLAEDLKPGDVILCSDGTISLNVLSCDKYLGLVRCRCENSALLGERKNVNLPGIVVDLPTLTEKDKEDIMQWGVPNKIDIIALSFVRKGSDLIQVRKLLGEHSKSIMLMSKVENQEGVMNFDKILENSDAFMVARGDLGMEIPIEKMFLAQKTMINKANAHGKPVVTATQMLESMTVSPRPTRAEATDVANAVLDGTDCVMLSGETAAGAHPETAVLTMSRICKEAEDFIDYDILHKKTLGMVSLPLSPIESLAASAVSTARSVFASAIVVLTRGGYTAELVAKYRPSVPILSVIMPEIAECSDSVAHVARRGLIYRGIIPVVGCSARDSTEEMIRLAIGFAKTKGICKTGDSIVALHKIDGSSIVRIVSVE

SEQ ID NO: 7660 - DNA, 1920 bp, Lilium longiflorum
  CDS (145)..(1677)
cgcggggctggtcaattcttccctcaaacaagtgctcattccaccatcctcctcctcccccactgttttctcactgcgttcccaaaccaacagctccccctctcccccagatctagggttagggtttcagttccccatctcgccatggcgaacatcgacatcgagggcatcctgaaggagctcccggccgacggccgcgtcccgaagacgaaattggtctgcaccctcgggccgtcgtccagatccgtgccgatgctcgagaagctgctgcgcgccggcatgaacacggccagattcaacttctcccacggcacgcacgagtatcaccaggagacgctcgataacctccggatcgcaatgcagaacacgcagattctctgcgccgtcgtgctcgataccaagggtcctgagattcgcactgggtttctgaaggatggaaaggccgtccaaccaaaggagggtcaagaaatcatagtgagcactgattacgatctcaaaggcggcgggaatacaattactatgagttacaagaaacttcctgtggatatgaaacctggaggcacaatcctgtgtgcagatggcagcattagcttaactgtcctatcatgtgacccagatgccggaactgtgagatgccgctgtgagaatactgcacttttaggtgagagaaagaatgtcaatctgccaggtgttgttgtggatctccccacactgacagagaaggacaaggaagacattttggaatggggtgttcccaacaacattgatatgattgctctgtccttcgtgcgcaagggctccgatcttgtcaatgtccgacaggttcttggatctcatgcaaaaaacataaagttgatgtcaaaggttgagaaccaagagggtgtcgtaaacttcgatgaaatcttaaaagagacagatgccttcatggttgcccgtggtgatctgggcatggaaattcccgttgagaagatcttccttgctcagaagctgatgatatacatatgcaaccttgcgggcaagcctgttgtcactgccacccagatgcttgagtctatgataaaatcccctcgcccgacacgtgctgaagccactgatgtcgccaatgccgtcctcgatggcaccgactgcgtcatgcttagtggcgaaagtgcggcgggagcctatctagagatagccgtgaaggtcatggccaagatatgtatcgaggcagagtcatcccttgattatgatgccatcttcaaggagatgataaggtctgcgcctctccccatgagcccactggagagtcttgcgtcctcggctgtccgtactgcgaacaaggccaaggcggctctgattgttgtattgacccgtggtgggactacagccaagctggtagcgaagtaccgcccggcagtgccaatcctgtctgtggtggtgccagtgctgacaagcgattcgttcgactggaatgttagtgacgagtcaccagcaaggcatagcctcatctacagaggcctcatcccgctgctagcggagggttctgcgaaggcgactgatgccgagtcgacagaggtgatcctggaggctgcactcaagtcagcgacggcaaggaggctgtgcaaacctggtgactctattgttgcgctgcatcgcattggtgttgcttctgtcattaaaatttgcatagtgaaatgattaatgaatgagacccggcgactgtctgtcgagttactgctatttttatgaacgaaactcagttgttttgttatgcataaacagttatgacaaactcagtttgtaggtatgcaagttgtatacataaccagttgggtattggagaggggactccatattcttgtaaagcccgctgatgaagatttgtaccgattctggtattaaggttgattaaattctgtggttcttctagccaaaaaaaaa

SEQ ID NO: 7661 - protein, 510 aa, Lilium longiflorum
MANIDIEGILKELPADGRVPKTKLVCTLGPSSRSVPMLEKLLRAGMNTARFNFSHGTHEYHQETLDNLRIAMQNTQILCAVVLDTKGPEIRTGFLKDGKAVQPKEGQEIIVSTDYDLKGGGNTITMSYKKLPVDMKPGGTILCADGSISLTVLSCDPDAGTVRCRCENTALLGERKNVNLPGVVVDLPTLTEKDKEDILEWGVPNNIDMIALSFVRKGSDLVNVRQVLGSHAKNIKLMSKVENQEGVVNFDEILKETDAFMVARGDLGMEIPVEKIFLAQKLMIYICNLAGKPVVTATQMLESMIKSPRPTRAEATDVANAVLDGTDCVMLSGESAAGAYLEIAVKVMAKICIEAESSLDYDAIFKEMIRSAPLPMSPLESLASSAVRTANKAKAALIVVLTRGGTTAKLVAKYRPAVPILSVVVPVLTSDSFDWNVSDESPARHSLIYRGLIPLLAEGSAKATDAESTEVILEAALKSATARRLCKPGDSIVALHRIGVASVIKICIVK

SEQ ID NO: 7662 - DNA, 1413 bp, Vibrio marinus
  CDS (1)..(1413)
atgaaaaagactaaaattgtttgtacaattggtccaaaaactgaatcagtagagaaactaacagagcttgttaatgcaggcatgaacgttatgcgtttaaatttctctcatggtaactttgctgaacattcagtgcgtattcaaaatatccgtcaagtaagtgaaaacctgaataagaaaattgctgttttactggatactaaaggtccagaaatccgtacgattaaactagaaaacggtgacgatgtaatgttgaccgctggtcagtcattcacgtttacaacagacattaacgtggtaggtaataaagactgtgttgctgtaacatatgctggttttgctaaagaccttaatcctggtgcaatcatccttgttgatgatggtttaattgaaatggaagttgttgcaacaactgacactgaagttaaatgtacagtattaaatactggtgcacttggtgaaaataaaggcgttaacttacctaacatcagtgtaggtctacctgcattgtcagaaaaagataaagctgatttagcgtttggttgtgagcaagaagttgattttgttgctgcatcatttattcgtaaggctgatgatgtaagagaaattcgtgaaatcctatttaataatggtggcgaaaacattcagattatctcgaaaattgaaaaccaagaaggtgtagacaatttcgatgaaatcttagctgaatcagacggtatcatggttgctcgtggcgatctcggtgttgagatcccagttgaagaagtgatcatggcacagaagatgatgatcaaaaaatgtaataaagcaggtaaagttgtaattactgcaacacaaatgcttgattcaatgatcagtaacccacgtccaacacgtgcagaagcgggcgatgttgccaatgctgtgcttgacggtaccgacgcggtaatgctttctggtgaaactgcgaaaggtaaatacccagttgaagctgtgtctatcatggcaaacatctgtgaacgtactgataactcaatgtcttcggatttaggtgcgaacattgttgctaaaagcatgcgcattacagaagctgtgtgtaaaggtgcggtagaaacaacagaaaaattgtgtgctccacttattgttgttgcaactcgtggcggtaaatcagcaaaatctgttcgtaaatacttcccgaaagcaaatattcttgctatcacaacaaatgaaaaagcagcgcaacagttatgcctaactaaaggcgtaagcagctgcatcgttgagcagattgatagcactgatgagttctaccgtaaaggtaaagagcttgcattagcaactggtttagctaaagaaggcgatatcgttgttatggtatcaggtgcgttagtaccatcaggtacaacgaatacggcatctgttcaccaactttaa

SEQ ID NO: 7663 - protein, 470 aa, Vibrio marinus
MKKTKIVCTIGPKTESVEKLTELVNAGMNVMRLNFSHGNFAEHSVRIQNIRQVSENLNKKIAVLLDTKGPEIRTIKLENGDDVMLTAGQSFTFTTDINVVGNKDCVAVTYAGFAKDLNPGAIILVDDGLIEMEVVATTDTEVKCTVLNTGALGENKGVNLPNISVGLPALSEKDKADLAFGCEQEVDFVAASFIRKADDVREIREILFNNGGENIQIISKIENQEGVDNFDEILAESDGIMVARGDLGVEIPVEEVIMAQKMMIKKCNKAGKVVITATQMLDSMISNPRPTRAEAGDVANAVLDGTDAVMLSGETAKGKYPVEAVSIMANICERTDNSMSSDLGANIVAKSMRITEAVCKGAVETTEKLCAPLIVVATRGGKSAKSVRKYFPKANILAITTNEKAAQQLCLTKGVSSCIVEQIDSTDEFYRKGKELALATGLAKEGDIVVMVSGALVPSGTTNTASVHQL

SEQ ID NO: 7664 - DNA, 1979 bp, Oryza sativa
  CDS (224)..(1747)
gatccgcatctccccacccattggttccctttccaatttcacctcgcccaaccctatttatttatttatttaacccttcccccatctcgcctccattcttggagaccaagaagaagaaagaggaaaccacacccacctccatctccgcctccgccgccgccgccgccgaccaagtcgagggggagatccagcgagagcgaggaggaggaggaggatggcggtgatggaggagcagcaggagggagccgcgggggtgatgcggcggaggcccaagacgaagatcgtgtgcacgctggggccggcgtcgaggtcggtggagatgatcgggcggctgctccgcgccgggatgtgcgtcgcgcgcttcaacttctcccacggatcccacgagtaccaccaggagacgctcgacaacctccgcgccgccatggagagcaccggcatcctctgcgccgtcatgctcgacaccaaggggccagagatccgaactggatttctgaaagatggaaaacccgtacagttgaagaagggtcaagaaatcacagtttcaactgattatagcataaagggtgatgacaacatgatatcaatgagctacaagaagctagcggtggatctgaagccaggcagtgtaatattatgtgctgatggcaccatcactcttactgtccttcactgtgataaagagcaaggcttggttcgctgccgttgtgagaacactgctatgcttggtgagaggaagaatgttaaccttccaggagttattgttgatctcccgacacttactgagaaggacaaggaggatattcttaaatggggtgtcccaaacaagattgacatgattgctctgtcttttgttcgtaaaggctcagaccttgtagaggtcaggaaggtgcttgggaagcatgcaaagtcaataatgctgatgtcaaaggttgagaatcaagagggagtggctaactttgatgatatcctggcacaatctgatgcttttatggttgcaaggggtgatttgggaatggaaattccgatagagaagatcttttatgcacagaaggtgatgattttcaagtgcaatattcagggcaagccagttgtgactgcaacccagatgttggaatctatgatcaagtctccccgccctactagagcagaagcgactgatgttgccaatgcagttcttgatggcactgactgtgtcatgctcagtggtgagacagctgctggggcttacccggaactggctgtacggaccatggccaagatctgcctgcaagcggagtcatgcgtcgaccatgccgctgttttcaagtccattaccgcatcagctccaattcccatgagcccattggagagccttgcatcatcagctgtgcgtacagcgaactctgccaaggcggcgctcatcttggtcctgactaggggaggaacaactgctaggctggtggccaagtacaggccatccatgccgattctgtccgtcgtggttcctgagctgaaacagaccgactccttcgactggacctgcagcgacgaagctcctgcgcggcacagcctcatcgtcaggggagtgatcccgatgctgagtgcagccactgccaaggccttcgacaacgaagccactgaagaagctctcgggttcgccatcagcaacgccaaggcgatggggctctgcaactccggtgagtccgtcgtcgccctccaccggatcggaactgcatctgtcatcaagctcctgacagcgaactagtggcagacggcagttaatccacaccattttgctcggaggaaaatttttgctgggggattcttacttaccacgcatatctatagcttttgttgccatgatagtggcatttgcattcaggtgcaccttcggtgtttgctgttcatgggttaaccattgaaacagttaaattcgttattgctaccgcagcttatttcgctgcctctgctgctactagtattaaacttgacagccg

SEQ ID NO: 7665 - protein, 507 aa, Oryza sativa
MEEQQEGAAGVMRRRPKTKIVCTLGPASRSVEMIGRLLRAGMCVARFNFSHGSHEYHQETLDNLRAAMESTGILCAVMLDTKGPEIRTGFLKDGKPVQLKKGQEITVSTDYSIKGDDNMISMSYKKLAVDLKPGSVILCADGTITLTVLHCDKEQGLVRCRCENTAMLGERKNVNLPGVIVDLPTLTEKDKEDILKWGVPNKIDMIALSFVRKGSDLVEVRKVLGKHAKSIMLMSKVENQEGVANFDDILAQSDAFMVARGDLGMEIPIEKIFYAQKVMIFKCNIQGKPVVTATQMLESMIKSPRPTRAEATDVANAVLDGTDCVMLSGETAAGAYPELAVRTMAKICLQAESCVDHAAVFKSITASAPIPMSPLESLASSAVRTANSAKAALILVLTRGGTTARLVAKYRPSMPILSVVVPELKQTDSFDWTCSDEAPARHSLIVRGVIPMLSAATAKAFDNEATEEALGFAISNAKAMGLCNSGESVVALHRIGTASVIKLLTAN

SEQ ID NO: 7666 - DNA, 1533 bp, Arabidopsis thaliana
  CDS (1)..(1533)
atggagaagttacttgctggacaaacaaacaatggatccctcaagtcaaagacgaagatcgtctgtactctcggaccggcttcgagatcggttgagatggttgagaagcttctcaaagccggtatgaacgtagcccggttcaacttctcccatggttctcactcataccatcaagaaactcttgacaatctcagaaccgccatggagaacacttgtattccctgtgccgtcatgctcgacaccaagggtcctgagatccgaaccgggtttctcaaagaaggcaaaccggttgagctaattcaaggtcaagagattacaatctcaactgattacaccatggaaggagattcaaacacaatctcaatgagttacaagaaacttgctgaagatctcaagtccggtgacgtgattctctgttccgacggtacaatctctcttaccgtcttgtcttgtgacaagaatctcggtcttgttcgtgcccgttgcgagaactctgcagttcttggagaaagaaagaacgtgaacctccctggaatcgtagttgatcttccaacactcacagagaaggatcaagaggatattctccaatggggagttccgaataagatcgatatcatcgctctttcctttgttcgtaaaggatctgatctggtcgaggtcaggaagttgcttggagagaacgcaaagagtatcatgctcatgtcaaaggtggagaatcaagaaggagtgatgaattttgacaagattctggaatattctgatgcattcatggtggctagaggtgatttaggaatggagattccgattgaaaagatgtttcttgctcagaagatgatgattcagaaggctaatgctcttgggaagccaatcgtcacagccacacagatgcttgagtcaatgaccaaatctcctcgtccaactagagcagaagccaccgatgtagctaacgctgtccttgacggcactgattgcgtcatgctcagtggagaaaccgccgccggagctcaccctgaaaccgccgtgctaacaatgtcaagaatctgtaaggaagcagaggatttcatcgattacgacacaatgcacaagaagattcaagatatcgtttcgttgcctttatctcctattgagagcttggccgcttcagccgtttcgacggcgaggagtctttgtgcggctgcgattgtcgttctaaccaagggaggttacacggtggagcttgtggccaagtacaggcctagtgttccgattctgtccgtaattgtgccggagattactcgtacggatgatttcgagtggtcgtgctctgaatctgcggctcatgtggcaagacgtggtttgatctaccgtggaattgttcctgtgatggcgacgggagcatccgctaggtcttcgaacaaggactcgacggaggagacgattcaattcgccattgaattcgcgaagaagaagggaatatgtaagacaggagactcgattgtggcgttgcacaagatcgatggctcctctgttgtcaagattttgaacgtggagtag

SEQ ID NO: 7667 - protein, 510 aa, Arabidopsis thaliana
MEKLLAGQTNNGSLKSKTKIVCTLGPASRSVEMVEKLLKAGMNVARFNFSHGSHSYHQETLDNLRTAMENTCIPCAVMLDTKGPEIRTGFLKEGKPVELIQGQEITISTDYTMEGDSNTISMSYKKLAEDLKSGDVILCSDGTISLTVLSCDKNLGLVRARCENSAVLGERKNVNLPGIVVDLPTLTEKDQEDILQWGVPNKIDIIALSFVRKGSDLVEVRKLLGENAKSIMLMSKVENQEGVMNFDKILEYSDAFMVARGDLGMEIPIEKMFLAQKMMIQKANALGKPIVTATQMLESMTKSPRPTRAEATDVANAVLDGTDCVMLSGETAAGAHPETAVLTMSRICKEAEDFIDYDTMHKKIQDIVSLPLSPIESLAASAVSTARSLCAAAIVVLTKGGYTVELVAKYRPSVPILSVIVPEITRTDDFEWSCSESAAHVARRGLIYRGIVPVMATGASARSSNKDSTEETIQFAIEFAKKKGICKTGDSIVALHKIDGSSVVKILNVE

SEQ ID NO: 7668 - DNA, 2235 bp, Drosophila melanogaster
  CDS (1)..(2235)
atgcgggtcgtgcgtatgaacttctctcacggctctcacgagtatcactgccagacaatacaggcggctcgtaaggccatcgccatgtacgtggagcaaacgggtctgcccagaacattggcaattgctctggacaccaagggtccagagatccggacgggcaaactggccggtggcaatgatagggctgagatagagctcaagaccggagacaaagtgacattgagcaccaagaaggagatggcagacaagagtaacaaggataatatctatgtggattatcagaggctacctcaactggtcaaaccaggaaatcgggtatttgtagacgacggattgattgcattgatcgtgaaggaatcaaagggagatgaagtgatctgtcaggtggagaacggtggcaagctgggctcccacaagggaatcaatttgccaggagttccggtagatcttcccagcgtaacggagaaggataagcaggatcttaaatttggggccgagcaaaaggtggacatgatcttcgcatcgttcatacgagacgcaaatgctctgaaggaaatccgccaagtacttggaccggctggagcgtgtataaagatcatctctaagattgaaaaccaccaaggtctggtaaacatagacgacattatccgtgaatcagatggcataatggtggcccgaggtgatatgggcattgagatacccacggaggatgttcccctagcccagaaatcgattgtggctaagtgcaacaaggtgggcaagcctgtgatctgtgccacccagatgatggagtcgatgacgaacaagccgcgacccactcgtgccgaagcctcggatgtggccaacgctattttcgatggctgcgatgccgtaatgctgtccggtgaaacggccaagggcaagtatccggtggagtgcgtccagtgcatggccaggatctgtgccaaagtagaagcagttctatggtacgaaagcctgcagaacagccttaaaagggaaatccggaccagtgctgccgaccacatttcggcagttaccacggcgatcgcggaggcggccacggtgggccaagcccgggcaattgtggtggccagtccgtgctccatggtggcccaaatggtcagtcacatgaggccgccatgtccaattgtcatgctcacgggtaacgaatccgaggcggcccagtctctgctctttcgcggcatctacccactcctcgttgaggaaatggttattggcagctttaactttcgacgcatcatgcagtcgggcctgaagctgatgggcaagatggacatcttggagccgggtcagaaaggatcggtggtgctggttaatgccatgtcggcagaaaagatcaccttccggctgttcactatccgtcagcagaccaaggaagaacgcgatcaggatgagcgatgccgaaaattggccctagagcagagctgcaaggagagggctgaaaaggaggaatgcagaaagctccagcaagcggaagaatgtcagaagcaaaaactggccaaaaaatgtaaacagttcgaagagaagcaaaaggtctgccccaaaaagaatgatactccgaagaatgattgtccgaagaaagattgtccgaagaaagaatgtcccaagcaagatgacgaaatctcaaagtgcaggcaaatgcaagaagcggaagctgaagaaaggaagtgcaaagaagagtttgaacagatgtgcaaattagctgaagaaaaaaggaaagaagctgaaaaatgcaggaaagcggacgaagaacgaaggaaagaggaagctgaaaagtgcaggaaattggaagaagataggaaatgcaaattggctgaagagaagaaaaggaatgaagaagaacttaagataatagaagcagaagtggccaaactggaagctgctgagaaggccaagcgtttgaaggaggaagagaaaaagaaggaagaactaatgaagtgcaagcaacgaaatgaagcgaaaaaaaagagggaagaggctgaaaggtgcaagagaaaggaaagagaaagggagctagctgaaatggaaaacaaatggaaacaggttgcggagaaaagaaagagaaagaaggcagcagagatgtgcaggaaaatagaggatgcaaaagaaaaagccgcggcagaatcggctgataagattctgaaagctgtgtgcgaaaaactaaagcaatctctctcggatccggacaaatcaaaaaagggcaagaaataa

SEQ ID NO: 7669 - protein, 744 aa, Drosophila melanogaster
MRVVRMNFSHGSHEYHCQTIQAARKAIAMYVEQTGLPRTLAIALDTKGPEIRTGKLAGGNDRAEIELKTGDKVTLSTKKEMADKSNKDNIYVDYQRLPQLVKPGNRVFVDDGLIALIVKESKGDEVICQVENGGKLGSHKGINLPGVPVDLPSVTEKDKQDLKFGAEQKVDMIFASFIRDANALKEIRQVLGPAGACIKIISKIENHQGLVNIDDIIRESDGIMVARGDMGIEIPTEDVPLAQKSIVAKCNKVGKPVICATQMMESMTNKPRPTRAEASDVANAIFDGCDAVMLSGETAKGKYPVECVQCMARICAKVEAVLWYESLQNSLKREIRTSAADHISAVTTAIAEAATVGQARAIVVASPCSMVAQMVSHMRPPCPIVMLTGNESEAAQSLLFRGIYPLLVEEMVIGSFNFRRIMQSGLKLMGKMDILEPGQKGSVVLVNAMSAEKITFRLFTIRQQTKEERDQDERCRKLALEQSCKERAEKEECRKLQQAEECQKQKLAKKCKQFEEKQKVCPKKNDTPKNDCPKKDCPKKECPKQDDEISKCRQMQEAEAEERKCKEEFEQMCKLAEEKRKEAEKCRKADEERRKEEAEKCRKLEEDRKCKLAEEKKRNEEELKIIEAEVAKLEAAEKAKRLKEEEKKKEELMKCKQRNEAKKKREEAERCKRKERERELAEMENKWKQVAEKRKRKKAAEMCRKIEDAKEKAAAESADKILKAVCEKLKQSLSDPDKSKKGKK

SEQ ID NO: 7670 - DNA, 3033 bp, Drosophila melanogaster
  CDS (1)..(3033)
atgctacctacgggaaacagctttccgaagaataatgggaaaataatgcctctaattatcattaataaatcgagagacaagtcaacaaacccggccgtcgagtcaacaacttggttgcgcttcaaggcagccaaggaaaaacgtttccttttggccaatggattggatgacggccaaacaatgcgtccagtttggacaaacatttgcagcagcaaacccatttcatgcccattcccaacttcccacgttgcacggcagcctcaaaattcagatttttttattaaattttacatatatttggtctgcattactcaaattattttttttttcaaaattcgaaaatacgccggaaatctttgtcagagggcaagcctctgcgttgtgtcaccatgtcccaattttccattgagccttagatttcgctgctatgccgacaaatgcaaaagaaaaatggaacccaagaagtttcggctagaccgtggaccctacctttcccagctggactaccaatctcgtctgcagttccaagcaccagctctgaggttaccccttaccagcattatatgcaccattggaccctcatccagccagcccgaggttcttcttaatctcattcacgctgggatgaaggtggtccgattggacttctccgacggcacccacgattgccattgccaggctatccaggcggctcgtaaagccatcgccatgtatgcggaggaaacgggtcttcccaggagcttggccattgccctggacaccaagggtccggtaatcaatccacagggtgtagctgctgatttaaacgccataaccgaacaagacaaactggatctcaagtttggagcggatcaaaaggttgacatgatcttcgcatcgttcatccgcgatgccaaagctttgaaagaaattcgccaggcactgggtgcctgtccatcaagtgagcacataaagatcatttccaagatcgaaagtcaacaggctctggcgaacatagatgagataatccgcgaatccgatggcataatggtggcccttgggaatatgggcaacgaaatagcactggaggctgtaccgctggcccagaaatcgattgtggccaagtgcaacaaggttggaaagcctgtgatctgtgccaatcaaatgatgaattcgatgataaccaagccacgtcccactcgcgccgaatcctctgatgtggcaaacgcaatcttggatggttgtgatgcccttgtgttgtcagatgaaacggccaagggtaagtacccggtgcaatgtgtgcagtgcatggccagaatatgcgccaaagtcgagtcggttttatggtacgagagcattcagaacaacctcaagagcgaagtccggatcaacgccgccgatcacatctcggcggtaagcacggcaattgcagaagcggcaacggtgagtcaggctcaggcaatagtggtggccagtccgtgctccattgtgtcccagatggtcagtcaaatgaggccgccgtgtcctatcgtgttgctcacaggctgcccacatgaggccgctcaatccttgctttttcgtggcgtttatccactccttgtcaaggaaatggtttatggcagcgtaaactactgtcgcatcatgcaatcgggcttaaagatattggccaagttggacatcctgaaggcaggccaaaggggaactttggtgctggtcaatgccatgtcggcagacaagctcaccttcaggctgttcacttttgcacagccaactgaggcagagcgagaagaagaacgctgccgaaagttggccaggaagcagcgatgcaaggaaatgtctgtaaataaatcctgtccaaatccaaagagcagtaagtctgaaatatctataaagtccgatgaaaaagatggtaccagttcaaagaaagaatttcctaaggacgaagaagtttcgaaatgtttacaactagaaaatgaaattcagcagaaacggggtgaagattctgtaatgaacaaagaaaatgaaaatctctgccacaacgtggcattgaagtgcttacatttgaagaatgaaagacaagctcaatcggaagctatgatgaaacagacggaaaaacttaaaaaagcggaagatcctagaaaaaacaatgggacccttaaggatagttttaaccgtaagaaaaaagacgataaaacctcgaagtccgataaaaaggatggttccagctcaaagaaagatcgtcctaaccacaaggaagtctggaaatgtttacagcggagtcaagatttggtaatggcagaagaaaatgaatatctctgttcaaaaaaatcaaaagaatgtcccaataaggacgacgaggccttgaagtgcttacagctgaaaaaacaaagacaagctcgagcggaagctgagatgaaaaagaaggcagaactaaaaaaaaataatagtttaagccataagaaagaagacgataaagcaccaaactgcaacaaacttaaaaaacaaggcccaaagaagaataagtgcagagtagtcaaaatttcgaggacatccgaaaaggataattatattccgaagaaagaatatcctaggatcttcaatatagaaaaggctcagccaaaaactgtggtcaaacacagtaaagagttggcaaagtcctgcgatattgtactcgaaaactgcaagaccgtaaaacgcaaaaactgcaagactgtaaaattagaaaaatgtaagacagtaaaacttgaaaactgcaaaataacaaaacttaagaagtgcaaaacgatcaagctcgaaaattgtaagcagccgcgaagagttaggcaaagaactaatcttactaaaaaggcatacactttcagtactagagatacgaggaaaaaaataattccaccaaagcgttatcgcgttgtacgcggctctgcaattgttaaacaactaaaggaaaataaagccagcgagagtccaacagctgcgagcagattgtcgagtttcgctgaatgcgatagatttagcgagagagaaaagatacatttacggagagcgaatcgctga

SEQ ID NO: 7671 - protein, 1010 aa, Drosophila melanogaster
MLPTGNSFPKNNGKIMPLIIINKSRDKSTNPAVESTTWLRFKAAKEKRFLLANGLDDGQTMRPVWTNICSSKPISCPFPTSHVARQPQNSDFFIKFYIYLVCITQIIFFFKIRKYAGNLCQRASLCVVSPCPNFPLSLRFRCYADKCKRKMEPKKFRLDRGPYLSQLDYQSRLQFQAPALRLPLTSIICTIGPSSSQPEVLLNLIHAGMKVVRLDFSDGTHDCHCQAIQAARKAIAMYAEETGLPRSLAIALDTKGPVINPQGVAADLNAITEQDKLDLKFGADQKVDMIFASFIRDAKALKEIRQALGACPSSEHIKIISKIESQQALANIDEIIRESDGIMVALGNMGNEIALEAVPLAQKSIVAKCNKVGKPVICANQMMNSMITKPRPTRAESSDVANAILDGCDALVLSDETAKGKYPVQCVQCMARICAKVESVLWYESIQNNLKSEVRINAADHISAVSTAIAEAATVSQAQAIVVASPCSIVSQMVSQMRPPCPIVLLTGCPHEAAQSLLFRGVYPLLVKEMVYGSVNYCRIMQSGLKILAKLDILKAGQRGTLVLVNAMSADKLTFRLFTFAQPTEAEREEERCRKLARKQRCKEMSVNKSCPNPKSSKSEISIKSDEKDGTSSKKEFPKDEEVSKCLQLENEIQQKRGEDSVMNKENENLCHNVALKCLHLKNERQAQSEAMMKQTEKLKKAEDPRKNNGTLKDSFNRKKKDDKTSKSDKKDGSSSKKDRPNHKEVWKCLQRSQDLVMAEENEYLCSKKSKECPNKDDEALKCLQLKKQRQARAEAEMKKKAELKKNNSLSHKKEDDKAPNCNKLKKQGPKKNKCRVVKISRTSEKDNYIPKKEYPRIFNIEKAQPKTVVKHSKELAKSCDIVLENCKTVKRKNCKTVKLEKCKTVKLENCKITKLKKCKTIKLENCKQPRRVRQRTNLTKKAYTFSTRDTRKKIIPPKRYRVVRGSAIVKQLKENKASESPTAASRLSSFAECDRFSEREKIHLRRANR

SEQ ID NO: 7672 - DNA, 1814 bp, Drosophila melanogaster
  CDS (83)..(1747)
ttttttataactgcagagtgattgattttaatggtagttgcccaaaattttaagttattcctcttatccaaaatttacaaccatgtcgttgtccgcgaaatccgtgctaaaggagggctccacacagctgagccacatctgcgagctggatcttgcccagcaggcgtcccaccagcgcctcgtttccctgatcgcaaccatatcggtcagttcccggaacgcggacaccatatacaccatgataatgcgcggagtgaacatattccgtctgaacttctcccacgaatcgcacgagatgcactcgaaaacgatcgagctgatcaacgaggcgctggagaggattcataaggagacgggccaaatccgaacggtcgccattgcggcggacacgcgtggaccccagattcgtactggcctactggatggagatgtgttcctgcgcagcggcgacaatctgcgtctctcgatcaatcgggatctttacgacaagggcaacaaggaggcggtctacgtggactacccgaacatcatcaacctgaccaagaccggcgatcgcctgttcatcgacgacggcaggctgctgctccacatcttggaagtgggagtggatggtctgctgtgcgaggtcatccatggcggccagctgaacaacaactgcaacgtgatcctgccggagatcgagatcgatttgcccgccgtctccgagaaggatatgtttgacatccagttcagcataaaggccaacgtggacttcctcttcgcctccgccgtgcgcagtgccaagaacgtcaaggagctgcgaacggtgctcggcgagaagggcaagcacatcaagatcatcgccaagatggacagcaagatagctctgagcaggttctcggagattctgcgtgcggcggatggattgctgctttcgcgagcggatctgggcacccagatacccattgaaaagctcttcatcacccagaagagcatactgggccaatgcaacaaggtgggcaagccggtcatagtggcctcccacatcctcgagtccatgcgcaccctgccccatcccacacgggccgagtgcttcgatttggccaacgccatcatcgatggagcagactgcatcatgctgtcgtcggaagtggccattgggtcgtttcccaaggagacggtggccacctgcgacacattgtgccgggaggccgagaaggtgctctggtttcgagacctcttctccgacctggtcagcgaggtgcgtggcgagctggacgcggcacactcgctggccattgcagccgtggagacggccaagcgcaccaatgccaccctgatcatcgtgctgaccacctcgggccgctcggccactctggtcagcaagttccgaccccgctgtcccatcatggctatcacgcgctgcgaacggaccgcccgctgggtctatctgcatcgcggagtcctgccgatactgtacaccttggagcccagcacggactacgccaccgatgtggacgctcgggtgcagttcgccatgacctctgccaagaagtggggcatcatcgacgacggcgatcccattgtgatagtgagtgcctggaaggatggcggcgggttcaccaacaatgtccgtgtggtctacgctttcttcgaggcggatcgcgtggactgcctgttccggtcggacaggcggcattctcgaaagaacaccaacctgcagatggcaaatcgggagcctgctgataagaaaagtggtaatgcgtagctgagcccggagaaatggaacttggttgcctcaaatgtaatcatcaaataaattattttggaagatc

SEQ ID NO: 7673 - protein, 554 aa, Drosophila melanogaster
MSLSAKSVLKEGSTQLSHICELDLAQQASHQRLVSLIATISVSSRNADTIYTMIMRGVNIFRLNFSHESHEMHSKTIELINEALERIHKETGQIRTVAIAADTRGPQIRTGLLDGDVFLRSGDNLRLSINRDLYDKGNKEAVYVDYPNIINLTKTGDRLFIDDGRLLLHILEVGVDGLLCEVIHGGQLNNNCNVILPEIEIDLPAVSEKDMFDIQFSIKANVDFLFASAVRSAKNVKELRTVLGEKGKHIKIIAKMDSKIALSRFSEILRAADGLLLSRADLGTQIPIEKLFITQKSILGQCNKVGKPVIVASHILESMRTLPHPTRAECFDLANAIIDGADCIMLSSEVAIGSFPKETVATCDTLCREAEKVLWFRDLFSDLVSEVRGELDAAHSLAIAAVETAKRTNATLIIVLTTSGRSATLVSKFRPRCPIMAITRCERTARWVYLHRGVLPILYTLEPSTDYATDVDARVQFAMTSAKKWGIIDDGDPIVIVSAWKDGGGFTNNVRVVYAFFEADRVDCLFRSDRRHSRKNTNLQMANREPADKKSGNA

SEQ ID NO: 7674 - DNA, 1425 bp, Agrobacterium vitis
  CDS (1)..(1425)
atgttcattcgcagcaaccgccgcgccaagatcgtcgcaacagtcggccctgcctcaagttcaccggcaatactgaggtcgctgttcctggcaggcgtcgatacgttccggctcaatttcagccatggaagccgcgacgaccatgccgccgcctaccgccacatccgcgcgctggaaaaggagctgggaacctcgatcggcatccttcaggacctgcagggcccgaagatccgcatcggcgtgcttcacgaaggccggctgcagctgacgaaggacgcggaaatccgcttcgtgtgcgggaccgaaccagggcgcgggctgatggacattccccttccccatcgcgagatcttcgcggcagtcaagccgggcgacgatctgctgatcgacgatggacgggtgcgagtgcgggcgctgggcgtcagcgacgaattcatcgatgcaaaagtcatcgtcgctggaccgatatccaaccgcaagggtgtcaacctgccgggaaccgtcctcgatatttcccctctcaccccgaaggatcgcaaggatctcgaattcgggctggaactcggcgtcgactggatcgccctatcattcgtgcagactgcccgcgacatgatcgaagcccgatcgctggtcagcgacagggccgggctgatcgccaagatcgaaaaaccctcggcactggacgagatcgacgacatcgtagcgctttccgacgccatcatggtggcgcgcggcgatcttggtgtggaaatcccgcccgaggatgtgccgggccgtcagaaggaactcatccgcgcctgccgtatcgccgccaaaccggtgatcgtcgccacgcagatgctcgactcgatggtgacctcgccgacgccgacgcgcgcagaagcctcggacgtggcgggagcgatctatgacggcgccgacgccgtgatgctctcggcggagtctgcaacgggcgccttcccggtcgaaacggtggagatcatgagccgtatcatcgaaaagaccgaaaaacataaattctaccggccgatcctcgaagcgaccgaaccacagattgcccatacccctccgcacgcagtcgccaccgccgcggcagatgtcgcccttgccctgaaggcccctgttatcgtcgcgtttacggtcagcggcacgaccgcttccagaatcagccgggcacggccaccgctcccgatcctcgccctgacgccatccgaacagaccgcgcgtcagctcggactgatgtggggcgtcgtcagcctgctttcgccgacagtcgacacctatgaacaatccgtcgatcgcgccacccaggccgccgtacaaaccggcctggcggagaaaagcgatcagatcgtcgtggtgacgggatttccctttgcgaccgcgggcagcaccaacaaccttcgcgtcacccaggcgggttga

SEQ ID NO: 7675 - protein, 474 aa, Agrobacterium vitis
MFIRSNRRAKIVATVGPASSSPAILRSLFLAGVDTFRLNFSHGSRDDHAAAYRHIRALEKELGTSIGILQDLQGPKIRIGVLHEGRLQLTKDAEIRFVCGTEPGRGLMDIPLPHREIFAAVKPGDDLLIDDGRVRVRALGVSDEFIDAKVIVAGPISNRKGVNLPGTVLDISPLTPKDRKDLEFGLELGVDWIALSFVQTARDMIEARSLVSDRAGLIAKIEKPSALDEIDDIVALSDAIMVARGDLGVEIPPEDVPGRQKELIRACRIAAKPVIVATQMLDSMVTSPTPTRAEASDVAGAIYDGADAVMLSAESATGAFPVETVEIMSRIIEKTEKHKFYRPILEATEPQIAHTPPHAVATAAADVALALKAPVIVAFTVSGTTASRISRARPPLPILALTPSEQTARQLGLMWGVVSLLSPTVDTYEQSVDRATQAAVQTGLAEKSDQIVVVTGFPFATAGSTNNLRVTQAG

SEQ ID NO: 7676 - DNA, 1449 bp, Agrobacterium vitis
  CDS (1)..(1449)
atgttcatacgcaacaaccggcgatcaaagatcgtcgcgacggtcggaccggcgtcaagttcgcccgacatgcttcgctcactgtttctcgccggtgtcgatacgttccgcctgaatttcagccatggtgcccgggccgatcacgcggaagtctataggaacatccgggctctcgagcaggagcatgatgctgctatcgccgtgctgcaggatcttcagggtccgaagatccggatcggagttctggcacatggcaggctcgatctcgcacgtggatccaccatcggatttatccttggccgtgagggtggtgaaggaatgaacgatattccgctacctcatcgggaaatcttcgaggtggcggtgcccggaatggacctcctgatcgacgacggtagaataaaagtccggatcatggaggtgatggacgggcggcttgtttgcgaggtcctcaatggaggcgccttgtcgaaccgcaagggtgtcaacgtgcccggcgctgtcctggacatttccccgctcacggcgaaagatcgtgaggacctggaattcgggctcgagcttggcgtcgactgggtcgcactttctttcgttcagcgggcacgcgacatgatcgaagcccggtccctcgttggagacagggctggcctcattgccaagatcgagaagccgtctgccctcgatgacatcgaggatattgtcaggctttcggacagcgtcatggttgcgcgaggtgatctcggcgtggagatcccgccggaggacgttccgggcaagcagaaggaaatcatccgtgcatgccggctagcggccaagcccgtgattgtcgccacacagatgctcgactcgatggtgagttcgccaacgccgacgcgcgctgaagcttcggacgttgccggtgccatctatgatggggcagatgccgtcatgctttccgccgagaccgcaacaggcgcctacccggtggaggcggtcgaaattatgaaccggatcatcgagaagacggagaagcacaagcactaccggccgatccttgaggcaacggaacccgatgtcgctcaatcaccgccgcatgcagttgccactgcagcagccaacgttgccgtggctctgggatcgccggttgtggtggcctatacatcgagcggaacaaccgcggccagaatttcgcgtgccagaccggcattgccaattctggctctcactccgtccgaacaagtcgcgcgccggctcaacatgttctggggggttgtcggcgtgcgatcacaagatgtccacacctatgaggcgtcgctgattcatgcgcaacaggcggtgcaggaagcaaagctggcaagtccctccgatcacattgtcatcgtggcgggatttccatttgcgcaacagggcagcaccaacaatctccgcgtcgttcagatcgccgcaaccgacaacctagagattgcgtag

SEQ ID NO: 7677 - protein, 482 aa, Agrobacterium vitis
MFIRNNRRSKIVATVGPASSSPDMLRSLFLAGVDTFRLNFSHGARADHAEVYRNIRALEQEHDAAIAVLQDLQGPKIRIGVLAHGRLDLARGSTIGFILGREGGEGMNDIPLPHREIFEVAVPGMDLLIDDGRIKVRIMEVMDGRLVCEVLNGGALSNRKGVNVPGAVLDISPLTAKDREDLEFGLELGVDWVALSFVQRARDMIEARSLVGDRAGLIAKIEKPSALDDIEDIVRLSDSVMVARGDLGVEIPPEDVPGKQKEIIRACRLAAKPVIVATQMLDSMVSSPTPTRAEASDVAGAIYDGADAVMLSAETATGAYPVEAVEIMNRIIEKTEKHKHYRPILEATEPDVAQSPPHAVATAAANVAVALGSPVVVAYTSSGTTAARISRARPALPILALTPSEQVARRLNMFWGVVGVRSQDVHTYEASLIHAQQAVQEAKLASPSDHIVIVAGFPFAQQGSTNNLRVVQIAATDNLEIA

SEQ ID NO: 7678 - DNA, 2234 bp, Nicotiana tabacum
  CDS (59)..(1840)
cgttgctgtcgaccgaaaatttcctaaaaaatctcaaaatttctgctgaggaaaaacgatgtcgcaagctcttaacttcttcgtttcctcgtcttcacgttctccggcgactttcacaatctcaaggccgtcggttttcccgtcaaccggtagtttacggttactggtgaagaaatcgttgcggacgttagttgtggaagcgtcgtcggcggcggcgtcagatctcgacgagccgcagtcgtccccggtgttagtatcggagaatggttcaggaggggtattatcgagtgcgacgcaggagtacggtcgtaatgctgcaccggggaccgattcgagttcgattgaagtggatacagtaacggaggcggagttaaaggagaacgggtttaggagtacacgtagaacaaagttgatttgcacgattggacctgccacgtgtgggtttgagcagctggaacgattagctgagggaggaatgaatgtagctaggataaatatgtgccatggaacacgcgagtggcatcgtatggtgattgagagactgaggaggttgaatgaggagaaagggtttgctgtagctatcatgatggatactgaaggtagtgaaattcatatgggagatcttggtggcgcttcttctgctaaagctgaggatggtgaaatttggaatttcactgttcgttcatttgatccaccactcccagaacgcaccgttactgttaactatgatggctttgctgaagatgtgaaagtgggtgatgagctactagtagatggtggaatggtgagatttgaagtgattgagaaaattggcccagatgttaagtgtctttgcacagatcctggacttcttctacctcgggctaatctgacattttggcgggatggtaaactagtaagggaacgcaatgccatgcttccaacaatttcctcaaaggattggctagacatagactttggtattgctgagggtgttgattttattgctgtatcatttgtcaagtctgctgaagtcattaagcatcttaagagctacattcaagcccgggctcgggatagtgatatttctgtaattgcaaaaatagagagcattgactcattgaagaacttagaagagataatccaggcatcagatggtgctatggtcgcgagaggagatcttggtgctcaaattccattagaacaggttccatcagagcagcaaaagattgttcagatatgcaggcagctgaataggcctgttatagtagcctcccagctgctggaatctatgattgaataccctattccaactagagctgaagttgctgatgtttctgaagcagttaggcaaaggggggatgctttgatgctttctggtgagtcggccatgggacagtttcctgagaaggcattgactgtactaagaagtgttagcttgagaattgaaagaatgtggagggaacagaaacgccatgaagttattgaattgccatccatagcatcttcattttcagatagtatttcagaagagatctgcaactctgccgccaagatggcaaacaatttggaagttgatgctctttttgtttacaccaagaatgggcacatggcatctctcttgtcacgctgccgtcctgactgcccaatatttgcatttacaacgacaacatctgtacgcagacgcctgaacctgcaatggggtctaatgcctttccgcttgagtttctccgatgatatggaaagcaacctcaacaagacattctccttactaaaagctcggggcatgatcaagtcaggtgacctcatcattgctgtttccgacatgctgcagtccattcaagttatgaatgttccatgagtgcacaaattagttctgtgttttgagttttgagctaggcaaccccaattatatgccaattaaaccaattatgaagttcaacagttggttctgctagggagtaaaacaacgacgagcaatccttcctcagtgtgtcctcgtttcaggtgctggacttcaatgacatttggtgtaactcaactgtcgcttgtagtcaacacagatatgttgcaatgtataccccctgttttcctaggatttggatgtatcttctgcttgagttattgatctagaaatgagccttagaaatgatcgtgataattatggatttgttcttagaattgctattagcgtgctgtctttggtgtttttttaatgatctatcggtttgaattaccttttggaaaaaaaaaaa

SEQ ID NO: 7679 - protein, 593 aa, Nicotiana tabacum
MSQALNFFVSSSSRSPATFTISRPSVFPSTGSLRLLVKKSLRTLVVEASSAAASDLDEPQSSPVLVSENGSGGVLSSATQEYGRNAAPGTDSSSIEVDTVTEAELKENGFRSTRRTKLICTIGPATCGFEQLERLAEGGMNVARINMCHGTREWHRMVIERLRRLNEEKGFAVAIMMDTEGSEIHMGDLGGASSAKAEDGEIWNFTVRSFDPPLPERTVTVNYDGFAEDVKVGDELLVDGGMVRFEVIEKIGPDVKCLCTDPGLLLPRANLTFWRDGKLVRERNAMLPTISSKDWLDIDFGIAEGVDFIAVSFVKSAEVIKHLKSYIQARARDSDISVIAKIESIDSLKNLEEIIQASDGAMVARGDLGAQIPLEQVPSEQQKIVQICRQLNRPVIVASQLLESMIEYPIPTRAEVADVSEAVRQRGDALMLSGESAMGQFPEKALTVLRSVSLRIERMWREQKRHEVIELPSIASSFSDSISEEICNSAAKMANNLEVDALFVYTKNGHMASLLSRCRPDCPIFAFTTTTSVRRRLNLQWGLMPFRLSFSDDMESNLNKTFSLLKARGMIKSGDLIIAVSDMLQSIQVMNVP

SEQ ID NO: 7680 - DNA, 1599 bp, Agaricus bisporus
  CDS (1)..(1599)
atgtatcccgtcgatggcatccgttctcagatcgagtggaacaccactcttaacgtctctgatgctcctgtcccgactgagaccactaaatatcatcgcaagacagctatcattgcgaccattgggcctaaaatcaataccgtcgaaaagctcactgacgttcgcctagctggtgtaaacatcgttcgcatgaatttctcgcacggcacccatgagtaccatcagagtgttattgataacaccaggcaaatgatcaaaaacgacccacatgggcgccccgtagctattgctttggataccaaaggtcccgaaattcggaccggtcagacgagggatggcaatgactatcccattaaggctggggatgaatttatcgtcaccacagatcccaagtatagtgatatatgcgacaataaagttttgttcgttgactacgccaatcttgcaagcgtcactgcccctggcaaactgatctatattgatgatggtatcatctctcttctcattctctctattgatggtatgaacctccatgttcgtgctctcaataatgggaccctctcctctcgcaagggtgtaaatttgcccaaaacggacgtcgaccttccaccactttccgagaaagacaaagatgatctgcgtttcgggattcgtaatggagtcgatatgatcttcgcgtcttttatccgccgtggtgaggacgtaagacagatccgtgaagttctcggccccgatggtgccagcatcaaaattatcgtcaagattgaaaatgagcaaggtgtcgctaactttgatgagattttaaaggaggccgacggtgtcatggttgctcgcggcgatttgggaattgaaattcctgcaagtcaagtattccttgctcagaagatgatgatcgccaagtgcaacattgttgggaagccagtgatcgtcgcaactcaaatgcttgagtccatgacgtacaacccccggcctactcgtgcggaagttagtgacgtcgcaaatgctgtccttgatggctctgattgtgtcatgttgtcgggagagactgctaagggatcttatcccgttcaatctgtcctgatgatggcggagacttgcttgcttgcggaaactgctatttgctacccgcctctatatgacgacctccgcgctgtccaggctcggccaacagaaactgcggagactgttgctatcgccgctgttgctgctgcagccgaacaggatgccaaagcactacttgtcctatcaacaagtggggagactgcccgtctcgtttccaagtatcgccccaagatcccgatcatcactgtcacccgtaatgagcaaaccgcaagacaaatccacttgcatcgcggttgctatcctttctggtaccctgaacctcgaggtgtccaaaaccatcaatggcagactgatgtggacaaccgcatccggtttggtcttcgcaacgctttggcactcaatgtcatccaacctggcgccagtattatcgcagtgcagggttggaagggcggtcttggtcacaccaatacgcttcgcattctgacagtgcccactgaccctgccgaccttgagcttcagcctctgggttctctataa

SEQ ID NO: 7681 - protein, 532 aa, Agaricus bisporus
MYPVDGIRSQIEWNTTLNVSDAPVPTETTKYHRKTAIIATIGPKINTVEKLTDVRLAGVNIVRMNFSHGTHEYHQSVIDNTRQMIKNDPHGRPVAIALDTKGPEIRTGQTRDGNDYPIKAGDEFIVTTDPKYSDICDNKVLFVDYANLASVTAPGKLIYIDDGIISLLILSIDGMNLHVRALNNGTLSSRKGVNLPKTDVDLPPLSEKDKDDLRFGIRNGVDMIFASFIRRGEDVRQIREVLGPDGASIKIIVKIENEQGVANFDEILKEADGVMVARGDLGIEIPASQVFLAQKMMIAKCNIVGKPVIVATQMLESMTYNPRPTRAEVSDVANAVLDGSDCVMLSGETAKGSYPVQSVLMMAETCLLAETAICYPPLYDDLRAVQARPTETAETVAIAAVAAAAEQDAKALLVLSTSGETARLVSKYRPKIPIITVTRNEQTARQIHLHRGCYPFWYPEPRGVQNHQWQTDVDNRIRFGLRNALALNVIQPGASIIAVQGWKGGLGHTNTLRILTVPTDPADLELQPLGSL

SEQ ID NO: 7682 - DNA, 1446 bp, Buchnera aphidicola
  CDS (1)..(1446)
atgttaaatcgtgttagaagaacaaaaattgtagcaactttaggaccttctacagataaagcaaataatcttgaaaagattattttatctggagcaaatgttcttcgtttaaatttttctcatggttcatctgaagaacataaaaaaagagcgaaaaaagcaaaagaaataatgtttaaattaaattgtcatattgctttattaggtgatttacaaggaccaaaaatcagaatttctaaatttaaaaaaaacagtatttttttaaaagttaatgacgtttttatattagatgcaaatttaaatgaaaaaaatggaaacaatgaaagagtcggaattgattataaaaaattaccaaatgacctaaatgtaaatgatatcttgttgttagacgacggaagaatacaattaaaagtaataaaaattgaaaaatgtgcaatatttacaaaagttattataggtggcattctatctaataataagggtattaataaattaggtggtggtttatcagcagatgcattaacagaaaaagataaaaaagatataattcttgcttctgaaattgatgtagattatttggccgtatcgttccctcgttgtgctgatgatttaataaaagccagagagttattaaaaaaatctggtagtaacgctcaaattatagctaaaatagaaagagccgaagctgtatttgatcaaaatgctatagaaaatataatattgtcttcagatgcaattatgattgctagaggagacttaggtgtcgaaattggtgatgcagaattggtaggtattcaaaaaaaattaattagaactgctagaaaattaaataaggtagcaattactgcaacacaaatgatggaatcaatgattttaaatccgttacctactcgtgcagaagttatggatgtagccaatgctgtgttagatggaagcgatgcagtcatgctgtctgcggaaactgcatctggaaaatatccatctgaaactgtgataagtatggctaaagtttgcaaaggggcagaaaaagttcctagtattaatgtttctagacatcgtcttaatgtagaatttcaaagcattgaggaagccattgctatgtcatcaatgtatgcggcgaatcacttaaaaggaattacagcaattattactatgacagaatctggtaaaacagcattaatgacttctagaattacttctggactaccgatttttgctttatcaaaacataaaaaaactttaaatttaactgctctctatagaggtgtgattcctatttattttgatagtgataaggatggtgttgaagctgctaatgaagcaataattcttttgtgcaagaaaaaatttctatttaataatgatttagtcattgtcactcaaggtgacataatggggaaaataggtaaaacgaataccagtagaattttaagagttacatattaa

SEQ ID NO: 7683 - protein, 481 aa, Buchnera aphidicola
MLNRVRRTKIVATLGPSTDKANNLEKIILSGANVLRLNFSHGSSEEHKKRAKKAKEIMFKLNCHIALLGDLQGPKIRISKFKKNSIFLKVNDVFILDANLNEKNGNNERVGIDYKKLPNDLNVNDILLLDDGRIQLKVIKIEKCAIFTKVIIGGILSNNKGINKLGGGLSADALTEKDKKDIILASEIDVDYLAVSFPRCADDLIKARELLKKSGSNAQIIAKIERAEAVFDQNAIENIILSSDAIMIARGDLGVEIGDAELVGIQKKLIRTARKLNKVAITATQMMESMILNPLPTRAEVMDVANAVLDGSDAVMLSAETASGKYPSETVISMAKVCKGAEKVPSINVSRHRLNVEFQSIEEAIAMSSMYAANHLKGITAIITMTESGKTALMTSRITSGLPIFALSKHKKTLNLTALYRGVIPIYFDSDKDGVEAANEAIILLCKKKFLFNNDLVIVTQGDIMGKIGKTNTSRILRVTY

SEQ ID NO: 7684 - DNA, 1440 bp, Buchnera aphidicola
  CDS (1)..(1440)
atgatacgtcgttttagacgaacaaaaattgttgctacattaggtccgtcaactgataatcatattattttagagaatatgattaaatctggtgttaatgtttttcgtttaaacttttcacatggaacacgagaagaacatatttatagagcaaaactcgtaacaagtattgcaaaaagattaaattgtcacattgctcttttaggtgatttacaaggtcctaaaattcgaatttgtaaatttcaagataaaaaagtttttttaaaagtaaataattatttcatattagacgctaatttaaatgaaaatttagggacatcggaaagagttggaatagattataagaatttacctaaagacgtaaaaaaatgtgatattctcttattagatgatggaaaaatacaattaaaggttattaatatagtagatcaagaaatatttactaaaataattataggtggtgtgttatctaataataagggaattaacaaattaggaggaggtttatcagcaaggattttaactaaaaaagataaaagagatattatcacttcgattgatattggggtagattatttagctgtttcatttccgagatatggaagtgatttagatcatgcacgtaagtgtgcagtaaaatttggtagtaaagcaaaaataattgctaaaatagaaagagctgaagcagtcaaagatttaaaaataattgatgaaataatattagcatctgatgcaataatggtagcacgaggagatttaggtgtagaaataggagaatctgaattagctggaatacaaaaaacattgataaggcgagcacgccaattaaatcgagtagttataactgctacacaaatgatggaatctatgatcaataatcctatgccaactcgtgctgaagtcatggatgttgctaatgctgtattagatggtagtgatgctgttatgttatcagcggaaactgcgtcaggaaaatatcctattgagactattaaagttatgtctaaagtttgtatgggggcagaaaaaatgcctagcatcaatgtttctcagcataggattcatgacaaatttcatgatattgaagaagctattgctatgtctgcaatgtatgctgcaaatcatttaagtggtattactgctattattactatgactgaatctggcaaaacatctttaatgacttctagaattacttctggtttaccaattttcgcgttatcttcacatatacaaacgctgaaattaactgcgttatatcgaggagttacgccaattttttttaatagtagcaaagaaggtgtttctgctgctaatgaagttattaacttattagtaaaaaggggttttttagaacctggaaatttagttattattactcaaggagatattatgggaaaagtaggaaaaactaatacaagtagaattttaaaagtgtga

SEQ ID NO: 7685 - protein, 479 aa, Buchnera aphidicola
MIRRFRRTKIVATLGPSTDNHIILENMIKSGVNVFRLNFSHGTREEHIYRAKLVTSIAKRLNCHIALLGDLQGPKIRICKFQDKKVFLKVNNYFILDANLNENLGTSERVGIDYKNLPKDVKKCDILLLDDGKIQLKVINIVDQEIFTKIIIGGVLSNNKGINKLGGGLSARILTKKDKRDIITSIDIGVDYLAVSFPRYGSDLDHARKCAVKFGSKAKIIAKIERAEAVKDLKIIDEIILASDAIMVARGDLGVEIGESELAGIQKTLIRRARQLNRVVITATQMMESMINNPMPTRAEVMDVANAVLDGSDAVMLSAETASGKYPIETIKVMSKVCMGAEKMPSINVSQHRIHDKFHDIEEAIAMSAMYAANHLSGITAIITMTESGKTSLMTSRITSGLPIFALSSHIQTLKLTALYRGVTPIFFNSSKEGVSAANEVINLLVKRGFLEPGNLVIITQGDIMGKVGKTNTSRILKV

SEQ ID NO: 7686 - DNA, 2354 bp, Gallus gallus
  CDS (81)..(1673)
agcggcggcggcgctcgggcaggacaggctttgggcacggcggcggaagcagcagcaggagacaccgaactccagtaaccatgtcgaagcaccacgatgcagggaccgctttcatccagacccagcagctgcacgctgccatggcagacacctttctggagcacatgtgccgcctggacatcgactccgagccaaccattgccagaaacaccggcatcatctgcaccatcggcccagcctcccgctctgtggacaagctgaaggaaatgattaaatctggaatgaatgttgcccgcctcaacttctcgcacggcacccacgagtatcatgagggcacaattaagaacgtgcgagaggccacagagagctttgcctctgacccgatcacctacagacctgtggctattgcactggacaccaagggacctgaaatccgaactggactcatcaagggaagtggcacagcagaggtggagctcaagaagggcgcagctctcaaagtgacgctggacaatgccttcatggagaactgcgatgagaatgtgctgtgggtggactacaagaacctcatcaaagttatagatgtgggcagcaaaatctatgtggatgacggtctcatttccttgctggttaaggagaaaggcaaggactttgtcatgactgaggttgagaacggtggcatgcttggtagtaagaagggagtgaacctcccaggtgctgcggtcgacctgcctgcagtctcagagaaggacattcaggacctgaaatttggcgtggagcagaatgtggacatggtgttcgcttccttcatccgcaaagctgctgatgtccatgctgtcaggaaggtgctaggggaaaagggaaagcacatcaagattatcagcaagattgagaatcacgagggtgtgcgcaggtttgatgagatcatggaggccagcgatggcattatggtggcccgtggtgacctgggtattgagatccctgctgaaaaagtcttcctcgcacagaagatgatgattgggcgctgcaacagggctggcaaacccatcatttgtgccactcagatgttggaaagcatgatcaagaaacctcgcccgacccgcgctgagggcagtgatgttgccaatgcagttctggatggagcagactgcatcatgctgtctggggagaccgccaagggagactacccactggaggctgtgcgcatgcagcacgctattgctcgtgaggctgaggccgcaatgttccatcgtcagcagtttgaagaaatcttacgccacagtgtacaccacagggagcctgctgatgccatggcagcaggcgcggtggaggcctcctttaagtgcttagcagcagctctgatagttatgaccgagtctggcaggtctgcacacctggtgtcccggtaccgcccgcgggctcccatcatcgccgtcacccgcaatgaccaaacagcacgccaggcacacctgtaccgcggcgtcttccccgtgctgtgcaagcagccggcccacgatgcctgggcagaggatgtggatctccgtgtgaacctgggcatgaatgtcggcaaagcccgtggattcttcaagaccggggacctggtgatcgtgctgacgggctggcgccccggctccggctacaccaacaccatgcgggtggtgcccgtgccatgagctgccggcgcccccgcctcttccacccccgcgccccttccccatgcattaggccagcagtcgcttgcgatgttctcctcgtccctagcgtggatttaggttgctcaacaccaccgagtgcagcagcgggggaagagaccttaaatcactcagaatacttgaagtgtgtagttgtttccagacctctctccctgtagttagccatgtcagagcggggccctgtgctccccacgtccccctagcttagcactgccctcagggtgtggctgtgcctctccttgccccggctgtggggtgatggggaaggagtgggcgcttatggtaacggttctgctgctgcacaccgcagctcccccaggttggtgccctctgtccatgaggggttataggttgtcccctctgggcttacactccaaaggtgtgctccacggttcctacaagaatcccaaaccagggtgctgctcgttgtccccctgggtgcaggtggagtcctgcgggttgttggggtgcaggatgggtgggggacgcacgcttcatctccatgcagccacctgcccttctatggtgtctgtctgtgttgtcgcctttcctgagagcgttccttttgtctgggcgccctgtttgctccggtgggtgtattgggttgtggagcaccactgtgcacgtcaataaagagctgag

SEQ ID NO: 7687 - protein, 530 aa, Gallus gallus
MSKHHDAGTAFIQTQQLHAAMADTFLEHMCRLDIDSEPTIARNTGIICTIGPASRSVDKLKEMIKSGMNVARLNFSHGTHEYHEGTIKNVREATESFASDPITYRPVAIALDTKGPEIRTGLIKGSGTAEVELKKGAALKVTLDNAFMENCDENVLWVDYKNLIKVIDVGSKIYVDDGLISLLVKEKGKDFVMTEVENGGMLGSKKGVNLPGAAVDLPAVSEKDIQDLKFGVEQNVDMVFASFIRKAADVHAVRKVLGEKGKHIKIISKIENHEGVRRFDEIMEASDGIMVARGDLGIEIPAEKVFLAQKMMIGRCNRAGKPIICATQMLESMIKKPRPTRAEGSDVANAVLDGADCIMLSGETAKGDYPLEAVRMQHAIAREAEAAMFHRQQFEEILRHSVHHREPADAMAAGAVEASFKCLAAALIVMTESGRSAHLVSRYRPRAPIIAVTRNDQTARQAHLYRGVFPVLCKQPAHDAWAEDVDLRVNLGMNVGKARGFFKTGDLVIVLTGWRPGSGYTNTMRVVPVP

SEQ ID NO: 7688 - DNA, 1425 bp, Clostridium perfringens
  CDS (1)..(1425)
atgcaaaaaacaaaaatgatatttacaattggtccttcaagtgattcagaagaaattttaagagagttcataagaattggtatgaatgcagctagattaaacttctcacatggagaccatgcaagtcataaagaaaaaatagaacttattaagagacttagaaaagaagaaaaatcagctacagctatcttattagacattaagggtcctaaaataagaacatataattttaaaaatggcgaagctgaattaaaaaatggtgatgaattcacattctcttgcggagatgaaatattaggtgataacactaaatgttcaatctcttataaagaactatatgaagacataaaacctggtggatcaatacttgttgatgatggacttttagaatttaaagtaaaggaagtccgtggaactgatataatatgtgaagttattgaaggaggtactataaaagaccataaaggtgtaaatgtacctaatgtaccaatcaaactccctgcagtaactgaaaaggatagatctgacttaatatttggttgcgagatggaagtagactttgtagcagcttctttcataagaaaaccagaggatgtacttgaagttagagaaattctagactctcatggtggaaaagatataaaaataatatcaaaaatagaaagccaagaaggtgtagataacataaaagaaataattaaagttactgatggtgtaatggttgctagaggtgatatgggagtagaaattcctatagaaaatgtacctataattcaaaaaaatataattaagaaatgtaatcaagcagggaaaatagttataacggcaactcaaatgttagattctatgataagaaatccaagacctactagagctgaagcttctgacgtatgtaatgccatatttgatggtacagatgccataatgcttagtggagaaagtgcttctggtagcttccctatagaggcagcaatgacaatgtctagaatagcaaaaaaagcagaagctaacttagactataattatcttttaagaagattaaaagatccaaatccaaatcccgatgcctttgcagatgccataagttattcagcatcaaaaacagctagcaaattccctacaaaagctatagtagcagccactcagactggttcaactgctaagatattatcaaaatataaacctagctgtccaataatagctattactccatatgaaaaagttagaagaagcttagctttaaactttggaataatttctaagaaatgtgcttattttaatagtacagatgaaattatagaggaagctagaaaagtagctaaagaatttgaaatagctgaaactggagataatataatggtagctgctggattcccaacatcaataactggtggaacaaacatgctaaaaattgaaaaaatataa

SEQ ID NO: 7689 - protein, 474 aa, Clostridium perfringens
MQKTKMIFTIGPSSDSEEILREFIRIGMNAARLNFSHGDHASHKEKIELIKRLRKEEKSATAILLDIKGPKIRTYNFKNGEAELKNGDEFTFSCGDEILGDNTKCSISYKELYEDIKPGGSILVDDGLLEFKVKEVRGTDIICEVIEGGTIKDHKGVNVPNVPIKLPAVTEKDRSDLIFGCEMEVDFVAASFIRKPEDVLEVREILDSHGGKDIKIISKIESQEGVDNIKEIIKVTDGVMVARGDMGVEIPIENVPIIQKNIIKKCNQAGKIVITATQMLDSMIRNPRPTRAEASDVCNAIFDGTDAIMLSGESASGSFPIEAAMTMSRIAKKAEANLDYNYLLRRLKDPNPNPDAFADAISYSASKTASKFPTKAIVAATQTGSTAKILSKYKPSCPIIAITPYEKVRRSLALNFGIISKKCAYFNSTDEIIEEARKVAKEFEIAETGDNIMVAAGFPTSITGGTNMLKIEKI

SEQ ID NO: 7690 - DNA, 1425 bp, Corynebacterium efficiens
  CDS (1)..(1425)
atggaaagacgaactaagattgtatgcaccctcggtccggcggtcgccagcgcggatgggatcctccgactggttcaggacggcatggatgtggcccgcctgaacttctcgcacggcgatcaccccgaccatgaacagaactacaagtgggtccgtgaagccactgacaagaccggtcgcgcggtcggcatcctcgccgacctgcagggccccaagatccgtctcggacggttcaaggagggctcaaccgtatgggagaccggtgagacggtccgcatcacggtggatgatgtcgaaggcacccatgaccgtgtctccaccacctacaagaacctggccaaggatgcccgtccgggggaccgtctgctggtcgatgacggcaaggtcggcctcgtctgcgtctccgtcgagggcaacgatgtcatctgtgaggtcaccgaaggtggccccgtctccaacaacaagggtgtctccctgcccggcatggacatctccgtgccagccctatccgagaaagacatcaaggatcttcgtttcgccctgaagctcggcgttgacttcatcgccctgtccttcgtccgctccccagcggacgtcgaactcgtccatgccatcatggatgaggagggacgtcgcgtcccggtgatcgccaagctggagaagccggaggcggtcgcagcactcgagtccatcgtgctggcgttcgacgcgatcatggtcgcccgtggagacctcggcgtggaggtcccgctcgaggaggtcccgctcgtgcagaagcgggcgatccagatcgcccgggagaacgccaagccggtcatcgtggccacccagatgctcgattcgatgattgagaattcccgtccgacccgtgcggaggcctccgatgtggccaacgccgttctcgatggtgccgatgccgtcatgctctccggtgagacctccgtgggtaaggatccccacaatgtggtccgcacgatgtcccgtatcgtccgcttcgccgagaccgacggccgggttccggatctcacgcacattccgcgcaccaagcgtggcgtgatctcctattccgcccgcgacatcgccgagcgactcaatgcccgcgccctggtcgccttcaccacctcgggggacaccgccaagcgtctggcccgtctgcactcccatctgccgctgctggtcttcacccctgatccgagcgtccgctcccagctggcgctcacctggggtgcccagaccttcctgtgcccgaaggtggatgacaccgatggcatgatgcgtgaggttgaccgtgcgctgctggccatggacgagtatcagaaggatgacatgatggtggtcgtcgccggttcccctccgggggtcacgggaaacaccaacatgatccacgttcacctgctgggtgaggatacccggattcccaagtag

SEQ ID NO: 7691 - protein, 474 aa, Corynebacterium efficiens
MERRTKIVCTLGPAVASADGILRLVQDGMDVARLNFSHGDHPDHEQNYKWVREATDKTGRAVGILADLQGPKIRLGRFKEGSTVWETGETVRITVDDVEGTHDRVSTTYKNLAKDARPGDRLLVDDGKVGLVCVSVEGNDVICEVTEGGPVSNNKGVSLPGMDISVPALSEKDIKDLRFALKLGVDFIALSFVRSPADVELVHAIMDEEGRRVPVIAKLEKPEAVAALESIVLAFDAIMVARGDLGVEVPLEEVPLVQKRAIQIARENAKPVIVATQMLDSMIENSRPTRAEASDVANAVLDGADAVMLSGETSVGKDPHNVVRTMSRIVRFAETDGRVPDLTHIPRTKRGVISYSARDIAERLNARALVAFTTSGDTAKRLARLHSHLPLLVFTPDPSVRSQLALTWGAQTFLCPKVDDTDGMMREVDRALLAMDEYQKDDMMVVVAGSPPGVTGNTNMIHVHLLGEDTRIPK

SEQ ID NO: 7692 - DNA, 2084 bp, Drosophila melanogaster
  CDS (229)..(1830)
tctcgtcctcgccgcgtccgattttccatatatcccgattttcgtctcaaacttggaagatatattgccaaaatattgcattcggctagccgctgcgttgtgtgtgttgttgtgcgtggagttgcgtgtgcagttgcaagaagatatagtcgtctatatcgtcagaccgatctcgatcccaagtgcgattcccgttggttacatactacccgttcggtaggcaacaaaatggtgaacgtaaccatctacgatgaggcaccgcagctgaagcccaacgaagtaccccaaaacatggccgcaggagctgatacccaactggagcacatgtgccgtctgcagttcgactcgccagtgccccatgtgcgtctgtccggaatcgtgtgcaccatcggacctgcctccagcagcgtggagatgctggagaagatgatggccaccggcatgaacatcgcgcgcatgaacttctctcacggatcgcacgagtaccatgccgccaccgtggccaatgtgcgccaggcggtgaagaactactcggccaagctgggctacgaacaccccgtggccattgccctggacaccaaggggcccgagatccgtaccggtctgatcggaggcagcggcaccgccgagattgagctgaagaagggcgagaagatcaagctgaccaccaacaaggaattcctggagaagggctctctggagattgtgtacgtggactacgagaacattgtcaatgtggtgaagcccggcaaccgggtgttcgtcgatgacggtctgatctcactgattgtccgcgaggtaggcaaggattccctcacctgcgaggtggagaacggcggctctctgggttcccgcaagggtgtgaacctgccaggcgtgcccgtcgatctgcctgccgtctccgagaaggataagagcgatctgctgttcggtgtggagcaggaagtggacatgatctttgcttcgttcatccgcaacgccgctgctttgaccgagatccgtaaggttcttggcgagaagggcaagaacatcaagatcatttccaagatcgagaaccagcagggcatgcacaacctggacgagatcatcgaggccggtgatggcattatggtggcccgtggagatctgggtattgagattcccgccgagaaggtgttcctcgcccagaaggccatgattgcccgctgcaacaaggctggcaagcctgtgatctgcgccactcagatgttggagtcaatggtgaagaagccacgtcccactcgcgctgagatctctgatgtggccaacgctgtgctcgatggtgctgattgcgtcatgttgtctggtgagaccgccaagggcgagtacccgctggagtgcgtcctgaccatggccaagacctgcaaggaggccgaggctgccctctggcaccagaacctctttaacgacttggttcgcggcgctggtaccatcgatgcctctcacgcggctgccatcgctgccgttgaggctgccaccaaggccaaggcctccgccatcgtggtgatcaccaccagcggcaagtcggccttccaggtgagcaagtaccgcccacgctgccccatcatcgcggtcacccgtttcgcgcagaccgcccgacaggcccatctctaccgtggactggtgccactcatctacaaggagcccggtcttggtgactggctgaaggacgtggacgtgcgcgtgcagttcggtctgcaggtcggaaagaagaacggcttcatcaagaccggcgattccgtcgtggtggttaccggctggaagcagggctccggcttcaccaacaccatccgcattgtcaccgtcgaataaattctgccgctcaggaagtacctggatgcgtcgcagctgccgcgggcgtcgcgttgattactgttaataaccaagttaatttattaattacacaatattcggaatattggaaactgcaggaggctgctggaaccgctgtcagaagcgccgaaggccggcccgggcctcaaacagacacacaaatatactataccattgttgaataatagagatttcttcgaaaattataataaagtcatcactgtatttatgta

SEQ ID NO: 7693 - protein, 533 aa, Drosophila melanogaster
MVNVTIYDEAPQLKPNEVPQNMAAGADTQLEHMCRLQFDSPVPHVRLSGIVCTIGPASSSVEMLEKMMATGMNIARMNFSHGSHEYHAATVANVRQAVKNYSAKLGYEHPVAIALDTKGPEIRTGLIGGSGTAEIELKKGEKIKLTTNKEFLEKGSLEIVYVDYENIVNVVKPGNRVFVDDGLISLIVREVGKDSLTCEVENGGSLGSRKGVNLPGVPVDLPAVSEKDKSDLLFGVEQEVDMIFASFIRNAAALTEIRKVLGEKGKNIKIISKIENQQGMHNLDEIIEAGDGIMVARGDLGIEIPAEKVFLAQKAMIARCNKAGKPVICATQMLESMVKKPRPTRAEISDVANAVLDGADCVMLSGETAKGEYPLECVLTMAKTCKEAEAALWHQNLFNDLVRGAGTIDASHAAAIAAVEAATKAKASAIVVITTSGKSAFQVSKYRPRCPIIAVTRFAQTARQAHLYRGLVPLIYKEPGLGDWLKDVDVRVQFGLQVGKKNGFIKTGDSVVVVTGWKQGSGFTNTIRIVTVE

SEQ ID NO: 7694 - DNA, 1901 bp, Eimeria tenella
  CDS (57)..(1652)
ctgcgtcgaagagaaactgtggctcattgtagcttgtgcactccccactaggcaagatggcgaatcctacacactctcaagtcgtcgcagctccggacagttccggacggctgctccgcctagttagcgccagctcagtcatgatgcagcttttgggcaaaagtacgaatatccgcatgtcccagatcctggaacaccacgaagatgaggacttcagtgcgcaccgcacgaagattgtgtgcacgatgggccccagctgctgggatgtggacaagatggtgcagttgatcgatgccgggatgaacgtgtgccgtcttaacttctctcatggtgatcatgaggcacatggccgtgtggtcaagaaccttcaggaggctctcaagcagcgcccagggaagcgggttgccttgttgctcgacacgaagggtcctgaaatcaggacgggcatgctggagggtgacaagccaatcgagcttcacgcgggggacatgctcaagatcgtcaccgactacagctttgtaggcaacaagagctgcatcgcctgctcatacgagaaactgcccagctctgtcaagccaggaaataccattctcattgctgatggctccctatccgttgaagtcgtggagtgtggcaaggattacgtcatgactagggttatgaacccggccatcattggcaacaagaagaacatgaaccttcccggcgttaaggtcgacttgcccgttattggcgagaaggacaagaatgacattctgaattttggcattcctatgggctgcaacttcattgccgcgtccttcgtgcagtctgcagacgacgtgcgctatatccgcagcattcttggcaccaaggggcgcaacatcaagatcattcccaagattgaaaatgttgagggtctcctcaacttcgatgaaattcttcaggaggcagacggcattatgattgccagaggcgatctcggtatggagatcccacctgaaaaggtcttccttgcccagaagatgatgatctcaaaatgtaatgttgctggaaagcccgtcatcacggcaacgcagatgcttgagtcgatgacgaagaacccacgcccgacgcgtgccgaagctgcagatgtggcgaatgctgtccttgatggcactgattgcgtcatgctctccggggagacggcgaacggaagcttccctgttcaggctgtcactgtcatgtcccgtgtctgcttcgaggccgaaggctgcattgactatcagcaggtgttcagagccacttgccaagctaccatgactcctattgacacccaggaggcagtggctcgtgctgctgttgagacagctcagtcaatcaacgcatcgctcatcctcgcccttactgaaactggccgcactgctcgcctgatcgcgaagtataggccaatgcagccaattctggctttgagcgcttcggaggaaaccatcaagcagctgcaggtcattcgcggcgttacaacattcttggtgccgactttccagggcacggaccagctgattcgcaacgcactttctgcagccaaggagctgcagctggtcagcgaaggcgacagcattgtcgcagtgcacggaatcaaggaggaggttgcaggatggtccaacctcctgaaggttcttgtcgtcgagtaggcgacttgtcagcgttcgcctttcggggtgtaacagcggctgacgcgtggaattcttggctcagccatgagccgctgctgtcgcgcgagcaggcagtggatgcgcgaacgttcgctgcctctgcttaaccgccgttcggtggaactcgggcttttagctccattttaatagaccgcgaggcggtgtgctgcggcgttttctaaggacttctgcgttaggtcgttgtgaagctaaaaaaaaaaaaaaaaa

SEQ ID NO: 7695 - protein, 531 aa, Eimeria tenella
MANPTHSQVVAAPDSSGRLLRLVSASSVMMQLLGKSTNIRMSQILEHHEDEDFSAHRTKIVCTMGPSCWDVDKMVQLIDAGMNVCRLNFSHGDHEAHGRVVKNLQEALKQRPGKRVALLLDTKGPEIRTGMLEGDKPIELHAGDMLKIVTDYSFVGNKSCIACSYEKLPSSVKPGNTILIADGSLSVEVVECGKDYVMTRVMNPAIIGNKKNMNLPGVKVDLPVIGEKDKNDILNFGIPMGCNFIAASFVQSADDVRYIRSILGTKGRNIKIIPKIENVEGLLNFDEILQEADGIMIARGDLGMEIPPEKVFLAQKMMISKCNVAGKPVITATQMLESMTKNPRPTRAEAADVANAVLDGTDCVMLSGETANGSFPVQAVTVMSRVCFEAEGCIDYQQVFRATCQATMTPIDTQEAVARAAVETAQSINASLILALTETGRTARLIAKYRPMQPILALSASEETIKQLQVIRGVTTFLVPTFQGTDQLIRNALSAAKELQLVSEGDSIVAVHGIKEEVAGWSNLLKVLVVE

SEQ ID NO: 7696 - DNA, 3479 bp, Lactobacillus delbrueckii
  CDS (1277)..(3046)
aagctttaggccaaagaaagagcctggacttcaaaatttgggacatgaagcaggtaaatttgcgctgaaaacgacttgaccaatttgcttttttgaaaaaaatctctcctagtgaaataaataataaacgccaggctgggatttgtaagccctaacaggttgaaagtctaaaaaaatctaatttaaaccaaattttacaagactttatgcgggaaaaatgttatgatttacatgatgtgagatattacacaatttaaatcatgaatgaggtgaattcatgaaacggattggtattttgactagcggcggtgacgcccctggtatgaatgcagccgtaagagccgtaaccagagtcgcgatcgcgaacggtttggaagttttcggtatcagatacggttttgcaggtttggttgcgggcgacattttcccattggaaagtgaagacgtagcccacttgatcaatgtttccggtaccttcctctactctgcgcgttatcctgaatttgcagaagaagaaggacagctggctggtattgaacaattgaagaagcacggcatcgatgctgttgtcgttattggtggggatggttcctaccatggcgccctgcagctgacccgccacggcttcaactcaattggcctgccaggcacgatcgacaacgatatcccttacacggatgccacgatcggctatgacacggcctgcatgacggcaatggacgcgatcgacaagatccgtgacactgcttctagccaccaccgcgtcttcattgtcaacgtaatgggccgcaactgtggtgacatcgctatgcgcgtcggcgtagcctgcggggcggacgcgatcgtcattcctgaaagaccatatgatgtcgaagaaatcgccaaccggctcaagcaagcccaggaaagcggcaaggaccacggtttggtagttgttgctgaaggcgtaatgaccgctgaccaattcatggctgaactgaagaagtatggtgacttcgacgtccgggccaatgttttgggtcacatgcagcggggcggcacgccaactgtttctgaccgggtgctggcttccaagctgggcagcgaagccgttcaccttcttttggaaggcaagggcggcctggctgtcggcattgaaaacggcaaggttacttcacacgacatccttgatttatttgatgagtctcacaggggtgactatgacttgttaaagctcaacgcagatttatcaagatagttgtttctatagtttttgatttagggagattttttcaagatgaaaaaaacaaagattgttagtactttagggccagcttcagacgatattgaaactattaccaagttagccgaagcaggcgcaaacgtattccgtttcaacttctcacacggtaaccacgaagaacacttggcaagaatgaacatggttcgtgaagttgaaaagaagactggcaagcttttgggcatcgctttggacaccaagggtgctgaaatcagaaccactgaccaagaaggcggcaagttcactatcaacactggtgacgaaatccgcgtgtcaatggacgcaaccaaggccggcaacaaggacatgatccacgttacctacccaggtctgttcgacgacactcacgtaggcggcactgtattgatcgacgacggtgctgttggtttgactatcaaggccaaggacgaagaaaagcgcgaattggtttgtgaagctcaaaacactggtgtcatcggctcaaagaagggtgttaacgctccaggtgttgaaatccgcctcccagggattactgaaaaggacactgacgacatccgctttggtttgaagcacggtattaacttcatctttgcttcatttgtacgtaaggctcaagacgttcttgacattcgcgcactttgcgaagaagctaacgcatcatacgttaagatcttcccaaagattgaatcacaagaaggtattgacaacatcgacgaaatcttgcaagtttcagatggtttgatggttgcccgtggtgacatgggtgttgaaatcccattcatcaacgtgccatttgttcaaaagactttgatcaagaagtgcaacgctttgggcaagccagttatcactgctactcaaatgctggactcaatgcaagaaaacccacgtccaacccgtgccgaagtaactgacgttgctaacgccgttcttgacggtactgacgcaactatgctgtcaggtgaatcagcaaacggtttgtacccagtacaatcagttcaagctatgcacgacatcgatgttcggactgaaaaggaattggacacccggaacactctggctctgcaacgctttgaagaatacaagggctcaaacgttactgaagctatcggtgaatcagttgtccgcactgctcaagaactgggcgttaagactatcatcgctgctactagctccggctacacagctcgtatgatctccaagtaccgtccagacgcaaccatcgttgccttgactttcgacgaaaagatccaacactcattgggtatcgtttggggcgttgaaccagttttggcaaagaaaccttcaaacactgacgaaatgttcgaagaagctgcccgcgtagctaaggaacacggtttcgttaaggatggcgacctggtaatcatcgttgccggcgtaccattcggccaatcaggtactactaacttgatgaagctgcaaatcatcggcaaccaacttgctcaaggtttgggcgtaggcactggctcagttatcggcaaggctgttgttgcgaacagcgctgaagaagccaacgctaaggttcacgaaggcgacatcctggtagctaagactactgacaaggactacatgccagctatcaagaaggccagcggtatgatcgttgaagcttccggcttgaccagccacgcagctgttgtcggcgtatcactcggcattccagttgttgtcggtgttgctgacgcaacttcaaagatcgctgacggctcaactttgactgttgacgcacgtcgcggcgcaatttaccaaggtgaagtttcaaacctgtaatctaggattgcaagtctgacaaccacagaagaaagagttcaatcaatcgattgagctcttttcctttgccaattttttctctgctttctttaatgattgccttgaatatagctaaggcagaagaggtattttaaactgctgagccgctttaaatcacctgcaaacttaatctacccaaaaagcatagccgaccttagaagaccgatatgggctgtttagcagggaggaaaaagcgcattaaaaactccagctgagctagagttaaattatcacttttttaattgttaagctgcaaggtcatcttcacctaagatgatctgcaaggtgtcgtggacgatcttgtccttggccagttgggcctggtcatcgtcttggtcgcggaagtcgttgatcatttctgccgcgatgggttggtttttgatgacccagatcc

SEQ ID NO: 7697 - protein, 589 aa, Lactobacillus delbrueckii
MKKTKIVSTLGPASDDIETITKLAEAGANVFRFNFSHGNHEEHLARMNMVREVEKKTGKLLGIALDTKGAEIRTTDQEGGKFTINTGDEIRVSMDATKAGNKDMIHVTYPGLFDDTHVGGTVLIDDGAVGLTIKAKDEEKRELVCEAQNTGVIGSKKGVNAPGVEIRLPGITEKDTDDIRFGLKHGINFIFASFVRKAQDVLDIRALCEEANASYVKIFPKIESQEGIDNIDEILQVSDGLMVARGDMGVEIPFINVPFVQKTLIKKCNALGKPVITATQMLDSMQENPRPTRAEVTDVANAVLDGTDATMLSGESANGLYPVQSVQAMHDIDVRTEKELDTRNTLALQRFEEYKGSNVTEAIGESVVRTAQELGVKTIIAATSSGYTARMISKYRPDATIVALTFDEKIQHSLGIVWGVEPVLAKKPSNTDEMFEEAARVAKEHGFVKDGDLVIIVAGVPFGQSGTTNLMKLQIIGNQLAQGLGVGTGSVIGKAVVANSAEEANAKVHEGDILVAKTTDKDYMPAIKKASGMIVEASGLTSHAAVVGVSLGIPVVVGVADATSKIADGSTLTVDARRGAIYQGEVSNL

SEQ ID NO: 7698 - DNA, 1941 bp, Leishmania mexicana
  CDS (112)..(1611)
atactgacacacactgcacgctctgtgcttcactttgttgttttcaagcagctgtttctcaattcactttactcatatttccaacctcttatcctcctcttacgtaacaacatgtcccagttagcgcacaatctgacgctctcgatcttcgacccggttgcgaactaccgggccgcccggatcatctgcactatcggccccagcacgcaaagtgtggaggcgctgaaggggctgattcagagtggcatgtctgtggcgcgtatgaacttctcgcatgggtcacacgagtatcaccagacgacgatcaacaatgtgcgccaggcggccgcggagctcggtgtgaatatcgcgattgcgctggacacaaaggggcccgagattcggacgggacagttcgttggtggtgatgctgtgatggagcgaggagcgacgtgctatgtgacgacagaccctgcgtttgcggacaagggcaccaaggacaagttctacatcgactaccagaacctgtcgaaggtggtgcgccccggcaactacatctacatcgacgacggcatcctgatcctgcaagtgcagagccacgaggacgagcagacgctggagtgcacagtcaccaactcgcacacgatatctgaccggcgcggtgtgaacctgccggggtgcgacgtggacctgcccgctgtgtcggcgaaagaccgcgtggacctgcagttcggtgtcgaacagggtgtggacatgatcttcgcgtcgttcatccggagcgcggagcaggtgggtgatgtgcggaaggcgctcggaccgaagggccgagacatcatgatcatctgcaagatcgagaaccaccagggcgtgcagaacattgactctatcattgaggagagcgacggcatcatggttgcgcgcggcgacctcggcgttgagattccagcagagaaggtggtggttgcgcagaagattctgatcagcaagtgcaacgttgctggcaagccggtgatctgcgcgacgcagatgctggagagcatgacgtacaacccccgcccgacgcgcgctgaggtatcggacgtcgctaacgctgtcttcaacggtgccgattgcgtgatgctgtctggtgagacggcgaaaggcaagtatccgaatgaggtggttcagtacatggcgcgtatctgcctagaggcacagagcgcgcttaacgaatatgtcttcttcaacagcatcaaaaagctgcagcacatcccgatgagtgctgatgaggctgtttgcggcagtgctgtcaactccgtgtctgagaccaaagccaaggcaatggtggtgctgagcaacacaggcgcaggcgctcgactggtggcgaagtaccgtccgaactgcccgattgtgtgtgtgacgacgcgcctgcagacgtgccgccagctgaacatcacacagggcgtggagagtgtcttctttgatgcagataagctcggccacgacgagggcaaggagcatcgcgtggcagcaggtgttgaattcgccaagtcgaagggctatgtgcaaactggtgactactgcgttgtgattcatgccgatcacaaggtaaagggctatgccaaccagacgcgcatacttctcgtcgaatgaggccagatcccattcgcatatgcgcgccactttgtcctatacggaaaagggactctctgaggtattatatcctttggtttgtctccgcgcccttcgaactttcgacatgtgcttgcggttagcgtgatcggtggcatgttgctgcctctgccccttttgtttgtgtgatttgtcgtaccattcacgaatggcgaatgctgtttttttttctgttttttgctgttctcctggaccacctttcgtctatacacttcttgagctgccagctaccgcctttgtcggcgcacgggatcgtgggctgtgtatttgcgttgaggggagtggaggcag

SEQ ID NO: 7699 - protein, 499 aa, Leishmania mexicana
MSQLAHNLTLSIFDPVANYRAARIICTIGPSTQSVEALKGLIQSGMSVARMNFSHGSHEYHQTTINNVRQAAAELGVNIAIALDTKGPEIRTGQFVGGDAVMERGATCYVTTDPAFADKGTKDKFYIDYQNLSKVVRPGNYIYIDDGILILQVQSHEDEQTLECTVTNSHTISDRRGVNLPGCDVDLPAVSAKDRVDLQFGVEQGVDMIFASFIRSAEQVGDVRKALGPKGRDIMIICKIENHQGVQNIDSIIEESDGIMVARGDLGVEIPAEKVVVAQKILISKCNVAGKPVICATQMLESMTYNPRPTRAEVSDVANAVFNGADCVMLSGETAKGKYPNEVVQYMARICLEAQSALNEYVFFNSIKKLQHIPMSADEAVCGSAVNSVSETKAKAMVVLSNTGAGARLVAKYRPNCPIVCVTTRLQTCRQLNITQGVESVFFDADKLGHDEGKEHRVAAGVEFAKSKGYVQTGDYCVVIHADHKVKGYANQTRILLVE

SEQ ID NO: 7700 - DNA, 1452 bp, Methylobacterium extorquens
  CDS (1)..(1452)
atgatggaggcccctttgaagcgctcgcgccgcaccaagatcgtcgccaccctcggcccggcatccgacacgccggagatgatcgagaagctgttccacgccggtgcggacgtgttccgcatcaacatgagccatctggctcgcgagaagctgcctgaacgcatcgaggtgattcgcaccatcgagcgggagggcaagcgccccatcggcatcctcgtcgaccttcagggcccgaagctgcggctcggcaccttcgtcggcgacgcggccgtgctggagaacggccagaccttcgtgctcgattcggatccgacgccgggcgataccgaccgcgtcttccttccccatcctgagatcctgtcggcgctggagcccagccacggcatcctgatcgacgatggcaagcttcgcctcatcgtcacggaggtgagcgaggggcgtgccgtcacccgcgtcgaggtcggcggtcgcatctcgaatcgcaagggcgtgtcgctgccccacaccgcgctgccggtgccggcgatgaccgagaaggatcgcggtgatctggaagcgggcctcgcggccggcgccgactggatcgcggtgtccttcgtgcagcgcccggaagacgtggcggaggtcaagaaggtcgccgccgggcgcgccctggtgatggccaagatcgagaagccgcaggcgctcacccgcctcgatgagatcatcgagatctccgacggcatcatggtcgcccgcggcgacctcggcgtcgagatgccgctcgaacaggtgccgggcgtgcagaagcgcatcacccgcgtcgcccgccggctcggcaagccggtcgtcgtcgcgacgcagatgctcgaatcgatgatcacctcaccggtgccgacccgcgccgaggtgtcggacgtggccaccgccgtctacgagggcgcggatgcggtgatgctctcggccgaaagcgccgccggcgactttccggtcgaggcgatcggcaccatgaaccgcatcgccgaacaggtggagcgcgacgcgctctactggtcgatcctgatggcgcagcgttccgagccggagccgaccgcttccgacgccatcgcggccgcggcccaccagatcgtcgaggcgctgagcctgcgctcgatcatggcctggacccattccggttcaacggtgctgcggctggcgcgcgcccggcccaatgccagcgtcatcgcgctgacgccgaagcgcgagacggcgcggcgcctcaccatggcctggggcgtgcacccgatcgtcaccaaggatgccagcgacgtggacgacatggccttccgcgccgcgaagttcgcggtgcgcgagcgcttcgccgagatcggcgaccgagtgatcatcgtggccggcgtgccgttcggcattccgggggcgaccaacatggtgcgcatcgccttcgtcacccgcgagcacgccgagcgggcctga

SEQ ID NO: 7701 - protein, 483 aa, Methylobacterium extorquens
MMEAPLKRSRRTKIVATLGPASDTPEMIEKLFHAGADVFRINMSHLAREKLPERIEVIRTIEREGKRPIGILVDLQGPKLRLGTFVGDAAVLENGQTFVLDSDPTPGDTDRVFLPHPEILSALEPSHGILIDDGKLRLIVTEVSEGRAVTRVEVGGRISNRKGVSLPHTALPVPAMTEKDRGDLEAGLAAGADWIAVSFVQRPEDVAEVKKVAAGRALVMAKIEKPQALTRLDEIIEISDGIMVARGDLGVEMPLEQVPGVQKRITRVARRLGKPVVVATQMLESMITSPVPTRAEVSDVATAVYEGADAVMLSAESAAGDFPVEAIGTMNRIAEQVERDALYWSILMAQRSEPEPTASDAIAAAAHQIVEALSLRSIMAWTHSGSTVLRLARARPNASVIALTPKRETARRLTMAWGVHPIVTKDASDVDDMAFRAAKFAVRERFAEIGDRVIIVAGVPFGIPGATNMVRIAFVTREHAERA

SEQ ID NO: 7702 - DNA, 1439 bp, Mycobacterium intracellulare
  CDS (1)..(1419)
atgagtagacgcgggaagatcgtctgcacccttgggcctgcgaccaattcggacgagttgatcttggcgctggttgaggcgggaatggacgtcgcccggttgaacttcagccacggtgattacgccgatcacaaagcggcctacgaacgggtccgggtggcctccgacgccaccggccgtgccgtcggcgtgctcgccgatttgcagggccccaagatcaggctgggacgcttcgcgaccggcccaacctactgggccgacggtgagaccgtccggatcaccgtcgccgactgcgagggcagccacgaccgggtgtcgaccacctacaagaaactggccgaggacgccgccgtcggtgaccgggttctggtcgacgacggcaaggtctgcctggtggtcgatggcatcgagggcgacgacgtcatctgcacggtcgtcgagggcggcccggtcagcaacaacaagggaatctcgttgccgggcatgaacgtgtcggcaccggccttgtcggagaaggacatcgaggacctcaccttcgccctggacctcggcgtcgacctggtcgccctgtccttcgtgcgctcgccggccgacgtcgagctggtgcacgaggtgatggaccgggtcgggcgacgggttccggtgatcgccaagctggaaaagcccgaagccgtcgacaatctggaaaccatcgtgctggccttcgacgccatcatggtggcccgcggcgacctcggcgtcgagctgccactggaagaggttccgctggtgcagaagcgggccatccagatggcccgggagaacgcgaaaccggtcatcgtggccacccagatgctcgattccatgatcgagaactcacgcccgacccgcgccgaggcctccgacgtcgccaacgccgtcctcgacggcgccgacgcggtgatgctgtccggggagacgtcggtgggcaagtatccgatggctgccgtgcggaccatgtcgcgcatcatctgcgcggtcgaggacaattccacggccgccccgccgctgacccacgtgccgcgcaccaaacgcggcgtgatctcctatgcggcccgcgacatcggcgagcggctcgacgccaaagccctggtcgccttcacccaatccggcgacacggtcaagcggctcgcgcgcctgcacaccccgctgccgctgctggccttcaccgcctggcccgaggtgcgcagccagctcgccatgacctggggcaccgaaacgttcatcgtcccgatgatgacctccacgggcggcatgatccgccaggtcgacaagtcactgctcgaactcggtcgctacaagcgcggcgacctggtggtcatcgtcgccggcgcgccacctggcacagtagggtcgaccaacctgatccacgtgcaccggatcggggaggacgacgtctaacgcccggacccgaaggagag

SEQ ID NO: 7703 - protein, 472 aa, Mycobacterium intracellulare
MSRRGKIVCTLGPATNSDELILALVEAGMDVARLNFSHGDYADHKAAYERVRVASDATGRAVGVLADLQGPKIRLGRFATGPTYWADGETVRITVADCEGSHDRVSTTYKKLAEDAAVGDRVLVDDGKVCLVVDGIEGDDVICTVVEGGPVSNNKGISLPGMNVSAPALSEKDIEDLTFALDLGVDLVALSFVRSPADVELVHEVMDRVGRRVPVIAKLEKPEAVDNLETIVLAFDAIMVARGDLGVELPLEEVPLVQKRAIQMARENAKPVIVATQMLDSMIENSRPTRAEASDVANAVLDGADAVMLSGETSVGKYPMAAVRTMSRIICAVEDNSTAAPPLTHVPRTKRGVISYAARDIGERLDAKALVAFTQSGDTVKRLARLHTPLPLLAFTAWPEVRSQLAMTWGTETFIVPMMTSTGGMIRQVDKSLLELGRYKRGDLVVIVAGAPPGTVGSTNLIHVHRIGEDDV

SEQ ID NO: 7704 - DNA, 1635 bp, Thermoplasma acidophilum
  CDS (1)..(1635)
atgaagaccaagatagttgcgacaataggcccggctagcagttcgcccgagataatgaaacagatgatagacaacggtctttcgctggtaagaataaattctgcacatgcagatataaaggatgtatcgaagataacgcagatggttcgttctatcaacagggacgttggtataatgatagacctgaagggcccagagctcagaacgggcgaattcgcgggtggtacattgaaaatatcatccggtaaggactacgtcatgggcaaagacatagtcctgaacaacatgaacgtgctttcggctgttcaggttggcgacaggatactgatgagcgatggtgaagtatcattcgaggttgaatcaacagatccgttcacaatccgggctctaaacgatggcgttctaagggacaggagccgtgtgaatatccccggccgtttcatagagctcggaaccataacggacagggatcgtgccttcataagggagggcatagcggatggcgtggacttcttcgccctttcatttgtgcagaaatctgagaacgttgacagcctgcgcgacttcgttatagacagcggtggcgatcagtacataatatcgaagatagagacgaagagcggcctggataacatagaggagatagtgaagtcatccgatggcatcatggtggcgcgtggcgatctcggtgtggaacttcccttgaaagaggtcgtgctggctcagaagcacataataaagacagcgcatgaggatggcgatttcactatcgtagcgacccaggtgctggaatccatggtaaacaacagttcacccacaagggcagagatttcagacattacaaatgcgatcatagacaatgcagatgccttaatgctctccgaggagagtgcgataggaaagtatccggttcaggccgtccgtacgctcaaggaggtttcggattacgtggaggacaaggtgtcgttcgattcttcatattactttaagggaaacaccatagcatactcagtagcaagggcagcgaagatactctctgatgatatcaagagcgatgggatagtggcacttacgcatactggatcaaccgttaggatgatatcgtcgctgaggccaaaggccatggtctacgctgccactgtaagcgagagtcttgccagaaagctgaacatatacttcggcgtattgccattgcatatggagggcaacgcagaagatcttagtttttcagagattatggaatacatagtgcgttctggtaggttcgctgatggaagtaagctcgtgatgaccagcggcgatccgtacttcacgtttggagggacgaacgacgtcaaggtggccgttgtaggcaaattcataggaagaggctattcatttggagatagcttatccggtacggcaacttacggtacgaagggagacatactcatgtctgaggatggaagaattcctggaactgatttcagggcattcatattcacatctgatatcaagccatctcttatgtcttctttaaagggaaaaacggttgtaaccaaggcaagattggttcgtcagataaaggaaggcgagcgcatatacatcgatggaaatacgggaataatactcatggcttcgccggatcaaaaataa

SEQ ID NO: 7705 - protein, 544 aa, Thermoplasma acidophilum
MKTKIVATIGPASSSPEIMKQMIDNGLSLVRINSAHADIKDVSKITQMVRSINRDVGIMIDLKGPELRTGEFAGGTLKISSGKDYVMGKDIVLNNMNVLSAVQVGDRILMSDGEVSFEVESTDPFTIRALNDGVLRDRSRVNIPGRFIELGTITDRDRAFIREGIADGVDFFALSFVQKSENVDSLRDFVIDSGGDQYIISKIETKSGLDNIEEIVKSSDGIMVARGDLGVELPLKEVVLAQKHIIKTAHEDGDFTIVATQVLESMVNNSSPTRAEISDITNAIIDNADALMLSEESAIGKYPVQAVRTLKEVSDYVEDKVSFDSSYYFKGNTIAYSVARAAKILSDDIKSDGIVALTHTGSTVRMISSLRPKAMVYAATVSESLARKLNIYFGVLPLHMEGNAEDLSFSEIMEYIVRSGRFADGSKLVMTSGDPYFTFGGTNDVKVAVVGKFIGRGYSFGDSLSGTATYGTKGDILMSEDGRIPGTDFRAFIFTSDIKPSLMSSLKGKTVVTKARLVRQIKEGERIYIDGNTGIILMASPDQK

SEQ ID NO: 7706 - DNA, 1497 bp, Trypanoplasma borreli
  CDS (1)..(1497)
atgatgcgaaaatctcaacttcagttcaacactgagcttcgtgtacatcatccaccggcactcttccgttctaacaaaattatatgtacaatcggtccgtcgtcccaaagtgtggaggtactcaaagacctcatgaaggctggtctaaatgttgcgcgcatgaatttctcccatggaacttacgagtatcatcagaagaccatcgataatgtcaggaaggcagcctcagagcttggtatacacgtaggaatcgctttagatactaaaggacctgagatccgcactggtctgttccctgctggagatgttgtgatcgaggcccacaagacagtaatattaacaactgatgagacgttcaaagaaaaaggcacagctgagaagttctacgtggattacatgaatattaccaaggtagtccctgttggtggtcatatatttgtcgatgatggtcttctggacctgatagtcgtcaagatctccggtaaagacattgagtgtgtggcgcagaacacccatactatcagcaatcggaaaggcattaatcttcctaatgcagatgtggaccttcccgcagtttctgagaaggacctgatggacttgcagttcggggccaagaatcgcgtagactttgtgttcgcctcttttattcgtaatgctgatcaggtgaatgaggtacgtcaggcttttggagggaaaatagcagtaattgcgaagattgaaaactaccaaggaatagacaatatagatgcgattattgatgcagcagatggcattatggttgctcgtggtgatctcggtgtggagattcctgcagaaaaggttgttattgcccaaaagatgatcatgtccaagtgcaataaagttggtaagacagttatatgtgctacacagatgcttgattctatgacgcacggcccccgacctacccgtgcggaggtcagcgatgtggccaagtccgtgcttgatggagctgactgtgtaatgctatcaggggaaactgcaaaagggaaatatcctgttgaaaccgtcgtatacatgtcgcgtatatgctgcgaaacacaggtcacaatgtggaacatggccgccttcgaagctatcaagaatctccaatcgttcccgctgataccagaggaagccatctgctcttctgcagttaattctatatttgagctacacgctaaggcaatattggtgctaactaatacaggtcgcagtgcacatatggtgagtaagtatcgcccacctgtccccatcatatgtgcttcgcaagagctagacgtctgtcgtctgctcagcatcacccgcggtaccatacctgtgtactatgacactgagaagctggggcctgactatgatcgtgagaagcgagttggattggcaattgatgtagggaagcagatgggtgtgttcaaagaaggagatgtcgttgtggctgttcacgctgatcatcatacaaaagggtttgcgaaccagatcagggccatatacattaaataa

SEQ ID NO: 7707 - protein, 498 aa, Trypanoplasma borreli
MMRKSQLQFNTELRVHHPPALFRSNKIICTIGPSSQSVEVLKDLMKAGLNVARMNFSHGTYEYHQKTIDNVRKAASELGIHVGIALDTKGPEIRTGLFPAGDVVIEAHKTVILTTDETFKEKGTAEKFYVDYMNITKVVPVGGHIFVDDGLLDLIVVKISGKDIECVAQNTHTISNRKGINLPNADVDLPAVSEKDLMDLQFGAKNRVDFVFASFIRNADQVNEVRQAFGGKIAVIAKIENYQGIDNIDAIIDAADGIMVARGDLGVEIPAEKVVIAQKMIMSKCNKVGKTVICATQMLDSMTHGPRPTRAEVSDVAKSVLDGADCVMLSGETAKGKYPVETVVYMSRICCETQVTMWNMAAFEAIKNLQSFPLIPEEAICSSAVNSIFELHAKAILVLTNTGRSAHMVSKYRPPVPIICASQELDVCRLLSITRGTIPVYYDTEKLGPDYDREKRVGLAIDVGKQMGVFKEGDVVVAVHADHHTKGFANQIRAIYIK

SEQ ID NO: 7708 - DNA, 1629 bp, Yarrowia lipolytica
  CDS (1)..(1629)
atgatttacaccgccaattcgtccccttccaccaacctgcagtggctcagtaccctgaacacggatgacattcccaccaagaactaccgaaagtcgtccatcattggtactatcggtcccaacacaaactccgccgagatgatctccaagcttcgacaagctggtctcaacattgttcgaatgaacttctcccacggctcgtacgagtaccaccagtccgtcattgagaacgcccgagagtccgagcagcggttccgaggccgacccctagccattgctctcgacaccaagggccccgagatccgaaccggtgtcaccaaggacgacaaggactgggacgtcaaggccggccatgtcatgctcttctccaccaaccccaagtacaaggaccagtgcgacgataagatcatgtacattgactacaccaacattgtcaagcagattgacattggcaagatcatcttcgttgacgacggtgttctgtccttcaaggttctcgagaagattgacggcgagaccctcaaggtcgagactctcaacaacggtaagatctcttctcgaaagggtgtcaacctccctggcaccgatgtcgatctccccgctctgtccgagaaggacaaggccgatctcaagtttggtgttgagcacggtgtcgacatgatttttgcctctttcgtccgaaccgccaacgacgtccaggccatccgagacgtgctcggcgagaagggcaagggcatccaggtcatctccaagattgagaaccagcagggtgtcaacaactttgacgagattctgaaggagaccgacggtgtcatggttgcccgaggagacttgggtatcgagatccccgccccccaggttttcattgcccagaagcagctgatcgccaagtgtaacctggccggaaagcccgtcatctgtgccacccagatgctcgattccatgacctacaacccccgacccacccgagccgaggtctctgatgtcggtaacgccgtccttgatggtgctgactgtgtcatgctgtctggtgagacggccaagggaacctaccccattgagtccgtcaagatgatgcacgagacctgtctggttgccgagaaggccattgcctatgctcctctgttcaatgagatgcgaaccctgactgtccgacccaccgagaccgtcgagaccattgctatctccgccgtgtctgcttctttcgagcagcaggcccgagctattattgtgctgtccacatcgggaacctccgcccgactgtgttccaagtatcgacccaactgtcccattcttatggtgactcgaaacgcacaggccgctcgattctcccatctgtaccgaggcgtctaccccttcatctaccacaaggcccgagcttccaaccctgccgagtggcagcacgatgttgaggagcgactcaagtggggtatggacgaggctgttgctcttggtattcttaacaagggcgatgttgttgtcgccatccagggatggaccggtggtctggccacaccaacactctccgagttctcgagtgtgtctaaactttttaacacaaacctattagattataaaacatacagcatggtgattaagtcggtgaacggaggggttttgtacaagtag

SEQ ID NO: 7709 - protein, 542 aa, Yarrowia lipolytica
MIYTANSSPSTNLQWLSTLNTDDIPTKNYRKSSIIGTIGPNTNSAEMISKLRQAGLNIVRMNFSHGSYEYHQSVIENARESEQRFRGRPLAIALDTKGPEIRTGVTKDDKDWDVKAGHVMLFSTNPKYKDQCDDKIMYIDYTNIVKQIDIGKIIFVDDGVLSFKVLEKIDGETLKVETLNNGKISSRKGVNLPGTDVDLPALSEKDKADLKFGVEHGVDMIFASFVRTANDVQAIRDVLGEKGKGIQVISKIENQQGVNNFDEILKETDGVMVARGDLGIEIPAPQVFIAQKQLIAKCNLAGKPVICATQMLDSMTYNPRPTRAEVSDVGNAVLDGADCVMLSGETAKGTYPIESVKMMHETCLVAEKAIAYAPLFNEMRTLTVRPTETVETIAISAVSASFEQQARAIIVLSTSGTSARLCSKYRPNCPILMVTRNAQAARFSHLYRGVYPFIYHKARASNPAEWQHDVEERLKWGMDEAVALGILNKGDVVVAIQGWTGGLATPTLSEFSSVSKLFNTNLLDYKTYSMVIKSVNGGVLYK

SEQ ID NO: 7710 - DNA, 1596 bp, Oryctolagus cuniculus
  CDS (1)..(1596)
atgtcaaagtcccacagtgaagccgggtctgccttcatccagacgcagcagctgcacgcagccatggcggacacattcctggagcacatgtgccgcctggacatcgactccgcgcccatcacggcccgcaacacgggcatcatctgtaccattggccctgcctcccgatctgtggagacgctgaaggagatgatcaagtctgggatgaacgtggcgcgcatgaacttctcccacggaactcacgagtaccatgcggagaccatcaagaacgtgcgcacagccacggaaagctttgcctcagaccccatcctctaccggcccgtcgcggtggctctggacactaagggacccgagatccgaacggggctcatcaagggcagcggcacggcggaggtggagctgaagaagggagccacgctcaagatcacgctggacaacgcctacatggagaagtgcgacgagaacatcctgtggctggactacaagaacatttgcaaggtggtggacgtgggcagcaaggtctacgtggacgatggcctcatctccctgcaggtgaagcagaaaggtcctgacttcctggtgacggaggtggagaacggtggcttcttgggcagcaagaagggcgtgaacctccccggggctgcggtggacctgcctgccgtgtccgagaaggacatccaggatctgaagttcggcgtggagcaggacgtggacatggtgtttgcctctttcatccgcaaggcggctgacgtccatgaggtcaggaagatcctgggagagaaagggaagaacatcaagatcatcagcaaaattgagaaccacgagggggtgcgcaggtttgatgagatcctggaggccagcgacgggatcatggtggctcgtggtgatcttggcattgagattcctgcagagaaggtcttccttgcccagaagatgataattgggcgatgcaaccgtgctgggaagcctgtcatctgtgccacgcagatgctggagagcatgatcaagaagccccgccccacccgcgccgagggcagtgacgtggccaacgcggtcctggatggagccgactgcatcatgctgtctggagagacggccaagggcgactaccccctggaggccgtccgcatgcagcacctgatagctcgcgaggctgaggcagccatgttccaccgcaagctgttcgaagaacttgcgcgcagctccagtcactccacagacctcatggaggccatggccatgggcagcgtggaggcttcctataagtgtttagcggcagctttgatagttctcacggagtctggcaggtctgctcaccaagtggcccggtaccgcccgcgcgcccccatcattgccgtgacacggaaccaccagaccgcccgccaggcccacctgtaccgtgggatcttcccggtggtgtgtaaggatccggtccaggaggcctgggcagaggatgtcgacctccgggtaaacttggccatgaatgtcgggaaggcccgcggtttcttcaagaagggagatgtggtcattgtgctcaccggatggcgccctggctctggcttcaccaacaccatgcgcgtggtgcccgtcccgtga

SEQ ID NO: 7711 - protein, 531 aa, Oryctolagus cuniculus
MSKSHSEAGSAFIQTQQLHAAMADTFLEHMCRLDIDSAPITARNTGIICTIGPASRSVETLKEMIKSGMNVARMNFSHGTHEYHAETIKNVRTATESFASDPILYRPVAVALDTKGPEIRTGLIKGSGTAEVELKKGATLKITLDNAYMEKCDENILWLDYKNICKVVDVGSKVYVDDGLISLQVKQKGPDFLVTEVENGGFLGSKKGVNLPGAAVDLPAVSEKDIQDLKFGVEQDVDMVFASFIRKAADVHEVRKILGEKGKNIKIISKIENHEGVRRFDEILEASDGIMVARGDLGIEIPAEKVFLAQKMIIGRCNRAGKPVICATQMLESMIKKPRPTRAEGSDVANAVLDGADCIMLSGETAKGDYPLEAVRMQHLIAREAEAAMFHRKLFEELARSSSHSTDLMEAMAMGSVEASYKCLAAALIVLTESGRSAHQVARYRPRAPIIAVTRNHQTARQAHLYRGIFPVVCKDPVQEAWAEDVDLRVNLAMNVGKARGFFKKGDVVIVLTGWRPGSGFTNTMRVVPVP

SEQ ID NO: 7712 - DNA, 1799 bp, Xenopus laevis
  CDS (11)..(1606)
atcagagaacatggcgcagctgatgcaggacctgggaccggctttcgtccaacggcagcagctgaatgcctcaatggccgacaccttcctggatcacatgtgtctgttggacattgactcggagcccataacggccagaaacaccagcattgtctgtaccatcggtccagcctcgcgctctgtggaaatgctgaaggagatgataaaggctgggatgaacatcgctcgtctgaacttctctcacgggagccatgagtaccacgctgggtctattcacaatattcgggaagccaccgagagctttgcctcaaatcccattcactaccggcctgtggctatcgctctggacaccaaggggccagaaatccgaactggggtcatcaagacgggggagaacacagaggtggagctgatgaaaggctcaattatgaaagtgactaatgacgagtccttcaaggataagtgtgacgagaagatcctgtgggtggattataagaacatctgtaaagttgtgaaggtcggaggcaggatttttgtggacgatggactgatttctctgttggttagagagattggccctgattactgcatggctgaagtggagaatgggggtaacctgtgcagtaagaaaggggtgaatttgcctggggctccggtggaccttcctgcattatcggagagagattgcctggacttgaagtttgggattgagcagggagtagacatggtatttgcttccttcattcgcaaggcgcaagatgtacacaccattcgcaaggaactgggagaaaaaggtcggaatattcgcatcatcagcaaaatagaaaatcatgagggagtcaagaggttcgatgagattctcgaggccagtgatgggataatggtggcccggggtgatctcggcattgaaattccagcagagaaggttttcttggcacagaaaatgatgattggacgttgcaacagagccgggaagccagtgatctgtgccacgcagatgttggagagtatgatcaagaagcctcgtccgacccgtgcggagagcagtgatgtggccaatgctgtgctggatggagctgactgtatcatgttgtctggagagactgccaagggcctgtacccagtggagtctgtacacatgcagcatgcgattgcccgggaggctgaggcagcgatctacaatcgccagctgtttgaggaactcagacgagtgaccccactgacccaggatcccacagaggtgactgccataggggctgtagaggcctcgtttaaatgctgtgctggagccatcattgttctgaccacgtctggccggtctgcgcaactcctttctcgttaccgccctcgtgctcccatcattgcagtgacacgtagtgcccaggtggggcgccaggctcatctcaaccgcggggtcttccctgtcctgtaccaggaggcgcagctggaagtttgggctgatgatgtggatcgtagggtgcagtttgccatttccattggaaaagtccgtgggttcctgagcaaagacgacattgtgattattgtgactggctggaggcctgggtctggctacaccaatatcatgcaggtggtgagggtgccgtaagcctggcagtacaacactactcacaccctgtacctggggtcccctgtacaagtgggggtttccctgtatgtacccagtattttatcaatgcaggtttcctttatctgcttcccattccatattaaacatgggccaaagcttcaaaaaaaaaaaaaaaaaaaaaaaaaaaaaaaaaaaaaaaaaaaaaaaaaaa

SEQ ID NO: 7713 - protein, 531 aa, Xenopus laevis
MAQLMQDLGPAFVQRQQLNASMADTFLDHMCLLDIDSEPITARNTSIVCTIGPASRSVEMLKEMIKAGMNIARLNFSHGSHEYHAGSIHNIREATESFASNPIHYRPVAIALDTKGPEIRTGVIKTGENTEVELMKGSIMKVTNDESFKDKCDEKILWVDYKNICKVVKVGGRIFVDDGLISLLVREIGPDYCMAEVENGGNLCSKKGVNLPGAPVDLPALSERDCLDLKFGIEQGVDMVFASFIRKAQDVHTIRKELGEKGRNIRIISKIENHEGVKRFDEILEASDGIMVARGDLGIEIPAEKVFLAQKMMIGRCNRAGKPVICATQMLESMIKKPRPTRAESSDVANAVLDGADCIMLSGETAKGLYPVESVHMQHAIAREAEAAIYNRQLFEELRRVTPLTQDPTEVTAIGAVEASFKCCAGAIIVLTTSGRSAQLLSRYRPRAPIIAVTRSAQVGRQAHLNRGVFPVLYQEAQLEVWADDVDRRVQFAISIGKVRGFLSKDDIVIIVTGWRPGSGYTNIMQVVRVP

SEQ ID NO: 7714 - DNA, 2404 bp, Brachydanio rerio
  CDS (37)..(1635)
gtcagcgagagcaggatattaccagtctcctccacgatgtctcaaactaaagctcaggatatgggctctgccttcatccagacgcagcagctcaatgctgccatggccgacactttcctggagcacatgtgtctgctggacatcgactccgagcccaccatcgctcgcaacactggaatcatctgcaccatcggaccggcctcccgctcagtggacacactgaaggagatgatcaagtctggcatgaacatcgctcgcatgaacttctctcacggctcacacgagtatcatggagaaactattaaaaatgtacgtgaggcttgtgccagcttcaagccgggcagcatccagtacaggccagtgggcatcgccctcgacaccaaaggaccagaaatccgaactgggctcattaaagggagtggcacagctgaggtggagctgaagaagggaaataagatcaaggtgaccttagacgactccttcatggagaactgtgatgaagataccctctggctggactacaagaacatcaccaaggtggtggaggtgggcagtaaagtctacatcgatgacggactcatctctctccaggttctgcagatcgggtctgactatctgatctgtgagattgagaatggaggatctctgggcagtaagaagggtgtgaatctgccgggagccgcagtggatctgcctgcagtctcagagaaggacatcaaggatctgcagttcggtgtggagatgggtgtcgatatgatcttcgcctccttcatccgcaaggccgctgatgtgcaggcagtccgaaaagtgctgggagaaaagggcaaaaacatcaagattatcagcaagctggagaaccatgagggagtgcgcaggtttgatgagattatggaggccagcgacggcatcatggtggctcgtggtgatctaggaattgaaatccccacggaaaaggtgtttctggctcagaagatgatgattggtcgttgcaacaaggcaggaaagccaatcatctgtgccacacagatgttggagagcatgatcaagaagcctcgtcctacacgtgcggagggcagtgatgtggccaatgcagttctggacggagccgactgcattatgctgagcggagagacagctaaaggagattaccctctggaggccgtccgcacacagcacatgatcgctcgggaggcagaggctgccatgtttcatcggcaggtgtttgaggacctgcggcgctgtttgccactctccaccgaccccgccgaggccatcgccatcggggcagtggaggcctcctttaaaatcctgtcctcagcgtttatagtgctcactgggtccggcaggtctgctcatctgatctctcggtatcgtcctcgcgctccaatcctagcggtgacacgtaatgaacagacagctcgacaggctcatctttaccgtggtattttccccatatactacaacagcccatctaatgatgtgtgggccgaggacgtggacctgagggtcaacttcgccatggatgtcggtaaagctcgtggattcttcaaggctggtgatgtggtgatcgttctgactggctggcgtcccggctctggatacaccaacaccatgcgtgtcgtcccagtgccgtaaaaccgttaaaacccctctgctgttcatacatcactcctccatacatcacacaaaccccactccagcagaaaacacaaggccagtggaccaccctgttatcttctccccctgattggtcagtggatcatcatcctctctcctgattggttggtgtcccatcatcctctcatttgattggttgttctcacctgttttgtttttttatttcatctataatctcctgtttatctcacacacacatgaaacccgagctgtctgtctggtttgtgtctgtctgtccgcatggtgaagcgcagggatgggtggcgaatgctcaatcagctgtaacctgtaacggttatattagtagtgtttctctgtctgtgtgcttttatttgtgttcacactcctgacgatgttacattgtgtgtttgcactcgaccctgagatcgttatatattcatatattttctgaaatgtttggatgtctcgcgtccgcctcatttcagctgtggagtaaaggaggggtgaatattaatcattcccagcatcctctgctgtataaccccgtctctgctgctcacgtgtgtgtgtgtgtttgatgaatgaatgagagtgtgtgtttagatctacctgctttgtgtcgctagagtgcaagatgtactaactataagagtaatctatagtctcattctgaagtgttgtattattggagactgaattaataaaggagacgagcacttgaaaaaaaaaaaaaaaaaaaaaaaaaaaaaaaaaaaaaaaaaaaaaa

SEQ ID NO: 7715 - protein, 532 aa, Brachydanio rerio
MSQTKAQDMGSAFIQTQQLNAAMADTFLEHMCLLDIDSEPTIARNTGIICTIGPASRSVDTLKEMIKSGMNIARMNFSHGSHEYHGETIKNVREACASFKPGSIQYRPVGIALDTKGPEIRTGLIKGSGTAEVELKKGNKIKVTLDDSFMENCDEDTLWLDYKNITKVVEVGSKVYIDDGLISLQVLQIGSDYLICEIENGGSLGSKKGVNLPGAAVDLPAVSEKDIKDLQFGVEMGVDMIFASFIRKAADVQAVRKVLGEKGKNIKIISKLENHEGVRRFDEIMEASDGIMVARGDLGIEIPTEKVFLAQKMMIGRCNKAGKPIICATQMLESMIKKPRPTRAEGSDVANAVLDGADCIMLSGETAKGDYPLEAVRTQHMIAREAEAAMFHRQVFEDLRRCLPLSTDPAEAIAIGAVEASFKILSSAFIVLTGSGRSAHLISRYRPRAPILAVTRNEQTARQAHLYRGIFPIYYNSPSNDVWAEDVDLRVNFAMDVGKARGFFKAGDVVIVLTGWRPGSGYTNTMRVVPVP

SEQ ID NO: 7716 - DNA, 26 bp, artificial sequence
  primer
atgtctagattagaaagattgacctc

SEQ ID NO: 7717 - DNA, 25 bp, artificial sequence
  primer
ttaaacggtagagacttgcaaagtg

SEQ ID NO: 7718 - DNA, 1755 bp, Saccharomyces cerevisiae
  CDS (1)..(1755)
atgggaatacacataccatatctcacgtcaaagacatcgcaatcaaatgttggtgatgccgttggcaacgctgatagtgtagagttcaacagtgagcatgactcaccttcaaagagaggtaaaattacacttgagtcacatgaaatacagagggctcccgctagcgatgatgaagataggattcaaattaaacccgtgaacgacgaggatgacacgtcggtcatgatcacttttaaccaatctctttcgcccttcatcatcactctgacttttgtcgcatccatatccggtttcatgtttggttacgacactggttatatatccagtgcgctgatctcgatcggcacagatctggaccacaaggtacttacttatggggagaaggaaattgtcactgcggctacctctctgggagctttgattaccagtattttcgccggtactgcagctgacatatttggtaggaaacgttgtttaatgggttcgaatctgatgtttgtcattggcgcaatcttacaggtctccgcacacacattctggcaaatggctgttggtagactgatcatgggtttcggtgtcggtatcggctccttgatcgcgccacttttcatcagtgaaattgctcccaaaatgatcagagggagactaactgtcatcaattccttatggttgactggtggtcaattagtcgcttacggttgcggtgctgggttaaactacgtcaacaatggttggagaattcttgttggattgtcactaattcccactgctgtgcaattcacatgcctgtgctttttacctgacactccaagatactacgttatgaagggcgacttggcaagggctactgaggtgttgaagagaagttacactgacacttcggaggaaatcattgaacgtaaggtggaagaacttgttactttgaatcaatctattcctggtaagaatgtccctgaaaaagtctggaataccatcaaagaattgcacacagtaccatctaatctaagggctttgatcattggttgtggtttacaagcaattcaacagtttaccggttggaattcgttgatgtatttctctggtaccatcttcgaaactgtcggtttcaaaaattcttccgctgtttcaatcatcgtgtccggtaccaattttattttcactttagttgcctttttttccattgacaaaataggccgtagaaccatattattgattggattaccaggcatgaccatggctttagtcgtgtgctctattgctttccattttctaggtattaagtttgatggcgctgtcgctgtggtggtttcctccggtttctcctcttggggtattgtgatcatcgtatttattatcgtatttgctgcgttctacgctcttggtatcggtactgttccatggcaacaatcggaactattcccccaaaacgtgagaggtattgggacttcatatgcaactgctacaaactgggctggttcactggttattgcatccacatttttgaccatgttacagaatatcactcctgcaggtacatttgcctttttcgcgggattgtcgtgcttatcaaccattttctgctacttctgttatccagaattatcgggattggagttagaagaggtacaaactattttgaaggacgggttcaacatcaaagcctcgaaagctttggccaagaagagaaaacagcaagttgccagagttcatgaattgaaatatgaaccaactcaagagattatagaggatatatag

SEQ ID NO: 7719 - protein, 584 aa, Saccharomyces cerevisiae
MGIHIPYLTSKTSQSNVGDAVGNADSVEFNSEHDSPSKRGKITLESHEIQRAPASDDEDRIQIKPVNDEDDTSVMITFNQSLSPFIITLTFVASISGFMFGYDTGYISSALISIGTDLDHKVLTYGEKEIVTAATSLGALITSIFAGTAADIFGRKRCLMGSNLMFVIGAILQVSAHTFWQMAVGRLIMGFGVGIGSLIAPLFISEIAPKMIRGRLTVINSLWLTGGQLVAYGCGAGLNYVNNGWRILVGLSLIPTAVQFTCLCFLPDTPRYYVMKGDLARATEVLKRSYTDTSEEIIERKVEELVTLNQSIPGKNVPEKVWNTIKELHTVPSNLRALIIGCGLQAIQQFTGWNSLMYFSGTIFETVGFKNSSAVSIIVSGTNFIFTLVAFFSIDKIGRRTILLIGLPGMTMALVVCSIAFHFLGIKFDGAVAVVVSSGFSSWGIVIIVFIIVFAAFYALGIGTVPWQQSELFPQNVRGIGTSYATATNWAGSLVIASTFLTMLQNITPAGTFAFFAGLSCLSTIFCYFCYPELSGLELEEVQTILKDGFNIKASKALAKKRKQQVARVHELKYEPTQEIIEDI

SEQ ID NO: 7720 - DNA, 1560 bp, Glycine max
  CDS (1)..(1560)
atgcctgcggtaggaggtattagcaacggagggggcaaggagtaccctggaagcctcactccttttgtgacggtaacatgtatagttgcagccatgggtgggttaatcttcggttacgatatcggaatttcaggtggggtgacatccatggatccgtttctgctcaagtttttcccgtcggtgttccggaagaagaattccgacaaaacggtgaaccagtactgtcaatacgacagccagacactgacgatgttcacgtcgtcgctgtatctcgccgcgttgctgtcgtcgttggttgcctccaccgtcacacgtaggttcggccgaaaactctccatgcttttcggaggcttgcttttcctcgtcggtgcccttatcaacggttttgcccaacacgtgtggatgctcatcgtgggtcggatcttgctcgggttcggtatcgggtttgccaatcaatctgtgccactctacctatctgaaatggcttcatacaaatatagaggagcattgaacattggctttcaattgccaatcacattggtattcctcgtggccaatgtgttgaactacttctttggtaaaatccatggtggttggggatggaagattgaagtttgggaaggtgctatggtccctgcccttataatcacagtaggatcactagtccttccagacactcccaattccatgattgaaaggggtgatcgcgagaaggccaaggctcagcttcagagaattcgcggcatcgacaatgttgatgaagagttcaatgaccttgtggcagcaagtgaatcctctagccaagtggagcacccttggaggaacttgttgcaaagaaagtacagaccccacctcaccatggcagtgttgattccattcttccagcaactcactggaatcaatgtcatcatgttttacgcgccggtcctgttcagctccatcgggtttaaggatgatgctgctctaatgtcagctgtgatcaccggcgttgttaatgttgtcgcaacttgtgtctcaatttatggtgttgacaagtggggtaggagagcccttttccttgaaggtggagtccaaatgctcatttgccaggctgtagttgcagctgcaattggagcaaagtttggaactgatgggaacccaggtgatttgccaaagtggtatgcaattgttgtggttctcttcatttgcatttatgtatcagcatttgcctggtcatggggtcccctaggttggttggtgcctagtgagatctttcccttggagattcgttcggctgctcagagtatcaatgtgtcggtgaacatgcttttcactttcttgattgcacaagtcttcttgacaatgctttgccacatgaagttcggcttgttcctcttctttgccttcttcgtgttgatcatgacattcttcgtctacttcttcttgcccgaaacaaagggcattccaattgaagaaatggggcaggtttggcaggcacaccccttctggtccagattcgtggagcatgatgattatggcaatggtgttgagatgggaaagggagctattaaagaagtgtag

SEQ ID NO: 7721 - protein, 519 aa, Glycine max
MPAVGGISNGGGKEYPGSLTPFVTVTCIVAAMGGLIFGYDIGISGGVTSMDPFLLKFFPSVFRKKNSDKTVNQYCQYDSQTLTMFTSSLYLAALLSSLVASTVTRRFGRKLSMLFGGLLFLVGALINGFAQHVWMLIVGRILLGFGIGFANQSVPLYLSEMASYKYRGALNIGFQLPITLVFLVANVLNYFFGKIHGGWGWKIEVWEGAMVPALIITVGSLVLPDTPNSMIERGDREKAKAQLQRIRGIDNVDEEFNDLVAASESSSQVEHPWRNLLQRKYRPHLTMAVLIPFFQQLTGINVIMFYAPVLFSSIGFKDDAALMSAVITGVVNVVATCVSIYGVDKWGRRALFLEGGVQMLICQAVVAAAIGAKFGTDGNPGDLPKWYAIVVVLFICIYVSAFAWSWGPLGWLVPSEIFPLEIRSAAQSINVSVNMLFTFLIAQVFLTMLCHMKFGLFLFFAFFVLIMTFFVYFFLPETKGIPIEEMGQVWQAHPFWSRFVEHDDYGNGVEMGKGAIKEV

SEQ ID NO: 7722 - DNA, 1536 bp, Glycine max
  CDS (1)..(1536)
atggctggtggaggattgacaaatggaggtccaggcaaaagagctcatctctatgagcacaaattcactgcttattttgcctttacctgtgttgttggagctcttggtggttctctttttggttatgatcttggtgtttcaggtggggtgccttcaatggatgatttcctgaaggaattcttcccaaaggtttacagaaggaagcagatgcatctgcatgaaacagactattgtaaatatgacgaccaagtgctgacactgtttacatcatctctttatttctcagcacttgtcatgacattctttgcttccttcttgacaagaaagaagggaagaaaggccattatcattgtgggagcccttagcttcctggctggggctatcctcaatgccgcagccaagaacattgcaatgctaattattggcagagtccttcttggtggaggcattggatttggcaaccaagctgttccattgtatctttcggaaatggctccagctaagaaccgaggagcagtgaaccaactgtttcagttcacaacttgtgctggaatcttaattgcaaacctagtgaattactttactgaaaaaatccatccctatggatggaggatatctctgggtttggcaggtcttccagcatttgcaatgcttgttggaggtatttgttgtgctgagacaccaaacagccttgtggagcaaggaaggttggataaagcaaaacaagtattgcagagaattagaggtaccgagaacgttgaagccgaatttgaggatcttaaagaagccagtgaagaagcacaagctgttaagagcccgtttaggacactcctcaagaggaagtacaggccacaactgatcataggtgcattggggattccagcgttccagcagctaactggcaataactccatcctcttctatgcccctgtcatttttcagagcttgggctttggtgccaatgcttcactgttttcatcttttattaccaatggggctcttcttgttgccactgtcatctcaatgtttttggttgacaagtatggtagaagaaaattctttctggaagctggctttgaaatgatatgctgcatgattattacaggtgcagtcttggctgtgaactttgggcacggcaaagaaattgggaaaggagtgagtgcctttctggttgttgtgatcttcttgttcgttttggcatatgggagatcttggggtccccttgggtggttggttcccagtgagctcttcccattagagataagatcatctgcacagagtattgtggtctgtgtcaacatgatcttcactgcacttgttgctcaattgttcctcatgtcactttgccacctcaaatttgggatcttcttgctctttgcttccttaattatcttcatgagcttctttgtcttcttccttttgcccgaaaccaagaaagttccaattgaggagatttatcttctttttgagaatcattggttctggaggagatttgtaactgaccaagacccagagacatcaaaggggactgcttaa

SEQ ID NO: 7723 - protein, 511 aa, Glycine max
MAGGGLTNGGPGKRAHLYEHKFTAYFAFTCVVGALGGSLFGYDLGVSGGVPSMDDFLKEFFPKVYRRKQMHLHETDYCKYDDQVLTLFTSSLYFSALVMTFFASFLTRKKGRKAIIIVGALSFLAGAILNAAAKNIAMLIIGRVLLGGGIGFGNQAVPLYLSEMAPAKNRGAVNQLFQFTTCAGILIANLVNYFTEKIHPYGWRISLGLAGLPAFAMLVGGICCAETPNSLVEQGRLDKAKQVLQRIRGTENVEAEFEDLKEASEEAQAVKSPFRTLLKRKYRPQLIIGALGIPAFQQLTGNNSILFYAPVIFQSLGFGANASLFSSFITNGALLVATVISMFLVDKYGRRKFFLEAGFEMICCMIITGAVLAVNFGHGKEIGKGVSAFLVVVIFLFVLAYGRSWGPLGWLVPSELFPLEIRSSAQSIVVCVNMIFTALVAQLFLMSLCHLKFGIFLLFASLIIFMSFFVFFLLPETKKVPIEEIYLLFENHWFWRRFVTDQDPETSKGTA

SEQ ID NO: 7724 - DNA, 2856 bp, Homo sapiens (man)
  CDS (180)..(1658)
tagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggctgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcctttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgataagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaacatggttttgaaatgcttgtggattgagggtaggaggtttggatgggagtgagacagaagtaagtggggttgcaaccactgcaacggcttagacttcgactcaggatccagtcccttacacgtacctctcatcagtgtcctcttgctcaaaaatctgtttgatccctgttacccagagaatatatacattctttatcttgacattcaaggcatttctatcacatatttgatagttggtgttcaaaaaaacactagttttgtgccagccgtgatgctcaggcttgaaatcgcattattttgaatgtgaagggaa

SEQ ID NO: 7725 - protein, 492 aa, Homo sapiens (man)
MEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTAFRGALGTLHQLGIVVGILIAQVFGLDSIMGNKDLWPLLLSIIFIPALLQCIVLPFCPESPRFLLINRNEENRAKSVLKKLRGTADVTHDLQEMKEESRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAILMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 7726 - DNA, 2487 bp, Oryctolagus cuniculus (domestic rabbit)
  CDS (124)..(1602)
cggcgcgcaggcagcgagaggccgagcgacccaagtcggagtcagccgccgtcggagtctcgggatccgaatcgcagagcccgcccgccgacccagcactgccagaaccactagcgcagggccatggaacccagcagcaagaaggtgacgggccgcctcatgctggccgtgggaggagcagtgctcggctccctgcagtttggctacaacactggagtcatcaacgccccccagaaggtgatcgaggagttctacaaccagacgtggatccaccgctatggggagcgcatcttgcccaccacgctcaccacgctgtggtccctctcggtggccatcttctccgtcgggggaatgattggctccttctctgtgggcctcttcgttaaccgctttggccggcggaactcaatgctgatgatgaacctgctggccttcgtgtccgccgtgctcatgggcttctcaaagctggccaagtccttcgagatgctcatcctgggccgcttcatcattggcgtgtactgcggcctgaccacaggcttcgtgcccatgtacgtgggggaggtgtcgcctacagccctgcgcggggccctgggtaccctgcaccagctgggcatcgtcgtcggcatcctcatcgcgcaggtgttcggcctggactccatcatgggcaacgaggacctgtggcccctgctgctgagcgtcatcttcgtcccagccctgctgcagtgcatcgtgctgcccctgtgccccgagagcccccgcttcctgctcatcaaccgcaacgaggagaaccgggccaagagtgtgctgaagaagctgcgtgggaatgccgacgtgacccgggacctgcaggagatgaaggaggagagccggcagatgatgcgggagaagaaggtcaccatcctggagctcttccgctcacctgcctaccgccagcccatcctcagcgccgtggtgctgcagctgtcccagcagctgtccggcatcaacgccgtcttctattactccacgagcatcttcgagaaggcgggggtgcagcagcctgtgtacgccaccatcggctccggcatcgtcaacaccgccttcaccgtcgtatcgctgttcgtggtggagcgagccggccggcggaccctgcacctcatcggcctggcaggcatggcagcgtgtgctgtgctcatgaccatcgcgctggccctgctggagcagctgccctggatgtcctatctgagcatcgtggccatctttggcttcgtggccttctttgaagtgggccctggccccatcccgtggttcatcgtggctgagctcttcagccagggtcctcggccagcagctgttgccgtcgctggcttctccaactggacctcgaatttcattgtgggcatgtgcttccagtatgtggagcaactgtgcggcccctacgtgttcatcatcttcaccgtgctcctggttctgttcttcatcttcacctacttcaaagttcctgagactaaaggccggaccttcgatgagatcgcttccggcttccggcaggggggagccagccaaagcgacaagacgcccgaggagctcttccaccctctgggggctgattcccaagtgtgaggcgccccacactgcctgcccggcctgctcccagcagccccatggagctctctggaagacaggcttagctgggtgggacttccaaacctgacacatcgcagccgagccgggccggggcttctttcttcatccagcagcaatgtccacaagaacattcaggacttttcatggctccaggatttgaacaaaaccaagactgttgctcaaccctattcagacaagcagcaggttttataagttttttattattgattttgttattatttttttatcaccagagtctcctgtccccaccctccaggcttcactctgaatgcctcaacgcctgagcgtggggaccaagccctgtccagacacttgccttcttcgccaagctaatctgtagggctggacttctgaccaaggacacactaatcgaactacgaacttcaaggcttctactccgggaggtggctgtggccaccttccgcagcctggatctcctgccctggggtcaggctccgttagattcacccgcccctctcttcctactcaaaccactcagattaatctttccttgcctgagaccagttgggagcactggagagcagggaggagaggggaagggccagactgggctgccaggttctagtctcctttgcactgagggccagatgaccaccccgagagagagccccacgaggctgagaactcactgctccagaagacatggacactcctgccctgctgtgtatagatggaagatatttatatatattttttggttgtcaatattaaatacagacactaagttatagtatatctggacaaaccaacttgtaaatacaccaacacatccttctgtaacttacctaaacagatataaatggctggtttttagaaaaa

SEQ ID NO: 7727 - protein, 492 aa, Oryctolagus cuniculus (domestic rabbit)
MEPSSKKVTGRLMLAVGGAVLGSLQFGYNTGVINAPQKVIEEFYNQTWIHRYGERILPTTLTTLWSLSVAIFSVGGMIGSFSVGLFVNRFGRRNSMLMMNLLAFVSAVLMGFSKLAKSFEMLILGRFIIGVYCGLTTGFVPMYVGEVSPTALRGALGTLHQLGIVVGILIAQVFGLDSIMGNEDLWPLLLSVIFVPALLQCIVLPLCPESPRFLLINRNEENRAKSVLKKLRGNADVTRDLQEMKEESRQMMREKKVTILELFRSPAYRQPILSAVVLQLSQQLSGINAVFYYSTSIFEKAGVQQPVYATIGSGIVNTAFTVVSLFVVERAGRRTLHLIGLAGMAACAVLMTIALALLEQLPWMSYLSIVAIFGFVAFFEVGPGPIPWFIVAELFSQGPRPAAVAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 7728 - DNA, 3642 bp, Saccharomyces cerevisiae
  CDS (551)..(3205)
ttcagtctcaaaactttcagtacaaaaagtggcgtattggccttgtttttttcttattatgtcttatagtattatatttatatatttatgtacttatccttttatgtttaaacctaatcaagatcacaattagaactagcttaacattacttctcaaaaccaaccaatacctcttatatcttttttacagcctttcccttatgtttttaccatgtacacctcgagcggcaaatctccggggaaattttaaacttgccgcatcgcacattctaaagaacaaaaggaggaggaactgtcaattattctataatctggggaaattcagtcatactgagaaaaactagacaatagtcctatcctcggcaaattgcattgatagtacttacacatcgagagatcataggacagataagaagcattttattgaagaaaaacagagagagtcactataagttgacctcactatagaaattaaaacagaaaagttttactgaggacctttttaaacagaaggatatgcctttgttggcatagaaagaagaatttataaatggatcctaatagtaacagttctagcgaaacattacgccaagagaaacagggtttcctagacaaagctcttcagagggtgaagggcatagcactgcgacgaaacaatagtaacaaagatcatacaacagatgatacgacaggtagcatacgaacccctacgagcttgcagcggcaaaattctgacaggcaatctaatatgacatccgtgtttacggatgacatttctaccatagacgacaactcaattttattttcagagcctcctcagaaacaatctatgatgatgtctatatgcgtaggtgtttttgttgcagttggcggatttttatttggttatgatacaggtctgatcaacagtattacatctatgaactatgtgaagtcacacgtagcacctaatcacgattcatttaccgcccaacaaatgtccattttggtgtcatttttgtcattgggaactttttttggggctttaactgcaccatttatatctgattcgtatggcaggaagcctactatcattttcagtacaattttcatcttctctatcggaaattctttacaggtaggtgctggaggaatcacattattgattgtgggaagggtcatttcaggtatcggtataggcgcaatttcagcggttgttccattataccaagcagaagctacacataaatcattaagaggtgctattatttctacttaccaatgggccattacctggggcttgctcgtgtcaagtgcagtgtcgcaagggacacacgcaagaaacgacgcatcttcgtatcggattcccatagggttgcaatatgtctggtcgtcatttctcgctatcgggatgttctttctccctgagagtccacgctattacgttttgaaagacaagctagatgaagcagctaaatctttatcgtttttaagaggtgtaccagtccatgattctgggttactggaagaactagttgaaataaaggcaacatatgattacgaggcatcttttggttcttcgaacttcattgattgttttatttcaagtaaaagtagaccaaagcaaactctaaggatgtttacgggaattgcccttcaagcatttcaacaattttcaggtatcaactttatattttactacggtgtcaatttcttcaataagacaggagtcagtaatagttatctggtttcatttataacctatgctgttaatgttgtctttaatgttcctggtttgttttttgtggaattttttggtagacgtaaggtgctggttgttgggggtgttatcatgactatagccaactttattgtggccattgttgggtgttccttaaagactgtagcggccgcaaaagttatgatagcatttatatgtctattcatagctgccttttctgctacatggggtggtgttgtttgggttatttcagcagaactgtacccattgggtgtgagatctaaatgtacggctatatgcgctgctgctaactggcttgtaaactttatttgtgctttaattaccccttatattgtagatactgggtcgcatacatcatcattaggtgcaaaaatattcttcatttggggctccttaaatgcgatgggggtgatagttgtttacttgaccgtttatgaaacgaagggtttgacattagaagagattgatgaattatatattaagtcatccactggtgtcgtgtcaccaaaatttaataaagatattagggaacgcgcacttaaattccaatacgatcctttgcaaagattagaagacggaaagaacacttttgttgctaaaagaaataattttgacgatgaaacaccaagaaatgattttcgaaatacgatatcgggcgaaatagatcatagtcccaatcaaaaagaagttcattctatcccagaacgtgttgatattcctactagtacagaaattcttgaaagcccgaacaaaagtagtggtatgacagtccctgtgtcaccttctctgcaagacgttccaatcccgcaaacaacagagcctgctgaaattcgaaccaaatatgtggacctaggaaatgggcttggtcttaatacgtataatagagggcctccctcactctcaagcgactcaagcgaagattacacagaagatgaaataggcgggccctcatctcaaggcgaccaaagtaatagaagtactatgaatgatattaatgattatatggcacgtctcattcacagtacttctactgcaagtaacacgacagataagttctccggtaaccaaagtacccttcgttaccacacggcttcctcacattcggatacaactgaagaggacagcaatttgatggacctgggaaacgggcttgccttgaatgcttataacagaggtccaccttcaattttaatgaattccagtgatgaagaggcaaatggtggtgagacgtctgataatttgaacacagctcaagacttggctggtatgaaggaacgaatggcgcagtttgcgcagagctatattgacaagagaggcggtctggaacctgaaactcaatctaatattttgagcacttctctctccgtgatggctgacactaatgaacataataatgaaatcctccactcaagcgaagaaaacgccactaatcaacctgtaaatgaaaataatgatttgaaataattaatttaatgttattcgatgtattaattaagcggacgtgcattataattttaatcatgtgaaagaaataattgtaacttgagatactactcaacttttatagatacacaatgtttatcttgacacacattcaattacattacttgatttaatgcctttccaaaattatgatcttttcttctataacacttttggatacttagccgccgacggataccatcttcggtcaacgtcggaagtcattataaacgaaaaggtttcccaatagaaaagtcctgcaggagccacgtataacactggcttgaattatcaacaactctcgaaggcgctggaagagaatttttacgcaagttagtattcgcataacattagttggcaaattacacaattttttgatacaatatatatacatatattttccccattgtttttcttag

SEQ ID NO: 7729 - protein, 884 aa, Saccharomyces cerevisiae; identical to SEQ ID NO: 168

SEQ ID NO: 7730 - DNA, 1774 bp, Mus musculus (house mouse)
  CDS (80)..(1561)
cgaggaacacttgctgccgagaacattggctggatacctctagatctaccctttaagacttgagaactaggttgggaccatggggacaacgaaggtgaccccatctctggtgttcgccgtgactgttgccacgatcggctctttccagtttggctacaacactggagtcatcaatgcacctgagacaatcctaaaggactttcttaactacactttggaagagcggttagaagacctaccaagtgagggactgctgactgccctctggtccttatgtgtggccatcttctctgttggtggcatgattggctctttttctgttggactctttgtcaaccgctttggcagacgcaactctatgcttctagtcaacttgctggccatcattgcgggctgccttatgggattcgccaagatagcggagtctgttgaaatgctgatcctgggccgcttactcattggcattttctgtggcctgtgcacgggctttgtgcctatgtacattggagaggtgtctcccactgcccttcggggtgcatttggcacactaaaccagctgggcatcgttgttgggattctggtagctcagatctttggtttggactttattctgggctctgaagaactgtggcctgggctccttggcttaaccatcattccagctatcctgcaaagcgcagcccttccattttgccctgagagtccaagattcttgctcattaacaaaaaggaggaagaccaagctacagagatcctgcagcgcttgtggggcacctcggacgtggtccaggagatccaggagatgaaggatgagagtgttcggatgtcacaggagaagcaggtgactgtgctggagctcttcaggtcacccaactacgtccagccgcttctcatctccattgtcctccagctgtctcagcagctctctgggatcaatgctgtgttctattactcaacaggaatcttcaaggacgcgggtgtccaggaaccgatctatgccacgattggagcaggcgtggtcaatactatcttcactgtagtttctctgttcctggtggagagggcagggaggagaaccctgcatatgataggcctgggaggcatggctgtttgctccgttttcatgacgatttcgctgttactaaaggatgactatgaagccatgagttttgtctgtattgtggctatcttgatctacgtagccttctttgagattggacctggccccattccctggtttattgtggctgagctcttcagccagggcccccgcccagctgccattgcggtggctggctgttgtaactggacctccaactttctggtcggaatgctcttcccctcagctgcagcctacttaggagcctacgtttttatcatcttcgctgccttcctcatcttcttcctaatcttcaccttcttcaaagtcccggagaccaaaggcaggactttcgaggacattgcccgggccttcgaggggcaggcgcactctggaaaaggccctgccggtgtggagttgaacagcatgcagccggtcaaggagacccctggcaacgcctgagccgggagcacctccttcacctccctccactgtggaaagccacctccccttaagtggggagacctcatcaggatgaaccaggactgcttctgagtgctgctattctcaccccacacactccatgaaaactcagctgcacccaatgctggggttgaccagatcgccaatggcttttaagtgtttgatttggggatacttccttgtaatcaggaa

SEQ ID NO: 7731 - protein, 493 aa, Mus musculus (house mouse)
MGTTKVTPSLVFAVTVATIGSFQFGYNTGVINAPETILKDFLNYTLEERLEDLPSEGLLTALWSLCVAIFSVGGMIGSFSVGLFVNRFGRRNSMLLVNLLAIIAGCLMGFAKIAESVEMLILGRLLIGIFCGLCTGFVPMYIGEVSPTALRGAFGTLNQLGIVVGILVAQIFGLDFILGSEELWPGLLGLTIIPAILQSAALPFCPESPRFLLINKKEEDQATEILQRLWGTSDVVQEIQEMKDESVRMSQEKQVTVLELFRSPNYVQPLLISIVLQLSQQLSGINAVFYYSTGIFKDAGVQEPIYATIGAGVVNTIFTVVSLFLVERAGRRTLHMIGLGGMAVCSVFMTISLLLKDDYEAMSFVCIVAILIYVAFFEIGPGPIPWFIVAELFSQGPRPAAIAVAGCCNWTSNFLVGMLFPSAAAYLGAYVFIIFAAFLIFFLIFTFFKVPETKGRTFEDIARAFEGQAHSGKGPAGVELNSMQPVKETPGNA

SEQ ID NO: 7732 - DNA, 2798 bp, Leishmania donovani
  CDS (676)..(2319)
cccgggtagttccggacaaactacacggacgtgccaaaggaagagaggaagagaggcaacgaagagggagagaaggggtggggagagcgggacaaccccgacgctctcctccacctcactctcatttcatggagcgggtcttgtgaaactcctggctaggtttaccgcattgtgcagaggcatctcgcacgctgctaccgctgctgctgtccctcctcccgctgattctgcgctcacccgtgttcttcccacttttttctctcttctcgctccacttgcaccgacgtcatgctttccaccttttctcgaaacaccatcggtgccgtttctatacatacacgcctctgccacactcgctatcgctaccacatacacgcacatgctggcgtacccgtgcagctaagaagaaacaacagaaccaagcacagcacagcacacaacacgagcaacagtgtccttctctcaggaagtttgtacagacgcccactcccataacacgcatattgaatacgcaaccagagcacgcacacgcatatatatatatatatatatatataactgtaaggcaaatatatcgcacgctcacgcactagcacgtactgtgccgcgaacgaaagccaaacaacaacaaaaaggaagcagcctgcggagcacaagctcaaaacaaagccgacgatgcgagcatctgtcatgctatgtgccgccttgggcggttttctcttcggctatgacacgggcgtcatcaatgctgccctgttccagatgaaggaccacttcggcttcagcgagcattcgtggcagtacgccctcatcgtcgccattgccatcgctggtgccttcgttggcgcctttatttctggcttcatctctgccgcctttggtcgccgtccatgcatcgccgtggcggacgccctgttcgttatcggctctgtgcttatgggcgctgccccaaatgtggaagtggtgctcgtgtcgcgcgtcatcgtcggcttggctatcggtatcagctctgccaccattccagtgtacctggcggaagtaacatcgccgaagcaccgtggcgccaccatcgttctcaacaacctgtttctgacaggtggccagtttgttgcggccggtttcaccgcgatcatggtcgtcttcacgagcaagaacatcggttggcgtgtggcgatcggcataggtgcgctgccggctgtcgttcaggcgttctgcctcctctttttcctgccggagagcccacgctggcttctctcgaagggccacgcggaccgcgccaaggcggtagcggacaagttcgaggtggacctctgcgagttccaggagggcgatgagctgccgtccgtcagaatcgactatcgcccgctgatggcgcgcgacatgcgcttccgcgtggtgctcagctctgggctgcagatcattcagcagttttcgggtatcaacaccatcatgtactacagctctgtgatcctgtacgacgccggcttccgagacgccatcatgccagtcgttctgtccatcccgctcgccttcatgaatgccctcttcacggcggtagccatcttcacggtcgaccgctttggtcgccgccgcatgctgctcatctctgtctttggctgccttgtgctgctggtggtgattgccataattggcttcttcatcggcacgcgcatctcgtactccgttggtggcgggcttttcttggcgctgctcgccgtctttctcgccttgtacgcgcctggcattggctgcatcccgtgggtgatcatgggcgagatctttcctacgcacctgcggacgtcggcggcatccgtcgcgaccatggccaactggggggccaacgtactcgtgtcgcaggtgtttccgatcctgatgggcgccatcggcgtcggcggcaccttcacgatcatctccggtctcatggccctcggctgcatatttgtctacttcttcgccgtggagacgaaggggctcacgctggagcagatcgacaacatgttccgcaagcgcgccggcctgccgccgcgcttccacgaggaaggcgagagcggcgaaagcggtgccggttaccgcgaagacggcgacctcggccgcctggcgacggaggatgtctgtgacctgtcctcgttgggcaaccgggttgtgtcctttgccaaagcggaggacgccttcacggaggtggcaatgcccgatcgccacgccgtgtccaacaagtttgaagagagagcgacgagctcttcctcagatccccagtcgctcgaaaaccaggacgaggtgcggcaagcagccatcaaagcagctccgcacgagcccaagtagagaccgtaaaccccactccctccctccctccctacaactgcatcttccctaccgactccatataaagtccatgcacgcctatatgcgagtcgctgaggtggcgagatgagcggacggaggaggaacagagaataaaagggaaaaggcttctggcacatgtagtctggcgcacctgtgcagcacgcatcagaacgaaaaaagaaagacagcccgcgccgctcggggatgatctggtgcgcacctcttcctctatccattgtgttcgcgtgtatgtttctgtgccttgtacgtctcctgggggagtcatcgagactttggcccagctctctgtctacgcttcaaaggatgtgttgtcttcatccagctcgtatgcacgtgtatgagaatgttttctttttttctcttccagcctgcatgcgagtctgaggtgcctgcgtgcgtgcactctttacttcgccaaaaacacatctgtgaagctt

SEQ ID NO: 7733 - protein, 547 aa, Leishmania donovani
MRASVMLCAALGGFLFGYDTGVINAALFQMKDHFGFSEHSWQYALIVAIAIAGAFVGAFISGFISAAFGRRPCIAVADALFVIGSVLMGAAPNVEVVLVSRVIVGLAIGISSATIPVYLAEVTSPKHRGATIVLNNLFLTGGQFVAAGFTAIMVVFTSKNIGWRVAIGIGALPAVVQAFCLLFFLPESPRWLLSKGHADRAKAVADKFEVDLCEFQEGDELPSVRIDYRPLMARDMRFRVVLSSGLQIIQQFSGINTIMYYSSVILYDAGFRDAIMPVVLSIPLAFMNALFTAVAIFTVDRFGRRRMLLISVFGCLVLLVVIAIIGFFIGTRISYSVGGGLFLALLAVFLALYAPGIGCIPWVIMGEIFPTHLRTSAASVATMANWGANVLVSQVFPILMGAIGVGGTFTIISGLMALGCIFVYFFAVETKGLTLEQIDNMFRKRAGLPPRFHEEGESGESGAGYREDGDLGRLATEDVCDLSSLGNRVVSFAKAEDAFTEVAMPDRHAVSNKFEERATSSSSDPQSLENQDEVRQAAIKAAPHEPK

SEQ ID NO: 7734 - DNA, 1536 bp, Arabidopsis thaliana (mouse-ear cress)
  CDS (1)..(1536)
atgagttcctcaggagaagaacgaggtgttgttgttgccgagtccgagccgccaagagggaatagaagccgatttgcttttgcttgtgcaatcttagcctccatgacttctatcatccttggttatgatattggagtgatgagtggagctgcaattttcataaaagacgatttgaagctgtcggacgtacaacttgagattcttatgggaattctaaatatctattctctgatcggttcaggagcagctggaagaacttccgattggatcggaagacgatataccatagtgttggcaggattcttcttcttttgtggagccctactaatgggttttgccactaactatcctttcattatggtcggccgttttgtagccggtatcggtgtcggttacgctatgatgattgcgcctgtttataccacggaagtcgctccagcctcttctcgaggcttccttagctctttccctgagatatttatcaacattggtatactattgggatacgtatccaattacttcttcgccaagcttccagagcacattggatggaggttcatgttaggtattggagctgtgccctcagtgtttctagccattggagtgttggcaatgcccgagtctccacggtggctcgtcatgcagggtcgtctaggggacgcttttaaagtccttgacaaaacctcaaacaccaaagaagaagccatctcaaggctcaatgacatcaaacgcgcagttggaatccccgatgatatgacagacgatgttatagtcgttccgaataaaaagagcgctggaaaaggcgtgtggaaggaccttctcgttcgaccaaccccgtccgttcgacacatcctcatagcatgccttggtatccatttctcccagcaagcctccggaattgatgctgtcgtgctttactctccgaccatcttctcaagggctggactgaagtccaagaatgaccagctcttggctacggtcgctgtcggagttgtcaagactctcttcatcgtagtaggaacttgtttggtggaccggtttggacgtcgtgccttgttgcttacgagtatgggtggaatgtttttttccttgaccgcccttggaactagtctcacggtgatcgacaggaaccccgggcaaacactcaagtgggctatagggctcgccgttacgacggtgatgacttttgtcgcaacattctcattaggtgcaggccccgtgacgtgggtctacgcctcagagatattccccgtgaggctaagagcgcaaggagcaagtttgggagtgatgttgaatagactaatgagtggtattataggaatgacattcctatctctttctaagggtctcaccatcggtggtgcattccttctcttcgccggagttgcggttgccgcgtgggtcttcttcttcactttcctcccggagacacgtggtgtgcctttagaagaaatagagagtctcttcgggagctacagcgcaaacaaaaagaacaatgttatgagcaaagggaaacaagtagttgatgaacaatga

SEQ ID NO: 7735 - protein, 511 aa, Arabidopsis thaliana (mouse-ear cress)
MSSSGEERGVVVAESEPPRGNRSRFAFACAILASMTSIILGYDIGVMSGAAIFIKDDLKLSDVQLEILMGILNIYSLIGSGAAGRTSDWIGRRYTIVLAGFFFFCGALLMGFATNYPFIMVGRFVAGIGVGYAMMIAPVYTTEVAPASSRGFLSSFPEIFINIGILLGYVSNYFFAKLPEHIGWRFMLGIGAVPSVFLAIGVLAMPESPRWLVMQGRLGDAFKVLDKTSNTKEEAISRLNDIKRAVGIPDDMTDDVIVVPNKKSAGKGVWKDLLVRPTPSVRHILIACLGIHFSQQASGIDAVVLYSPTIFSRAGLKSKNDQLLATVAVGVVKTLFIVVGTCLVDRFGRRALLLTSMGGMFFSLTALGTSLTVIDRNPGQTLKWAIGLAVTTVMTFVATFSLGAGPVTWVYASEIFPVRLRAQGASLGVMLNRLMSGIIGMTFLSLSKGLTIGGAFLLFAGVAVAAWVFFFTFLPETRGVPLEEIESLFGSYSANKKNNVMSKGKQVVDEQ

SEQ ID NO: 7736 - DNA, 1482 bp, Arabidopsis thaliana (mouse-ear cress)
  CDS (1)..(1482)
atggccgatcaaatctccggcgagaagccggccggagttaatagattcgctcttcaatgtgctatcgtcgcctccatcgtctccatcatctttggttacgatactggtgttatgagtggagcgatggtgtttatagaagaagatttgaagacaaacgacgttcaaatagaagttctcactggaattctcaacctttgtgcccttgtcggatcattgctcgccggaagaacgtcggacataatcggacggcgttacacaatcgtcttggcctcaatactattcatgttaggctcaatattgatgggttggggtccgaattatccggttctcctatccggtagatgcaccgctggactcggagtcggttttgctctgatggttgctccggtttactctgccgagatcgcaactgcttcacatagaggactcttagcttctcttcctcacctttgtatcagtatagggattttactaggttatatcgtgaattacttcttctccaagttacctatgcatatcggttggagactcatgctcggtatagccgcggttccgtccctagtgctagcgttcgggatcttgaaaatgccggaatctccacggtggttgattatgcaaggccgtcttaaggaaggcaaggagatattggaattggtatctaattcccctgaagaagcagaactccgctttcaagacatcaaagctgctgcgggaatcgacccgaaatgcgtagacgatgttgtgaaaatggagggtaagaagactcatggtgaaggagtgtggaaagagctcattctaagaccaactcctgcagtgagacgtgttcttttaactgctcttgggattcatttcttccaacacgcctccggaatcgaagcagtgcttttatacggtccgaggatctttaagaaagcaggaatcacgactaaagacaagcttttcttggttactatcggtgtcggaatcatgaaaacgacgtttattttcactgcgactttattgttagacaaggtaggtcgaaggaagcttttgttgaccagcgttggaggaatggtcattgcgttgacaatgttgggatttgggcttacaatggcccaaaatgctggcgggaaattagcgtgggctttagtactgagcatagttgcggcttatagtttcgtggcgtttttctctattgggctcggcccaataacttgggtctacagttctgaggttttcccgttgaagcttagggcacaaggagcgagtctcggcgttgcggtgaacagagtaatgaacgccaccgtgtcgatgtcgtttttgtcgttgactagtgcgataaccaccggtggagctttctttatgttcgccggagttgcggcagtggcgtggaatttcttcttcttcctcttgccggagacgaaaggaaaatcacttgaagaaatcgaagcgctttttcaaagagacggtgataaagtacgcggcgaaaacggtgcagcttag

SEQ ID NO: 7737 - protein, 493 aa, Arabidopsis thaliana (mouse-ear cress); identical to SEQ ID NO: 172

SEQ ID NO: 7738 - DNA, 1395 bp, Salmonella enterica subsp. enterica serovar Typhi
  CDS (1)..(1395)
atgcctgacaataaaaaacaagggcgttccaacaaggccatgacattttttgtctgctttcttgcagccctggcaggattactttttggcctggatatcggcgttatcgccggtgctttacccttcattaccgacgagtttcagattaccgcacacactcaggaatgggtggtcagctccatgatgtttggcgcggccgtcggcgctgtcggcagcggctggctctcctttaagctgggtcgtaaaaaaagcctgatgatcggcgctatcctgttcgtcgccggttcgctgttctccgctgcggcgcctaacgttgaagtcctgattatttctcgcgtgctgctgggtctggccgtcggcgtcgcttcctacactgcaccgttgtacctgtccgagatcgcgccggaaaaaattcgcggcagtatgatctcaatgtaccaactcatgatcaccatcgggattctgggcgcttatctgtccgataccgcgttcagctacagcggcgcatggcgctggatgctcggcgtgatcatcatcccggctattctgctgctgatcggcgtcttcttcctgccggacagcccgcgctggtttgcggcgaaacgccgtttccatgatgctgaacgcgtcctgttgcgcctgcgtgacaccagtgcggaagcaaaacgtgagctcgatgaaattcgcgaaagtttgcaggttaaacagagcggttgggcgctgttcaaagagaacagcaacttccgccgcgccgtgtttcttggcattttgttgcaggtcatgcagcaatttaccgggatgaacgtcatcatgtattacgcgccgaaaatcttcgaactggcggggtacacgaataccacggagcagatgtggggcaccgttattgttggtctgactaacgtgctggcaaccttcatcgctatcggcctggttgaccgctggggccgcaagccgaccctgacgctgggcttcctggtcatggcgattggtatggggattctgggtacgatgatgcacatcggcatccattcgccgtctgcgcaatacttcgctatcgctatgctgctgatgttcatcattggatttgcgatgagcgctggtccgctgatttgggtactgtgctccgaaatccagccgctgaaaggccgcgatttcggcatcacctgctccaccgcgaccaactggatcgccaatatgatcgtcggcgcaacgttcctgaccatgctgaacaatctgggtaacgccaacaccttctgggtctatgcgggcctgaacgtactgtttatcctgctgaccctgtggctggtgccggaaaccaaacacgtttcgctggaacacattgaacgtaacctgatgaaaggtcgtaaactgcgcgaaatcggcgcccacgactaa

SEQ ID NO: 7739 - protein, 464 aa, Salmonella enterica subsp. enterica serovar Typhi
MPDNKKQGRSNKAMTFFVCFLAALAGLLFGLDIGVIAGALPFITDEFQITAHTQEWVVSSMMFGAAVGAVGSGWLSFKLGRKKSLMIGAILFVAGSLFSAAAPNVEVLIISRVLLGLAVGVASYTAPLYLSEIAPEKIRGSMISMYQLMITIGILGAYLSDTAFSYSGAWRWMLGVIIIPAILLLIGVFFLPDSPRWFAAKRRFHDAERVLLRLRDTSAEAKRELDEIRESLQVKQSGWALFKENSNFRRAVFLGILLQVMQQFTGMNVIMYYAPKIFELAGYTNTTEQMWGTVIVGLTNVLATFIAIGLVDRWGRKPTLTLGFLVMAIGMGILGTMMHIGIHSPSAQYFAIAMLLMFIIGFAMSAGPLIWVLCSEIQPLKGRDFGITCSTATNWIANMIVGATFLTMLNNLGNANTFWVYAGLNVLFILLTLWLVPETKHVSLEHIERNLMKGRKLREIGAHD

SEQ ID NO: 7740 - DNA, 2568 bp, Saccharomyces cerevisiae
  CDS (461)..(2299)
ctcgaggagaacttctagtatattctgtatacctaatattatagcctttatcaacaatggaatcccaacaattatctcaacattcacccatttctcaccttcagctcaaatcctcatcccggaaccttttttcttatttgttccctcttctactacaagagctttcaaattgtagtcaaaaacccgctttactaaaaaaacatcgccaaaaaaatttccaaaatcgctcgtcttgccactaaaagtatgcaaaatattatgtgaagcaaagttatttcgtgtcttccgcctaacagaacgtaagcagttgaccatactttagtatagagtacgaaaaaacacaaagaataccttaataaaataaacattgtcgttcgctaggaaaacggtaacgaaaacaaaaaactaaaagaagaaaagaggcaggacgcagtaaaagcaagaaaactgcttttttttcatggctgaaatgaagaattcgacagctgctagttccagatggacgaagagtcgtctctcccatttctttccctcgtacactaatagcagtggtatgggggccgcctcaactgatcaatcttctacgcagggagaagaactgcaccataggaagcactgtgaagaagacaatgatggtcaaaaaccgaaaaagtctcccgtatccacctctacaatgcaaataaaatctagacaggatgaggacgaggatgacggtcgaattgtcattaaaccagttaacgatgaagatgatacatcagtgattataactttcaatcagtcaatatccccttttattattacattgacattcgttgcgtccatttctgggttcatgtttggttatgatactggttacatatcgagtgcgctaatttctatcaatagagatttagacaacaaagttttaacttatggagaaaaagaattaattacggccgccacatcattgggcgctttgattacaagtgtgggcgctggtactgctgctgatgtgtttggaagaagaccatgtttaatgttctccaatctgatgtttttgatcggagcaattttacaaattaccgcgcacaagttttggcaaatggcggccggtagactgattatgggtttcggtgtcggtattggttctttgatttctcctctttttattagtgaaattgctcctaagatgatcaggggtaggttaaccgttataaattccctatggctgacaggtggtcaattgattgcttacggttgtggtgcgggcctgaaccacgtcaaaaacggttggagaatcttagttggtttgtccttgatacctactgttttgcagttttcttttttctgttttttgccggatacaccaagatactacgtaatgaaaggcgatttaaagagagcaaaaatggttctcaaacgaagttacgtaaacactgaagatgaaataattgatcaaaaagttgaagaattatctagcttaaatcaatcgataccaggaaaaaatccaataacaaaattctggaatatggtcaaggaattgcacactgtgccttcaaatttcagagctttgattattggttgtggtctacaagccattcaacaattcacaggttggaattccttaatgtatttctccggtacaatatttgaaactgttggattcaaaaattcttctgccgtttctattattgtctcaggtactaattttgtgttcacattaatagcatttttctgtattgataaaatcggccgtaggtacattttactgattggactacctggtatgactgtggcgctggttatatgtgctatagcgttccatttcctaggtattaagtttaacggtgctgatgcagtagtggcatctgatggattttcatcttggggcattgtcattatcgtatttattattgtgtatgcagccttttatgccctcggtatcggcactgttccatggcaacaatcggaattatttccacaaaacgtcagaggtgtagggacatcctacgctactgccaccaattgggcaggttctttagtcattgcgtctacgttcttgactatgttacaaaatattacaccaacgggtacattttcattctttgccggtgtagcatgtttatcaaccattttttgttacttttgttatccagaactatcaggattggagttagaggaagttcaaacaattttaaaggacggattcaatatcaaagcctctaaagctctagctaaaaagaggaaacaacaggtggccgaaggtgctgcccatcataaactcaaattcgaacctacacaggaaattgtagaaagttagactgctacaccaacaaaaaataaaagataaagaacaaaaaagaaggaagaaagctataaaagggagacaattcatttcatctaatcttaaaagtttttatttaaatatataagtaagagcgaagtatttaaaaataaaaattcataaaagttgagcttgatgaaagttatatcttttcgagcggtatgtttctttcgtgtaaaattcttcttaaagtatctaacttctcctcatctttcaagtttcctttaactacaactttttggatc

SEQ ID NO: 7741 - protein, 612 aa, Saccharomyces cerevisiae
MAEMKNSTAASSRWTKSRLSHFFPSYTNSSGMGAASTDQSSTQGEELHHRKHCEEDNDGQKPKKSPVSTSTMQIKSRQDEDEDDGRIVIKPVNDEDDTSVIITFNQSISPFIITLTFVASISGFMFGYDTGYISSALISINRDLDNKVLTYGEKELITAATSLGALITSVGAGTAADVFGRRPCLMFSNLMFLIGAILQITAHKFWQMAAGRLIMGFGVGIGSLISPLFISEIAPKMIRGRLTVINSLWLTGGQLIAYGCGAGLNHVKNGWRILVGLSLIPTVLQFSFFCFLPDTPRYYVMKGDLKRAKMVLKRSYVNTEDEIIDQKVEELSSLNQSIPGKNPITKFWNMVKELHTVPSNFRALIIGCGLQAIQQFTGWNSLMYFSGTIFETVGFKNSSAVSIIVSGTNFVFTLIAFFCIDKIGRRYILLIGLPGMTVALVICAIAFHFLGIKFNGADAVVASDGFSSWGIVIIVFIIVYAAFYALGIGTVPWQQSELFPQNVRGVGTSYATATNWAGSLVIASTFLTMLQNITPTGTFSFFAGVACLSTIFCYFCYPELSGLELEEVQTILKDGFNIKASKALAKKRKQQVAEGAAHHKLKFEPTQEIVES

SEQ ID NO: 7742 - DNA, 1449 bp, Bacillus subtilis; identical to SEQ ID NO: 173
  CDS (1)..(1449)

SEQ ID NO: 7743 - protein, 482 aa, Bacillus subtilis; identical to SEQ ID NO: 174

SEQ ID NO: 7744 - DNA, 1644 bp, Arabidopsis thaliana (mouse-ear cress); identical to SEQ ID NO: 175
  CDS (1)..(1644)

SEQ ID NO: 7745 - protein, 547 aa, Arabidopsis thaliana (mouse-ear cress); identical to SEQ ID NO: 176

SEQ ID NO: 7746 - DNA, 1560 bp, Caulobacter crescentus
  CDS (1)..(1560)
atggtcgtcagaaccaccgcttgcgcgctgataccggtaacactaatgtcgccggcaaccaaaggtccgacaaggaccagtagggcatcaacgggccggtacggccccatggggaggacacctgtggcttcagtatccaacgccggtcccagcgccggcatgagcgcggacggcgggaaggtcaacatgaccttcgtcgccgcgatcgtcgccgtcgccacgatcggcggcttcatgttcggctacgacagcggcgtcatcaacggcacgcaagagggcctggaaagcgccttcaatctcagcaagctgggcaccggcctgaatgtcggcgccatcctgatcggctgcgccatcggcgccttcgccgccggccgcctggccgacgtgtggggccgccgcacggtgatgatcatctcggccctgctgttcgtgatcagcgccatcggcaccggcgcggccgagagctcgatcgtgttcatcatcttccgcctgatcggcggtctgggcgtcggcgccgccagcgtgctgtgcccggtctacatctcggaagtcacgcccgcgaacatccgcggccgcctgtcgtccgtgcagcagatcatgatcatcaccggcctgaccggcgccttcgtggccaactacgccctggcccacaccgccggcagctcgacggccgagttctggctgggcctgcccgcctggcgctggatgttctggatgcagatcattcccgccggcgtgttcttcctctgcctgctgggcattcccgaaagcccccgctacctcgtggccaagggcaaggacgcccaggccgaagcgatcctctcgcgcctgttcggcgcgggccagggcgccaagaaggtcgaggaaatccgcgcctcgctgtcggccgatcacaagcccacgttctcggaccttctggatccgacgaccaagaagctgcgcgtcatcctgtgggcgggcctcgtcttggccgtgttccagcagctggtgggcatcaacatcgtcttctactacggctcggtgctgtggcagtcggtgggcttcaccgaggacgacagcctgaagatcaacatcctgtcgggcacgctgtcgatcctggcctgtctgctggccatcggcctgatcgacaagatcggccgcaagccgctgctgctgatcggttcggccggcatggccgtgacgcttggcgtgctgacctggtgcttctcgaccgccaccacggtcaacggcgccctgaccctgggcgaccagatcggcctgaccgcccttatcgccgccaacctctacgtgatcttcttcaacctctcgtggggtccggtcatgtgggtgatgctgggcgagatgttccccaaccagatgcgcggctcggccctggccgtctgcggcttcgcccagtggatcgccaacttcgccatctcggtcagcttcccggccctggccgcggccagcctgccgatgacctacggcttctatgcgctgagcgctgtcgtctcgttcttcctggtccagaagctggtccacgaaacgcgcggcaaggaactggaagcgatgcaggggtga

SEQ ID NO: 7747 - protein, 519 aa, Caulobacter crescentus
MVVRTTACALIPVTLMSPATKGPTRTSRASTGRYGPMGRTPVASVSNAGPSAGMSADGGKVNMTFVAAIVAVATIGGFMFGYDSGVINGTQEGLESAFNLSKLGTGLNVGAILIGCAIGAFAAGRLADVWGRRTVMIISALLFVISAIGTGAAESSIVFIIFRLIGGLGVGAASVLCPVYISEVTPANIRGRLSSVQQIMIITGLTGAFVANYALAHTAGSSTAEFWLGLPAWRWMFWMQIIPAGVFFLCLLGIPESPRYLVAKGKDAQAEAILSRLFGAGQGAKKVEEIRASLSADHKPTFSDLLDPTTKKLRVILWAGLVLAVFQQLVGINIVFYYGSVLWQSVGFTEDDSLKINILSGTLSILACLLAIGLIDKIGRKPLLLIGSAGMAVTLGVLTWCFSTATTVNGALTLGDQIGLTALIAANLYVIFFNLSWGPVMWVMLGEMFPNQMRGSALAVCGFAQWIANFAISVSFPALAAASLPMTYGFYALSAVVSFFLVQKLVHETRGKELEAMQG

SEQ ID NO: 7748 - DNA, 1386 bp, Bacillus subtilis
  CDS (1)..(1386)
atgaagaaagacacaaggaaatatatgatctactttttcggcgctttagggggactgctatatggttacgatacaggtgttatctccggagcactcctgtttatcaataacgatattcctttaacgacattgacagaaggattggttgtcagcatgctgctccttggcgcgattttcggttctgccttgagcggcacatgctcagaccgctggggcaggagaaaggttgtatttgtcctttccatcatttttattatcggtgcgctcgcttgcgcattttctcaaacaatcggcatgctgattgcatctagggtgatactcgggttggccgtcggcggttcaacggcacttgtgcccgtgtatctttccgaaatggcaccgacgaaaattcgcgggacactcggcacaatgaacaacttaatgattgtcaccgggattttgctcgcctatatcgttaactacctgttcacaccgtttgaagcgtggcgctggatggtcggtctggctgcagtgcctgccgtgcttctattaatcggcatcgccttcatgccggaatcgccaagatggctcgtgaagcgcggcagcgaagaagaagcgagacgcatcatgaacatcactcatgaccccaaagacatcgaaatggaattggcagagatgaagcaaggggaagcggagaaaaaagaaacgacacttggcgtgctgaaagccaagtggattcgccctatgcttctgattggcgtcggccttgccattttccagcaggcagtcggcattaacacggtcatctactacgcgccaaccatttttacgaaggccggtcttggcacatcagcttcggcgctcggcacaatgggaatcggcatcctcaacgtcatcatgtgtatcactgccatgatcttaattgaccgtgtcggccgcaaaaaacttctgatctggggaagtgtcggcatcacactgagccttgctgctttatcaggcgtgctcctgacactggggctttccgcatcaacagcgtggatgacagtagtctttctcggtgtctatatcgtcttttaccaggcgacatggggtccggtagtgtgggtgctcatgcctgagctcttcccgtccaaagcacgcggagccgcgacagggttcacgactttggtgttatcggcggctaacctgatcgtgtcgcttgtcttcccgctgatgctaagcgcgatgggcatcgcatgggtctttatggttttctcagtcatttgtcttctctcatttttcttcgcgttctacatggtaccggaaaccaaagggaaaagcttggaggaaattgaagcaagcctgaaaaaacggtttaaaaagaagaaaagcacccaaaaccaagtgctgaatgagcgtacattataa

SEQ ID NO: 7749 - protein, 461 aa, Bacillus subtilis
MKKDTRKYMIYFFGALGGLLYGYDTGVISGALLFINNDIPLTTLTEGLVVSMLLLGAIFGSALSGTCSDRWGRRKVVFVLSIIFIIGALACAFSQTIGMLIASRVILGLAVGGSTALVPVYLSEMAPTKIRGTLGTMNNLMIVTGILLAYIVNYLFTPFEAWRWMVGLAAVPAVLLLIGIAFMPESPRWLVKRGSEEEARRIMNITHDPKDIEMELAEMKQGEAEKKETTLGVLKAKWIRPMLLIGVGLAIFQQAVGINTVIYYAPTIFTKAGLGTSASALGTMGIGILNVIMCITAMILIDRVGRKKLLIWGSVGITLSLAALSGVLLTLGLSASTAWMTVVFLGVYIVFYQATWGPVVWVLMPELFPSKARGAATGFTTLVLSAANLIVSLVFPLMLSAMGIAWVFMVFSVICLLSFFFAFYMVPETKGKSLEEIEASLKKRFKKKKSTQNQVLNERTL

SEQ ID NO: 7750 - DNA, 1743 bp, Arabidopsis thaliana (mouse-ear cress)
  CDS (1)..(1743)
atggtggaagaagcatcgaaatcagagcagataaatatcacagaggtgtggacgacgacatgggagacaccttacattatgcggctggctctctctgccggtattggaggactcctcttcggatacaacacgggagtcatcgcaggggctcttctctatataaaagaggagtttggtgaggtagacaacaagacatggcttcaggagatcattgtgagcatgaccgtggctggagccattgttggagcagctataggaggatggtacaacgataagtttggtaggaggatgtctgttcttatagcggatgtgctcttcctgctgggtgccctggtgatggtgattgctcatgcgccgtgggtcatcatcctcggcagactcttggtgggttttggggttggtatggcttctatgacctcaccgctttacatctctgagatgtctcctgcgagaatcagaggcgccttggtcagcaccaacggacttctcatcaccggaggacagtttctatcttatctcatcaaccttgccttcgtccatacaccgggtacatggaggtggatgttgggagtctcggcgattccagcgatcattcagttctgcctcatgctaacgctgccagagtctccacggtggctctatagaaatgataggaaagccgagtcaagagacatcctcgagagaatatacccggcagagatggttgaagcggagatagctgcactcaaggagtctgtccgggcagagacggctgacgaggatattatcggccataccttctctgataagctcagaggcgctctctcgaatccagttgtccgccacggtctggccgcaggtatcaccgtccaggtcgcccagcagtttgtgggaatcaacacagtcatgtactacagtcctactattctgcagtttgcaggttacgcatccaacaagacagccatggctcttgctctcataacctccggtctcaatgcagtggggtctgtagtaagcatgatgtttgtagaccgttatggtcggcgcaagcttatgatcatttccatgttcgggatcataacttgccttgtcattttggctgccgttttcaatgaagcctcaaaccacgctccaaagatcgataagagagactccagaaacttcgcaaaaaatgctacttgtcccgcatttgccccattcacagcctcccgttctcctccctccaactggaattgtatgaagtgtcttcaatacgattgcggattctgctccaacggagcacaggagtacgcacctggagcatgcattgttcagtctgctgatatgaaggcattgtgccactcgaaaggcagaaccttcttcaaagacggatgccccagcaagttcgggtacctggccattgtcttccttggcctctacatcattgtgtacgcgcccggtatgggcacagttccatggattgtcaactcagagatctatcctcttcgctacagagggctcgcgggaggaatcgctgcagtctcaaactggatgtcaaatctcgtagtgagtgagacgttcctgacattgacaaacgcagtcgggtcatcgggaacattccttctatttgcagggtcatccgcagtcgggctgttcttcatctggctgcttgtgcctgagaccaaagggcttcagtttgaggaagtggaaaagttgctagaaggagggtttaggcctagtttattgcggccaacgaccaaggaaaatcaagtggaaacgccttag

SEQ ID NO: 7751 - protein, 580 aa, Arabidopsis thaliana (mouse-ear cress)
MVEEASKSEQINITEVWTTTWETPYIMRLALSAGIGGLLFGYNTGVIAGALLYIKEEFGEVDNKTWLQEIIVSMTVAGAIVGAAIGGWYNDKFGRRMSVLIADVLFLLGALVMVIAHAPWVIILGRLLVGFGVGMASMTSPLYISEMSPARIRGALVSTNGLLITGGQFLSYLINLAFVHTPGTWRWMLGVSAIPAIIQFCLMLTLPESPRWLYRNDRKAESRDILERIYPAEMVEAEIAALKESVRAETADEDIIGHTFSDKLRGALSNPVVRHGLAAGITVQVAQQFVGINTVMYYSPTILQFAGYASNKTAMALALITSGLNAVGSVVSMMFVDRYGRRKLMIISMFGIITCLVILAAVFNEASNHAPKIDKRDSRNFAKNATCPAFAPFTASRSPPSNWNCMKCLQYDCGFCSNGAQEYAPGACIVQSADMKALCHSKGRTFFKDGCPSKFGYLAIVFLGLYIIVYAPGMGTVPWIVNSEIYPLRYRGLAGGIAAVSNWMSNLVVSETFLTLTNAVGSSGTFLLFAGSSAVGLFFIWLLVPETKGLQFEEVEKLLEGGFRPSLLRPTTKENQVETP

SEQ ID NO: 7752 - DNA, 1774 bp, Arabidopsis thaliana (mouse-ear cress)
  CDS (1)..(1743)
atggagggaggaataatacatggaggagcagatgaatcagctttcaaagaatgtttctctctaacatggaagaatccttatgttcttcgtcttgctttctctgccggaatcggtggtcttctctttggttacgacaccggagtgatatcaggtgctctgctttatatcagagatgatttcaagtctgttgacagaaatacttggttacaggagatgatagtgagcatggcagttgcaggagccatcgttggagccgccataggaggttgggcgaacgacaaattagggaggagaagcgcgattctcatggcggatttcctctttttattaggagctatcattatggcggctgctcctaacccgtccctccttgtcgttggccgtgtttttgtgggcctcggggtcgggatggcctcgatgaccgctcctctatacatctcagaagcttcgcctgctaagatcagaggagctttggtcagtactaatgggtttctcattaccggaggacagttcttgtcttacctcataaacttagcctttactgatgtgaccggaacgtggagatggatgctcggaatcgccggaattccagctcttttacagtttgtcttaatgtttacactcccggagtcacctcgatggttataccgcaagggaagagaagaagaggctaaagcgattctaagaagaatatactcagcagaagatgtagaacaagagatacgtgcacttaaagactcagttgaaacagagatacttgaagaagggtcttccgagaaaatcaacatgatcaaactatgcaaagctaaaaccgttagacgaggactaatagctggtgttggtctccaagtgtttcaacagttcgttgggatcaacacagttatgtattacagtccaaccattgttcagcttgccggtttcgcttcaaacagaacagctcttctcttgtctctagttaccgcaggacttaatgcatttggttctataattagcatttacttcattgatagaatcggaaggaaaaagcttttgatcattagccttttcggagtcattatctcgctaggaatactaaccggtgttttttatgaagcggctactcacgctcctgcgattagctcactcgagacacaaaggttcaataatattagttgtccggattataagtcagctatgaataccaatgcttgggattgtatgacttgtttgaaagcttcttctccatcttgtggctattgttcctctcccattggaaaggaacatcccggggcatgttggatctctgatgattcggttaaggacttatgtcataacgaaaaccggctttggtacacgagaggatgtcctagcaattttggttggtttgctcttcttggattgggactttatatcatcttcttctctcctggaatggggactgttccatggatagttaactcagagatttatccattgagattcagaggaatatgtggaggaatagctgcaactgcaaattggatatcaaatttgattgtggctcaatcttttttgtcattgaccgaagctattgggacttcttggacttttctcatctttggagtgatctcagtcattgctcttctctttgttatggtttgtgttccggagacaaaaggaatgccaatggaggagattgagaagatgcttgaacgaagatcgatggagtttaagttttggaagaaaaaatcaaaacttgttgagaaacaaaaccagagtgcatgagagaaactcttaaaggaagcataatcaatga

SEQ ID NO: 7753 - protein, 580 aa, Arabidopsis thaliana (mouse-ear cress)
MEGGIIHGGADESAFKECFSLTWKNPYVLRLAFSAGIGGLLFGYDTGVISGALLYIRDDFKSVDRNTWLQEMIVSMAVAGAIVGAAIGGWANDKLGRRSAILMADFLFLLGAIIMAAAPNPSLLVVGRVFVGLGVGMASMTAPLYISEASPAKIRGALVSTNGFLITGGQFLSYLINLAFTDVTGTWRWMLGIAGIPALLQFVLMFTLPESPRWLYRKGREEEAKAILRRIYSAEDVEQEIRALKDSVETEILEEGSSEKINMIKLCKAKTVRRGLIAGVGLQVFQQFVGINTVMYYSPTIVQLAGFASNRTALLLSLVTAGLNAFGSIISIYFIDRIGRKKLLIISLFGVIISLGILTGVFYEAATHAPAISSLETQRFNNISCPDYKSAMNTNAWDCMTCLKASSPSCGYCSSPIGKEHPGACWISDDSVKDLCHNENRLWYTRGCPSNFGWFALLGLGLYIIFFSPGMGTVPWIVNSEIYPLRFRGICGGIAATANWISNLIVAQSFLSLTEAIGTSWTFLIFGVISVIALLFVMVCVPETKGMPMEEIEKMLERRSMEFKFWKKKSKLVEKQNQSA

SEQ ID NO: 7754 - DNA, 1554 bp, Arabidopsis thaliana (mouse-ear cress)
  CDS (1)..(1554)
atggctggaggagcctttgtatcagaaggtggtggtggaggaaacagctatgaaggcggagtcaccgtctttgtcatcatgacatgtattgtggccgctatgggaggtctcctctttggttatgacctcggtatctcaggtggagtgacatctatggaggagtttctgagcaagtttttcccggaggtggataagcaaatgcacgaagcaaggcgcgagactgcttactgcaaattcgataaccaattgctacagttgttcacttcctcactctacctcgcggcactcgcgtcttcctttgtagcttcggctgtcacaaggaagtacggacgcaaaatctccatgtttgttggaggggttgctttcctcataggttctctattcaacgcatttgctaccaatgtcgcaatgctcatcgttggtagattgttgctcggagtcggtgttggatttgccaatcagtctacgcctgtttatctctcggagatggctccagcgaagatccgaggagcacttaacatcgggtttcaaatggctataaccatcgggattttgattgcaaacttaatcaactacggaacatctcaaatggctaagaacggatggagagtatcattgggtttagccgctgtaccggcagttattatggttattggatcttttgtcttgcccgatacaccaaactcgatgctcgagagaggcaagtacgaacaagcgagagagatgttgcaaaagattcgtggagctgataacgtagatgaggagtttcaagatctgtgtgatgcttgtgaggctgctaagaaagtggataatccatggaagaacattttccaacaggcaaaatacagacccgctcttgttttctgttctgcgattcctttcttccaacagattactggtatcaatgttatcatgttctacgcccccgttctctttaagactctcggttttgcggatgatgcctcgctcatctcagcggttattacgggtgcggtcaatgttgtctctacccttgtctccatctatgcggttgacaggtacggaagaaggattctcttccttgaaggaggcatccaaatgattgtttcccagatcgttgttggtaccttgattggtatgaagtttggaaccacgggatcagggaccttaacacctgcaacagcagattggatcctggctttcatatgtttgtatgttgcaggatttgcatggtcatggggtccattaggatggttagtaccaagtgagatctgtccattggaaatcagaccagcgggacaagccatcaacgtctctgtcaacatgttcttcactttcctcattggacagtttttcctcacgatgctttgccacatgaagtttggtctcttctacttctttggaggaatggttgcagtcatgaccgtcttcatctacttcttgttgccggagacaaaaggggttccaattgaagaaatgggaagagtatggaagcaacatccgttctggaaacgttacatgccagatgatgctgttattggaggaggtgaagaaaactacgtcaaggaggtttga

SEQ ID NO: 7755 - protein, 517 aa, Arabidopsis thaliana (mouse-ear cress)
MAGGAFVSEGGGGGNSYEGGVTVFVIMTCIVAAMGGLLFGYDLGISGGVTSMEEFLSKFFPEVDKQMHEARRETAYCKFDNQLLQLFTSSLYLAALASSFVASAVTRKYGRKISMFVGGVAFLIGSLFNAFATNVAMLIVGRLLLGVGVGFANQSTPVYLSEMAPAKIRGALNIGFQMAITIGILIANLINYGTSQMAKNGWRVSLGLAAVPAVIMVIGSFVLPDTPNSMLERGKYEQAREMLQKIRGADNVDEEFQDLCDACEAAKKVDNPWKNIFQQAKYRPALVFCSAIPFFQQITGINVIMFYAPVLFKTLGFADDASLISAVITGAVNVVSTLVSIYAVDRYGRRILFLEGGIQMIVSQIVVGTLIGMKFGTTGSGTLTPATADWILAFICLYVAGFAWSWGPLGWLVPSEICPLEIRPAGQAINVSVNMFFTFLIGQFFLTMLCHMKFGLFYFFGGMVAVMTVFIYFLLPETKGVPIEEMGRVWKQHPFWKRYMPDDAVIGGGEENYVKEV

SEQ ID NO: 7756 - DNA, 1260 bp, Bacillus subtilis
  CDS (1)..(1260)
atggatatgaatgaacatcgaaatcgaaggttgaaattaataatgatttcagcaacttttggagggcttctctttggatatgacaccggagttataaatggagctttaccttttatggcaaggccagatcagcttgatttaacacctgttacagaagggcttgttacgagtattcttttattaggtgccgcgtttggagcgttgttatgcggaagattggctgatcgagatcgccgccgtaaaatgatccttaatctttcctttttatttttcctggcatcactgggaacagcgttagcacctaatgttttcatcatggcggtctttcgttttttactggggctggctgttggaggagcctcggcgatggtgccggcctttttagcagaaatggcaccgcatgaaaagagagggcgtatggtaacccaaaatgaactaatgattgttggcgggcaatttttagcatatgtttttaatgcgatcctcggtgtaacaatggcaaatacgggacatgtttggagatacatgctagtcatttgtgctgtaccggctatcatgttatttgccagtatgcttaaggtaccagaaagcccccgatggctaatctccaaaggcaaaaacagtgaggcgctgcgagttcttaaacaaattcgagaagataaacgtgcagaagctgaatgtagagaaattcaagaagcggtagaaaaagatacagcactagaaaaggcatcactcaaggacttttctacaccatggctgcgccgtcttttatggattggaatcggtgttgccatcgtgaatcaaattacaggtgtgaactcgattatgtattatggcacacaaatccttaaagaatctggttttggtacaaaagcggctttaatcgctaatattggaaatgggctgatatcagttattgcagttatatttgggatttggctggtcggaaaagtgagacggcgtccaatattattgattggtttggcagggacgactacagcgctcctattgattgcgattttctcaattgtgcttgatggatctatggcacttccttatgtagtgctttctttgaccgttttatttcttgcctttatgcaagggtgtgtaggacctgtgacttggcttgtcatagcggaaatattccctcaaaggttaagaggacttggttctgggataagtgtttttttcctttggatattaaactttgtgatcggttttgctttcccgatcttgcttagctctgtaggtttgtcttaa

SEQ ID NO: 7757 - protein, 419 aa, Bacillus subtilis
MDMNEHRNRRLKLIMISATFGGLLFGYDTGVINGALPFMARPDQLDLTPVTEGLVTSILLLGAAFGALLCGRLADRDRRRKMILNLSFLFFLASLGTALAPNVFIMAVFRFLLGLAVGGASAMVPAFLAEMAPHEKRGRMVTQNELMIVGGQFLAYVFNAILGVTMANTGHVWRYMLVICAVPAIMLFASMLKVPESPRWLISKGKNSEALRVLKQIREDKRAEAECREIQEAVEKDTALEKASLKDFSTPWLRRLLWIGIGVAIVNQITGVNSIMYYGTQILKESGFGTKAALIANIGNGLISVIAVIFGIWLVGKVRRRPILLIGLAGTTTALLLIAIFSIVLDGSMALPYVVLSLTVLFLAFMQGCVGPVTWLVIAEIFPQRLRGLGSGISVFFLWILNFVIGFAFPILLSSVGLS

SEQ ID NO: 7758 - DNA, 1518 bp, Bacillus subtilis
  CDS (16)..(1389)
aagggagtcatctttatgaaaaagcagtcaaatatatggctttattttttcggagctcttggaggcgcgttatatggctatgataccggagtgatttccggagctattttatttatgaaaaaggagttaggcttaaacgcgtttacagaaggtcttgttgtcagctccttgctggttggggcgatattgggctcaggagcggccggcaagctgactgaccgtttcggaagaaaaaaagcaattatggcagccgcgctgctgttttgtataggcggtcttggtgtggcactggccccaaatacaggagtcatggtgctgtttcgcatcattttgggacttgcagtcggaacatcgacgacaatcgtacccctttatttatctgaactggcgccaaaacataaacgcggggcgctgtcatcactgaatcagctgatgatcacggtcggcatccttctttcttacattgtcaattacatatttgccgatgccgaagcgtggcgctggatgcttggattggctgctgtgccgtcattgctcttgcttattggcattttgtttatgccggagagcccgcgctggctgttcacgaatggcgaagaaagcaaagcgaagaaaattcttgaaaaattgcgtggcacaaaagatattgatcaggaaatacatgatataaaagaagcggaaaagcaggatgaaggcggtctgaaggagctgttcgatccatgggtgcgcccagcgcttattgcaggtttgggactcgcttttttgcagcaatttatcggaacgaatacgatcatctactatgcgccaaagacctttacaaacgtcggattcggaaactccgcttcgattttaggcacggtcggaatcggcacagtcaatgttctcatgacattagtagcgattaaaatcatcgacaagattggaagaaagccgttactgctattcgggaatgcgggcatggtgatcagcttgatcgttctcgctttagtaaatctctttttcaataacactccggctgcctcatggacgaccgtcatttgtttaggcgtgtttatcgttgtctttgcggtcagctggggaccggttgtgtgggtgatgcttcctgaattgttcccgcttcacgtcagaggaatcgggaccggtgtttcgaccttaatgttgcacgttgggacactgattgtttcattaacctatccaatattaatggaagcgatcggaatcagttatttattcctgatttatgccgcgatcggtatcatggcgttcttatttgtccgatttaaagtgacagagacaaagggaagaagccttgaagaaattgagcaggatttacgggacaaaaacggacagggaggagcggccggaaaacagcagactgtcggaacataaaaaagggtgcgcgatcatgcgcacccttttgattgcttactttcccaccgtgccaaagttaatgattttaaaagaaatatcgtacttaaaatcagtctcagaaaatatttcatcccaatgcccttttac

SEQ ID NO: 7759 - protein, 457 aa, Bacillus subtilis
MKKQSNIWLYFFGALGGALYGYDTGVISGAILFMKKELGLNAFTEGLVVSSLLVGAILGSGAAGKLTDRFGRKKAIMAAALLFCIGGLGVALAPNTGVMVLFRIILGLAVGTSTTIVPLYLSELAPKHKRGALSSLNQLMITVGILLSYIVNYIFADAEAWRWMLGLAAVPSLLLLIGILFMPESPRWLFTNGEESKAKKILEKLRGTKDIDQEIHDIKEAEKQDEGGLKELFDPWVRPALIAGLGLAFLQQFIGTNTIIYYAPKTFTNVGFGNSASILGTVGIGTVNVLMTLVAIKIIDKIGRKPLLLFGNAGMVISLIVLALVNLFFNNTPAASWTTVICLGVFIVVFAVSWGPVVWVMLPELFPLHVRGIGTGVSTLMLHVGTLIVSLTYPILMEAIGISYLFLIYAAIGIMAFLFVRFKVTETKGRSLEEIEQDLRDKNGQGGAAGKQQTVGT

SEQ ID NO: 7760 - DNA, 1695 bp, Arabidopsis thaliana (mouse-ear cress)
  CDS (12)..(1475)
agaatcaaaagatgagtttcagggatgataatgaggaggctaggaatgatttgcgtcggccgtttattcacaccggaagctggtaccggatgggttcgagacaatcgagtatgatgggttcctctcaagttattcgagacagctctatctctgttcttgcatgtgttttgatcgttgctcttggccctattcaattcggattcacttgtggttattcatctccaactcaagctgcaatcaccaaggatctcggtttaacagtatctgagtactctgtgtttggttctctttccaatgtgggtgctatggttggtgcaattgccagtggtcagattgcagaatacattggacgaaaagggtctcttatgattgctgcaattcccaatatcattggatggctttgcatatcatttgcaaaagatacttcttttctttacatgggaagacttttagaaggctttggcgttgggatcatctcttacactgtacctgtatatatcgctgagatagctccacaaaatatgagaggaggattgggttcggttaaccagctttctgtgacaattggaataatgttggcgtatttacttggcctctttgttccatggagaattcttgcagttctggggatattgccgtgtacattattgataccaggtctctttttcatccccgaatcccctcgctggctggcaaaaatgggtatgacagatgaatttgaaacttcattacaagttcttcgaggatttgagactgatattaccgttgaagttaatgaaatcaagagatctgtggcatcatctacaaagcgaaatacagttcggtttgtagatctcaaacgcaggagatactatttcccacttatggttggtatagggttgcttgtacttcaacaacttggtggaattaatggtgtcctattctattccagtacaatatttgaatctgcaggagttacatcgagtaacgcagcaacatttggggtcggggctattcaggtagtagcgactgcaatatccacttggttggtggacaaagcaggtcgtcggcttctgcttactatctcttcggttgggatgacgattagccttgtaattgttgcagctgctttctatcttaaggaatttgtgtctcctgattcagacatgtacagttggctgagcatattgtcagtagttggagttgtggcaatggttgtctttttctcattgggaatgggaccaataccgtggctcattatgtctgagatccttcctgtgaacataaagggtttagctggaagtattgcaactctagccaattggttcttttcttggttgatcaccatgacagcaaatttgctgttagcctggagcagtggaggaactttcactctgtatggattggtttgtgcattcacagtggtgttcgtgactctatgggttcctgagaccaaaggcaaaactcttgaagaacttcaatccttgttcagatgaacaaattgaaacaacttcattctttgtcaccctctctctccctctctgttttggccaagaacaagaagaaacaagagattttccagctttgttaattgggctgagaacgttactaagatttgtttgtttgttcgttgtgtgtcaataatcgcattatcttctatcacatgtatatcaacatactacattcaagtatttgtaattttattgaactctttac

SEQ ID NO: 7761 - protein, 487 aa, Arabidopsis thaliana (mouse-ear cress)
MSFRDDNEEARNDLRRPFIHTGSWYRMGSRQSSMMGSSQVIRDSSISVLACVLIVALGPIQFGFTCGYSSPTQAAITKDLGLTVSEYSVFGSLSNVGAMVGAIASGQIAEYIGRKGSLMIAAIPNIIGWLCISFAKDTSFLYMGRLLEGFGVGIISYTVPVYIAEIAPQNMRGGLGSVNQLSVTIGIMLAYLLGLFVPWRILAVLGILPCTLLIPGLFFIPESPRWLAKMGMTDEFETSLQVLRGFETDITVEVNEIKRSVASSTKRNTVRFVDLKRRRYYFPLMVGIGLLVLQQLGGINGVLFYSSTIFESAGVTSSNAATFGVGAIQVVATAISTWLVDKAGRRLLLTISSVGMTISLVIVAAAFYLKEFVSPDSDMYSWLSILSVVGVVAMVVFFSLGMGPIPWLIMSEILPVNIKGLAGSIATLANWFFSWLITMTANLLLAWSSGGTFTLYGLVCAFTVVFVTLWVPETKGKTLEELQSLFR

SEQ ID NO: 7762 - DNA, 1395 bp, Bacillus subtilis; identical to SEQ ID NO: 177
  CDS (1)..(1395)

SEQ ID NO: 7763 - protein, 464 aa, Bacillus subtilis; identical to SEQ ID NO: 178

SEQ ID NO: 7764 - DNA, 1780 bp, Arabidopsis thaliana (mouse-ear cress)
  CDS (1)..(1749)
atggtggaaggaggaattgcgaaagcagacaaaacagagttcacagagtgttggagaacaacatggaagacaccttacatcatgcgacttgctctctccgccggaatcggaggtcttctcttcggttacgataccggagtcatttccggagctcttcttttcatcaaagaagattttgatgaagttgataagaaaacatggcttcagtcaactattgttagtatggcagtggctggagccatcgtcggagcagcagtcggaggttggatcaatgataagtttggtaggaggatgtcgattcttatcgccgatgttcttttcttgatcggtgcgattgtgatggcatttgctccggctccttgggttatcatcgttggaagaatctttgttgggtttggtgttggtatggcttcgatgacgtctccgttgtatatctctgaagcttctccggcgaggattagaggtgcacttgttagtaccaatggtcttctcatcactggtggacaattcttctcgtacctcatcaatcttgcttttgtccatactccgggaacatggagatggatgttgggtgttgcgggagttccagctattgttcagtttgtgcttatgttgtcgctacctgagtctccaaggtggttatatagaaaggacaggattgcggaatccagagcgattcttgagaggatttacccggctgacgaagtggaggcggagatggaagctttgaaactgtcagtggaggcagagaaagcagacgaggcaatcattggagatagcttctctgcaaagctgaaaggagctttcgggaatcccgttgttcgacgtggactcgctgctggtatcacggtgcaagtggctcagcagtttgtggggatcaacactgtcatgtactacagtccttctattgtgcaatttgctggttacgcctctaacaagacagctatggccttgtctcttattacttccggtttgaatgctttgggttctattgtgagcatgatgtttgtcgatcggtacgggagaaggaagctcatgatcatctctatgtttgggatcatagcatgtcttatcatcttagccacggtgttctcacaagcggccatccacgcccccaagatcgatgcgtttgagtcaaggacgtttgcaccaaatgctacttgttcagcatatgcccctctcgcagccgaaaatgctcctccctcgaggtggaactgcatgaagtgtctcaggtccgaatgtggattctgcgccagcggggtacagccgtacgcaccaggagcatgtgtggtgttgtcagatgacatgaaagcaacttgcagctcaagaggaagaacattcttcaaagatggatgtccaagcaagtttgggttcttagctatagtgtttttggggctttacatcgtagtctacgcaccaggtatgggcactgtcccgtggatcgtcaactctgagatctatccgctcagatacagaggtcttggtggaggaatagccgccgtctcgaattgggtctccaacctgatagtgagtgagagcttcctctcactcacccatgctctcggctcctctggtaccttccttctctttgctggcttctccacgatcgggctcttcttcatttggttgctcgttcctgagaccaaagggcttcagtttgaggaggtcgagaagttgctcgaggtcggcttcaagcccagtctcttgcggcggagggagaagaagggcaaagaagtcgatgctgcttaagacgatgatgatcacttatctctctctttct

SEQ ID NO: 7765 - protein, 582 aa, Arabidopsis thaliana (mouse-ear cress)
MVEGGIAKADKTEFTECWRTTWKTPYIMRLALSAGIGGLLFGYDTGVISGALLFIKEDFDEVDKKTWLQSTIVSMAVAGAIVGAAVGGWINDKFGRRMSILIADVLFLIGAIVMAFAPAPWVIIVGRIFVGFGVGMASMTSPLYISEASPARIRGALVSTNGLLITGGQFFSYLINLAFVHTPGTWRWMLGVAGVPAIVQFVLMLSLPESPRWLYRKDRIAESRAILERIYPADEVEAEMEALKLSVEAEKADEAIIGDSFSAKLKGAFGNPVVRRGLAAGITVQVAQQFVGINTVMYYSPSIVQFAGYASNKTAMALSLITSGLNALGSIVSMMFVDRYGRRKLMIISMFGIIACLIILATVFSQAAIHAPKIDAFESRTFAPNATCSAYAPLAAENAPPSRWNCMKCLRSECGFCASGVQPYAPGACVVLSDDMKATCSSRGRTFFKDGCPSKFGFLAIVFLGLYIVVYAPGMGTVPWIVNSEIYPLRYRGLGGGIAAVSNWVSNLIVSESFLSLTHALGSSGTFLLFAGFSTIGLFFIWLLVPETKGLQFEEVEKLLEVGFKPSLLRRREKKGKEVDAA

SEQ ID NO: 7766 - DNA, 1368 bp, Clostridium acetobutylicum
  CDS (1)..(1368)
atgaataaaaaaatatctccagcactaatttatttctttggagccttcggtggatttatgtttggatatgatattggaataattaatggtgctttacctggaattaatgcaacttggcacgtaagttcttggttagaaggatttatcacttctggattgtttgttggagctatgataggagcctcattaatggcttcactagcagataggtttggtcgtcgtagaatgattatgtggagtgcaattgtgtttgcacttggtgcattaggttctgccgtttctactagtactaatcttttaatcggtgctcgtgttattttaggagtagctgtaggtggagcttctgctttagttccaatgtatatgggagaaattagccctgctgaaacacgtggaaaactatctggtttaaatcaattaatgataactgttggaatgcttttctcatatggtgtaaattttgcgtttgctggtgcatttgaaggatggcgttggatgcttggaggagctatggtacctgcaatggtactattaattggaacatttatacttccagagtcaccaagatttttagctagaataggaaagacagaattagcaaaacaagtacttcagactttacgttcaaaggaagaggcagaaactgaatatcaagagattattaattcaaaacatactgaaacaggttcttttggagatttatttgcaaaacaggctttgccagctgtaattgcaggctgtgggttaacacttcttcaacaaattcaaggtgcaaacactattttctactattcatcacaaattttatccaatgtttttggatcagcaaatggtggaactattagtactgttggaattggtgtggttctagtattagcaactattgtaactttattggttgtagacaaattcaaacgtcgtacattatttatgactggttctattggaatgggcgcatctctattattagttggattaatttatccatactctgaagctaaacatgcgtgggcaacttggttagtattcttcttcatatgtttatacgttgttttctatgcatactcttgggcagctactacatggattgttgttggagaattattcccaagtaatgttagaggacttgcaacaggtattgcatcagcagtaaactggtttggtaacattttagttgctttattcttcccagtattacttgaaactgtaggtttatctgtaatcttcttcggttttgctgcaatttgtatcataggatttttatttgcaaaatatgttctttatgaaacaaaaggaaaatctttagaagaaattgagacatatttgtacaatcgttctattggaaaagttagaggattaaatgagtag

SEQ ID NO: 7767 - protein, 455 aa, Clostridium acetobutylicum
MNKKISPALIYFFGAFGGFMFGYDIGIINGALPGINATWHVSSWLEGFITSGLFVGAMIGASLMASLADRFGRRRMIMWSAIVFALGALGSAVSTSTNLLIGARVILGVAVGGASALVPMYMGEISPAETRGKLSGLNQLMITVGMLFSYGVNFAFAGAFEGWRWMLGGAMVPAMVLLIGTFILPESPRFLARIGKTELAKQVLQTLRSKEEAETEYQEIINSKHTETGSFGDLFAKQALPAVIAGCGLTLLQQIQGANTIFYYSSQILSNVFGSANGGTISTVGIGVVLVLATIVTLLVVDKFKRRTLFMTGSIGMGASLLLVGLIYPYSEAKHAWATWLVFFFICLYVVFYAYSWAATTWIVVGELFPSNVRGLATGIASAVNWFGNILVALFFPVLLETVGLSVIFFGFAAICIIGFLFAKYVLYETKGKSLEEIETYLYNRSIGKVRGLNE

SEQ ID NO: 7768 - DNA, 1422 bp, Bacillus subtilis
  CDS (1)..(1422)
atgaataaacaaggaaatcaaatgtcatttttacgtacaattattttagtctccactttcggcgggcttctttttggctatgataccggtgtgctcaatggagctttgccgtatatgggagagccggatcagcttaatctcaatgccttcacagaaggccttgtcaccagttcacttctttttggagcggcactgggtgctgtgtttggcggcaggatgtctgattttaacggccgccgcaaaaatattttgttcctcgctgttatattttttatttcaacgattgggtgtacgtttgcaccaaatgttacggtcatgattatttcccgttttgtgctcggtattgcggttgggggtgcatccgtaacggtgcctgcctatttagcagagatgtctcctgtggaaagcaggggacggatggtgacgcagaacgaattgatgattgtatcaggacagcttttggcctttgtttttaatgcgatccttggaacaacaatgggagacaactcccatgtgtggaggtttatgctggtcattgcgtcacttccagccttgttcctgtttttcggcatgatcagaatgcccgagagtccccgttggcttgtttctaaaggaagaaaagaagatgctttgcgtgtattgaaaaaaatcagggacgaaaaacgggcagcagctgagctgcaagaaattgaattcgctttcaaaaaagaagaccagcttgaaaaagcgacatttaaagatctttcagtcccatgggtgcgccgtattgtgtttattggattagggattgcgattgtacagcaaattacaggtgtgaattcgattatgtattatgggactgaaattctaagaaattccggtttccaaacggaagccgctttaatcggaaatattgcgaatggcgtgatttcggtattggcaacattcgtcggaatctggctgctgggaagagtggggcgccggccgatgctgatgacaggcttgatcggtacgacaacagcattattgctaatcgggatattctcacttgtacttgaaggatcaccggcacttccgtatgtagtcctgtcattaacggtcacatttcttgcttttcagcagggcgccatttcaccagtgacttggctgatgctatctgaaattttcccgcttcgccttcgcggactgggaatgggtgttacggtattctgtctgtggatggtgaattttgcagtcagtttcacgtttccgatattgctggcagctatcgggctgtccacaacgttctttatcttcgttggattaggaatttgctctgtcttgtttgtgaagaggtttttgccggaaacgaaagggctttcgcttgagcagctggaggaaaacttccgcgcttatgatcacagcggggcaaagaaggattctggggctgaagtgattggataa

SEQ ID NO: 7769 - protein, 473 aa, Bacillus subtilis
MNKQGNQMSFLRTIILVSTFGGLLFGYDTGVLNGALPYMGEPDQLNLNAFTEGLVTSSLLFGAALGAVFGGRMSDFNGRRKNILFLAVIFFISTIGCTFAPNVTVMIISRFVLGIAVGGASVTVPAYLAEMSPVESRGRMVTQNELMIVSGQLLAFVFNAILGTTMGDNSHVWRFMLVIASLPALFLFFGMIRMPESPRWLVSKGRKEDALRVLKKIRDEKRAAAELQEIEFAFKKEDQLEKATFKDLSVPWVRRIVFIGLGIAIVQQITGVNSIMYYGTEILRNSGFQTEAALIGNIANGVISVLATFVGIWLLGRVGRRPMLMTGLIGTTTALLLIGIFSLVLEGSPALPYVVLSLTVTFLAFQQGAISPVTWLMLSEIFPLRLRGLGMGVTVFCLWMVNFAVSFTFPILLAAIGLSTTFFIFVGLGICSVLFVKRFLPETKGLSLEQLEENFRAYDHSGAKKDSGAEVIG

SEQ ID NO: 7770 - DNA, 1566 bp, Arabidopsis thaliana (mouse-ear cress); identical to SEQ ID NO: 181
  CDS (1)..(1566)

SEQ ID NO: 7771 - protein, 521 aa, Arabidopsis thaliana (mouse-ear cress); identical to SEQ ID NO: 182

SEQ ID NO: 7772 - DNA, 1302 bp, Lactococcus lactis subsp. lactis
  CDS (1)..(1302)
atgagaaaactttctcccactttcatctatttttttggtgctttaggtggcttattatttggatatgacacaggcgtcatatcgggagcgctactttttattgaaaaagagagctggcaggtgagttcttgggcttggatggaaggatggattacagcggcagttttaatgggagctgtaattggcgcggtcgtaattggaccaatgagtgaccgttttggtcggaaacgtctgttacttttgtcagcggtcatcttttttgttggagctttaggttcaggactttcaaatagtgctgagttactaatcatctctcgggttattctcgggatggctgttgggtcagcttcagctttggtgccgacttatttatcggaactttcacccgctaaaattcgtggtggagtttcaactatgtttcaattgatgattatgactgggattttattagcctatatctcaaactatgctttaaaaggagtttcaggaaattggcattggatgcttggtttggccactgttccagcagcccttcttttcatcggtggactctttttgccagaatctccaagatttcttgttcgtcatgataatgaagcaggtgcccgtgaaatattagggatgataaatgacgatccaaactcgattgaagcagaaatttctgatattcaattgatggctaaggaagaaaaacaaggtggcttacaagaattatttggtcaaatgtcacgtccagttttgattatggcaattggtctggcaatttttcaacaggttatgggctgtaatacagtattatactttgcaccatcaatttttgttgcggtaggatttggggcaagcgcagctttacttgctcatattgggattggtattttcaatgttattgtaacttatattgcaatgagagtaatggataaagttaatcgtcggtggatgctcaattttggtgcttggggaatgggaatttctcttgtattgatgtcagtagggatgattttagcagaaaatgctcatattggctttggtaaatatttagcagttatcgctttaacggtatatattgccttcttctcagcaacatggggaccagtaatgtgggtgatgattggtgaatctttcccacttaaaatccgtggcttaggaaattcatttggtgctgctgtcaactgggctgctaactgggtggtgtcattaacattcttaccattattatcattttttggaacaggtaaaattttcctgatttatgcggcttgttgtttcctctcaatttggtttactagtaaaaaaagttattga

SEQ ID NO: 7773 - protein, 433 aa, Lactococcus lactis subsp. lactis
MRKLSPTFIYFFGALGGLLFGYDTGVISGALLFIEKESWQVSSWAWMEGWITAAVLMGAVIGAVVIGPMSDRFGRKRLLLLSAVIFFVGALGSGLSNSAELLIISRVILGMAVGSASALVPTYLSELSPAKIRGGVSTMFQLMIMTGILLAYISNYALKGVSGNWHWMLGLATVPAALLFIGGLFLPESPRFLVRHDNEAGAREILGMINDDPNSIEAEISDIQLMAKEEKQGGLQELFGQMSRPVLIMAIGLAIFQQVMGCNTVLYFAPSIFVAVGFGASAALLAHIGIGIFNVIVTYIAMRVMDKVNRRWMLNFGAWGMGISLVLMSVGMILAENAHIGFGKYLAVIALTVYIAFFSATWGPVMWVMIGESFPLKIRGLGNSFGAAVNWAANWVVSLTFLPLLSFFGTGKIFLIYAACCFLSIWFTSKKSY

SEQ ID NO: 7774 - DNA, 1536 bp, Arabidopsis thaliana (mouse-ear cress); identical to SEQ ID NO: 183
  CDS (1)..(1536)

SEQ ID NO: 7775 - protein, 511 aa, Arabidopsis thaliana (mouse-ear cress); identical to SEQ ID NO: 184

SEQ ID NO: 7776 - DNA, 1410 bp, Clostridium acetobutylicum; identical to SEQ ID NO: 185
  CDS (1)..(1410)

SEQ ID NO: 7777 - protein, 469 aa, Clostridium acetobutylicum; identical to SEQ ID NO: 186

SEQ ID NO: 7778 - DNA, 2890 bp, Saccharomyces cerevisiae; identical to SEQ ID NO: 189
  CDS (818)..(2443)

SEQ ID NO: 7779 - protein, 541 aa, Saccharomyces cerevisiae; identical to SEQ ID NO: 190

SEQ ID NO: 7780 - DNA, 2613 bp, Mus musculus (house mouse)
  CDS (180)..(1658)
aaaaaggcagctccgcgcgctctcccccaagagcagaggcttgcttgtagagtgacgatctgagctacggggtcttaagtgcgtcagggcgtggaggtctggcgggagacgcatagttacagcgcgtccgttctccgtctcgcagccggcacagctagagcttcgagcgcagcgcggccatggatcccagcagcaagaaggtgacgggccgcctcatgttggctgtgggaggagcagtgctcggatcactgcagttcggctataacactggtgtcatcaacgccccccagaaggttattgaggagttctacaatcaaacatggaaccaccgctacggagagcccatcccatccaccacactcaccacgctttggtctctctccgtggccatcttctctgtcgggggcatgattggttccttctctgtcggcctctttgttaatcgctttggcaggcggaactccatgctgatgatgaacctgttggcctttgtggctgctgtgcttatgggcttctccaaactgggcaagtcctttgagatgctgatcctgggccgcttcatcatcggtgtgtactgcggcctgactactggctttgtgcccatgtatgtgggagaggtgtcacctacagctctacgtggagccctaggcacactgcaccagctgggaatcgtcgttggcatccttattgcccaggtgtttggcttagactccatcatgggcaatgcagacttgtggcctctgctgctcagtgtcatcttcatcccagccctgctacagtgtatcctgttgcccttctgccccgagagcccccgcttcctgctcatcaatcgtaacgaggagaaccgggccaagagtgtgctgaagaagcttcgagggacagccgatgtgacccgagacctgcaggagatgaaagaagagggtcggcagatgatgcgggagaagaaggtcaccatcttggagctgttccgctcacccgcctaccgccagcccatcctcatcgctgtggtgctgcagctgtcccagcagctgtcgggtatcaatgctgtgttctactactcaacgagcatcttcgagaaggcaggtgtgcagcagcctgtgtacgccaccatcggctccggtatcgtcaacacggccttcactgtggtgtcgctgtttgttgtagagcgagctggacgacggaccctgcacctcattggcctggctggcatggcaggctgtgctgtgctcatgaccatcgccctggccttgctggaacggctgccttggatgtcctatctgagcatcgtggccatctttggctttgtggccttctttgaagtaggccctggtcctattccatggttcattgtggccgagctgttcagccaggggccccgtcctgctgctattgctgtggctggcttctccaactggacctcaaacttcattgtgggcatgtgcttccagtatgtggagcaactgtgcggcccctacgtcttcatcatcttcacggtgctcctcgtgctcttcttcatcttcacctacttcaaagtccctgagaccaaaggccgaaccttcgatgagatcgcttccggcttccggcaggggggtgccagccaaagtgacaagacacccgaggagctcttccaccctctgggggcggactcccaagtgtgaggagccccacacccagcccggcctgctccctgcagcccaaggatctctctggagcacaggcagctagatgagacctcttccgaaccgacagatctcgggcaagccgggcctgggcgcctttcctcagccagcagtgaagtccaggaggatattcaggactttgatggctccagaatttttaatgaaagcaagactgctgctcagatctattcagataagcagcaggttttataatttttttattactgattttgttattttttttttttatcagccactctcctatctccacactgtagtcttcaccttgattggcccagtgcctgagggtggggaccacgccctgtccagacacttgccttctttgccaagctaatctgtagggctggacctatggccaaggacacactaataccgaactctgagctaggaggctttaccgctggaggcggtagctgccacccacttccgcaggcctggacctcggcaccataggggtccggactccattttaggattcgcccattcctgtctcttcctacccaaccactcaattaatctttccttgcctgagaccagttggaagcactggagtgcagggaggagagggaagggccaggctgggctgccaggttctagtctcctgtgcactgagggccacacaaacaccatgagaaggacctcggaggctgagaacttaactgctgaagacacggacactcctgccctgctgtgtatagatggaagatatttatatattttttggttgtcaatattaaatacagacactaagttatagtatatctggacaaacccacttgtaaatacaccaacaaactcctgtaactttacctaagcagatataaatggctggtttttagaaaaaaaaaaaaaaaaaaaaaaaaaaaaaaaaaaaaaaaaaaaaaaaaaaaaaaaaaaaaaaaaaaaaaaaaaa

SEQ ID NO: 7781 - protein, 492 aa, Mus musculus (house mouse)
MDPSSKKVTGRLMLAVGGAVLGSLQFGYNTGVINAPQKVIEEFYNQTWNHRYGEPIPSTTLTTLWSLSVAIFSVGGMIGSFSVGLFVNRFGRRNSMLMMNLLAFVAAVLMGFSKLGKSFEMLILGRFIIGVYCGLTTGFVPMYVGEVSPTALRGALGTLHQLGIVVGILIAQVFGLDSIMGNADLWPLLLSVIFIPALLQCILLPFCPESPRFLLINRNEENRAKSVLKKLRGTADVTRDLQEMKEEGRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAVLMTIALALLERLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 7782 - DNA, 1559 bp, Synechocystis sp
  CDS (92)..(1498)
gaattcatgacgaagtttttttacttggtaggatttattccgtgggcaagcgcaacttgccataggctaacttcttcaatttcagctttacatgaatccctcctcttctccttcccaatctacggctaacgttaagtttgtcctgctgatttcgggggtagcagccctgggggggttcctgtttggctttgacactgcggtgatcaatggggcggtggcggccctacaaaaacattttcagacggacagtcttttaacaggtttatctgtatccttagctctgttgggatcagcactgggagcctttggggcgggaccgatcgccgatcgccatgggcggattaaaacgatgattttagcggcggtgctgttcaccctcagttccattgggtcgggtttacctttcaccatttgggattttattttttggcgggtgttggggggcattggggtgggggccgctagcgttattgccccggcctacattgcggaagtgtcgccggcccatctgcgggggcgtttaggatctttgcaacagttggccattgtttctggcattttcattgccctgctcagtaattggtttattgctttgatggcggggggatcggcccaaaatccctggttgttcggtgcggcggcctggcgttggatgttctggacagagctaattcccgccctgctctatggagtttgcgctttcctgatccccgaatctccccggtatttagtcgcccaagggcaaggggaaaaagcggcggctattttgtggaaagtggaagggggagacgtgcccagtcgcattgaggaaatccaggcaacggttagtctcgaccataaaccccggtttagcgatctgctcagtcgtcggggaggattattgcccattgtctggattggtatggggttgtcggcactacaacagtttgttggcattaacgtaattttttattacagtagcgtgctctggcgatcggtgggttttaccgaagaaaagtctctgttaatcacggtaatcactggttttatcaatatcctcaccaccctagtggcgatcgcctttgtggataaatttggccgtaagcctttgttgctcatgggctccattggtatgaccattaccttgggcatcctttccgtggtgtttgggggagcaacggtggttaatggccaacccaccctgacgggggccgctgggataattgctttggtgacagccaatctttatgtatttagttttggtttttcttgggggcccattgtttgggtcttgctgggggaaatgtttaataacaaaattcgagcggcggccctatcggtggcggcgggggtacagtggattgctaactttattatttccactacttttccgcccctattggatacggtgggtttgggccccgcctatggtttatatgccacttcagcggccatttcaattttctttatctggttttttgtgaaggaaactaagggtaaaactctggagcaaatgtgattaattttttattttgaggggaattaattgacattagcttgatttttttcgggagggtacc

SEQ ID NO: 7783 - protein, 468 aa, Synechocystis sp
MNPSSSPSQSTANVKFVLLISGVAALGGFLFGFDTAVINGAVAALQKHFQTDSLLTGLSVSLALLGSALGAFGAGPIADRHGRIKTMILAAVLFTLSSIGSGLPFTIWDFIFWRVLGGIGVGAASVIAPAYIAEVSPAHLRGRLGSLQQLAIVSGIFIALLSNWFIALMAGGSAQNPWLFGAAAWRWMFWTELIPALLYGVCAFLIPESPRYLVAQGQGEKAAAILWKVEGGDVPSRIEEIQATVSLDHKPRFSDLLSRRGGLLPIVWIGMGLSALQQFVGINVIFYYSSVLWRSVGFTEEKSLLITVITGFINILTTLVAIAFVDKFGRKPLLLMGSIGMTITLGILSVVFGGATVVNGQPTLTGAAGIIALVTANLYVFSFGFSWGPIVWVLLGEMFNNKIRAAALSVAAGVQWIANFIISTTFPPLLDTVGLGPAYGLYATSAAISIFFIWFFVKETKGKTLEQM

SEQ ID NO: 7784 - DNA, 1704 bp, Kluyveromyces marxianus var. lactis, Candida sphaerica; identical to SEQ ID NO: 193
  CDS (1)..(1704)

SEQ ID NO: 7785 - protein, 567 aa, Kluyveromyces marxianus var. lactis, Candida sphaerica; identical to SEQ ID NO: 194

SEQ ID NO: 7786 - DNA, 1545 bp, Arabidopsis thaliana (mouse-ear cress)
  CDS (1)..(1545)
atggccggagggttcgtcagtcaaacgccgggtgttcggaactacaattacaaactgacaccgaaagtgtttgtgacatgtttcatcggtgcttttggtggtctcatcttcggatacgatctcgggatctcaggaggggtaacctcaatggagccattcttggaagagttcttcccttacgtctacaagaagatgaagagcgcacatgagaacgagtactgtcgatttgatagtcagcttctcactctcttcacttcgtctctctatgtggcggctttggtgtcttctctctttgcctccaccattactagagttttcggaaggaaatggtcgatgtttctcggtggtttcaccttcttcatcggttctgctttcaacggctttgcccaaaacatcgctatgcttctcattggtcgtatcctacttggtttcggagtcggattcgccaatcaatctgtaccggtttatttatcagaaatggctcctccgaatctaagaggagctttcaacaacgggtttcaagtagcgattatctttggtattgtggttgcaacgatcatcaattacttcaccgcacagatgaaaggaaacatcggatggagaatctctctcggattagcttgtgtccctgcagtgatgatcatgatcggagctctgatccttcccgacactcccaactctctcatcgaacgtggctacaccgaagaggccaaggaaatgcttcagtccatccgaggaaccaatgaagtcgatgaagagtttcaagatctcattgatgcaagtgaggagtccaagcaagtgaaacacccatggaagaacatcatgcttcctcgttacagaccacaattgatcatgacttgcttcattcctttctttcaacaacttaccggaatcaatgtcattaccttctacgccccggttttgttccaaaccctcgggttcggtagcaaagcttccctcctatcagctatggtaacgggtatcatcgagctcttgtgtaccttcgtctctgtttttacagtggataggtttggaagaagaatcttgttcctccaaggaggtatccagatgcttgtctctcagatcgctattggagccatgattggagtcaaatttggagtggctggaacaggaaacatagggaaaagtgatgccaatctaatcgtggcactgatctgcatctatgtagcgggtttcgcctggtcatggggaccgttgggatggttggttcctagtgagatatctccactagagatccgatcagcagctcaagccataaacgtttcggtcaacatgttcttcacattccttgtggctcagctcttcctcactatgctttgtcacatgaaattcggactattcttcttcttcgccttctttgttgtcataatgacaatattcatctacttgatgttgcctgagacaaagaatgtgccaatcgaagagatgaacagagtgtggaaggcacattggttctggggaaagtttattcctgatgaagctgtcaatatgggtgctgctgagatgcaacagaagtccgtatga

SEQ ID NO: 7787 - protein, 514 aa, Arabidopsis thaliana (mouse-ear cress)
MAGGFVSQTPGVRNYNYKLTPKVFVTCFIGAFGGLIFGYDLGISGGVTSMEPFLEEFFPYVYKKMKSAHENEYCRFDSQLLTLFTSSLYVAALVSSLFASTITRVFGRKWSMFLGGFTFFIGSAFNGFAQNIAMLLIGRILLGFGVGFANQSVPVYLSEMAPPNLRGAFNNGFQVAIIFGIVVATIINYFTAQMKGNIGWRISLGLACVPAVMIMIGALILPDTPNSLIERGYTEEAKEMLQSIRGTNEVDEEFQDLIDASEESKQVKHPWKNIMLPRYRPQLIMTCFIPFFQQLTGINVITFYAPVLFQTLGFGSKASLLSAMVTGIIELLCTFVSVFTVDRFGRRILFLQGGIQMLVSQIAIGAMIGVKFGVAGTGNIGKSDANLIVALICIYVAGFAWSWGPLGWLVPSEISPLEIRSAAQAINVSVNMFFTFLVAQLFLTMLCHMKFGLFFFFAFFVVIMTIFIYLMLPETKNVPIEEMNRVWKAHWFWGKFIPDEAVNMGAAEMQQKSV

SEQ ID NO: 7788 - DNA, 1853 bp, Nicotiana tabacum (common tobacco)
  CDS (103)..(1674)
atttctacagtttacgattacagttctctctcaacttttttcttttttcttgatcatttcttgtgccacaagttgttcttgttttgtgatcagctcagaaagatggctggtggtggtggtattggtcccggcaacgggaaagaatatcccggcaatttaactctttatgttaccgttacgtgcattgtcgctgccatgggtggtctcattttcggttacgatattggaatttctggaggtgtgacatcaatggactcattcttgagcagatttttcccatctgtgttcaggaagcaaaaggcagatgattcaacaaatcaatactgcaaatttgacagccaaacattgacgatgttcacgtcgtcattgtacttggctgctcttttgtcgtctctggtggcatctactgtcaccagaaaacttggacggagactttctatgctctgtggaggtgtcctcttctgtgctggagctttgatcaatggctttgctcagaatgttgctatgctcattgttggtcgtattttactaggttttggtattggattcgccaatcagtctgttccactatacctatctgaaatggctccatacaagtacagaggagcactcaacctaggttttcaactgtccattacaattggtatacttgtagcaaatgtgttgaactatttctttgccaagattcattggggatggagattaagcttaggaggtgctatggtacctgcattgatcatcacaataggctcacttttccttcccgagacaccaaactccatgatcgaacgtggcaatcacgacgaagccaaagctaggcttaaaagaatcagaggcattgatgatgtagacgaagagttcaatgatttagtcgtggcgagtgaggcttctaggaaaattgagaacccttggagaaatttgttgcaaaggaaatataggccacatctcacaatggcaattatgatcccatttttccagcaacttactggaatcaatgtgattatgttctatgcaccagttttgtttaagactattggttttggtgctgatgcttcccttatgtctgctgttattactggtggagtcaatgtacttgcaactgttgtttctatttactatgttgataaattgggaagaagattcttgttccttgaaggtggcattcaaatgctcatctgccaaatagcggtgtcaatttgcatagctataaaatttggagtgaatggaactccaggggatttaccaaagtggtacgcgatagtagtggtgatattcatctgtgtttatgtagctggatttgcttggtcctggggacctctaggatggttggtacctagtgaaattttcccacttgaaattcgatcagctgctcaaagtatcaatgtttcagtgaacatgatcttcacatttatagtggcacaagtattcttgacaatgttgtgtcatttgaagtttggattgttcctcttctttgcattctttgttgtgattatgactgtcttcatttacttcttcttgcctgagacaaagaatatcccaattgaagagatggtgattgtgtggaaagagcattggttctggtctaagttcatgactgaagtggactatcctggaactaggaatggaacaagtgttgaaatgtcaaaagggagtgctggttacaaaatagtatgacctaattaaagaagatgtttggatttattttaattttatttgttgttgtataatgttttagtgggatgatattgttagatttgaactgtttctcttgtctctattgcatagaaaatacatactttactgtgttcaatttcaacctctcaacaattaatataagatttgtcagagcaaaa

SEQ ID NO: 7789 - protein, 523 aa, Nicotiana tabacum (common tobacco)
MAGGGGIGPGNGKEYPGNLTLYVTVTCIVAAMGGLIFGYDIGISGGVTSMDSFLSRFFPSVFRKQKADDSTNQYCKFDSQTLTMFTSSLYLAALLSSLVASTVTRKLGRRLSMLCGGVLFCAGALINGFAQNVAMLIVGRILLGFGIGFANQSVPLYLSEMAPYKYRGALNLGFQLSITIGILVANVLNYFFAKIHWGWRLSLGGAMVPALIITIGSLFLPETPNSMIERGNHDEAKARLKRIRGIDDVDEEFNDLVVASEASRKIENPWRNLLQRKYRPHLTMAIMIPFFQQLTGINVIMFYAPVLFKTIGFGADASLMSAVITGGVNVLATVVSIYYVDKLGRRFLFLEGGIQMLICQIAVSICIAIKFGVNGTPGDLPKWYAIVVVIFICVYVAGFAWSWGPLGWLVPSEIFPLEIRSAAQSINVSVNMIFTFIVAQVFLTMLCHLKFGLFLFFAFFVVIMTVFIYFFLPETKNIPIEEMVIVWKEHWFWSKFMTEVDYPGTRNGTSVEMSKGSAGYKIV

SEQ ID NO: 7790 - DNA, 2114 bp, Saccharomyces cerevisiae
  CDS (373)..(2076)
ggatcggtaactctgattatcacagagaaagcttcgtggagaatttttccagattttccgctttccccgatgttggtatttccggaggtcattatactgaccgccattataatgactgtacaacgaccttctggagaaagaaacaactcaataacgatgtgggacattgggggcccactcaaaaaatctggggactatatccccagagaatttctccagaagagaagaaaagtcaaagttttttttcgcttgggggttgcatataaatacaggcgctgttttatcttcagcatgaatattccataattttacttaatagcttttcataaataatagaatcacaaacaaaatttacatctgagttaaacaatcatgaattcaactccagatttaatatctccacaaaagtcaagtgagaattcgaatgctgacctgccttcgaatagctctcaggtaatgaacatgcctgaagaaaaaggtgttcaagatgatttccaagctgaggccgaccaagtacttaccaacccaaatacaggtaaaggtgcatatgtcactgtgtctatctgttgtgttatggttgccttcggtggtttcgttttcggttgggatactggtaccatttctggtttcgtcgcccaaactgatttcttgagaagattcggtatgaagcataaagatggtagttattatttgtctaaggttagaactggtttaattgtctccattttcaacattggttgtgccattggtggtattattttggctaaattgggtgatatgtacggtcgtaaaatgggtttgattgtcgttgttgttatctacatcatcggtattattattcaaattgcatccatcaacaaatggtaccaatatttcatcggtagaattatttccggtttgggtgttggtggtattgccgttttatctcctatgttgatttctgaagtcgctcctaaggaaatgagaggtactttagtctcctgttaccaactgatgattaccttgggtattttcttgggttactgtaccaacttcggtactaagaactactccaactctgtgcaatggagagttccattaggtttgtgttttgcctgggctttgtttatgatcggtggtatgactttcgttccagaatccccacgttatttggttgaagctggtcaaattgacgaagcaagagcatctctttccaaagttaacaaggttgccccagaccatccattcattcaacaagagttggaagttattgaagctagtgttgaagaagctagagctgctggttcagcatcatggggtgagttgttcactggtaagccggccatgtttaagcgtactatgatgggtatcatgatccaatctctacaacaattgactggtgataactatttcttctactatggtactaccgtttttaacgctgttggtatgagtgattctttcgaaacttctattgttttcggtgtcgtcaacttcttctctacttgttgttctttgtacactgtcgatcgttttggacgtcgtaactgtttgttatatggtgccattggtatggtctgctgttatgtagtttacgcttctgttggtgtcaccagactatggccaaatggtgaaggtaatggttcatccaagggtgctggtaactgtatgattgtctttgcctgtttctatattttctgttttgctaccacttgggctccaattgcttatgttgttatttctgaaactttcccattgagagtcaagtctaaggctatgtctattgctacagctgctaattggttgtggggtttcttgattggtttcttcactccatttattactggtgctattaacttctactacggttacgttttcatgggctgtatggttttcgcctacttctacgttttcttctttgtgccagaaactaagggtttgactttggaagaagtcaatgatatgtacgctgaaggtgttctaccatggaagtctgcttcatgggttccaacatctcaaagaggtgctaactacgatgctgatgcattgatgcatgatgaccagccattctacaagaaaatgttcggcaagaaataatttcacgctaaaccgtagtgctgaataatagtgtattt

SEQ ID NO: 7791 - protein, 567 aa, Saccharomyces cerevisiae; identical to SEQ ID NO: 196

SEQ ID NO: 7792 - DNA, 1605 bp, Chlorella kessleri
  CDS (1)..(1605)
atggccggcggcgcaatagtagcttcaggaggggcttcccgcagttcagagtatcaaggcggtcttacagcctatgtcttgctggtagccttggttgccgcctgcggtgggatgctgttgggctatgacaatggcgtcaccggaggtgtagcctccatggagcagtttgagaggaagttcttccctgatgtgtatgagaagaagcagcagattgtggagaccagcccatactgcacctacgacaacccgaagctgcagctctttgtgtcctcgctgttcctggcgggtctcatctcctgcatcttctctgcctggatcacccgcaactggggccgcaaggccagcatgggtattggcggtatcttcttcatcgctgctggtggcctggtcaatgcattcgcccaggacattgccatgctcatcgtcggccgcgtcctgctgggttttggcgttggccttggcagccaggtggttccccagtacttgtctgaggttgcccccttctcccaccgcggcatgctcaacatcggctaccagctgtttgtcaccatcggcatcctcatcgcaggactcgtcaactacggcgtgaggaactgggacaatggctggcgcctgtccctgggtctggctgccgtccccggcctcatcctgctgctgggagctattgtcctgcccgagtcccccaacttcctggtggagaagggccgcactgaccagggtcgtcgcatcctggagaagctgcggggcacctcccatgtagaagctgagtttgccgacatcgtggcagcagtcgagattgctcgtcccattaccatgcgtcagagctggaggtcactctttacccgccgctacatgccccagctgttgaccagctttgtcatccagttcttccagcagttcaccggcatcaacgccatcatcttctacgtgcctgtgctcttctcctccctgggaagtgccagctccgcagccctgctcaacactgtcgtggtgggcgctgtcaacgtgggcagcaccatgattgccgtcctcttgtccgacaagtttggccgccgcttcctgctcattgagggcggcattacgtgctgcctggccatgcttgcggccggtattacccttggtgtggagtttggacagtacggcactgaggacctgccccaccccgtctctgctggtgtcctggctgtcatctgtatcttcattgctggatttgcgtggtcctggggccccatgggctggctcatcccctctgagatcttcaccctggagacccgccctgccggcactgccgtggctgtcatgggcaacttcctgttctccttcgtcattggccaggccttcgtgtccatgctttgcgccatgaagtttggcgtcttcctcttcttcgctggctggttggtgattatggttctgtgtgccatcttcctgttgcccgagaccaagggtgtgcccatcgagcgtgtccaggcactctacgcccgccactggttctggaagaaggtaatgggtcctgctgcccaggagatcattgctgaggatgagaagcgtgtggctgcctcccaggctatcatgaaggaggagaggatctctcagaccatgaagtaa

SEQ ID NO: 7793 - protein, 534 aa, Chlorella kessleri
MAGGAIVASGGASRSSEYQGGLTAYVLLVALVAACGGMLLGYDNGVTGGVASMEQFERKFFPDVYEKKQQIVETSPYCTYDNPKLQLFVSSLFLAGLISCIFSAWITRNWGRKASMGIGGIFFIAAGGLVNAFAQDIAMLIVGRVLLGFGVGLGSQVVPQYLSEVAPFSHRGMLNIGYQLFVTIGILIAGLVNYGVRNWDNGWRLSLGLAAVPGLILLLGAIVLPESPNFLVEKGRTDQGRRILEKLRGTSHVEAEFADIVAAVEIARPITMRQSWRSLFTRRYMPQLLTSFVIQFFQQFTGINAIIFYVPVLFSSLGSASSAALLNTVVVGAVNVGSTMIAVLLSDKFGRRFLLIEGGITCCLAMLAAGITLGVEFGQYGTEDLPHPVSAGVLAVICIFIAGFAWSWGPMGWLIPSEIFTLETRPAGTAVAVMGNFLFSFVIGQAFVSMLCAMKFGVFLFFAGWLVIMVLCAIFLLPETKGVPIERVQALYARHWFWKKVMGPAAQEIIAEDEKRVAASQAIMKEERISQTMK

SEQ ID NO: 7794 - DNA, 2160 bp, Saccharomyces cerevisiae; identical to SEQ ID NO: 197
  CDS (216)..(1928)

SEQ ID NO: 7795 - protein, 570 aa, Saccharomyces cerevisiae; identical to SEQ ID NO: 198

SEQ ID NO: 7796 - DNA, 1673 bp, Rattus norvegicus (Norway rat)
  CDS (85)..(1566)
ggcttaaggaaacttgctgcggaggaaagacattggctggacacctctagatctaccttaagacttgagagctaggttgggaccatggggacagcgaaggtgaccccatctctggtgttcgctgttactgttgccacaatcggttctttccagtttggctacaacaccggagtcatcaatgcgcctgagacaatcattaaggactttcttaactacacgttggaagagcggttggaagacctaccaagggaggggctgctgaccacgctctggtcgttatgtgtggccatcttctccgttgggggcatgattggctctttttctgtcggactctttgtcaaccgctttggcagacgcaactccatgcttctagtcaacctgattgccatccttgggggttgccttatgggcttcgccaagatagcggagtcggttgaaatgctgatcctgggccgcctgattattggcatcttctgtggtctgtgcacgggctttgtgccgatgtacattggagaggtgtctcccactgccctacggggtgcatttggcacgctaaaccagctgggcatcgttgttgggatccttgtggctcaggtctttggtttggactttattctgggctctgaggagctgtggcctggactactgggcttaaccatcattccagctatcctacagagcgcagcccttccgttttgccccgagagtccaaggttcttgctcattaacagaaaggaggaagaccaagcaacggagatcctccagcggttgtggggcaccccggatgtgatccaggagatccaggagatgaaagacgagagtatcaggatgtcacaggagaagcaggtcactgtgctggagctcttcaagtctcctagctacttccagccccttctcatctccgttgtcctccagttgtctcagcagttctctgggatcaatgctgtgttctattactcgacgggaatcttccaggatgcgggtgtccaggagcccatctatgccacgattggagcgggtgtggtcaacactatcttcactgtagtctctctgttcctggtggagcgggcaggaaggagaaccctgcacatgataggcctgggaggcatggctgtttgctccgttttcatgacgatttctctgttactgaaggatgaatatgaagccatgagctttgtctgtattgtggctatcttggtctacgtggccttctttgagattggccctggccccattccctggtttattgtggctgaactcttcagccagggcccccgaccagctgccatggctgtggctggctgttctaactggacctccaactttttggtgggaatgttcttcccctcggctgcggcctacttgggagcctacgtttttatcatcttcgctgccttcctcgttttcttcctaatcttcacctccttcaaagtcccagagaccaaaggcaggactttcgaggatattacccgggccttcgaggggcaggcgcactctgggaaaggctctgctggtgtggagttgaacagcatgcagcctgtcaaggagacccctggcaatgcctgagccggacctcctccctcacctccctccactgtggaaagccaacctcccctgaagtggcgagacctcatcaggatgaaccaggactgcttctgagcgctcgtatcaca

SEQ ID NO: 7797 - protein, 493 aa, Rattus norvegicus (Norway rat)
MGTAKVTPSLVFAVTVATIGSFQFGYNTGVINAPETIIKDFLNYTLEERLEDLPREGLLTTLWSLCVAIFSVGGMIGSFSVGLFVNRFGRRNSMLLVNLIAILGGCLMGFAKIAESVEMLILGRLIIGIFCGLCTGFVPMYIGEVSPTALRGAFGTLNQLGIVVGILVAQVFGLDFILGSEELWPGLLGLTIIPAILQSAALPFCPESPRFLLINRKEEDQATEILQRLWGTPDVIQEIQEMKDESIRMSQEKQVTVLELFKSPSYFQPLLISVVLQLSQQFSGINAVFYYSTGIFQDAGVQEPIYATIGAGVVNTIFTVVSLFLVERAGRRTLHMIGLGGMAVCSVFMTISLLLKDEYEAMSFVCIVAILVYVAFFEIGPGPIPWFIVAELFSQGPRPAAMAVAGCSNWTSNFLVGMFFPSAAAYLGAYVFIIFAAFLVFFLIFTSFKVPETKGRTFEDITRAFEGQAHSGKGSAGVELNSMQPVKETPGNA

SEQ ID NO: 7798 - DNA, 2209 bp, Saccharomyces cerevisiae
  CDS (213)..(1925)
aaaaggaggaaaatacaaaatatactagaactgaaaaaaaaaaagtataaatagagacgatatatgccaatacttcacaatgttcgaatctattcttcatttgcagctattgtaaaataataaaacatcaagaacaaacaagctcaacttgtcttttctaagaacaaagaataaacacaaaaacaaaaagtttttttaattttaatcaaaaaatgtcacaagacgctgctattgcagagcaaactcctgtggagcatctctctgctgttgactcagcctcccactcggttttatctacaccatcaaacaaggctgaaagagatgaaataaaagcttatggtgaaggtgaagagcacgaacctgtcgttgaaattccaaagagaccagcttctgcctatgtcactgtctctattatgtgtatcatgatcgcctttggtggtttcgttttcggttgggatactggtaccatttctggtttcatcaatcaaaccgatttcatcagaagatttggtatgaagcataaagatggtactaattatttgtctaaggttagaactggtttgattgtctccattttcaacattggttgtgccattggtggtattattctttccaaattgggtgatatgtacggtcgtaaggtgggtttgattgtcgttgttgtcatctacatcatcggtattattattcaaattgcatctatcaacaaatggtaccaatatttcatcggtagaattatttccggtttgggtgttggtggtattgccgttttatctcctatgttgatttctgaagtatccccaaagcatttaaggggtactttagtctcttgctaccaattgatgattactgccggtattttcttgggttactgtaccaacttcggtactaagaactactccaactctgtgcaatggagagttccattaggtttgtgttttgcctgggctttgtttatgattggtggtatgacatttgttccagagtctccacgttatttggctgaagtcggtaagatcgaagaagccaaacgttctattgccgtttctaacaaggttgctgttgatgatccatctgttttggctgaagtcgaagctgtcttggctggtgtagaggcagagaaattagctggtaatgcatcctggggtgaattgtttagtagcaagacaaaggtccttcagcgtttgatcatgggtgctatgattcaatctctacaacaattgacaggtgataactatttcttctactatggtactactattttcaaggctgttggtttgagtgactctttcgaaacctctattgtcttgggtattgttaactttgcttccacctttgttggtatttacgttgttgagagatatggtcgtcgtacttgtttgctatggggtgctgcatccatgactgcttgtatggttgtctatgcttccgtgggtgtcaccagattatggccaaatggtcaagaccaaccatcttccaagggtgctggtaactgtatgattgtctttgcctgtttctatattttctgttttgctactacatgggctccaattccttatgtcgttgtttctgaaactttcccattgagagtcaagtctaaggctatgtctattgctacagctgctaattggttgtggggtttcttgattggtttcttcactccatttattactggtgctattaacttctactacggttacgttttcatgggctgtttggtcttcatgttcttctatgttttgttagttgttccagaaactaagggtttgactttggaagaagtcaacaccatgtgggaagaaggtgttctaccatggaagtctgcctcatgggttccaccatccagaagaggtgccaactacgacgctgaagaaatgactcacgatgacaagccattgtacaagagaatgttcagcaccaaataatttgcgaacacttttattaattcatgatcacgctctaatttgtgcatttgaaatgtactctaattctaattttatatttttaatgatatcttgaaaagtaaatacgtttttaatatataccaaaataatacagtttaattttcaagtttttgatcatttgttctcagaaagttgagtgggacggagacaaagaaactttaaagagaaatgcaaagtgggaagaagtcagttgtttaccgaccgcactgttattcacaaatattccaattttgcctgcaggtcga

SEQ ID NO: 7799 - protein, 570 aa, Saccharomyces cerevisiae
MSQDAAIAEQTPVEHLSAVDSASHSVLSTPSNKAERDEIKAYGEGEEHEPVVEIPKRPASAYVTVSIMCIMIAFGGFVFGWDTGTISGFINQTDFIRRFGMKHKDGTNYLSKVRTGLIVSIFNIGCAIGGIILSKLGDMYGRKVGLIVVVVIYIIGIIIQIASINKWYQYFIGRIISGLGVGGIAVLSPMLISEVSPKHLRGTLVSCYQLMITAGIFLGYCTNFGTKNYSNSVQWRVPLGLCFAWALFMIGGMTFVPESPRYLAEVGKIEEAKRSIAVSNKVAVDDPSVLAEVEAVLAGVEAEKLAGNASWGELFSSKTKVLQRLIMGAMIQSLQQLTGDNYFFYYGTTIFKAVGLSDSFETSIVLGIVNFASTFVGIYVVERYGRRTCLLWGAASMTACMVVYASVGVTRLWPNGQDQPSSKGAGNCMIVFACFYIFCFATTWAPIPYVVVSETFPLRVKSKAMSIATAANWLWGFLIGFFTPFITGAINFYYGYVFMGCLVFMFFYVLLVVPETKGLTLEEVNTMWEEGVLPWKSASWVPPSRRGANYDAEEMTHDDKPLYKRMFSTK

SEQ ID NO: 7800 - DNA, 3025 bp, Saccharomyces cerevisiae; identical to SEQ ID NO: 201
  CDS (510)..(2288)

SEQ ID NO: 7801 - protein, 592 aa, Saccharomyces cerevisiae; identical to SEQ ID NO: 202

SEQ ID NO: 7802 - DNA, 1683 bp, Saccharomyces cerevisiae
  CDS (1)..(1683)
atgtctgaagaagctgcctatcaagaggatacagcagtccaaaatactccagctgatgctttgtcgccagttgaatccgattctaattccgctttgtctactccatccaacaaagctgaaagagatgacatgaaagatttcgacgagaatcacgaagaatctaataactacgttgaaattccaaagaagcccgcctccgcctacgttacagtttccatctgttgtttaatggttgctttcggtggttttgttttcggttgggatactggtaccatttctggttttgttgctcaaactgattttatcagaagatttggtatgaagcaccacgatggtacttattatttgtctaaggttagaactggtttaattgtctccattttcaacattggttgtgccattggtggtattattttagcaaaattaggtgatatgtatggtcgtaaaatgggtttgattgtcgttgttgtcatctacattatcggtatcattatccaaattgcctcaatcaacaagtggtaccaatatttcattggtagaattatctctggtttaggtgtcggtggtattgccgttttatctcctatgttgatttctgaagtctctccaaagcatattagaggtactttggtttcatgttaccaacttatgattactttgggtattttcttgggttactgtacaaactacggtaccaagacctacaccaattctgtccaatggagagttccattaggtctaggtttcgcttgggctttgtttatgattggtggtatgacattcgttccagaatctccacgttatttagttgaagtcggtaaaattgaagaagctaagcgttctattgctctttcaaataaggtcagcgcagacgatccagctgttatggctgaagtcgaagttgttcaagctacagttgaagctgaaaaattagctggtaatgcctcctggggtgaaatatttagcactaagactaaggttttccaacgtttgatcatgggtgctatgattcaatcattgcaacaattgacaggtgataactatttcttctattacggtactaccgttttcactgctgtcggtttggaagattcttttgaaacttctattgtcttgggtattgtcaactttgcttccacctttgttggtattttcttagtcgaaagatatggtcgtcgtagatgtttattatggggtgctgcttccatgacagcttgtatggttgttttcgcttctgttggtgttacaagattgtggccaaatggtaagaagaacgggtcttctaagggtgctggtaactgtatgattgtcttcacatgtttctacttattctgttttgccactacctgggctccaattccatttgttgttaactctgaaactttcccattgagagttaagtccaagtgtatggctattgctcaagcttgtaactggatctggggtttcttgattggtttctttactccatttatttcaggtgctattgatttctactacggttatgttttcatgggctgtttggtcttttcttacttctacgtcttcttcttcgttccagaaactaaaggtttgactttagaagaagttaacaccttatgggaagaaggtgttttgccatggaaatcaccttcttggttccaccaaacaagagaggtactgactacaacgctgatgatctaa

SEQ ID NO: 7803 - protein, 560 aa, Saccharomyces cerevisiae
MSEEAAYQEDTAVQNTPADALSPVESDSNSALSTPSNKAERDDMKDFDENHEESNNYVEIPKKPASAYVTVSICCLMVAFGGFVFGWDTGTISGFVAQTDFIRRFGMKHHDGTYYLSKVRTGLIVSIFNIGCAIGGIILAKLGDMYGRKMGLIVVVVIYIIGIIIQIASINKWYQYFIGRIISGLGVGGIAVLSPMLISEVSPKHIRGTLVSCYQLMITLGIFLGYCTNYGTKTYTNSVQWRVPLGLGFAWALFMIGGMTFVPESPRYLVEVGKIEEAKRSIALSNKVSADDPAVMAEVEVVQATVEAEKLAGNASWGEIFSTKTKVFQRLIMGAMIQSLQQLTGDNYFFYYGTTVFTAVGLEDSFETSIVLGIVNFASTFVGIFLVERYGRRRCLLWGAASMTACMVVFASVGVTRLWPNGKKNGSSKGAGNCMIVFTCFYLFCFATTWAPIPFVVNSETFPLRVKSKCMAIAQACNWIWGFLIGFFTPFISGAIDFYYGYVFMGCLVFSYFYVFFFVPETKGLTLEEVNTLWEEGVLPWKSPSWFHQTREVLTTTLMI

SEQ ID NO: 7804 - DNA, 1463 bp, Klebsiella oxytoca
  CDS (27)..(1445)
gtcttacttcgtctggcaggaaaaaaatgaccactctcagtcacgactctacaaccatgccgcgtacgcagcgcgatacccggcgcatgaatcagtttgtctccattgccgccgcggtggcagggttgctgtttggcctcgatatcggggtgattgccggggcgctgccctttattaccgaccattttgttttatccagccgcctgcaggagtgggtggtgagcagcatgatgctgggagccgccatcggcgcgttatttaacggctggctctctttccgcctcgggcgcaaatacagcctgatggtgggcgcggtgctgttcgttgccggctccgtgggctccgcgtttgcgaccagcgtcgaaatgctgctggtggcaaggatcgttctcggggtcgccgtggggatcgcctcttataccgcgccgctgtacctgtcggaaatggcgagcgaaaacgtgcgcggcaagatgatcagcatgtatcagctgatggtgacgctgggtatcgtgatggcgtttctctccgacaccgcgttcagctacagcggcaactggcgggcgatgcttggcgtactggcgctgccggcggtggtgctgattattctggtgatcttcctgccgaacagcccgcgctggctggcggaaaaagggcgtcacgtggaagcggaagaggtgctgcggatgctgcgcgacacgtcagaaaaagcccgtgacgagctcaacgagatccgcgaaagcctgaagctgaagcagggcggctgggcgctgtttaaggtcaaccgcaacgtgcggcgggcggtattcctcggcatgctgttgcaggcgatgcagcagtttaccggtatgaatatcatcatgtactacgcgccgcgcatctttaaaatggcgggcttcaccaccaccgaacagcagatggtcgcgaccctggtggttggcctgacctttatgttcgccacctttatcgccgtctttaccgtcgataaggccggacgtaagccggcgctgaaaatcggttttagcgtgatggccatcggcacgctggtgctgggctactgtctgatgcagtttgataacggcaccgcctccagcggtctctcctggctgtcggtggggatgaccatgatgtgtatcgccggctatgcgatgagcgccgcgccggtggtgtggatcctgtgttcggaaattcagccgctgaagtgccgcgatttcggcatcacctgctcaaccaccaccaactgggtgtcgaacatgattatcggcgcgaccttcctgacgctgctggacgcgatcggcgcggcaggaaccttctggctttataccgcgctgaacgtcgcctttatcggcgtgacgttctggctgatcccggaaaccaaaaacgtcaccctggagcatattgaacgcaggctgatgtccggcgagaagctgcgcaatatcggcaattaattacaacgactcgcgcgg

SEQ ID NO: 7805 - protein, 472 aa, Klebsiella oxytoca
MTTLSHDSTTMPRTQRDTRRMNQFVSIAAAVAGLLFGLDIGVIAGALPFITDHFVLSSRLQEWVVSSMMLGAAIGALFNGWLSFRLGRKYSLMVGAVLFVAGSVGSAFATSVEMLLVARIVLGVAVGIASYTAPLYLSEMASENVRGKMISMYQLMVTLGIVMAFLSDTAFSYSGNWRAMLGVLALPAVVLIILVIFLPNSPRWLAEKGRHVEAEEVLRMLRDTSEKARDELNEIRESLKLKQGGWALFKVNRNVRRAVFLGMLLQAMQQFTGMNIIMYYAPRIFKMAGFTTTEQQMVATLVVGLTFMFATFIAVFTVDKAGRKPALKIGFSVMAIGTLVLGYCLMQFDNGTASSGLSWLSVGMTMMCIAGYAMSAAPVVWILCSEIQPLKCRDFGITCSTTTNWVSNMIIGATFLTLLDAIGAAGTFWLYTALNVAFIGVTFWLIPETKNVTLEHIERRLMSGEKLRNIGN

SEQ ID NO: 7806 - DNA, 1641 bp, Saccharomyces cerevisiae; identical to SEQ ID NO: 203
  CDS (1)..(1641)

SEQ ID NO: 7807 - protein, 546 aa, Saccharomyces cerevisiae; identical to SEQ ID NO: 204

SEQ ID NO: 7808 - DNA, 1695 bp, Saccharomyces cerevisiae; identical to SEQ ID NO: 205
  CDS (1)..(1695)

SEQ ID NO: 7809 - protein, 564 aa, Saccharomyces cerevisiae; identical to SEQ ID NO: 206

SEQ ID NO: 7810 - DNA, 3277 bp, Saccharomyces cerevisiae; identical to SEQ ID NO: 207
  CDS (802)..(2505)

SEQ ID NO: 7811 - protein, 567 aa, Saccharomyces cerevisiae; identical to SEQ ID NO: 208

SEQ ID NO: 7812 - DNA, 1710 bp, Saccharomyces cerevisiae; identical to SEQ ID NO: 209
  CDS (1)..(1710)

SEQ ID NO: 7813 - protein, 569 aa, Saccharomyces cerevisiae; identical to SEQ ID NO: 210

SEQ ID NO: 7814 - DNA, 1701 bp, Kluyveromyces marxianus var. lactis, Candida sphaerica; identical to SEQ ID NO: 211
  CDS (1)..(1701)

SEQ ID NO: 7815 - protein, 566 aa, Kluyveromyces marxianus var. lactis, Candida sphaerica; identical to SEQ ID NO: 212

SEQ ID NO: 7816 - DNA, 1704 bp, Saccharomyces cerevisiae
  CDS (1)..(1704)
atggcaagcgaacagtcctcaccagaaattaatgcagataatctaaacagtagtgcagctgacgttcatgtacagccacccggagagaaagaatggtcagacgggttttatgacaaagaagtcattaatggaaatacgccagacgcaccgaagagaggctttttaggttaccttattatctacttactatgctatcctgtatcctttggcggttttttacctggttgggatagtggtattactgcaggcttcatcaatatggataactttaaaatgaattttggttcttacaagcacagtactggtgagtattatttgagcaacgtgcgtatgggtcttctcgtggccatgttcagtgtaggatgttccattggcggtgttgcttttgcgagacttgctgatactttaggtagaaggctagcaattgtaatcgtggttttggtatatatggttggtgcaattattcagatcagttcgaatcacaaatggtaccaatactttgtcggtaagatcatctacggtcttggtgctggtggctgttcggtgttgtgtccaatgcttttatctgaaatagcccccacagatttgagaggtggacttgtctcattgtaccaacttaacatgaccttcggtattttcttgggttattgtagcgtttatggaacaaggaagtatagtaatactgcgcaatggaggattcctgtgggactatgctttctgtgggctctaattatcatcgttggcatgttattagttccagagtccccaagatatctgattgaatgtgagagacatgaagaggcctgtgtctccatcgccaagatcgacaaggtttcaccagaggatccatgggtactcaaacaggctgatgaaatcaacgccggtgtccttgcccaaagagaactaggggaagcctcatggaaagaacttttctccgtcaaaacaaaagtccttcaacgtttgatcacaggtattcttgtgcaaacctttttgcaacttactggtgaaaactacttcttcttctacggaactaccattttcaaatcagttgggcttactgatgggtttgagacttcgatcgtcctaggtacagtgaatttcttctccactattattgctgttatggtcgtagacaaaataggccgtcgtaaatgtctgttattcggagcggcttcaatgatggcttgtatggtcatatttgcaagtatcggggtaaaatgtctttaccctcatggccaggatggtccatcctcgaaaggtgcaggtaatgccatgattgtgttcacatgcttctatatattctgctttgcaacgacatgggcccctgttgcttatattgtggttgccgagtcattcccttcgaaggtcaaatctaaagcaatgtcaatttcgactgcattcaactggttatggcaattcttgattggttttttcacaccattcattactgggtctatccacttctattatggttatgtgttcgtaggttgtttggttgctatgtttttgtacgttttcttctttttaccagaaacaattggtctatctttggaggaaacccagttactatatgaagaaggtataaaaccatggaaatctgcatcttgggtaccaccctcaaggagaggagcttcttccagggaaactgaggctaagaagaaaagctggaaagaagttttgaagttcccaaagagttttaattga

SEQ ID NO: 7817 - protein, 567 aa, Saccharomyces cerevisiae
MASEQSSPEINADNLNSSAADVHVQPPGEKEWSDGFYDKEVINGNTPDAPKRGFLGYLIIYLLCYPVSFGGFLPGWDSGITAGFINMDNFKMNFGSYKHSTGEYYLSNVRMGLLVAMFSVGCSIGGVAFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYSNTAQWRIPVGLCFLWALIIIVGMLLVPESPRYLIECERHEEACVSIAKIDKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAASMMACMVIFASIGVKCLYPHGQDGPSSKGAGNAMIVFTCFYIFCFATTWAPVAYIVVAESFPSKVKSKAMSISTAFNWLWQFLIGFFTPFITGSIHFYYGYVFVGCLVAMFLYVFFFLPETIGLSLEETQLLYEEGIKPWKSASWVPPSRRGASSRETEAKKKSWKEVLKFPKSFN

SEQ ID NO: 7818 - DNA, 3323 bp, Saccharomyces cerevisiae; identical to SEQ ID NO: 217
  CDS (1189)..(2883)

SEQ ID NO: 7819 - protein, 564 aa, Saccharomyces cerevisiae; identical to SEQ ID NO: 218

SEQ ID NO: 7820 - DNA, 3143 bp, Saccharomyces cerevisiae; identical to SEQ ID NO: 219
  CDS (962)..(2686)

SEQ ID NO: 7821 - protein, 574 aa, Saccharomyces cerevisiae; identical to SEQ ID NO: 220

SEQ ID NO: 7822 - DNA, 4409 bp, Saccharomyces cerevisiae; identical to SEQ ID NO: 221
  CDS (1233)..(3524)

SEQ ID NO: 7823 - protein, 763 aa, Saccharomyces cerevisiae; identical to SEQ ID NO: 222

SEQ ID NO: 7824 - DNA, 1668 bp, Saccharomyces cerevisiae
  CDS (1)..(1668)
atgtctacagatgaaagtgaagacgtttattctgatctgtattccattatctcccaggtaacatccaatactgccaatgacatcgagcaactcccatatgctttaacgttcaaaacgtcgttaatcttcgttggtgctaccattggtgggcttttattcggctatgatactggtgttatatcaggtgttctgctttctttaaagcccgaagatctatctttggtagttttaacggatgttcagaaggagctgataacttccagtacaagcgtcggatcattttttggctctattctggcatttcctttagcagataggtatggaagaagaattactctcgcaatctgctgttcaatttttatcctagctgcaattggaatggctatagcaagaacattgacgtttttgatttgtgggagattgctggttgggatcgctgttggagtgtctgcccagtgcgtccctctatttctgagtgaaatttcaccttccagaatcaggggttttatgttgacattgaacattattgccatcactggaggtcaattggtttcctatgtgattgcgtcccttatgaaagagattgataattcatggagatatttgttcgcactttctgctattccagctattctgttcctttcaatactggattttatccctgaatcgccacgatggtccatttccaagggagacattctatataccagggattctctaagaatgctatatcctactgcatctacatatcatgtgaatagtaaaattaagcagctgataattgaactcgataagttacgactatacgaagatgcaagtgaacctttactagtacagtcccaatcggttattcgatacatggatagttcaacctcaggaactcttagcccacctaacattaaaagactttcctcgaacacagaaagaactagcaacacaatgtcctcctcatcagcatatctatcggcgttgcgaggcccagctccaaacggtgccctggcatctaacaaaaagaaaagacacagaatggagccacgcacaataagagcgttaatagtaggttgcatgttaatgtttttccagcaaatcactggctttaatgcttttatgtactatgcggcaataatattttccaaatttaatataaaaaaccctctactgcctccaattttgattgcctcaacgaacttcatattcacttttttcgccatgtacaccatggactctttgggaagaagagccattcttttgagaacaattttgattatgactgttgggttacttctttgcagtgtaggtttcggtcatgaccaagtcaatttacttttaatttctgttgtaatttatgttgcagcatatgcttctgcgatgggcagcgttccatggacctgtgtggaatttctccccttgaacaggagatcatttggggcatcatgtatagcctgcacaaattggttgaccaatgcatttgtttcaatgacatatctgagcactattaacaccattggtgatgaaaatacaatgctcatttttgcttttttcacagtttgtgcctggtttttcgtatatttttggtatccagaagtcaaaggtttgtcactggaagaggttggaagggtttttgataatggaattgatgttcattatgtctttcgtacctaccattga

SEQ ID NO: 7825 - protein, 555 aa, Saccharomyces cerevisiae
MSTDESEDVYSDLYSIISQVTSNTANDIEQLPYALTFKTSLIFVGATIGGLLFGYDTGVISGVLLSLKPEDLSLVVLTDVQKELITSSTSVGSFFGSILAFPLADRYGRRITLAICCSIFILAAIGMAIARTLTFLICGRLLVGIAVGVSAQCVPLFLSEISPSRIRGFMLTLNIIAITGGQLVSYVIASLMKEIDNSWRYLFALSAIPAILFLSILDFIPESPRWSISKGDILYTRDSLRMLYPTASTYHVNSKIKQLIIELDKLRLYEDASEPLLVQSQSVIRYMDSSTSGTLSPPNIKRLSSNTERTSNTMSSSSAYLSALRGPAPNGALASNKKKRHRMEPRTIRALIVGCMLMFFQQITGFNAFMYYAAIIFSKFNIKNPLLPPILIASTNFIFTFFAMYTMDSLGRRAILLRTILIMTVGLLLCSVGFGHDQVNLLLISVVIYVAAYASAMGSVPWTCVEFLPLNRRSFGASCIACTNWLTNAFVSMTYLSTINTIGDENTMLIFAFFTVCAWFFVYFWYPEVKGLSLEEVGRVFDNGIDVHYVFRTYH

SEQ ID NO: 7826 - DNA, 1542 bp, Arabidopsis thaliana (mouse-ear cress)
  CDS (1)..(1542)
atggcaggagggtcgtttggtccgaccggtgtggctaaggagagagcagaacaataccaagggaaagtcactagttatgttataatcgcttgccttgttgcagctattggtggatccatctttggatatgacattggaatctcaggaggagttacatcgatggatgagtttcttgaggagtttttccacacggtttatgagaagaagaagcaagctcatgaaagtaattactgcaaatatgataatcaaggcttagctgctttcacttcttcactctacttagctggtttggtttcgactctcgtggcttcacccatcactaggaactacggtaggcgtgcgagtattgtttgtggtggaatcagctttcttattggatctggtttgaatgctggagctgtgaacttagctatgcttcttgccggacggatcatgcttggtgttggtattgggtttggaaatcaggcggttcctttgtatttatcagaagtggcaccaactcatctacgaggtggtttaaacatgatgtttcagctagctacaactatcgggatctttacagcgaacatggttaattacggtactcaacagcttaagccttggggatggagactctctcttggtttagctgcttttccagctctgcttatgacgcttggcgggtatttcttacccgagacaccaaacagtttggtcgaaagaggattaacagagagaggtcgacgagtcttagtgaagctaagaggaacagaaaacgtcaacgccgagcttcaagacatggtagatgcgagtgagcttgcgaattccatcaaacatccattcagaaacatcttgcagaaacgacacaggcctcagctagttatggctatttgcatgccaatgtttcagatactcacagggataaactccattctcttctacgcacctgttctgttccagacaatggggtttggaggaaacgcatctctctattcatcagctttaacaggagctgttcttgtcctatcaacatttatttccataggattagtagacagattgggacgaagagctcttctcataactggaggaatacaaatgataatctgtcaagtcatagtagcagtgatcttaggagtgaaatttggagacaaccaagagctatcaaaagggtactcagtgatcgtagtcatcttcatctgcctctttgttgtagcgttcggatggtcatggggtcctctaggttggaccatacctagcgaaatctttccgttagagactcgttcagcggggcagagtatcacagtagctgtaaatctcctcttcactttcatcatagctcaagctttccttggtctcctctgtgcattcaagtttggaatcttcctcttctttgctggttgggtgacagtaatgactatctttgtgtatttcctgttgcctgaaaccaaaggagttccaatagaagagatgacactcttatggagtaaacattggttctggaaaaaagtattacctgatgcaacaaatcttgaagatgagagcaagaatgtatctgtttaa

SEQ ID NO: 7827 - protein, 513 aa, Arabidopsis thaliana (mouse-ear cress)
MAGGSFGPTGVAKERAEQYQGKVTSYVIIACLVAAIGGSIFGYDIGISGGVTSMDEFLEEFFHTVYEKKKQAHESNYCKYDNQGLAAFTSSLYLAGLVSTLVASPITRNYGRRASIVCGGISFLIGSGLNAGAVNLAMLLAGRIMLGVGIGFGNQAVPLYLSEVAPTHLRGGLNMMFQLATTIGIFTANMVNYGTQQLKPWGWRLSLGLAAFPALLMTLGGYFLPETPNSLVERGLTERGRRVLVKLRGTENVNAELQDMVDASELANSIKHPFRNILQKRHRPQLVMAICMPMFQILTGINSILFYAPVLFQTMGFGGNASLYSSALTGAVLVLSTFISIGLVDRLGRRALLITGGIQMIICQVIVAVILGVKFGDNQELSKGYSVIVVIFICLFVVAFGWSWGPLGWTIPSEIFPLETRSAGQSITVAVNLLFTFIIAQAFLGLLCAFKFGIFLFFAGWVTVMTIFVYFLLPETKGVPIEEMTLLWSKHWFWKKVLPDATNLEDESKNVSV

SEQ ID NO: 7828 - DNA, 1524 bp, Arabidopsis thaliana (mouse-ear cress)
  CDS (1)..(1524)
atggctgtggttatatcttctaatggtaattccaagtctttcgacgcgaagatgactgtttatgtcttcatctgtgtcattatcgcggctgtaggcggtttgatcttcggttacgacatcggaatctcgggtggagtaacggcgatggacgatttcttgaaggaatttttcccatctgtgtacgaaaggaagaagcatgcgcatgagaacaactattgcaagtatgacaaccagttcttgcagctcttcacttcctctctatacctagcggctctagtggctagcttctttgcttcggctacatgctctaagctcggacgcagacccacaatgcaactcgcttccatcttcttcttgatcggtgttggccttgccgcgggagctgttaacatatacatgttgatcattggtagaatcttgcttggattcggtgttggctttggtaatcaggcggtaccgcttttcttatcagagattgctcccgcgaggcttcgtggaggtctcaacattgttttccaacttatggttacaattggaatcctaattgctaacatagtcaactacttcacctcctcaattcatccttacggatggagaattgccctcggtggcgcgggaattccggctctcatcctcctctttggatcgcttctcatctgcgaaacacccactagtctcatcgaacggaacaaaaccaaggaaggaaaagaaacactcaagaagatcagaggcgttgaagatgttgatgaggagtatgaatcaatagtccatgcttgcgatatcgcaaggcaggtcaaggacccttacacgaaactgatgaaacccgcgagcaggccgcctttcgtgattggaatgttgctacagtttttccaacagttcactggaatcaacgcgattatgttctacgctccggttttgttccagactgtagggtttggaaatgacgcagctctgctttccgcggttgtcacgggaacgatcaacgttctcagcacgtttgtcgggattttccttgtcgacaaaactggccgaagatttctattgctccaatcttccgttcacatgctcatatgccagttggtcattggaatcatcctagccaaggacctagacgtgacgggtacgctagcacggccacaagccctagtagtggtgatcttcgtgtgtgtttacgtgatgggtttcgcttggtcatggggccctctaggatggctaatccctagtgagaccttccccttggagactcgaacggaagggttcgcattggccgtgtcttgcaacatgttcttcacgttcgtgatcgctcaggccttcctatcgatgctttgcgcgatgaagtcagggatattcttcttcttcagtggttggatcgttgtgatgggacttttcgctttgttcttcgtgccggaaacgaaaggagtctccattgatgacatgagagatagtgtgtggaagctacattggtactggaagaggtttatgctcgaggaagatgagcatgacgttgagaagagaactgattga

SEQ ID NO: 7829 - protein, 507 aa, Arabidopsis thaliana (mouse-ear cress)
MAVVISSNGNSKSFDAKMTVYVFICVIIAAVGGLIFGYDIGISGGVTAMDDFLKEFFPSVYERKKHAHENNYCKYDNQFLQLFTSSLYLAALVASFFASATCSKLGRRPTMQLASIFFLIGVGLAAGAVNIYMLIIGRILLGFGVGFGNQAVPLFLSEIAPARLRGGLNIVFQLMVTIGILIANIVNYFTSSIHPYGWRIALGGAGIPALILLFGSLLICETPTSLIERNKTKEGKETLKKIRGVEDVDEEYESIVHACDIARQVKDPYTKLMKPASRPPFVIGMLLQFFQQFTGINAIMFYAPVLFQTVGFGNDAALLSAVVTGTINVLSTFVGIFLVDKTGRRFLLLQSSVHMLICQLVIGIILAKDLDVTGTLARPQALVVVIFVCVYVMGFAWSWGPLGWLIPSETFPLETRTEGFALAVSCNMFFTFVIAQAFLSMLCAMKSGIFFFFSGWIVVMGLFALFFVPETKGVSIDDMRDSVWKLHWYWKRFMLEEDEHDVEKRTD

SEQ ID NO: 7830 - DNA, 1868 bp, Arabidopsis thaliana (mouse-ear cress)
  CDS (73)..(1653)
aacttaagtgtttctgtttaactccttgagagaaaataacttttaaactttagcttctaagagatattcaggatgaccggaggaggatttgcgacttcggcgaacggagtagagtttgaggcaaagataactccaatagtcatcatatcttgcatcatggctgctaccggcggcctcatgtttggttacgacgtcggtgtctccggcggagtgacatcgatgccggactttctcgaaaagttttttcccgtggtttatcggaaagtagtagctggcgccgacaaagacagcaactactgcaaatacgacaaccaaggactacaacttttcacatcatctttatacttagccggtctaaccgcaacgttctttgcttcatacacgacaagaacgctcggaaggaggctaactatgctcatagccggcgttttcttcatcataggtgtggctctcaacgcgggggctcaagacctagccatgcttattgcaggcaggatattgcttggttgtggagttgggttcgctaatcaagccgttccgttgttcttgtcggagattgcacctactaggatccgtggtggtcttaatattctctttcagcttaacgtcactattggtatcctcttcgccaatcttgtcaactatgggaccgccaagattaaaggaggttggggatggaggttatcgttaggtttggcgggaattcccgcgcttcttctaacggtcggagctttattggtgacagagacaccaaacagtttagtcgaaagaggtcgtctcgatgaaggtaaagctgttcttcgtcgtattcgagggaccgataatgttgaaccagagttcgctgatctccttgaagctagtcgacttgctaaagaagttaaacacccttttagaaaccttcttcaacgtagaaaccgtcctcagctcgtcatcgccgtcgctttacagattttccagcaatgtactggaatcaacgcgattatgttctacgcgcctgttctgttcagcacattagggtttggtagtgacgcttcactttactcagcagtggtgaccggagcagtcaacgtcctctcaactttagtctcaatctactccgttgacaaagtcggtcgccgagttcttctcctagaagctggtgtccaaatgttcttctctcaagtcgtaatcgccattatccttggcgtcaaagtaacagacacttctacaaatctctccaaaggtttcgcaattctagtcgtggtaatgatctgcacatacgtcgctgctttcgcctggtcttggggaccgctcgggtggttaatccctagtgagacattccctctagagacacgttccgcgggacaaagtgtaacggtctgcgttaacttgctcttcacgttcattatcgctcaagctttcctctctatgctttgccatttcaagtttgggatattcatcttcttttctgcatgggttttgattatgtctgtctttgtgatgttcctacttccggagactaagaatattcctatcgaggagatgactgagagagtttggaagaagcattggttctgggctaggttcatggatgatcataatgatcacgagttcgtgaatggtgagaagagtaatggtaaatctaatggctttgatccttcaacacggctttaaagtggtttaagagtccctaaccaaagtagaagcagaagagagtgaacaagaggtggtaaacacaccaaagtagagaagggaaatacagttttcaattctatacagtgtactaaatttcgttactttaagtttgaactgcgtttgtgaataagtgaagttttttttttttgctttgttgtggttcttaatgtcatccctgagttccaattttctac

SEQ ID NO: 7831 - protein, 526 aa, Arabidopsis thaliana (mouse-ear cress)
MTGGGFATSANGVEFEAKITPIVIISCIMAATGGLMFGYDVGVSGGVTSMPDFLEKFFPVVYRKVVAGADKDSNYCKYDNQGLQLFTSSLYLAGLTATFFASYTTRTLGRRLTMLIAGVFFIIGVALNAGAQDLAMLIAGRILLGCGVGFANQAVPLFLSEIAPTRIRGGLNILFQLNVTIGILFANLVNYGTAKIKGGWGWRLSLGLAGIPALLLTVGALLVTETPNSLVERGRLDEGKAVLRRIRGTDNVEPEFADLLEASRLAKEVKHPFRNLLQRRNRPQLVIAVALQIFQQCTGINAIMFYAPVLFSTLGFGSDASLYSAVVTGAVNVLSTLVSIYSVDKVGRRVLLLEAGVQMFFSQVVIAIILGVKVTDTSTNLSKGFAILVVVMICTYVAAFAWSWGPLGWLIPSETFPLETRSAGQSVTVCVNLLFTFIIAQAFLSMLCHFKFGIFIFFSAWVLIMSVFVMFLLPETKNIPIEEMTERVWKKHWFWARFMDDHNDHEFVNGEKSNGKSNGFDPSTRL

SEQ ID NO: 7832 - DNA, 1527 bp, Arabidopsis thaliana (mouse-ear cress)
  CDS (1)..(1527)
atgccttcagtcggaattgtcatcggagatggcaaaaaagaatatcctggtaaactcactctttacgtcaccgtgacatgtattgtcgccgccatgggtggtctcatcttcggttacgacatcggtatctccggtggagtgacgacaatggattcgtttcagcaaaagttcttcccgtcggtttacgagaaacagaagaaggatcatgattcaaaccaatactgcagatttgacagcgtttctctcactctcttcacttcctctctttacctcgccgcactctgctcctccctcgttgcctcttacgttacccgtcagtttggccggaaaatttcgatgcttctcggtggagttctcttctgcgccggagctcttcttaacggtttcgcaactgccgtttggatgctcatcgttggtcgtttgttactcggtttcggtatcggcttcaccaatcagtctgtgccgttgtatctctcggagatggcaccgtataaatacagaggagcattgaacatcggattccagctctcaatcaccattggtatccttgtcgccaacgttttgaacttcttcttctccaaaatcagttggggttggagactcagtctcggcggcgccgtcgttccggcactcatcatcaccgtcggttctcttatcctcccggacacaccaaactccatgatcgagagaggtcaatttaggctagcggaagcgaaactccgtaagattcgtggcgtcgacgacattgatgacgagatcaacgatttgatcatcgccagtgaagcttcgaagctcgttgagcatccatggaggaatctgttgcagaggaagtatagaccacatctaacgatggcgattctgattccggcatttcagcagcttaccggaatcaatgttataatgttctacgcgccggttctgtttcaaacgattggatttggtagcgacgcggctctgatttcggcggttgtgaccggtttggttaacgttggagccaccgtggtgtcaatctatggcgttgataaatggggaagacgatttctattccttgaaggaggattccaaatgctaatttctcaggtagctgttgcggcggcgatcggagctaagttcggtgtcgatggaaccccaggcgttttaccaaaatggtacgccattgttgtggttttgttcatatgcatctacgtggcggcgtttgcttggtcgtggggtccactaggatggttagtgccatcggagatttttccgttggaaatccgatcagcggctcagagcataacggtgtcggtgaacatgatcttcacgttcttgattgcacaagtgtttttgatgatgctttgccacttgaagttcgggttgttcatattcttcgcgtttttcgtggtggtgatgtcgattttcgtctatcttttcttaccggagacaagaggagtgccgatcgaggagatgaatcgggtctggagatcacattggtattggtcgaagttcgttgacgccgagaagaatctaacgaaagttgttatctag

SEQ ID NO: 7833 - protein, 508 aa, Arabidopsis thaliana (mouse-ear cress)
MPSVGIVIGDGKKEYPGKLTLYVTVTCIVAAMGGLIFGYDIGISGGVTTMDSFQQKFFPSVYEKQKKDHDSNQYCRFDSVSLTLFTSSLYLAALCSSLVASYVTRQFGRKISMLLGGVLFCAGALLNGFATAVWMLIVGRLLLGFGIGFTNQSVPLYLSEMAPYKYRGALNIGFQLSITIGILVANVLNFFFSKISWGWRLSLGGAVVPALIITVGSLILPDTPNSMIERGQFRLAEAKLRKIRGVDDIDDEINDLIIASEASKLVEHPWRNLLQRKYRPHLTMAILIPAFQQLTGINVIMFYAPVLFQTIGFGSDAALISAVVTGLVNVGATVVSIYGVDKWGRRFLFLEGGFQMLISQVAVAAAIGAKFGVDGTPGVLPKWYAIVVVLFICIYVAAFAWSWGPLGWLVPSEIFPLEIRSAAQSITVSVNMIFTFLIAQVFLMMLCHLKFGLFIFFAFFVVVMSIFVYLFLPETRGVPIEEMNRVWRSHWYWSKFVDAEKNLTKVVI

SEQ ID NO: 7834 - DNA, 2118 bp, Lycopersicon esculentum (tomato)
  CDS (93)..(1664)
aattcggcacgagttttcttatataaaaaacatatcatcttcttattgttattttaactaccacatttgaagccggaaaacttagtaacacgatggccggtggaggatttacgacctccggtaacggagcacgcatttcgaggctaaaatcacaccaattggttatcatatcttgtattatggctgctaccggaggtctcatgtttggttatgatgttggagtttctggtggtgttacatcaatggatccatttttaaaaaaattctttccaacagtttataagagaacaaaggagccaggattagacagtaattactgtaaatacgataatcaagggttacaattatttacttcatcgttatacctagctggtttaacggcgacgttttttgcttcttacactacaagaaaacttggccggagattaactatgttaatcgccggttgttttttcattattggagttgtactaaatgctgctgctcaagatttagctatgcttattattggaagaattctccttggttgtggcgttggtttcgccaatcaggctgttccattatttttatcagaaatagcacctacaagaattcgtggaggacttaacattttgttccaacttaacgtaactattggtattctttttgccaatctcgtcaactacggaacagccaagattagtggaggatggggatggagattatcattagggttagctggatttccagcagtattgttgactttgggcgcattatttgttgttgaaaccccaaacagtttgattgaaagaggttacttagaagaaggcaaagaagtacttcgaaaaatcagaggtaccgacaacattgaacctgaattcttggaacttgttgaggctagtcgtgttgctaaacaagtcaaacaccctttcagaaatttactccaacgtaaaaatagacctcaattaatcatctctgttgccctccagatattccaacaatttacaggaatcaacgctattatgttctacgcacctgttttattttcaacactagggtttggaaacagcgcagctctttactcagctgtcatcaccggagcagtcaacgttctctccaccgttgtctcagtctactccgttgacaagctcggacgacgagtcctcctcctggaagctggggtccaaatgttactatctcaaataataatcgctataatcctaggtatcaaagttactgatcattcagacaaccttagccatggttggggaatcttcgtagtagttctgatctgtacatatgtatcggctttcgcatggtcatggggcccacttggatggttaattcctagcgagacgttccctttggaaactcgttcagctggtcaaagtgtaacagtgtgtgttaacttgcttttcacgtttgttatggcacaagcatttctctcaatgctttgtcatttcaagtatgggatattcttgttcttctcggggtggatttttgtgatgtcgttgttcgttttcttcttggtgcctgagacgaagaatgttcctattgaggagatgacggagagggtgtggaagcaacattggctgtggaagaggtttatggtgaatgaagatgatgttgatatgattaaaaagaatggacatgctaacggatatgatcccacttctcggttgtaaaataaaaaataaaagaatattagcggtgttttacgttgattttatcatagtaaagatgcgtagaaataaatcaaacatgcaagagagagatcagagtctactgtctagtctagtgatatcgataagtgtttctcacaaaataggtgtgcatttggattttttttactgcttgttttcctcctttatatcgttcaatgtagtagaaattgtttagccaaagtgtaagagatgcaatatggtgataatttatgtaaccatatagcctatgtatattagagatttggtataattcattttgggaaagcactttgatatgtttaatttcttgttatgtatgtatgacaaggtgtctagttataatgataaggcccaatagaggtttgcatgttgagtattgagacacaaaaatgaaaaaaaattacgctcaatgatcttgaaaaaaaaaaaaaaaaaa

SEQ ID NO: 7835 - protein, 523 aa, Lycopersicon esculentum (tomato)
MAGGGFTTSGNGARISRLKSHQLVIISCIMAATGGLMFGYDVGVSGGVTSMDPFLKKFFPTVYKRTKEPGLDSNYCKYDNQGLQLFTSSLYLAGLTATFFASYTTRKLGRRLTMLIAGCFFIIGVVLNAAAQDLAMLIIGRILLGCGVGFANQAVPLFLSEIAPTRIRGGLNILFQLNVTIGILFANLVNYGTAKISGGWGWRLSLGLAGFPAVLLTLGALFVVETPNSLIERGYLEEGKEVLRKIRGTDNIEPEFLELVEASRVAKQVKHPFRNLLQRKNRPQLIISVALQIFQQFTGINAIMFYAPVLFSTLGFGNSAALYSAVITGAVNVLSTVVSVYSVDKLGRRVLLLEAGVQMLLSQIIIAIILGIKVTDHSDNLSHGWGIFVVVLICTYVSAFAWSWGPLGWLIPSETFPLETRSAGQSVTVCVNLLFTFVMAQAFLSMLCHFKYGIFLFFSGWIFVMSLFVFFLVPETKNVPIEEMTERVWKQHWLWKRFMVNEDDVDMIKKNGHANGYDPTSRL

SEQ ID NO: 7836 - DNA, 1779 bp, Ricinus communis (castor bean)
  CDS (86)..(1657)
ctctgtttaagcttcttgttctatttctgtttctctgcaaggaagtgtacgtagcatataactaagagccaaaaaagaaaaaaaaatgcctgcagtaggaggtataccgccctctggtggcaacaggaaagtgtacccgggaaaccttactctttatgttactgtaacatgtgtcgttgcagccatgggtggcttgatctttggttacgatattgggatttctggtggagttacgtccatggattcattcttgaagaagttctttccttcagtttaccggaagaagaaagcggatgaatcgtcaaaccagtactgtcaatatgatagtcagacactgactatgttcacatcttcactgtacttggctgctttaattgcttctcttgtagcatctactattacgagaaaatttggtaggaaactctctatgctttttggcggtgtactcttttgtgctggagctatcatcaatggtgcggctaaagcagtctggatgttgattcttggtagaattttgcttggttttggtattgggtttgccaatcagtctgtgccgctctacctctctgagatggctccatacaaatacagaggagcactgaacattggtttccagttatcaattacaattggtatccttgtagccaatgtattgaattacttctttgccaagattaagggtggttggggttggaggctgagtcttggtggtgctatggtccctgccctcatcattacagttggatcattagtccttccagatacaccaaactccatgattgaacggggccagcacgaagaagccagagcacatctaaagagagttcgcggtgtagaagatgttgatgaggagtttactgaccttgttcatgctagtgaagattcaaagaaagttgaacatccttggaggaatttgttacagaggaaatacaggcctcatctctcaatggccattgcaattccgttctttcagcaactcaccggcattaatgtgatcatgttctatgctcctgttttgttcgatactattggattcggtagtgatgctgcactcatgtctgctgtgatcactggtcttgttaatgtttttgcaacaatggtctcaatttatggtgttgataagtggggaaggaggttccttttccttgagggtggagttcaaatgttgatttgccaggcaattgttgcagcctgcattggtgctaagtttggagtagatggagctcccggtgacttgccacaatggtatgcagtcgttgtggtgcttttcatttgcatttacgtatctggattcgcctggtcttggggtcccctgggatggctggtgccaagtgaaatcttcccactggaaattcggtctgctgcacaaagtgtgaatgtttctgtcaacatgttctttacatttgtagtagctcaagtattcctgataatgctttgtcatttgaagtttgggctattcatcttcttttcattctttgtgttgataatgtccatcttcgtgtactacttcttgcctgagacaaaaggcatcccaattgaagagatgggccaagtatggaagcaacactggtactggtcaagatatgttgtggatgaagattatcctaatggagggcttgaaatgggcaaggaaggccgaattccaaagaatgtgtaactaagcttggtggatttattttagcttatattttgaacccttttcccttttcttcttaccttttgggattagcagcagtacatactaatgatttcaatatcaaaaattatgtggaaattttt

SEQ ID NO: 7837 - protein, 523 aa, Ricinus communis (castor bean)
MPAVGGIPPSGGNRKVYPGNLTLYVTVTCVVAAMGGLIFGYDIGISGGVTSMDSFLKKFFPSVYRKKKADESSNQYCQYDSQTLTMFTSSLYLAALIASLVASTITRKFGRKLSMLFGGVLFCAGAIINGAAKAVWMLILGRILLGFGIGFANQSVPLYLSEMAPYKYRGALNIGFQLSITIGILVANVLNYFFAKIKGGWGWRLSLGGAMVPALIITVGSLVLPDTPNSMIERGQHEEARAHLKRVRGVEDVDEEFTDLVHASEDSKKVEHPWRNLLQRKYRPHLSMAIAIPFFQQLTGINVIMFYAPVLFDTIGFGSDAALMSAVITGLVNVFATMVSIYGVDKWGRRFLFLEGGVQMLICQAIVAACIGAKFGVDGAPGDLPQWYAVVVVLFICIYVSGFAWSWGPLGWLVPSEIFPLEIRSAAQSVNVSVNMFFTFVVAQVFLIMLCHLKFGLFIFFSFFVLIMSIFVYYFLPETKGIPIEEMGQVWKQHWYWSRYVVDEDYPNGGLEMGKEGRIPKNV

SEQ ID NO: 7838 - DNA, 1966 bp, Ricinus communis (castor bean)
  CDS (63)..(1595): n means a or g or c or t/u, s means g or c
tctggttctccctcttacaagacactggtgtgagtgagcttgcaatcggaaggttcagaaatatggctgcaggattggccattacaagtgaagggggtcagtacaatggcaggatgacctcctttgttgctctatcttgcatgatggctgccatgggaggagtcatttttggctatgatattggagtttcaggtggtgtgacatcaatggatcccttcttgaagaaattctttccggatgtgtacaggaaaatgaaagaagacacagaaattagcaactactgcaagtttgatagtcaacttttaacctccttcacatcctcactatatgttgctggccttgttgcttccttcttcgcctcgtcggtcactagagcttttgggcgcaagccatcaattcttttaggcggtgnngttttccttgccgnngcagcccttggtggtgctgcagttaatgtgtatatgttgatatttggccgcgtcttgcttggagttggtgtcggttttgcaaaccaggcagttccactttatctgtctgaaatggcaccgccaagatatagaggggcaatcaacaacggcttccaatttagtgttggtattggggcattgtctgccaaccttataaactatggaactgaaaagattgaaggtggctggggttggcgaatttccctagcaatggcagcagttccagctgcaatcctgacatttggtgcacttttcctcccagagacacccaatagcctgattcagcgcagcaatgatcatgagagagccaaacttatgttacaacgtgtgcgaggtaccactgatgtccaagcagaacttgacgatctcatcaaagctagcataatctcaagaactattcagcacccatttaagaatataatgcgaagaaagtatcggcctcaactagtaatggcagtagccataccatttttccagcaagtaacagggatcaatgtcattgcattttatgctccaatacttttcaggacaatcggcctggaagaaagtgcatccctcttatcttctattgtgacagggcttgtgggtagtgcgtcaacgttcatatcgatgcttatagtcgataaacttggaagaagagcattgtttatatttgggggtgtacagatgtttgtagcacagataatggttgggagtattatggcagctgagctaggcgatcatggtggtataggtaaagggtatgcttatatagttctgattttgatctgtatttacgtggctggattcgggtggtcatggggtcctcttggatggttggttcctagtgagatattcccattagagattcgatcagcagggcaaagtattgtggtggcagtgagctttttattcactttcgttgttgcacaaacttttctatctatgctttgccacttcaaatctggaattttcttcttttttggaggatgggttgtagtgatgactgcctttgtgcactttttgctgccagagacgaagaaggtgccaattgagaaaatggatatagtgtggagggaccactggttttggaagaaaattataggggaagaagctgctgaggaaaataataaaatggaagcagcatgaaatacaatcaattagtcaaattttattgctctacaaattcattttacaactgaagtaaagaatgacagattttacttatattcccactcactttccctgcgtttgatcaaggaaatgatgaaaggtcgttagcccttgttaggctcagtactaaaactaggtgaagagagtgttatacttgaatgtaatttcgatcattaacataatcaaactaaatgaagctgagttaaaatgaaatttgagcatgtgaaacagtaggtcaagctttccctatctctactaggatgtagaacaaagtcctatcgagaagaagaaaaaagaaattatctattgtaccagctggtttttttttttaaatttaattctttagc

SEQ ID NO: 7839 - protein, 510 aa, Ricinus communis (castor bean)
  Xaa in position 117 and 122 is unknown
MAAGLAITSEGGQYNGRMTSFVALSCMMAAMGGVIFGYDIGVSGGVTSMDPFLKKFFPDVYRKMKEDTEISNYCKFDSQLLTSFTSSLYVAGLVASFFASSVTRAFGRKPSILLGGXVFLAXAALGGAAVNVYMLIFGRVLLGVGVGFANQAVPLYLSEMAPPRYRGAINNGFQFSVGIGALSANLINYGTEKIEGGWGWRISLAMAAVPAAILTFGALFLPETPNSLIQRSNDHERAKLMLQRVRGTTDVQAELDDLIKASIISRTIQHPFKNIMRRKYRPQLVMAVAIPFFQQVTGINVIAFYAPILFRTIGLEESASLLSSIVTGLVGSASTFISMLIVDKLGRRALFIFGGVQMFVAQIMVGSIMAAELGDHGGIGKGYAYIVLILICIYVAGFGWSWGPLGWLVPSEIFPLEIRSAGQSIVVAVSFLFTFVVAQTFLSMLCHFKSGIFFFFGGWVVVMTAFVHFLLPETKKVPIEKMDIVWRDHWFWKKIIGEEAAEENNKMEAA

SEQ ID NO: 7840 - DNA, 1861 bp, Ricinus communis (castor bean)
  CDS (102)..(1670)
tttagccctcaagacttgaggaatttgtacgtatttctattttgctctgctttttggttgagttttctgaggaacagaagggaacagcaggagctttaaagatggcaggagggtccttggcaccggccggtgtggccaaggaaagagcagaacaatatcaagggaaggtcacctttgctgtgttcgttgcctgtatggttgctgctgttggagggtcgatttttggatacgatattggaatctcaggaggagtgatctcaatggatgcatttcttgaaaaatttttccgtagtgtatatttaaagaagaagcatgcacatgaaaacaactactgcaaatacgacgaccaaaggctggcagcttttacctcttctctctaccttgctggattggctgcatctctagtggcaggtcctattactagaatatatggtcgccgtgcaagtataatttctggaggcattagctttcttattggtgcagccttgaatgccacagctattaatctggcaatgctcctcctaggacggatcatgctaggtgttggcataggatttgggaatcaggctgttccactatatttatcagagatggcgcctactcatcttcgaggaggactgaacattatgtttcagttagcaacaaccagtggaatctttacagcaaatatggtaaattatggtactcataagcttgaatcatggggatggagactctcactgggactagcagcagccccagctctcctaatgacaataggaggattacttctgcccgagacaccaaacagtttaattgaacaaggattgcatgagaaagggagaaatgtcctggagaaaatcagaggaaccaagcatgtagatgcagaatttcaggacatgctagatgcgagtgaattggctaactcaatcaagcatcccttcagaaacattcttgagaaaaggaacagaccgcaattggttatggcaattttcatgccaacgttccagattcttacaggcattaatattatcctcttctatgctcccccactgtttcaaagcatgggatttggaggaaatgccgcactctactcctcagctgtgactggagcagttctttgttcctctaccttcatttccatagcaacagttgacagactaggtagaagatttttacttatcagtggaggaatacaaatgataacatgccaggtaatagtggctataatcttgggagtaaaatttggggacaaccagcaactgtctaaaagcttctcagtgttggtggtaattatgatttgcctctttgttttagcttttggatggtcatggggtccattaggctggacagtaccaagtgagatatttccactcgaaacgcgatcagctggacagagcattacagtagctgtaaaccttttcttcactttcgtcatagcacagtctttcccttcacttctttgtgcattcaagtttgggatattcctcttctttgctggttgggttactgtcatgaccgccttcgtttacatcttcctgcctgaaaccaaaggagttcccattgaagagatgatattcctatggagaaagcactggttctggaagaaaatagtgccaggacaaccagaagttgatgatagtagggaaagcatggaaatgggtgaagctgttgcaagcagaattaagtagccccccttccataagaatttctcacctcaagaagaatttcccattcacagagatgcttttctttcatgccagaaatcagaaatgacttggccagatagccaattgattatgcaaatattttcctgtatgtgaaagggcaaaaccttttatgcaatgatgccctcagcatcctgtctagctttccagactcg

SEQ ID NO: 7841 - protein, 522 aa, Ricinus communis (castor bean)
MAGGSLAPAGVAKERAEQYQGKVTFAVFVACMVAAVGGSIFGYDIGISGGVISMDAFLEKFFRSVYLKKKHAHENNYCKYDDQRLAAFTSSLYLAGLAASLVAGPITRIYGRRASIISGGISFLIGAALNATAINLAMLLLGRIMLGVGIGFGNQAVPLYLSEMAPTHLRGGLNIMFQLATTSGIFTANMVNYGTHKLESWGWRLSLGLAAAPALLMTIGGLLLPETPNSLIEQGLHEKGRNVLEKIRGTKHVDAEFQDMLDASELANSIKHPFRNILEKRNRPQLVMAIFMPTFQILTGINIILFYAPPLFQSMGFGGNAALYSSAVTGAVLCSSTFISIATVDRLGRRFLLISGGIQMITCQVIVAIILGVKFGDNQQLSKSFSVLVVIMICLFVLAFGWSWGPLGWTVPSEIFPLETRSAGQSITVAVNLFFTFVIAQSFPSLLCAFKFGIFLFFAGWVTVMTAFVYIFLPETKGVPIEEMIFLWRKHWFWKKIVPGQPEVDDSRESMEMGEAVASRIK

SEQ ID NO: 7842 - DNA, 1672 bp, Vicia faba (fava bean)
  CDS (18)..(1568)
cttcatcggagaaaaaaatgcctgcagccggaatccccatcggagcggggaacaaggagtaccccggaaacttaactcctttcgtcaccataacatgtgttgttgcagccatgggtggtttgatctttggttacgatataggaatttcaggtggtgttacttcaatgaatccgtttcttgagaaattttttccggcggtgtaccggaagaaaaacgcgcaacattcgaagaatcagtactgtcaatacgacagtgagacactgaccttgttcacatcctcgttgtacctggccgcgcttttgtcgtcggtggttgcttcaacgatcactagaaggtttggtcggaaactctccatgcttttcggaggcttgctttttctggtcggtgctctcattaatggccttgctcaaaacgttgcgatgttgatcgtcggtcggatcttgctcggattcggtatcgggtttgcgaatcagtctgtgccattatacttgtctgagatggctccatacaagtacagaggagcgttgaatattggatttcaattgtcaattacaattggaatacttgtggccaatattttgaactacttttttgccaaaatcaaaggtggatggggatggagattgagtttaggtggtgctatggtccctgcacttataataaccattggttcgctaatcctacccgacacgccaaattccatgatcgagcgtggggatcgagatggtgccaaggcacagcttaagagaattcgcggagttgaagatgttgatgaagagtttaatgatcttgtggctgctagtgaaacgtcgatgcaggttgaaaatccttggaggaatttgttgcagagaaaatatagacctcagcttactatggctgtgttgattccgttcttccaacagtttactggaattaacgttattatgttttacgcgcctgtgttgtttaactcgattgggtttaaggatgatgcttcacttatgtcagctgttatcaccggtgttgttaacgttgttgctacttgtgtctcaatttatggagttgataagtgggggagaagagctctttttctcgaaggtggtgttcaaatgcttatttgtcaggttgcagttgcagtttcaattgcggccaagtttggaacaagtggagaacctggtgatttaccaaagtggtatgctatagtagttgtgcttttcatatgcatttacgttgctggatttgcttggtcatggggtcctcttggttggttggtgcctagtgagatttttccattggagatccgttctgctgcgcagagtgtcaacgtgtcggtcaacatgctcttcaccttcttagttgcacagattttcttgaccatgctttgtcacatgaagtttggattgttcctcttctttgccttctttgtggtggtgatgacaatttatatatacactatgctgcctgaaactaagggaataccaattgaagagatggatagagtatggaaatcacacccatattggtctagatttgttgaacatgatgacaatggtgttgagatggccaagggaggtgttaaaaatgtataatttatcagtcttgcttttatttttatttttgttactaattagttttatttttattttgcttgtgaagcttggtattgaattgtccttaaaaaaaaaaaaaaaaa

SEQ ID NO: 7843 - protein, 516 aa, Vicia faba (fava bean)
MPAAGIPIGAGNKEYPGNLTPFVTITCVVAAMGGLIFGYDIGISGGVTSMNPFLEKFFPAVYRKKNAQHSKNQYCQYDSETLTLFTSSLYLAALLSSVVASTITRRFGRKLSMLFGGLLFLVGALINGLAQNVAMLIVGRILLGFGIGFANQSVPLYLSEMAPYKYRGALNIGFQLSITIGILVANILNYFFAKIKGGWGWRLSLGGAMVPALIITIGSLILPDTPNSMIERGDRDGAKAQLKRIRGVEDVDEEFNDLVAASETSMQVENPWRNLLQRKYRPQLTMAVLIPFFQQFTGINVIMFYAPVLFNSIGFKDDASLMSAVITGVVNVVATCVSIYGVDKWGRRALFLEGGVQMLICQVAVAVSIAAKFGTSGEPGDLPKWYAIVVVLFICIYVAGFAWSWGPLGWLVPSEIFPLEIRSAAQSVNVSVNMLFTFLVAQIFLTMLCHMKFGLFLFFAFFVVVMTIYIYTMLPETKGIPIEEMDRVWKSHPYWSRFVEHDDNGVEMAKGGVKNV

SEQ ID NO: 7844 - DNA, 2020 bp, Beta vulgaris (beet); identical to SEQ ID NO: 229
  CDS (190)..(1662)

SEQ ID NO: 7845 - protein, 490 aa, Beta vulgaris (beet); identical to SEQ ID NO: 230

SEQ ID NO: 7846 - DNA, 1925 bp, Beta vulgaris (beet)
  CDS (40)..(1689)
ctctttttctctctcttattggtgagaaataagtgagccatgagtgaaggaactaataaagccatgtcagacccaccaccaacaactgcaagcaaagtaatagcagattttgatcctttaaagaagcctcctaagagaaacaagtttgcttttgcttgtgctactttggcttctatgacttctgttttacttggttatgacattggagtaatgagtggtgcaataatctacctcaaagaagactggcacattagtgacacacaaataggagttctagtcggaatcttaaacatctactgcctcttcggctctttcgcagctggtagaacatccgattggatcggacgacgttacactatcgtgttagctggtgcaatcttcttcgttggcgcactactcatgggtttcgccacaaactacgcatttcttatggtaggccgttttgtaacaggaataggtgttggttatgcacttatgatcgcacctgtttacactgcagaggtttctcctgcttcttcaagaggatttcttacctcttttcctgaggttttcatcaatgcaggaattttgcttggatatatatctaatctcgcattttcaagcctcccaactcatttgagctggaggtttatgctcggaatcggggcgattccgagcatatttttggctattggagtgcttgctatgcctgagtcaccgaggtggcttgttatgcagggaaggcttggagatgctaagaaggtgcttaatcgaatatctgactcgcctgaggaggctcaacttaggctcagtgagattaagcagacagcaggaatcccagctgagtgtgatgaagacatatataaggttgaaaaaacaaagataaaatcagggaatgcagtttggaaagagctcttcttcaaccctactcccgcagtgaggcgtgcagtgattgcaggtatcggaattcactttttccagcaagcttccggcatcgacgccgtggttttatacagtccaaggatctttcagagtgctggaatcacaaatgcacgtaaacagttacttgcaacagtagctgtaggagttgttaagacacttttcatattagttgctacatttcaattagacaagtatggtagaaggcctttactattaacaagtgttggtggtatgatcatagccatcttaaccttagccatgtctttaactgttattgatcactctcatcacaagattacatgggctatagccttgtgtataaccatggtttgtgctgtcgttgcgtcgttttcgattggtttaggaccaattacatgggtatatagttcagaggttttccccttgaggttaagggctcaaggtactagcatgggtgtggctgttaatagagttgtaagtggtgttatttcaatatttttcttgcctttgtcacataagattacaacaggtggtgccttctttttgttcggagggattgctattattgcttggttcttcttcttgacgtttcttcctgagactagagggcgtacacttgagaatatgcatgagttgtttgaagattttagatggagggagtcatttccaggcaacaagtcaaataatgatgagaatagtacaagaaaacaaagcaatggtaatgacaagagtcaagtacaattgggagaaactactactagtactactgttacaaatgacaatcactgagaaacaattgttagtgtacaagtatagttatgtacggatgttatgtcatgtatagctgttcgacttttaatgataattaatcttaagtcgaacaagcttctaagatgtgtgtgtataacatggcgtgatgtacgcgcttgttatacacatgttgttcttagaatgtgatcctctttattttcgcaaatacattgtagcaaattaaagtaatctaattataggataccaaatggaaa

SEQ ID NO: 7847 - protein, 549 aa, Beta vulgaris (beet)
MSEGTNKAMSDPPPTTASKVIADFDPLKKPPKRNKFAFACATLASMTSVLLGYDIGVMSGAIIYLKEDWHISDTQIGVLVGILNIYCLFGSFAAGRTSDWIGRRYTIVLAGAIFFVGALLMGFATNYAFLMVGRFVTGIGVGYALMIAPVYTAEVSPASSRGFLTSFPEVFINAGILLGYISNLAFSSLPTHLSWRFMLGIGAIPSIFLAIGVLAMPESPRWLVMQGRLGDAKKVLNRISDSPEEAQLRLSEIKQTAGIPAECDEDIYKVEKTKIKSGNAVWKELFFNPTPAVRRAVIAGIGIHFFQQASGIDAVVLYSPRIFQSAGITNARKQLLATVAVGVVKTLFILVATFQLDKYGRRPLLLTSVGGMIIAILTLAMSLTVIDHSHHKITWAIALCITMVCAVVASFSIGLGPITWVYSSEVFPLRLRAQGTSMGVAVNRVVSGVISIFFLPLSHKITTGGAFFLFGGIAIIAWFFFLTFLPETRGRTLENMHELFEDFRWRESFPGNKSNNDENSTRKQSNGNDKSQVQLGETTTSTTVTNDNH

SEQ ID NO: 7848 - DNA, 1820 bp, Picea abies (Norway spruce)
  CDS (33)..(1574)
ggacagagcagcggagattgaaataaggtaaaatggcggggggcatggcggtcagcaggccgaagcaaggcagggctgagctctatgaagggcatattactgcatatgtgatattagcatgcatagttgctgctacaggaggttcgcttttcggctatgatcttggagtttcaggaggagtaacatccatggacgatttcctcaaaaagttttttcgacatgtttatgaacgaaagcagcatcacctccgtgaaacagactactgcaaatacgacaaccagctgctcactctgttcacttcgtcgctttatctttctggcctggttgccacattcggggcctcgtatataacgagaagcaagggacgaagagtaagcattataatcggaggcctcagtttcctcctaggggcgatcttgaacgctgccgcgaaaaatctcggcatgcttatagtcggccgtattcttctcggcgccggcgttggattcagcaaccagtcggtgccgctgtatctctcagaaatggcaccggccaaggtacggggtgggacgaacaatttgttccagctcaagacttgtctcggcatcttcgtcacaaatgtcataaattacttcacaaacaaacttcatccatggggctggcgtttatctttaggcctggccgtcattcccgcccttctgatgtccatcggcggctattttctgccggaaacaccgaacagcctggtggagcaggggcggctacaggaaggccgccagattcttgaaaagatccgaggcacgaagaacgtgcaagctgaattcgatgacctggttgaggccagcgatgttgcgcgggccgtgaagcatcctttccggaatcttctgcagaggagaaacaggccgcagctggtcatggggacgtgcattccagcgttccaacaattgacggggaacaactcgtttctgttctatgcgccggtgatcttccagagcctgggaatggggaacgacgcctcgctctactccgcgatcatgacaggcgcagtcataacgttcggcgctctcgtctcaatgttcacagtcgacagggtcggacggagatttctcttcatggagggtggaacgcaaatgatcgtctgccacgttattattagcatattgcttaaatcaaacttcgggaaaggtgagaaaattccgacgggctacggcgttggaatcgtgctcttgatatgtattttttacttgcttgcgtatgggtggctgtgggggccactctcatggctggtgtgcagcgagattttcccgatggaaagcctggtggtctgcgtcaacctgttcttcaccgcggtaatcgcccagtcgttcctggcacttctctgtcatttgaagtacgggatattcctgctgttcgggggtttggtcttcatcatgagcgtcgtcatttactttttcctgccagagacaaagaacgttcccatcgaagagatgaggtttcaatgggccaagcattggtactggaagagattcatggacgaatacatggacaatgatgacgaaaatgaaaaaggaaacatgacaaaagcagcggcgtagaagaaaaacacaaaatctgtgtgccaggcttgacgctgacctcaatcgggactacgggctgttattttatagatgtaaatgaagggaattttgagcaggacataattcccattccttttttattatgaattttttaatcaatgaatactgggcttctgctctggtttgtttgtgtgaatggctgtaaaaattatttgggaagtttgttagttgagcatgcttcttcgccaaaaaaaaaaaaaaaaa

SEQ ID NO: 7849 - protein, 513 aa, Picea abies (Norway spruce)
MAGGMAVSRPKQGRAELYEGHITAYVILACIVAATGGSLFGYDLGVSGGVTSMDDFLKKFFRHVYERKQHHLRETDYCKYDNQLLTLFTSSLYLSGLVATFGASYITRSKGRRVSIIIGGLSFLLGAILNAAAKNLGMLIVGRILLGAGVGFSNQSVPLYLSEMAPAKVRGGTNNLFQLKTCLGIFVTNVINYFTNKLHPWGWRLSLGLAVIPALLMSIGGYFLPETPNSLVEQGRLQEGRQILEKIRGTKNVQAEFDDLVEASDVARAVKHPFRNLLQRRNRPQLVMGTCIPAFQQLTGNNSFLFYAPVIFQSLGMGNDASLYSAIMTGAVITFGALVSMFTVDRVGRRFLFMEGGTQMIVCHVIISILLKSNFGKGEKIPTGYGVGIVLLICIFYLLAYGWLWGPLSWLVCSEIFPMESLVVCVNLFFTAVIAQSFLALLCHLKYGIFLLFGGLVFIMSVVIYFFLPETKNVPIEEMRFQWAKHWYWKRFMDEYMDNDDENEKGNMTKAAA

SEQ ID NO: 7850 - DNA, 1920 bp, Caenorhabditis elegans
  CDS (1)..(1920)
atggttcaagtggcgccggtggcagctggtgctggaagtggtcagacaaggccttcgtcagatcccaaaacaggatggtttgtgtacatgctcgcgttttctgcagtcataggaggatttctattcggatatgacactggaatcgtgtcagcagctatgctttatgttccaaatgcatctggaattaaacctctagactctgtttggcaggaaattatagttagtattacaccgggagtcgccgcaattggatcactatgttcgggtcctggatcggattttctcggaagaaaaaagataatcattggagcaagtgtaacttttacaattggagcaattatttgtgcagctgcatggactaaaataatccttttaattggcagaattttactcggacttgcgattggattcgcttcaatgattgttccaatctatgtatctgaagcttctccatcacatattcgtggaaaattggtgacaggatttcaactgatgattactgtaggtttggtgattgcaaatattattggaggagcttttagttatgtcgatccggatcaagttgggtggagacaaaaatcagatttttttttggaatttttgcttccaaacagtcagctgatctcaattttctctaaattccacttccaatccttcccaaacccgccgttttccagattaatgttcgccttcgcagccgtcccagccatcatccaattcgtctgcttcctgtttcttccagagtcccctcgttggctctacgagcacgggcggactgttgaagcacgtgaagtactcacaagaatctataatggacatacagaatgggttgattatgagattaatgaaattagtttctcgtatgaagaggagctacgtgccaaagcagaacacgctggaaatgggccaactattattagaattttgaaaactccgcatgtgagaaaagcaatgattattggatctcttcttcaaatgttccagcaattgtccggtattaatacggttatgtactatactggtaatattattcgaagtgccggagttaaggacaatcacacaactatttggatttccgttggaacatcagcaatcaatttcctcggaaccttcattccaatcgcattggtagaacgtgtgggtcgtcgtgtgcttctccttgtctcaatgatcggtgtgattcttttcctgatcgcaatgggtgtctcattccttctaatcaataatgactcattgagaacattcgatcaacaaaactacactttgaactacaatccatctgtgaaacatgctgcaaagtgtctcaaatatagtaattgcgatttctgtgtaactgatgagaactgcggattttgcgagagcaaggttgctaaaaaaggatactgtctaccattcccatcggatgactctagtgactactctgccactggaatttgtgaattctcgaatttgacaaacaatggaacagatttcgagtgggaagacacctattgtcacactaaattcacagtattgccaattattattatggtcttttaccttttatcattctctgcaggttacgccccgctaccatgggttctaaacgccgaattttatccattatgggcgagaagtacagccgtatcggtatcaactgcatgcaattggatatttaatttaatagtctcactgacattcctgtcactttcccaggcagcaacaaaatatggaacattcttcatttattgtggatgcaccatggttgctcttgtattcgttttcttctttgttccagaaacaaaaggatattcaattgatgaagttgagatgttattcatgacaaaagaagagagaaggaaagctcagaaagttctggatgagagtaaagaagggaagcatcggaattctgttgcaatgtcttttgatactaaattctaa

SEQ ID NO: 7851 - protein, 639 aa, Caenorhabditis elegans
MVQVAPVAAGAGSGQTRPSSDPKTGWFVYMLAFSAVIGGFLFGYDTGIVSAAMLYVPNASGIKPLDSVWQEIIVSITPGVAAIGSLCSGPGSDFLGRKKIIIGASVTFTIGAIICAAAWTKIILLIGRILLGLAIGFASMIVPIYVSEASPSHIRGKLVTGFQLMITVGLVIANIIGGAFSYVDPDQVGWRQKSDFFLEFLLPNSQLISIFSKFHFQSFPNPPFSRLMFAFAAVPAIIQFVCFLFLPESPRWLYEHGRTVEAREVLTRIYNGHTEWVDYEINEISFSYEEELRAKAEHAGNGPTIIRILKTPHVRKAMIIGSLLQMFQQLSGINTVMYYTGNIIRSAGVKDNHTTIWISVGTSAINFLGTFIPIALVERVGRRVLLLVSMIGVILFLIAMGVSFLLINNDSLRTFDQQNYTLNYNPSVKHAAKCLKYSNCDFCVTDENCGFCESKVAKKGYCLPFPSDDSSDYSATGICEFSNLTNNGTDFEWEDTYCHTKFTVLPIIIMVFYLLSFSAGYAPLPWVLNAEFYPLWARSTAVSVSTACNWIFNLIVSLTFLSLSQAATKYGTFFIYCGCTMVALVFVFFFVPETKGYSIDEVEMLFMTKEERRKAQKVLDESKEGKHRNSVAMSFDTKF

SEQ ID NO: 7852 - DNA, 1821 bp, Caenorhabditis elegans
  CDS (1)..(1821)
atggtcgctgttgccgcattttccagtagtgggcaggacaagcccgcgcatactcccaaattgggacttttcgtatatattttggctgccgcttcagtaattggcggttttctatttggatatgatacttctgtagtgtcggctgcaatgctttatatgcccgatgctccagggctcaagcctatggatactgtgtggcaggaggtgctggtcagtatttctccaggaatggctgctgtcggttcactgatgtctggtacctcctccgactatattggtcggcggaaagtgatcctcggagcttctgcaattttcacaattggagcattggtctgtgcggcttctgtgaacaaaattatgctcctagttggaagagttttgctgggaattgcaatcggatttgcttctatgattgtacccgtgtatctgggagaaaccgccccaactcacgtcagaggaatgctggtggccgcctttgccctgatgatcagtttcggtcaagtcgtcgcaaatatcacaggcggagcatttagttatattgatccatacaatgttggctggagattgatgttcgcctttgctgcagtaccttcaattatccagttcgtgtgcttcatgtttctcccggagaccccaagatggctctatgagaatggatttgagacggagacacgtgaggttctcgagaaagtgtataacggagataaagaatgggtagagtacgaaatggcggagatcattgctttcaatgaagatcaggctaaggaaaacgagaaagcccatgcctcgggcccagttatctggcggatcctgaagaccccacatgtcttgaaggcctgtttcatcggatccatgcttcaggccttccagcagcttgccggtatcaatacaatcctctactacacggcggatattattcggtcctctggaatttccaataatcacacaacgatttggatttcggtgcttctctcgctgtgcaactttatcgggcctttcgttccgatgagcttaatcgaaaaagtggggcgccgcattattttcctcttctcctgcggcttagtcgtcctgtcgttagtcttcatcggtgtggcgttcctcctggtaaaccatgactcggctgctacattgcctgcaaatcagtatggctctaactttaattcatcttatccagatgctaagggatgcatggcttatagcaactgcgactattgcgtgaccaccgatgcctgtggcttctgccacgacgccaataccaaacaggggtactgtcttccagcaggctttgataatcctgaagtgtactctagtacgggctcatgcacaaatagtaatggatccatcgccaacaacttcaaatgggaaaaatactactgtgacaccaagtacaccctcctgcctatcatcgcctgcggtgtctacctgctcaccttctcgtcgggcttcacctccctgccctgggtgctcaattcggagttctacccgatgtgggcccgatccacgtgtgtcgcaattagtaccacgtcaaattgggtgtttaacctgattattgcgctgacctacctttcattgactcaagttatcgggaaatacggagcattttggctatacgcgggcttaaccgttattgcgttcattttcatcctgtttttggtgcctgagacaaaaggatactccattgaagaggtagaaatgctatttatgaacaaaaaacaacgccgggaggcagagtccagacggcgagagacagtgacagaggtcaggagtcgaatgaacagtacggtttcttttggacaacacaatgaagtacataaatattga

SEQ ID NO: 7853 - protein, 606 aa, Caenorhabditis elegans
MVAVAAFSSSGQDKPAHTPKLGLFVYILAAASVIGGFLFGYDTSVVSAAMLYMPDAPGLKPMDTVWQEVLVSISPGMAAVGSLMSGTSSDYIGRRKVILGASAIFTIGALVCAASVNKIMLLVGRVLLGIAIGFASMIVPVYLGETAPTHVRGMLVAAFALMISFGQVVANITGGAFSYIDPYNVGWRLMFAFAAVPSIIQFVCFMFLPETPRWLYENGFETETREVLEKVYNGDKEWVEYEMAEIIAFNEDQAKENEKAHASGPVIWRILKTPHVLKACFIGSMLQAFQQLAGINTILYYTADIIRSSGISNNHTTIWISVLLSLCNFIGPFVPMSLIEKVGRRIIFLFSCGLVVLSLVFIGVAFLLVNHDSAATLPANQYGSNFNSSYPDAKGCMAYSNCDYCVTTDACGFCHDANTKQGYCLPAGFDNPEVYSSTGSCTNSNGSIANNFKWEKYYCDTKYTLLPIIACGVYLLTFSSGFTSLPWVLNSEFYPMWARSTCVAISTTSNWVFNLIIALTYLSLTQVIGKYGAFWLYAGLTVIAFIFILFLVPETKGYSIEEVEMLFMNKKQRREAESRRRETVTEVRSRMNSTVSFGQHNEVHKY

SEQ ID NO: 7854 - DNA, 1842 bp, Caenorhabditis elegans
  CDS (1)..(1842)
atggttgccgtggaattcaaagtgtctgaatcaggccggcctaggcctgagaaaaacccaaaattaggctttttcgtctacttattgggctctgccgccatcatcggtggcttcctattcgggtatgatacctctgtggtgtcggccgctatgctctacgtgccagaagctcccgggctcaagcctatgggaactgtgtggaaggaagtgattgtcagtattacaccaggtatggcagccgttggcgcctggttttcgggagccggctcggatcgctacggccgtaagccaattatcatcggctcaactctgatttttgtttgtggagccgttatttgtgccgttgcctggacaaaaatcgtaatgcttattggtagaattttcctgggcgttggtattggattcgcgtcaatggtggtgcctgtgtacctcggagaagcttcaccaacacacgtgcgcggaaccctcgtatcagcttttgcaatgatgatcagctttggacaagtcgtcgcgaacatcatgggcggtgtgttcagctactgggaaccctacaccatcggatggcggctcatgttcgcgttcgccggaattccagctctgatccaatttgtctgcttcatcttcttgccagagaccccaagatggctgtacgagaacggacacaccgagcaagccgagcaggttctggagaaaatctacggaggaaatacggaatggatcgagtacgagctggccgagattaagacttacgccgaggaacgccagaaacaaatggaggaagagaaaaaatctggcccggtaatctggagaatcctcaagacgccacacgtcctgaaggcctgcttcatcggatccatgcttcaggctttccagcagcttgccggtatcaacacaatcctctactacaccgccgacatcatcagaagtgctggaattgaaaactatcacactataatctggatttccgtgattttatcgatttgcaacctgatcggcccatttgctccgatgttcttcatcgaaaaactaggccgccgtaagcttttcctcttctcttgtgctggagtcgttgtctcgctggtgctcatcggtgtaagcttcctgctcgtcggcaacgattctgctccaaatttcgaccgctcggcttacctgctcgccggaaattatcagtcaaatggagaagccgagtcctgcctgatgctgagcaactgtgatagctgtgtaacttcggagcactgcggtttctgtgaagattcggagactagaactggcttctgcctgcctgtagatcacaatgacgtcactttatactcgtctactggcttgtgcacgaatggattggacaagagcaactcatcattccctaatgcaacctcgtatgtctggcaaaaacatcactgcaccacatcgtacacaatccttccaattgtcatgatgggtgtctacctgctcactttttcctgtggcttcacctccctgccatgggtcctcaactcggagttctatccgatgtgggcccgatcgacgtgtgtatcgattagtactttgtctaattgggttttcaacctaatcattgcactgacatatctttcactcacacacgctataacaaaatatggtgcattttggctttacgccatatttaccattattgcattcattttcatctacttcttggttcccgagactactggatattctattgacgaggttgaaatgctgttcatgaacaaacgccaacgcaacatcgccatgcaagctcgtcaagcaaaactggacgcagcatccgacaaagataaaaactcgtcaacttccctgtccactgagactataactatgtaa

SEQ ID NO: 7855 - protein, 613 aa, Caenorhabditis elegans
MVAVEFKVSESGRPRPEKNPKLGFFVYLLGSAAIIGGFLFGYDTSVVSAAMLYVPEAPGLKPMGTVWKEVIVSITPGMAAVGAWFSGAGSDRYGRKPIIIGSTLIFVCGAVICAVAWTKIVMLIGRIFLGVGIGFASMVVPVYLGEASPTHVRGTLVSAFAMMISFGQVVANIMGGVFSYWEPYTIGWRLMFAFAGIPALIQFVCFIFLPETPRWLYENGHTEQAEQVLEKIYGGNTEWIEYELAEIKTYAEERQKQMEEEKKSGPVIWRILKTPHVLKACFIGSMLQAFQQLAGINTILYYTADIIRSAGIENYHTIIWISVILSICNLIGPFAPMFFIEKLGRRKLFLFSCAGVVVSLVLIGVSFLLVGNDSAPNFDRSAYLLAGNYQSNGEAESCLMLSNCDSCVTSEHCGFCEDSETRTGFCLPVDHNDVTLYSSTGLCTNGLDKSNSSFPNATSYVWQKHHCTTSYTILPIVMMGVYLLTFSCGFTSLPWVLNSEFYPMWARSTCVSISTLSNWVFNLIIALTYLSLTHAITKYGAFWLYAIFTIIAFIFIYFLVPETTGYSIDEVEMLFMNKRQRNIAMQARQAKLDAASDKDKNSSTSLSTETITM

SEQ ID NO: 7856 - DNA, 1419 bp, Streptomyces coelicolor
  CDS (1)..(1419)
atggccagcacatcgcaggcgcccagtccaggagccgggacggctcatcccgatcatctcgggcacgtcatcttcatcgcggcggcggccgcgatgggcggtttcctgttcggttacgacagttccgtgatcaacggtgcggtcgaggcgatccgggaccgctacgacgtcggttccgcggtgctggcgcaggtcatcgccgtggctctgatcggctgtgccatcggtgccgcgaccgcgggccgtatcgcggaccgtatcggccgtatccgctgcatgcagatcgccgcggtcctgttcacggtgagcgccgtcggctccgcgctgcccttcgcgctgtgggacctggccatgtggcggatcatcggcggcttcgcgatcggcatggcctcggtgatcggccccgcctacatcgccgaggtgtccccgcccgcctaccgcggccggctcggttccttccagcaggccgcgatcgtcatcggcatcgccgtctcccagctggtcaactggggtctgctgaacgccgccggcggtgaccagcgcggcgagctgatgggcctggaggcctggcaggtcatgctcggcgtcatggtgatcccggccgtcctgtacggcctgctgtccttcgccatccccgagtccccccgcttcctgatctcggtgggcaagcgcgagcgcgccaagaagatcctcgaggaggtcgagggcaaggacgtggacttcgacgcccgcgtcaccgagatcgagcacgccatgcaccgcgaggagaagtcctccttcaaggacctcctcggcggcagcttcttcttcaagccgatcgtgtggatcggtatcggcctgtcggtcttccagcagttcgtcggcatcaacgtcgcgttctactactcctcgacgctgtggcagtcggtcggcgtcgaccccgccgactcgttcttctactcgttcacgacgtcgatcatcaacatcgtcggcaccgtgatcgcgatgatcttcgtggaccgcgtcggccgcaagccgctcgccctgatcggctccgtcggcatggtgatcgggctggcgctggaggcctgggccttctccttcgacctggtcgacgggaaactcccggccacccagggctgggtcgccctgatcgccgcccacgtcttcgtcctcttcttcgccctgtcgtggggcgtggtcgtgtgggtcttcctcggcgagatgttccccaaccggatccgcgccgccgcgctgggcgtggccgcctccgcgcagtggatcgccaactgggccatcaccgcgagcttcccgtcactggccgactggaacctctccggcacgtacgtgatctacacgatcttcgcggccctctccatccccttcgtcctgaagttcgtgaaggagaccaagggcaaggccctggaggaaatgggctga

SEQ ID NO: 7857 - protein, 472 aa, Streptomyces coelicolor
MASTSQAPSPGAGTAHPDHLGHVIFIAAAAAMGGFLFGYDSSVINGAVEAIRDRYDVGSAVLAQVIAVALIGCAIGAATAGRIADRIGRIRCMQIAAVLFTVSAVGSALPFALWDLAMWRIIGGFAIGMASVIGPAYIAEVSPPAYRGRLGSFQQAAIVIGIAVSQLVNWGLLNAAGGDQRGELMGLEAWQVMLGVMVIPAVLYGLLSFAIPESPRFLISVGKRERAKKILEEVEGKDVDFDARVTEIEHAMHREEKSSFKDLLGGSFFFKPIVWIGIGLSVFQQFVGINVAFYYSSTLWQSVGVDPADSFFYSFTTSIINIVGTVIAMIFVDRVGRKPLALIGSVGMVIGLALEAWAFSFDLVDGKLPATQGWVALIAAHVFVLFFALSWGVVVWVFLGEMFPNRIRAAALGVAASAQWIANWAITASFPSLADWNLSGTYVIYTIFAALSIPFVLKFVKETKGKALEEMG

SEQ ID NO: 7858 - DNA, 1674 bp, Schizosaccharomyces pombe; identical to SEQ ID NO: 233
  CDS (1)..(1674)

SEQ ID NO: 7859 - protein, 557 aa, Schizosaccharomyces pombe; identical to SEQ ID NO: 234

SEQ ID NO: 7860 - DNA, 2407 bp, Schizosaccharomyces pombe
  CDS (401)..(2128)
aaagattcattggttttattgttaagaagtgtgagacaaccattcttaattgctgacatttcaacactttctacttctctctttcgaaaattccggtcttatccgttgtaactgtttgttaacgtcttttttttcgtttaagaacagagttcctcggatacatcttttatctaagcggtaaatataacaagtttctgggttgtactgattgcatatcatagcaatcctttgaacatatcccttcgaatgctaaaaaattattagctttcgctcattatcgatttttacttcatctttaggtttcctgtcatacttacgatttatttgtttagtttgttaacgttaaaaaccattcctttaattataatcttattaatttacattcaaaagtttcagcaagatgtcaatctcttccaaggattttcaaaatgtaacgtcagcgggtttcgctgatgatactttcgctgccgatacatttgctgctgataaaaaaagtccatttgaatcctcggtttttgaaaacaaaacccaggtgcttcctgtggacagcgtgtctagattatctaacggagctcgaagtcgcagcaattctaacatttctttatctgagccacacgcacttaacgacactgttgaagatcaaccagttagcaaatgggtttgggtgcttgcttttgctgccggtatcggtggtctactgtttggctatgatacaggtgtcatttcaggtgctcttgtagttataggtactagcttgggcggacatgaattaacaaatggtggtaaagaatttatcacctctgcaacatctcttggtgcacttttaggagggataattgctggtgcccttgccgacttttttggtagaaaaccggtaattgcaatagctagtatcatcatcatagttggttccatagtacaggttacggctcaccatctttggcatatgattgtaggtcgctttgttatcggttggggcgttggcattgcatcacttattattcctttgtacctaagtgaaatcgctccgtctaaaatacgcggaaggttggttatcatatatgttttattaattacagctggtcaagtaattgcctatggaattgatacagcttttgaacacgtccataatggttggcgctggatggttggtttagcaatggttcctgcagctttccaattattcattcttatttggctacccgaatctcctcgtttgttagttaaaaaagaaagatctcaggaggcttataacactctggctcgaatctatcctactgctcacccttacgaaataaagactaagctctatttaattcaagaaggagttcgtgatcctttttcaggatctagatggcaaaagattgtgaaaacttttaaagaattatatttcaatccttcaaatttccgtgcattgatactggcttgcggactgcaagcgatgcaacaactttccggatttaattcattaatgtatttttctagtactatttttgaggttgttggctttaacaatcctactgctactggtcttatcattgcagctactaattttgtatttaccattgttgcctttggtgtgattgatttttttggtcgaagaatcttgctcctgttgaccgtatggggaatgattgctgctttaattgtatgcgcggtggcttttcattttttgccgaaagacgagaatggcaattatacttctggtcaatcaaatgcttgggctatcgttgttttaatttcgatgattgtttacgttgcgtcgtatgcctctggacttggaaatctcccttggcaacaatccgagctttttcctatgtccgttagaggtctaggcactggcatgtctactgctgttaactgggctggtaatcttggtataggtgcttcgttcttaacattgatgagtgaaataacacccacaggaacgtttgccctttatggaggcctttgctttttaggatggcttggtgcacttttctgctatcctgatttaaccgattataccatcgaagaaattggggagctgcttaaacatggatttggagttcgtgaaagtatgcgacatctcaaacgcgttcgacaagagcgagcttggtctcgtgaagataaagagcaaaataactagacagtctcttattttcatattattttttcatcacagtcaccattaggtgaaaactcatatatttaattgcgcttatcaaatcgagtaatactgtttcatagattttgtatcttaatatttatattaattgattacatatatacaaatatcttgtgccttgtgtgctatatgaactccagatgttgccgctaaagggttgaaagcagttaagctagacttaaattgtccattcacttcacgccgtaaatctatattttgcttccttactcgtatttattt

SEQ ID NO: 7861 - protein, 575 aa, Schizosaccharomyces pombe
MSISSKDFQNVTSAGFADDTFAADTFAADKKSPFESSVFENKTQVLPVDSVSRLSNGARSRSNSNISLSEPHALNDTVEDQPVSKWVWVLAFAAGIGGLLFGYDTGVISGALVVIGTSLGGHELTNGGKEFITSATSLGALLGGIIAGALADFFGRKPVIAIASIIIIVGSIVQVTAHHLWHMIVGRFVIGWGVGIASLIIPLYLSEIAPSKIRGRLVIIYVLLITAGQVIAYGIDTAFEHVHNGWRWMVGLAMVPAAFQLFILIWLPESPRLLVKKERSQEAYNTLARIYPTAHPYEIKTKLYLIQEGVRDPFSGSRWQKIVKTFKELYFNPSNFRALILACGLQAMQQLSGFNSLMYFSSTIFEVVGFNNPTATGLIIAATNFVFTIVAFGVIDFFGRRILLLLTVWGMIAALIVCAVAFHFLPKDENGNYTSGQSNAWAIVVLISMIVYVASYASGLGNLPWQQSELFPMSVRGLGTGMSTAVNWAGNLGIGASFLTLMSEITPTGTFALYGGLCFLGWLGALFCYPDLTDYTIEEIGELLKHGFGVRESMRHLKRVRQERAWSREDKEQNN

SEQ ID NO: 7862 - DNA, 1998 bp, Neurospora crassa
  CDS (1)..(1998)
atggcgtcgaacccaacgaacaccgcggcccctacgggtggccttaccgagaagaagcatgaccgccgttcaacatcgtccgaatccgtctcgggaaccgggtttgcggaacatgcagaccgcaccggcacttttaaccagaacgctcgactagaggcttcaaaaaagatagcgaatcctttggccggtctaagccctcagcgtctcgaggccatgggagaagaatatgcaatgatggccggtctcaccagcgaggaggacatcagggcctttcgactcggagccagaatcgccggcgatgagagcaactacgacctcatcccggagcttactgaacgggagaaagaggagtgcagcagtatgatgctaaccaccatacttcaagtttgctctctatgcgccgccgtccaaggaatggacgagacggtcgtcaacggcgcccagctcttctacaaggacaagtttggcattggtaccgatagccagagagacacctggcttctgggtctcgtcaactcagcgccctacctttgctgtgccttgatcggctgctggctcactgaaccgatgaacagaatctttggcagacgaggcaccatctttgtttcttgcatcatctcagccgtagcctgcttccaccaggcctttaccaacacgtggtggcacatgttcatcgcccgtttctacctcggccttggcatcggtcccaagtcagccaccacccccatcttcgccgccgaatgctcccctcccaagctccgcggtgcgctggtcatgcaatggcagatgtggaccgccttcggtatcatggtcggctacattgccgatctcgctttctacttcgttcccgatcacggcatcggcctgggtctgaactggcgtctgatgatgggctccgccatgatccccgccgtcatcgtcgtctgcctcgccttcctctgcccggagtcgccccgttggtatctcagcaagggccgacaccaagacgccttcggggcgctctgccgcctgcgtttcgaaaaggtccaagccgcccgcgacctcttctacacccacaccctcctcgaagccgagaagcaagccatgtcgggcgtcaagaagggtaaccgctttaaggagctcttcaccgtgcgtcgtaaccgcaacgcggtcattgcctcgtcgggactcatgttcatgcagcagttctgcggcgtcaacatcatcgcctactactcctcggcagtcttccgagacgccggcttcagcgacgtctcagcactggccgcctcgctcgggtttggcgtcgtcaactggctgtttgccatcccggccatgtacaccatcgacactttcggccggcgcaacctgctgctgaccaccttcccgctcatgtccctcttcctcttctttaccggcttcagcttttggatccccgaggactccaaagcccacatcggctgcatcgcgctaggcatttacttgttcggcatggtctactcccccggtgaagggccggtgccgtttacttactcggccgaagcctacccgctgtacatccggccaatcggcatgtccctcgccacggcgactacctggttcttcaatttcattctttccatcacctggcctaggatggtcacggccttcaagccgcagggcgcgtttggctggtatgcagggtggaatatcattgggtttctctttaccctgttcttggtccccgagaccaagggcaagacgctggaggagctcgatcacgtgtttgacgtgccgttgaagaagttggtcaggtatggggcagatcagagcttgtggttcttccataggggaaagaatggaaatggaatgaggccgacggcgcctagtgcggagatgtatcatggggatgcggagcggatgaacgaggtggttagcgggcagcagcttggggagggtgagagggagaagaggtggaacaaggaacaagagagggaaggggggattatgggacgaggggatgctgctgggaaggtgtag

SEQ ID NO: 7863 - protein, 665 aa, Neurospora crassa
MASNPTNTAAPTGGLTEKKHDRRSTSSESVSGTGFAEHADRTGTFNQNARLEASKKIANPLAGLSPQRLEAMGEEYAMMAGLTSEEDIRAFRLGARIAGDESNYDLIPELTEREKEECSSMMLTTILQVCSLCAAVQGMDETVVNGAQLFYKDKFGIGTDSQRDTWLLGLVNSAPYLCCALIGCWLTEPMNRIFGRRGTIFVSCIISAVACFHQAFTNTWWHMFIARFYLGLGIGPKSATTPIFAAECSPPKLRGALVMQWQMWTAFGIMVGYIADLAFYFVPDHGIGLGLNWRLMMGSAMIPAVIVVCLAFLCPESPRWYLSKGRHQDAFGALCRLRFEKVQAARDLFYTHTLLEAEKQAMSGVKKGNRFKELFTVRRNRNAVIASSGLMFMQQFCGVNIIAYYSSAVFRDAGFSDVSALAASLGFGVVNWLFAIPAMYTIDTFGRRNLLLTTFPLMSLFLFFTGFSFWIPEDSKAHIGCIALGIYLFGMVYSPGEGPVPFTYSAEAYPLYIRPIGMSLATATTWFFNFILSITWPRMVTAFKPQGAFGWYAGWNIIGFLFTLFLVPETKGKTLEELDHVFDVPLKKLVRYGADQSLWFFHRGKNGNGMRPTAPSAEMYHGDAERMNEVVSGQQLGEGEREKRWNKEQEREGGIMGRGDAAGKV

SEQ ID NO: 7864 - DNA, 1678 bp, Arabidopsis thaliana (mouse-ear cress)
  CDS (40)..(1530)
gatccgggatgggaaagaagcaggaggagactttttggaatggagagacaaaagagcatggaaaaagggttactcaggaagagcttaagcatacgtgagagaaagttccctaacgaagacgctttcttagaatccggtttatcgaggaagtctccgcgagaggtcaagaaacctcaaaacgacgatggtgaatgtcgtgttaccgcctctgttttcctcagcacctttgttgccgtatcaggctccttctgtaccggttgtggcgttggtttttcatcgggtgcacaagcagggattaccaaagatttatctctctccgttgcagaatactcaatgttcgggtcgatcttgacattaggaggcttgatcggtgcagtattcagcggtaaagtcgctgatgtcttgggaagaaaacggacgatgttgttttgcgaattcttctgtatcacaggctggctttgtgtagcattggctcagaatgcaatgtggctggactgtggaagattgttacttggaatcggcgttggtatatttagctacgtgattccggtgtatatagccgaaattgcacctaaacatgtccgaggatcgtttgtgttcgccaatcagttgatgcaaaattgcggaatttcactcttcttcatcattggcaattttattccatggagactactaacagtagtcggattggtgccatgtgtgttccacgtcttttgtttatttttcatccccgaatctccaagatggctggcgaagttaggtcgtgataaagaatgccgatcttcgttgcaacgccttaggggatctgacgtcgatatttctcgtgaagcaaacacaattcgagataccattgacatgacagaaaacggtggtgaaactaagatgtctgaattgtttcagagacgatacgcatatccgttaattatcggagttggtttaatgtttttgcaacaattgtgtgggagctccggtgttacctattatgctagtagcctcttcaacaaaggaggatttccaagtgctattggcacatccgtaatagccacaattatggttccaaaagcaatgctggcaacagtcctagtcgataaaatggggaggagaacgctcctaatggcttcttgttctgcaatgggtttgagtgctttgctcttaagtgtttcttacggtttccagtcgtttggcattcttccagaactcactcccatcttcacttgcatcggcgtcttgggtcacattgtgtcatttgccatgggaatgggaggactaccatggattataatggctgagatatttccgatgaatgtgaaagtgtcagctgggaccttagttactgtaaccaattggttatttggttggattatcacatacactttcaattttatgctagaatggaatgcatcaggaatgttcctcatcttctcaatggtctccgccagttcgatcgtatttatatactttttggtacctgagacaaaaggccgatcacttgaagaaatacaagcactgctcaacaactctgtgcaataatatcatttttctttttctttttgggtaaatgatcatatatataagtcgattgttgttatttggtgtgagtttgaatgtgatccgtgtgcgtatcaaattttggatgggaaatttgaaacagtaaaaatttgtatattcctcgtttggg

SEQ ID NO: 7865 - protein, 496 aa, Arabidopsis thaliana (mouse-ear cress)
MERQKSMEKGLLRKSLSIRERKFPNEDAFLESGLSRKSPREVKKPQNDDGECRVTASVFLSTFVAVSGSFCTGCGVGFSSGAQAGITKDLSLSVAEYSMFGSILTLGGLIGAVFSGKVADVLGRKRTMLFCEFFCITGWLCVALAQNAMWLDCGRLLLGIGVGIFSYVIPVYIAEIAPKHVRGSFVFANQLMQNCGISLFFIIGNFIPWRLLTVVGLVPCVFHVFCLFFIPESPRWLAKLGRDKECRSSLQRLRGSDVDISREANTIRDTIDMTENGGETKMSELFQRRYAYPLIIGVGLMFLQQLCGSSGVTYYASSLFNKGGFPSAIGTSVIATIMVPKAMLATVLVDKMGRRTLLMASCSAMGLSALLLSVSYGFQSFGILPELTPIFTCIGVLGHIVSFAMGMGGLPWIIMAEIFPMNVKVSAGTLVTVTNWLFGWIITYTFNFMLEWNASGMFLIFSMVSASSIVFIYFLVPETKGRSLEEIQALLNNSVQ

SEQ ID NO: 7866 - DNA, 2072 bp, Mus sp
  CDS (21)..(1454)
gcgggtcaggtcctgctgacatgtctcccgaggacccccaggagacgcagccgctattgcggccaccggaagccaggactccccgcggccgccgggtcttcctcgcttccttcgccgccgctctgggacccctcaacttcggcttcgcgctcggctacagctcccccgccatccccagcctgcggcgcaccgcacccccggccctgcgcctcggagacaatgcggcctcctggttcggggccgtcgtgaccctgggcgctgctgcagggggcatactgggcggctggctcctggaccgttcagggcgcaagctgagcctcttgctctgcaccgtgcccttcgtgactggctttgctgtcatcaccgcggcccgggatgtgtggatgctgctcggaggccgcctcctcaccggccttgcctgcggagtcgcctcactagtggcaccggtttacatctcggaaatcgcctacccagctgtccgaggactgctcggctcctgtgtgcagctgatggttgtcactggcatcctcctggcctatgtggcaggctgggtcctagagtggcgctggctggccgtgctgggctgtgtgccccccaccctcatgctgctgctcatgtgctacatgcccgagaccccacgttttctcctcactcaacaccagtaccaggaggccatggctgccttgcgcttcctgtggggctctgaggagggctgggaagagccccctgttggggctgagcaccagggcttccagctggccctgctgaggcgccctggcatctacaagcccctcatcatcggcatttccctcatggtcttccagcagctgtcaggggtcaatgctatcatgttctatgccaacagcatcttcgaggaggccaagttcaaggacagcagcctggcctcggtcactgtgggcataatccaggtcctgttcactgctgtggcggccctcatcatggacagagcagggcgaaggctgctcctggccttgtcgggtgtgatcatggtgttcagtatgagtgcctttggtacctacttcaaactgacccagagcctccccagcaactcctcccacgtaggcctggtgcccatcgcggcggagcctgtggatgtccaagtgggactggcctggctggctgtaggcagcatgtgcctcttcattgctggctttgcggtgggctggggacccatcccctggctcctcatgtcagagatcttccctctgcatgtcaagggtgtggctaccggcatctgtgtcctcaccaactggttcatggcctttctagtgaccaaagagttcaacagcgtcatggagatgctcagaccctacggtgccttctggctcaccgctgccttctgcgctctcagtgtcctattcacactgaccgttgtccctgagactaaaggcaggactctggaacaagtcacagcccatttcgagggacgatgacagaccctttctgtgcctgggagccccgagctgagctgcctttgggtttcagaaggagtggagtggcctgtaactaagccacacctcagtttgagcctggaggcccctgactcctcacctcagggccctctttgcccagatctcaacccagattcccaccgtgagcccaccagactctgagtgcggtctctgcagcctgcttcacacacaggacatctgaggagctgtgcatcctcacctgacccaggtgtctccttcttaagactgaggcagctgaagggacctgagggctcctggctcccgtttcctggctggggtgcccggtcctaagcagccgcctgtacctcacttgactgggagatcagaaagggacttagccatatgggctcagaaacaaggtcaggtgagcccaggtagaagagagaatgttcttgccaaccaagccctcctcagagctgcgcagagactctccggggtcaccctggggccagccagcttacccatcacttacaggttctttctggctctttcctgggctccgtgtcctgggtcattagccaccatatcttgttgagtttcaggaaataaaaagcctcttactgttcaaaaaaaaacaaa

SEQ ID NO: 7867 - protein, 477 aa, Mus sp
MSPEDPQETQPLLRPPEARTPRGRRVFLASFAAALGPLNFGFALGYSSPAIPSLRRTAPPALRLGDNAASWFGAVVTLGAAAGGILGGWLLDRSGRKLSLLLCTVPFVTGFAVITAARDVWMLLGGRLLTGLACGVASLVAPVYISEIAYPAVRGLLGSCVQLMVVTGILLAYVAGWVLEWRWLAVLGCVPPTLMLLLMCYMPETPRFLLTQHQYQEAMAALRFLWGSEEGWEEPPVGAEHQGFQLALLRRPGIYKPLIIGISLMVFQQLSGVNAIMFYANSIFEEAKFKDSSLASVTVGIIQVLFTAVAALIMDRAGRRLLLALSGVIMVFSMSAFGTYFKLTQSLPSNSSHVGLVPIAAEPVDVQVGLAWLAVGSMCLFIAGFAVGWGPIPWLLMSEIFPLHVKGVATGICVLTNWFMAFLVTKEFNSVMEMLRPYGAFWLTAAFCALSVLFTLTVVPETKGRTLEQVTAHFEGR

SEQ ID NO: 7868 - DNA, 2177 bp, Homo sapiens
  CDS (288)..(2177)
actatagggcgaattgggtaccgggccccccctcgaggtcgacggtatcgataagcttgatatcgaattccggccgtggcggcggctgctgccgtggcagccggagcggaagccgggaggaagaaagcggcggcagcggcggttgctcccgccggctcgggctgtctagctcgccgagactgccggcccgcggagccgcgtccccccgggcagccccgggcccctgccctatgtcccgcaaggcaagcgagaatgtggagtacacgctgcggagcctgagcagcctgatgggcgagcggcgcaggaagcagccggagccggacgcggcgagcgcggccggggagtgcagcctcctggctgccgccgaatcgagcaccagcctgcagagcgcgggcgcgggcggcggcggcgtcggggacctggagcgcgcggcgcggcggcagttccagcaggacgagacccccgccttcgtgtacgtggtggccgtcttctccgcgctgggcggcttcctgtttggctatgacaccggggtggtgtcaggggccatgctgctgctcaagcggcagctcagtctggacgcgctgtggcaggagctgctggtgtccagcacggtgggggcggctgccgtctcggcgctggccggaggcgccctcaacggcgtcttcggccgccgcgctgccatcctcctggccagtgccctcttcaccgccggctccgcggtgctggctgcggccaacaacaaggagacactgctcgccggccgcctggtcgtgggactcggcatcggcattgcttctatgacagtgccagtgtacattgcggaggtctcaccacccaatttaagaggccgattagtcaccattaataccctcttcatcacaggagggcagttctttgcaagtgttgttgatggagccttcagttatctccagaaggatggatggaggtacatgttgggacttgcagcagttccggcggttatacagttttttggctttctctttttgcctgaaagccctcgatggcttattcagaaaggacagactcagaaggcccgtagaattttatctcagatgcgtggtaaccagaccattgatgaggaatatgatagcatcaaaaacaacattgaagaggaggaaaaagaggttggctcagctggacctgtgatctgcagaatgctgagttatcccccaactcgccgagctttaattgtgggttgtggcctacaaatgttccagcagctctcaggcattaacaccatcatgtactacagtgcaaccattctgcagatgtctggtgttgaagatgatagacttgcaatatggctggcttcagttacagccttcacaaatttcattttcacacttgtgggagtctggcttgttgagaaggtgggccgcagaaagcttacctttggtagtttagcaggtaccaccgtagcactcattattcttgccttgggatttgtgctatcagcccaagtttccccacgcatcacttttaagccaatagctccgtcaggtcagaacgccacttgcacaagatacagttactgtaatgaatgtatgttggatccagactgcggtttctgctacaagatgaacaaatcaactgtcattgactcctcctgtgttccagttaataaagcatctacaaatgaggcagcctggggcaggtgtgaaaatgaaaccaagttcaaaacagaagatatattttgggcttacaatttctgccctactccatactcctggactgcacttctgggccttattttatatcttgtcttctttgcacctggaatgggaccaatgccttggactgtgaattctgaaatatatcccctttgggcaagaagtacaggaaatgcatgttcatctggaataaactggattttcaatgtcctggtttcactaacatttttacacacagcagagtatcttacatactatggagctttcttcctctatgctggatttgctgctgtgggactccttttcatctatggctgtcttcctgagaccaaaggcaaaaaattagaggaaattgaatcactctttgacaacaggctatgtacatgtggcacttcagattctgatgaagggagatatattgaatatatccgcgtgaagggaagtaactaccatctctccgacaacgacgcctcggacgtggagtga

SEQ ID NO: 7869 - protein, 629 aa, Homo sapiens
MGERRRKQPEPDAASAAGECSLLAAAESSTSLQSAGAGGGGVGDLERAARRQFQQDETPAFVYVVAVFSALGGFLFGYDTGVVSGAMLLLKRQLSLDALWQELLVSSTVGAAAVSALAGGALNGVFGRRAAILLASALFTAGSAVLAAANNKETLLAGRLVVGLGIGIASMTVPVYIAEVSPPNLRGRLVTINTLFITGGQFFASVVDGAFSYLQKDGWRYMLGLAAVPAVIQFFGFLFLPESPRWLIQKGQTQKARRILSQMRGNQTIDEEYDSIKNNIEEEEKEVGSAGPVICRMLSYPPTRRALIVGCGLQMFQQLSGINTIMYYSATILQMSGVEDDRLAIWLASVTAFTNFIFTLVGVWLVEKVGRRKLTFGSLAGTTVALIILALGFVLSAQVSPRITFKPIAPSGQNATCTRYSYCNECMLDPDCGFCYKMNKSTVIDSSCVPVNKASTNEAAWGRCENETKFKTEDIFWAYNFCPTPYSWTALLGLILYLVFFAPGMGPMPWTVNSEIYPLWARSTGNACSSGINWIFNVLVSLTFLHTAEYLTYYGAFFLYAGFAAVGLLFIYGCLPETKGKKLEEIESLFDNRLCTCGTSDSDEGRYIEYIRVKGSNYHLSDNDASDVE

SEQ ID NO: 7870 - DNA, 1422 bp, Bacillus megaterium
  CDS (1)..(1422)
atgaaacaaaatcgaaactcattatatattttttctattaccttagttgccgctatcggagggttactgtttggatatgacacagctgtaatatctggagctgaagaatcattaaaggtgtatcttattgacagcttagggttaggatctttagcacacggtgttactgtatcaagtgctttaataggatgtattattggaggattggtatctggttattttgcgacgaaactaggacgcaaacaatcacttatactagcagctattctttttatagtctcagcgttaggagcttcttatcctgagtttttatttttcacaaaaggggaaccgacactctctttgttactagcttttaacttctaccgcattataggtgggattggggttggcttagcatcagccatttgtcccatctatataggagaaattgcaccggcagatattcgcggcagattggtatcgttcaatcaatttatgattatttttggaatgttagtcgtttacttcgtgaattggggtattgcaaatggggaaaccttagaatggattaatgatgtaggttggagatacatgtttgcttcaggagctattccagctttactctttgcagcactcttgtttttagttcctgaaacgcctcgctacttagctatacagaatcaagatcaaaaagctttagccatactaactaaaattaatggatcttcagaagcgaaagcaattttagaagatattaaacaaacaatttctaccaatgtttcgtctgaaaaattattggcatatggaaaattagttatcgttgtaggtatactgctttctgtatttcaacagtttgtaggaatcaatgtagctctatattatgctccgcgtatttttgaaagcatgggagcagctaaaggttcttctatgctgcaaaccattattatgggattagtaaacgttatttttacagtaattgcaattttgacagttgatcggttgggaagaaaacctttattaataacagggtctatcggaatggccattggaatgttcggtgtagcaagcatggctttttcaaacatcattggtatagggacgcttgtatttatcattatttatacagcttcctttatgatgtcatggggaccaatttgttgggtgctcatttcagagatttttcctaataaaattagaggtcgtgctgtagctattgccgtagctgctcagtgggcggctaactattttatttcctctacatatcccgtgatgatggaatatagcggaggattaacatatggtttttacggtttaatgagtgtactttctgctttatttgtctggaaatttgttcctgaaacgaaaggtagaactctcgaacaaatggaaaatatgtggaggaaaaaacaaggggcttcaaagagtaagaaggccatataa

SEQ ID NO: 7871 - protein, 473 aa, Bacillus megaterium
MKQNRNSLYIFSITLVAAIGGLLFGYDTAVISGAEESLKVYLIDSLGLGSLAHGVTVSSALIGCIIGGLVSGYFATKLGRKQSLILAAILFIVSALGASYPEFLFFTKGEPTLSLLLAFNFYRIIGGIGVGLASAICPIYIGEIAPADIRGRLVSFNQFMIIFGMLVVYFVNWGIANGETLEWINDVGWRYMFASGAIPALLFAALLFLVPETPRYLAIQNQDQKALAILTKINGSSEAKAILEDIKQTISTNVSSEKLLAYGKLVIVVGILLSVFQQFVGINVALYYAPRIFESMGAAKGSSMLQTIIMGLVNVIFTVIAILTVDRLGRKPLLITGSIGMAIGMFGVASMAFSNIIGIGTLVFIIIYTASFMMSWGPICWVLISEIFPNKIRGRAVAIAVAAQWAANYFISSTYPVMMEYSGGLTYGFYGLMSVLSALFVWKFVPETKGRTLEQMENMWRKKQGASKSKKAI

SEQ ID NO: 7872 - DNA, 1711 bp, Amanita muscaria; identical to SEQ ID NO: 247
  CDS (38)..(1600)

SEQ ID NO: 7873 - protein, 520 aa, Amanita muscaria; identical to SEQ ID NO: 248

SEQ ID NO: 7874 - DNA, 2700 bp, Kluyveromyces lactis
  CDS (453)..(2603)
tttctttttgttgattatagtcgaagattttacagtccaaaactctctcaaatcccttgagcaattgatatataacattgaccaacatctgagaggaaatcaaaaagatagcccgtctgataataacaaccatcacatatcacttcaatcgcatttaacttgacaaaaagctaagtttaccagtactatttgcaagtacctagagacccaaactattatgactacggctcaacgatcactatgactactgattctgttccacgaaagaatatttctcaagctatcaaactagtgttcttcgacggaaagcacaagagcgtaacgaggcaggctcctctgaagtaccgacgggtggtaaatcgaataatgcttccgctacatcgtcacccgaagaggcacttgagaatagtggagaaaacttcgaactcacaaatttcgcatctttatcagaaatggaatcagaaatctttcttgcacctcccgccaaacaatcgaagaagatctccattcttgttggtatgtttgttgctgtgggtggatttttgtttgggtatgatacaggattaataaataatatcagcgaaatgccttatgttaaccaaaagtttgcacctaacaagaatcatttcacaacaccacaaatctcgatattagtgtcttttttatccttggggacgttcattggagccttactggcacctttaatctccgactcttatggtcgaaagactacaatgatctttagtacgttcgtggtatttatgataggaaactctttacaggtggcagctggttctatgaccatacttgtagttggaagagtcctctctggtatgagtgttggactaatatcggctgcggtgccattatatcaaagtgaagctgcacagaaatctgttcgtggtgcaattatttcctgttaccagtgggccattacatgggggctacttgtagcaagtgcagtttcccaaggaacatataaaagaatggatgcatctagttaccaaataccgatcggattacagtatatttggtcctttctactcggtgtcggcattcttttcctccctgaaagcccaagatactatgttttcaaagataggctagacaaagcggcaaaatctttatcctttttacgtggcgtaccagaggatgactccggattacttgaagagttggttgagatcaaagcaacatatgattacgagatgtcattcggaaaaatctcttacctagattgtttcagatcaacgagatcaagaaccaaacagcgtctacgaatgttgaccggtatcgctcttcaggcttttcagcaagtgagtggtatcaattttatcttttattatggcgtagactttttcaataagagtggtgtcagcgaaagctatttggtttccttcgtcacatatgcagtaaatgttgcgtttaacattccggggttattcttggtcgaatatatcggacgaagaaaattgttattgatgggtggtattcttatgactatctccaatttcattattgctatagtcggattagcgactgactccatggttgcgaacaaagtgatgattgcattcatctgtttattcattgcatcattttcggccacctggggtggtggtgtgtgggtaatttccgctgaattatatccattgggtgttcgcgctaaatgcaccgccatctgtgcagcatcaaactggctaataaatttcatctgtgcattaataacgccttacattatgcacatagatagcagtgtcagacaaacgagtatcggtaccaaaatcttctttgtttgggggtcattgaacgctgttggggttcttgttgtgtacttcaccgtgtacgaaacgaatggattatcattggaagagatcgatgagttgtacaagaaatcttcttctggaataaactccatagaatggaacaagaagatcaaagcctttccagatttgtttcaaaggacaagaccgaacaatgaaggtgacggagaagctgatgataacatacatacagatgaaaattataaccatactatttccagctataatggaacccaaaacaatgaaaaatatcctattcaagtacagatgccacaatttggtgtacggaacatcgaatttttgaacaccacaggctcatctccgcaatcggatatgacagaacccaactttgtcgacttgggtaatggtcttggtataacaacgtatcaaagaggcccaccatccgtccttactgactcgagtgaagaagaggaagagggacaacaacaagagacagatgagactgaggaaggtaaatcattcaaacaccagtacactgacgctcgtaataaaaatcgtggcgagcgcggcagtttcaatagcaatagttcaacctcaggcactactcgatcttcttcccacaaggccagtgttcaaaggatggaagaaattaatctgtacatggcccaattaatgcatcgcggaggaacagaagatctttcgcgtaacactaccgataacactcatcaaccgatatcacatgatatcatgagtcaatggaactcctcatcccaaaataaaggacctagcactcaaaccgatattaatagtaacacttaggaacactaactaatcttataatagtactttaatatataatttattacatgttgaatgacgcttaccggaaggagtatgtaaaatcttacttttatct

SEQ ID NO: 7875 - protein, 716 aa, Kluyveromyces lactis
MESEIFLAPPAKQSKKISILVGMFVAVGGFLFGYDTGLINNISEMPYVNQKFAPNKNHFTTPQISILVSFLSLGTFIGALLAPLISDSYGRKTTMIFSTFVVFMIGNSLQVAAGSMTILVVGRVLSGMSVGLISAAVPLYQSEAAQKSVRGAIISCYQWAITWGLLVASAVSQGTYKRMDASSYQIPIGLQYIWSFLLGVGILFLPESPRYYVFKDRLDKAAKSLSFLRGVPEDDSGLLEELVEIKATYDYEMSFGKISYLDCFRSTRSRTKQRLRMLTGIALQAFQQVSGINFIFYYGVDFFNKSGVSESYLVSFVTYAVNVAFNIPGLFLVEYIGRRKLLLMGGILMTISNFIIAIVGLATDSMVANKVMIAFICLFIASFSATWGGGVWVISAELYPLGVRAKCTAICAASNWLINFICALITPYIMHIDSSVRQTSIGTKIFFVWGSLNAVGVLVVYFTVYETNGLSLEEIDELYKKSSSGINSIEWNKKIKAFPDLFQRTRPNNEGDGEADDNIHTDENYNHTISSYNGTQNNEKYPIQVQMPQFGVRNIEFLNTTGSSPQSDMTEPNFVDLGNGLGITTYQRGPPSVLTDSSEEEEEGQQQETDETEEGKSFKHQYTDARNKNRGERGSFNSNSSTSGTTRSSSHKASVQRMEEINLYMAQLMHRGGTEDLSRNTTDNTHQPISHDIMSQWNSSSQNKGPSTQTDINSNT

SEQ ID NO: 7876 - DNA, 2065 bp, Prunus armeniaca
  CDS (363)..(1790)
cccattttcaactcattttcaacggacttcccaatattctctctctcactaaaaacccaattgcaaatcacagcatcacagactggtcgatcgctttctgggttttgtttctgatattctcgacttcaatttggtacaaaatgcaagcgtcaacttatggtgcactaaaggggagcatacgatttggggtccaaaaccaaacaagggtatcgggttttggtgaattgagaaatacaacaagtacagtatccagaaatctgtgcgtgattgataggagcacttgctgcggtggattgtgcctcagttctgcggctatgggagccaagcttgcacgtctcacaacgggctttgatgggatttccatgtccactttaaaagccagatccgtccaggctcgggcttctgatggcgatcttgagaatcttgttccctccaagcctcaggggaagtcttctggaacagttttcccatttgttggtgttgcttgtcttggagccattttatttggttatcatctgggggtggtaaatggtgctcttgagtacctatccaaggatcttggcattgctgaaaatgctgtattacaagggtgggtggttagtgcccttctagccggtgccacagttggatcatttactggtggagccttggctgataagttcggcagaactaggacttttcaattagatgtcattcctctagcaattggagcatttttatgtgccacatcccagagtgtgcaaacaatgatagttggccgctacttgctggcggttggaattggtatcacatcagctattgtcccactttatatatctgagatctctccaactgaaattcgtggtgcgcttggatctgtaaaccagctttttatatgtattgggattcttggagcgctggtggctggattacctttagcagcaaatccattatggtggaggacaatgtttggtgttgcaatagtaccctctgttctactggcactaggaatggctgcttcacccgaaagtccaagatggcttttccagcaaggaaaaatttctgaagctgaaaaggctataaaaacattatatggaaaagaaagagttagtgaggttatgcatgacttaacatctgcaactcagggttctgtagagcctgaagccggctggtttgatctattcagtagccgctattggaaagttgttagtgttggtgcggcacttttcttgttccaacaattggccgggataaacgctgtggtctattattctacttctgtcttccgcagtgctggcattacatctgatgttgcagcaagtgctcttgttggagcagcaaatgtcttcggaactgctgtcgcatcctcattgatggacagacaaggaagggaaagtcttctactcataagcttcggtggaatggctgcttcaatgttgctgctttctttgtcctttacatggaaagtcctggctccatattctggcccccttgctgttgctgggactgttctctatgtactgtccttttcacttggggctggccctgtgcctgctctccttcttccagagatatttgcttcaagaatcagagcaaaagcagtttctttgtcattgggcatgcactggatttcaaacttcgtcataggcctctatttcttgagctttgtaaccaagttcgggatcagctcagtgtatctcggatttgctggtgtctgtcttcttgctgtcttgtacatatctggtaatgttgttgaaacgaaagggcggtcattggaggaaatagagcgtgctcttagcgtttcaacttgattatgatatgactcaaactacatgtaaaaatctcacaacagctttggattttggccgaagcataggcaccatcactccttttcatgctgtgtggactaggtcatttccacctctcggggtcttgtatttagagattgaacttttgattgtaaccggataaaatggtgtctatggaattccatagctgtgcacaatactaatcggtgatgagtgctttgtgaataaagtatctaccgtgaattttgatactgttcttaaaaaaaaaaaaaaaaaaa

SEQ ID NO: 7877 - protein, 475 aa, Prunus armeniaca
MSTLKARSVQARASDGDLENLVPSKPQGKSSGTVFPFVGVACLGAILFGYHLGVVNGALEYLSKDLGIAENAVLQGWVVSALLAGATVGSFTGGALADKFGRTRTFQLDVIPLAIGAFLCATSQSVQTMIVGRYLLAVGIGITSAIVPLYISEISPTEIRGALGSVNQLFICIGILGALVAGLPLAANPLWWRTMFGVAIVPSVLLALGMAASPESPRWLFQQGKISEAEKAIKTLYGKERVSEVMHDLTSATQGSVEPEAGWFDLFSSRYWKVVSVGAALFLFQQLAGINAVVYYSTSVFRSAGITSDVAASALVGAANVFGTAVASSLMDRQGRESLLLISFGGMAASMLLLSLSFTWKVLAPYSGPLAVAGTVLYVLSFSLGAGPVPALLLPEIFASRIRAKAVSLSLGMHWISNFVIGLYFLSFVTKFGISSVYLGFAGVCLLAVLYISGNVVETKGRSLEEIERALSVST

SEQ ID NO: 7878 - DNA, 1893 bp, Petunia hybrida
  CDS (253)..(1785)
aagggaaaaaatattattacaaagagaaattacaaaagtttcaaaggtcgctctctcaataagagaaaaagcaaacaaatattgaaaacaagaaaagataaagaaaggcctttgcttcttatatatcccttgaaatcttgtgtatccacactatcattagtaaaagactaaaactcgcaaaaaattgtatttacatactatcgtataaataaaaagttagagatttaatttgctatcaacagttcaaacaagatggcaggaggctttgcagctggatctggaggaggtgactatgaaggaaaagtcacaacttttggtatcatgacatgtttggttgctgccacaggtggtctcctctttggttatgatattggtatctcaggaggagttacatctatggatgaattcttgctcaaattttttccaaatgtataccataaggagaaggccttgaaagcagggggcaaccaatattgcaaattcgatgatcatctattgcaactcttcacctcatcactttatttagcagcactagttgcttcatttgcagcttcaataaccaccaaggcctttggccgaaaaatctccatgcttattggaggtcttattttccttgttggtgctgtccttaatggtgctgccatgaatttggctgcactcatcattggtcgtttgttgcttggtgttggcattggctatgccaatcagtcagttccagtttatctctcagaaatggcaccacctaaacttagaggagcactcaatgtttgtttccaaatggctgtcacccttggtatttttgttgcaaatatggtcaactatggtacctcttcaatgaagaaaaatgggtggagagtttcacttgttctagcagctgttcctgcaattatcatgaccgtaggagcagtgttcttacccgatacccctaactccttaattgacagaggccagaaagagaaagccaaggccatgttgcaaaaaatccgtgggacaaataatgtagacaatgaatttgaggatcttataatagccagtgatatgtcaaagctagtgacagatccatgggggaacattatgaaacctaggtacagaccacaattgaccatagctgtcctcattcctttcttccaacaactcacaggtatcaatgtgatcatgttctatgcccctgtcctcttcaagactctgggatttggtgatgaggctgccttaatgaccgctgttatcactggacttgtcaatgtcttcgccacccttatctcaatattcactgttgatagatttggcagaagattcctgttcctcgcaggaggtctccttatgcttatctgccaggctgctgttggtagcgtcataggcagtgtgtttgggacggatggcttaggaacgttcagcaagggactcggaaacgtgacggtggggttgatctgtctgtatgtagcagcatttgcatggtcatgggggccattggggtggttggtgcctagtgaggttttcccaatggaaattcgatcagcagggcaatcaattacagtgtcagtgaacatgttcttcacattcgtgataggccaactcttccttaccatgctttgcgagatgaagtttggtctcttcttcttctttgctggatttgtggtactcatgacactcttcatcttcttcttcttgcctgagaccaaaggtatcccaattgaagaagtcaacagaatctggaagaatcattggttctggaaaagttacgtgccaaatgatgatgatgatcatcactctaaaaatcaagtttagaatgggcattaaaatgaaaaggaagattgtaaataattgtggccctcccggatgttactatgatattttttgttttcaatattaataaatacccactttttgcttgcc

SEQ ID NO: 7879 - protein, 510 aa, Petunia hybrida
MAGGFAAGSGGGDYEGKVTTFGIMTCLVAATGGLLFGYDIGISGGVTSMDEFLLKFFPNVYHKEKALKAGGNQYCKFDDHLLQLFTSSLYLAALVASFAASITTKAFGRKISMLIGGLIFLVGAVLNGAAMNLAALIIGRLLLGVGIGYANQSVPVYLSEMAPPKLRGALNVCFQMAVTLGIFVANMVNYGTSSMKKNGWRVSLVLAAVPAIIMTVGAVFLPDTPNSLIDRGQKEKAKAMLQKIRGTNNVDNEFEDLIIASDMSKLVTDPWGNIMKPRYRPQLTIAVLIPFFQQLTGINVIMFYAPVLFKTLGFGDEAALMTAVITGLVNVFATLISIFTVDRFGRRFLFLAGGLLMLICQAAVGSVIGSVFGTDGLGTFSKGLGNVTVGLICLYVAAFAWSWGPLGWLVPSEVFPMEIRSAGQSITVSVNMFFTFVIGQLFLTMLCEMKFGLFFFFAGFVVLMTLFIFFFLPETKGIPIEEVNRIWKNHWFWKSYVPNDDDDHHSKNQV

SEQ ID NO: 7880 - DNA, 1425 bp, Tetragenococcus halophilus; identical to SEQ ID NO: 249
  CDS (1)..(1425)

SEQ ID NO: 7881 - protein, 474 aa, Tetragenococcus halophilus; identical to SEQ ID NO: 250

SEQ ID NO: 7882 - DNA, 2846 bp, Pichia stipitis; identical to SEQ ID NO: 251
  CDS (175)..(1836)

SEQ ID NO: 7883 - protein, 553 aa, Pichia stipitis; identical to SEQ ID NO: 252

SEQ ID NO: 7884 - DNA, 2054 bp, Beta vulgaris subsp; identical to SEQ ID NO: 253
  CDS (94)..(1731)

SEQ ID NO: 7885 - protein, 545 aa, Beta vulgaris subsp; identical to SEQ ID NO: 254

SEQ ID NO: 7886 - DNA, 1708 bp, Taenia solium
  CDS (46)..(1548)
caattggaaccgtatggaatctgctgtctgatttgtctcacataaatggttaacttccactacgtattcgctacagtggtgattgtatttggctcttcatttcagttcggttttcaaaccggagttattaatagtcctctcccgctaatcgaaaaatacatcctaagcatatgtgaggacagaggcagttcaccttcaccagagttcgttcaggcaatgagcagcctcgtcgttgctggctttccgataggcggcatctttggtgcattgtttggcggatctgtatcaaataaaatggggcgaaagctgtctctttttatctttaacattccgatggccgttggatccctcctaatgatggcttgtcaggcagcggttagttttgaaatgattatcgttggtagagtgcttgttggatttgcctgtggtgccttcactggtatagcaccagtatatctcgcagaaatcgccccagtcaggattcgtggtatgtcggggataatgcaccaattggccattgtctgtgccattctaatttctcaaatccttgggttgaaggaattaatggggtcggcaaaactctggccttatctcctcggcctgacaatcataccctcggtcgtcctattattcctattttggatttgtccagacagcccccgttacattctactgaatagtcaggatctcgagagtgcgaaatctgcccttttttggctccgaggcgataccgaagtcgttgaagaggagatcggggagctcttggctgaacaagagaacgaaagcgaaaatcatactaaattccccctgaaagacctctttcgtgtcaaagctctgcgtttggctctcttcgtcgccgttgtagctcacttggcccaacagttttccggaataaatgctgctctcttctactccacttcgctatttgaaagcattgggctcacctcacaggccgtgtacgcgactttgggtgtgggctcgatgattgtcgtcatcactgtggcttccatcttccttattgaacgagttggtcggcggatccttcttataggcggtctcagtgtcatgcttttcagcgccgtcatcatcaccatcggcttggctcttcgcagccatgcctctggccttgtctaccttgccatcacttttgtctacatcttcgttggtggtttcgctatcggaccgggctcaatcccgtggtttgtggtggctgagatgtttgtgcaggagacacgtgatcctgccattgtgatcacagtcatcgtcaattggctcgctcaaattgttatcagcctgggatatcctccgcttttgaagtacctaaaggactactccttcatgccgttcattggcctgttggtgatcttcattgccctgctctacttcttcctgccagagacgaagggccgagcgccttgtgatgtgcaggatgagtttgtgcgcatgaccggcggcgcagaggacgacgtcaccctcggctcctacactcgctcccttcctagtgagaatggcgaaaatatgacgaaatccgatagggtcaaattctagcgccctttccctcctccctctcacctcatcaaatgtagtttttatcgcgtgacctttgcttctttggagtcatgttctatttcatatatttttttctggacagatttactgactttaataaagtacttgatatgactgccaaaaaaaaaaaaaaaaaaaa

SEQ ID NO: 7887 - protein, 500 aa, Taenia solium
MVNFHYVFATVVIVFGSSFQFGFQTGVINSPLPLIEKYILSICEDRGSSPSPEFVQAMSSLVVAGFPIGGIFGALFGGSVSNKMGRKLSLFIFNIPMAVGSLLMMACQAAVSFEMIIVGRVLVGFACGAFTGIAPVYLAEIAPVRIRGMSGIMHQLAIVCAILISQILGLKELMGSAKLWPYLLGLTIIPSVVLLFLFWICPDSPRYILLNSQDLESAKSALFWLRGDTEVVEEEIGELLAEQENESENHTKFPLKDLFRVKALRLALFVAVVAHLAQQFSGINAALFYSTSLFESIGLTSQAVYATLGVGSMIVVITVASIFLIERVGRRILLIGGLSVMLFSAVIITIGLALRSHASGLVYLAITFVYIFVGGFAIGPGSIPWFVVAEMFVQETRDPAIVITVIVNWLAQIVISLGYPPLLKYLKDYSFMPFIGLLVIFIALLYFFLPETKGRAPCDVQDEFVRMTGGAEDDVTLGSYTRSLPSENGENMTKSDRVKF

SEQ ID NO: 7888 - DNA, 1753 bp, Medicago truncatula
  CDS (29)..(1585)
cttcttcttgctactgaggtcagaaaaaatggctggtggtggaattcccattggagggggtaacaaagagtaccccggaaacctcactccttttgtcaccataacatgcatcgttgctgccatgggtggtttgatctttggctacgatattggaatttcaggtggtgtgacgtccatggatccgtttctgaagaaattttttccggcggtgtaccggaaaaagaacaaggacaaatcgacaaaccagtactgtcaatatgacagtcaaacattgacgatgtttacatcgtcgttgtatctggctgcccttttgtcctcgttggtagcttccaccataactcgtaggtttggtcggaaactttccatgcttttcggaggattacttttccttgtcggtgctcttattaatggctttgctaatcatgtttggatgttgatcgtgggtcggatcttgctcgggtttggtatcgggtttgctaatcagcctgtgccattgtacctctctgagatggctccttacaagtatagaggagcattgaatattgggtttcaattatcaattacaattggtatacttgtggccaatgtgttgaattacttttttgccaaaatcaaaggtggatggggatggagattgagtttaggtggtgctatggtcccagcacttataataacaattggatcattagtccttcccgacacccctaactcaatgatcgaacgtggtgatcgcgatggagctaaagctcaacttaagagaattcgcggcattgaagatgttgatgaagagtttaatgacctcgtagcagctagtgaggcctcaatgcaagttgaaaacccttggagaaatttgttgcagaggaaatatagacctcagcttactatggctgtattgataccattcttccaacaatttacaggcatcaatgttatcatgttttatgcacctgtgctatttaattccattgggtttaaggacgatgcttcacttatgtcggctgtcatcaccggtgttgttaatgttgttgctacttgtgtctcaatttatggagttgataagtggggtaggagagcccttttccttgaaggtggtgctcaaatgctcatatgccaggttgcagtagcagctgcaattggggccaaatttggaacaagtggaaaccctggtaatttaccagaatggtatgctatagtagttgtgctcttcatttgcatttacgtagcaggatttgcttggtcatggggtcctcttggttggttggttcctagtgagattttcccattggagattcgttctgcagctcaaagtgtaaacgtatctgtgaacatgcttttcaccttcttagttgcacaagttttcttgataatgctttgtcacatgaagtttggtttgttcctcttctttgccttcttcgttttggtgatgtcaatctatgtattcttcttattgcctgaaactaaaggaataccaattgaagagatggacagagtttggaaatcacatcccttctggtctagatttgttgaacatggtgatcatggcaatggtgttgagatgggaaagggagctcctaaaaatgtgtaattattattattagtcttcattttattttattttcattattaattagttttattggtgaaacactaactattggtgtcaacctcaagtatcaaatgtaatgaaattgcacttcaaaattacgggattatttttctcaaaaaaaaaaaaaaaaaaaaaaaaaaaaaaaaa

SEQ ID NO: 7889 - protein, 518 aa, Medicago truncatula
MAGGGIPIGGGNKEYPGNLTPFVTITCIVAAMGGLIFGYDIGISGGVTSMDPFLKKFFPAVYRKKNKDKSTNQYCQYDSQTLTMFTSSLYLAALLSSLVASTITRRFGRKLSMLFGGLLFLVGALINGFANHVWMLIVGRILLGFGIGFANQPVPLYLSEMAPYKYRGALNIGFQLSITIGILVANVLNYFFAKIKGGWGWRLSLGGAMVPALIITIGSLVLPDTPNSMIERGDRDGAKAQLKRIRGIEDVDEEFNDLVAASEASMQVENPWRNLLQRKYRPQLTMAVLIPFFQQFTGINVIMFYAPVLFNSIGFKDDASLMSAVITGVVNVVATCVSIYGVDKWGRRALFLEGGAQMLICQVAVAAAIGAKFGTSGNPGNLPEWYAIVVVLFICIYVAGFAWSWGPLGWLVPSEIFPLEIRSAAQSVNVSVNMLFTFLVAQVFLIMLCHMKFGLFLFFAFFVLVMSIYVFFLLPETKGIPIEEMDRVWKSHPFWSRFVEHGDHGNGVEMGKGAPKNV

SEQ ID NO: 7890 - DNA, 1726 bp, Saccharum hybrid
  CDS (73)..(1629)
tgtggctggtagtggctcgtcttggagcagagagagagagagagagagagagagagagggagggagccagcgatggcgggcggcgggatggcggcgctgggcgtgaagacggagcgcgcggcgcagtacaagggccgcatgacgctcgccgtcgccatgacctgcctcgtcgccgccgtcgggggcgccatcttcggctacgacatcggcatctccggaggtgtgacatccatggacccatttctggagaaattcttcccggtggtgttccacaggaagaactccggcgggaagaataactactgcaagtacgacaaccaggggcttgcggcgttcacctcctcgctctacctcgccggcctcgtggcgtccctcgtcgcgtcccccgtgacgaggaactacggccgcaaagccagcatcgtctgcggcggcgtcagcttcctcatcggcgcggcgctcaacgtggccgccgtgaacctggccatgctcatcctcgggcgcatcatgctcggcgtcggcatcggtttcggcaaccaggccgtgccgctgtacctgtcggagatggcgccggcgcacctccgcggcgggctgaacataatgttccagctcgcgacgacgctgggcatcttcacggcgaacctgatcaactacggcacgcagaacatcaagccgtgggggtggcgtctgtcactgggcctcgccgcggcgccggcgctgctgatgacgctggccgggctgttcctcccggagacgcccaacagcctcatcgagcgcgggcgcgtggaggagggccggcgcgtgctggagcgcatccggggcaccgccgacgtggacgcggagttcacggacatggtggaggcgagcgagctggccaacaccatcgagcacccgttccggaacatcctggagccgcgcaaccggccgcagctggtgatggccgtgtgcatgccggcgttccagatcctgacggggatcaactccatcctcttctacgcgccggtcctgttccagagcatgggcttcggcgggaacgcgtccctctactcctccgtgctcaccggcgccgtgctcttctcctcgacgctcatctccatcggcaccgtggaccgcctcggccgccggaagctcctcatcagcggcgggatccagatgatcgtgtgccaggtgatcgtggcggtgatcctgggcgccaagttcggggcggacaagcagctgtcgcggagctactcgatcgcggtggtggtggtgatctgcctgttcgtgctggcgttcgggtggtcgtggggcccgctggggtggacggtgccgagcgagatcttcccgctggagacgcggtcggcggggcagagcatcacggtggccgtgaacctgctcttcaccttcgccatcgcgcaggcgttcctgtcgctgctgtgcgccttcaagttcggcatcttcctcttcttcgccgggtggatcaccgtcatgaccgtcttcgtctgcgtcttcctgccggagaccaagggcgtgcccatcgaggagatggtgctgctctggcggaagcactggttctggaagaaggtcatgccggtggacatgccgctcgaggatggctggggcgccgcacctgccagcaacaatcacaagtgaagactgaggctgtgttcagatccaaaatttggtctaaagttgtcatcacatcgaatgtaatatagataaaaaaataactaatttcacagttaagtag

SEQ ID NO: 7891 - protein, 518 aa, Saccharum hybrid
MAGGGMAALGVKTERAAQYKGRMTLAVAMTCLVAAVGGAIFGYDIGISGGVTSMDPFLEKFFPVVFHRKNSGGKNNYCKYDNQGLAAFTSSLYLAGLVASLVASPVTRNYGRKASIVCGGVSFLIGAALNVAAVNLAMLILGRIMLGVGIGFGNQAVPLYLSEMAPAHLRGGLNIMFQLATTLGIFTANLINYGTQNIKPWGWRLSLGLAAAPALLMTLAGLFLPETPNSLIERGRVEEGRRVLERIRGTADVDAEFTDMVEASELANTIEHPFRNILEPRNRPQLVMAVCMPAFQILTGINSILFYAPVLFQSMGFGGNASLYSSVLTGAVLFSSTLISIGTVDRLGRRKLLISGGIQMIVCQVIVAVILGAKFGADKQLSRSYSIAVVVVICLFVLAFGWSWGPLGWTVPSEIFPLETRSAGQSITVAVNLLFTFAIAQAFLSLLCAFKFGIFLFFAGWITVMTVFVCVFLPETKGVPIEEMVLLWRKHWFWKKVMPVDMPLEDGWGAAPASNNHK

SEQ ID NO: 7892 - DNA, 1638 bp, Debaryomyces hansenii; identical to SEQ ID NO: 265
  CDS (1)..(1638)

SEQ ID NO: 7893 - protein, 545 aa, Debaryomyces hansenii; identical to SEQ ID NO: 266

SEQ ID NO: 7894 - DNA, 1737 bp, Debaryomyces hansenii; identical to SEQ ID NO: 277
  CDS (1)..(1737)

SEQ ID NO: 7895 - protein, 578 aa, Debaryomyces hansenii; identical to SEQ ID NO: 278

SEQ ID NO: 7896 - DNA, 1584 bp, Debaryomyces hansenii; identical to SEQ ID NO: 279
  CDS (1)..(1584)

SEQ ID NO: 7897 - protein, 527 aa, Debaryomyces hansenii; identical to SEQ ID NO: 280

SEQ ID NO: 7898 - DNA, 1674 bp, Debaryomyces hansenii; identical to SEQ ID NO: 281
  CDS (1)..(1674)

SEQ ID NO: 7899 - protein, 557 aa, Debaryomyces hansenii; identical to SEQ ID NO: 282

SEQ ID NO: 7900 - DNA, 1671 bp, Debaryomyces hansenii
  CDS (1)..(1671)
atgagtaattctactaaaaaggatgactgtcatgacgtgacaatagatagcactatatcagatattgaaatagaaaggtcaggctctacaaataatgttatgattgaaccaagtcccaaaagttcttcagaattgttgagctcagaatcagttatttctgattcggacgcaagaccatccaaattgattattttaatcacgttaacatcatctataagtgggtttatgtttgggtatgacaccggttacatatcgtctgcgttggtgaatattggcactgatttgagcaataaattattgtctaacggagagaaagaatttattacgtctgctacttctttgggtgcgttgatcggggctatcattggaggcatattagccaacttgattggaagaaaaatggtgttgttaggatcaaacgttatttttgttataggaactataattcaattagctgcacatactgtttggacgatgattgttggtagatttgttttgggactcggagtgggcattgcgtctttgatttcgcctttgatgttgagtgaattggcaccgtcaaaatataggggccgtttgattgttaccaactgtatgtttataactggaggtcaattggttgcctattttataaactggggattaactggtgtgaataatgggtggagagtatctgttggattatgtatggtaccccctataattcaatttgtgttgttttgtttcttacccgataccccaaggttttatattatggtaggtagagttgaagaagctagaaaagttttgagcaaaactcaccacaatccttccaatgctttcgttaatgcaactattcaagatatgatcgcctccaattcgactgttccaggaaataatccattagttcaagcgtggaactcaattaaaatcattcacacaaatccagcaaattttagggcattaatcttagcttgtggcttacaaggtatacagcaatttacggggtttaattctttaatgtatttcagtgcaacaattttcgaaactattgggttcgataatgcaactgcagtatctattattattgccgctacgaactttgtgtttacagggattgcattatgcattattgataagataggacgtagacgtatcctattaggtgcaattccatgcatgtgtatatcattagttctttgtgctattgccttccactttttaggtgtgaagtttacatcagattctgatgtcattgttgaagcgagaggcattactggctgggggattgttattattctcggtatggtgtggtttgtggcttcttacgctattggtataggtaacagtgcttggactggtgttgaattattctcagatgtaaatgttagagctgtcggctgtatgtatgctgctgctactaattgggctggttccttagttattgcatccactttcttgaccatgttggagaatattacacctcctggcacttttgcatttttcgcaggtttatgttttgttgcattcttttttgtttttttcttattgccagaagtttcaggcttggaactagaagaaactacagaatttttagcaaatggattcaatgttaaggcatctcgtcaaatttctaaggatagaaagaaagtgtcaaaattcgttactcaaaatgacgatcacagtgcataa

SEQ ID NO: 7901 - protein, 556 aa, Debaryomyces hansenii
MSNSTKKDDCHDVTIDSTISDIEIERSGSTNNVMIEPSPKSSSELLSSESVISDSDARPSKLIILITLTSSISGFMFGYDTGYISSALVNIGTDLSNKLLSNGEKEFITSATSLGALIGAIIGGILANLIGRKMVLLGSNVIFVIGTIIQLAAHTVWTMIVGRFVLGLGVGIASLISPLMLSELAPSKYRGRLIVTNCMFITGGQLVAYFINWGLTGVNNGWRVSVGLCMVPPIIQFVLFCFLPDTPRFYIMVGRVEEARKVLSKTHHNPSNAFVNATIQDMIASNSTVPGNNPLVQAWNSIKIIHTNPANFRALILACGLQGIQQFTGFNSLMYFSATIFETIGFDNATAVSIIIAATNFVFTGIALCIIDKIGRRRILLGAIPCMCISLVLCAIAFHFLGVKFTSDSDVIVEARGITGWGIVIILGMVWFVASYAIGIGNSAWTGVELFSDVNVRAVGCMYAAATNWAGSLVIASTFLTMLENITPPGTFAFFAGLCFVAFFFVFFLLPEVSGLELEETTEFLANGFNVKASRQISKDRKKVSKFVTQNDDHSA

SEQ ID NO: 7902 - DNA, 1947 bp, Debaryomyces hansenii
  CDS (1)..(1947)
atgtcttcaagtgcaattactgaaaagccgattatgacggacctggatgaagccaatccagatgttgggttattcgaacctagttccaattcaagtatagtagaagaaaagagaagagtgtcggagttggaaagtgttcactctaaaatcgcagaacctggtcaaggtgaaaagggaaacattttgtcgcagtattccgagaagcaggtgatgcaaatgggtagaaattatgctctcaagtacgatttggatccggatttattttctcgtgctgctgctttggccagaactccaggtgagttcaacgccatgcctttcatcacagaagaagaaaagcaagcgttgcacaaggaaagtaccaagaaatggcacattcctaaaaaattggttcatgtcattgcattaggttctatggctgcggctgtgcaaggtatggatcagtctgttattaacggtgcccttttgttctacccccaatatatgggagttcacaaggactttaacttttttggttatgatactgacatgattgaaggattgatcaacggtgcaccttatttatgtgcttcttgtcttgcttgttggatgtcagatttttggaatagacacttgggtcgtaagggtactattttctggacttgtgttatttctgctgtaacatgtttctggcaagggtttaccaatacatggtatcatctttttattgccagatttattatggggtttggtatcggaattaagtcagctactgtgcctgcgtacgccgctgaatgtacacctaagcaaatcagaggtgctttggttatgttgtggcagttttttacagcatttggtattatgcttggctatgccgcttgtttagcattttattatgtgccggatcggggtattggtggaggtcttaactggagattgatgttaggttccgctggtcttccagctgtattcgtattgttccaaattccatttgtgcctgaatctcctcgttggttgatgggtaaaggaagacacaaggactcgtacgattcattgaatgcaatgcgtcttgacaaaattgctgcagctagagatacgttctaccaatacgtcttattacaagaagaagcttcttacgagggtattccaacatggaagcgtcttgtcgaaatgataacgatcagaagaaatagaaacggtgccttcggtgcttggattgttatgtttatgcaacaattctgtggtatcaatgctattgtctattataattcaacaatttttatcagaggaggttttacccaagttgatgctcttacggcatcttggggtttcggtatggttaacttcctttttgctattccaactttctataccattgataccttcggtagacgtaatttgttgttgttgacattcccgttaatgtctatcttcttattatggaccgggtttggtttcttagcttctaacgaccaaactagaattggtattgtggctagtggtgtttacattttctctgccatttattctgccggtgaaggtccagttccattcacttattctgctgaagctttcccattgtatattcgtgatcttggtatgggttttgctactgccacatgttggtttttcaattttattttagctttgacttggcctaagcttgtgagcgcctttacggagactggtgcatttggctggtatgctggatggaatatagtagggttctttttggttttatggtttttgcctgaaactaaaggtttgaccttggaagaattggatgaagtcttctccgtcagtaccagaaagcatgctatctatcagaccaaaagtatcttaattagcttccaaagagttgtattgcgtcgtcatatcgacccattacctccattatatgagcaccaaaagagattggctgttaccaatcctgattggaacaataaaaccgaaactgctcatattgagtag

SEQ ID NO: 7903 - protein, 648 aa, Debaryomyces hansenii
MSSSAITEKPIMTDLDEANPDVGLFEPSSNSSIVEEKRRVSELESVHSKIAEPGQGEKGNILSQYSEKQVMQMGRNYALKYDLDPDLFSRAAALARTPGEFNAMPFITEEEKQALHKESTKKWHIPKKLVHVIALGSMAAAVQGMDQSVINGALLFYPQYMGVHKDFNFFGYDTDMIEGLINGAPYLCASCLACWMSDFWNRHLGRKGTIFWTCVISAVTCFWQGFTNTWYHLFIARFIMGFGIGIKSATVPAYAAECTPKQIRGALVMLWQFFTAFGIMLGYAACLAFYYVPDRGIGGGLNWRLMLGSAGLPAVFVLFQIPFVPESPRWLMGKGRHKDSYDSLNAMRLDKIAAARDTFYQYVLLQEEASYEGIPTWKRLVEMITIRRNRNGAFGAWIVMFMQQFCGINAIVYYNSTIFIRGGFTQVDALTASWGFGMVNFLFAIPTFYTIDTFGRRNLLLLTFPLMSIFLLWTGFGFLASNDQTRIGIVASGVYIFSAIYSAGEGPVPFTYSAEAFPLYIRDLGMGFATATCWFFNFILALTWPKLVSAFTETGAFGWYAGWNIVGFFLVLWFLPETKGLTLEELDEVFSVSTRKHAIYQTKSILISFQRVVLRRHIDPLPPLYEHQKRLAVTNPDWNNKTETAHIE

SEQ ID NO: 7904 - DNA, 2196 bp, Debaryomyces hansenii; identical to SEQ ID NO: 287
  CDS (1)..(2196)

SEQ ID NO: 7905 - protein, 731 aa, Debaryomyces hansenii; identical to SEQ ID NO: 288

SEQ ID NO: 7906 - DNA, 1659 bp, Debaryomyces hansenii; identical to SEQ ID NO: 291
  CDS (1)..(1659)

SEQ ID NO: 7907 - protein, 552 aa, Debaryomyces hansenii; identical to SEQ ID NO: 292

SEQ ID NO: 7908 - DNA, 1623 bp, Yarrowia lipolytica; identical to SEQ ID NO: 293
  CDS (1)..(1623)

SEQ ID NO: 7909 - protein, 540 aa, Yarrowia lipolytica; identical to SEQ ID NO: 294

SEQ ID NO: 7910 - DNA, 1602 bp, Yarrowia lipolytica; identical to SEQ ID NO: 295
  CDS (1)..(1602)

SEQ ID NO: 7911 - protein, 533 aa, Yarrowia lipolytica; identical to SEQ ID NO: 296

SEQ ID NO: 7912 - DNA, 1980 bp, Yarrowia lipolytica
  CDS (1)..(1980)
atggtttttggacgagaaaaagacgactctgagggtatcgaacatgtgccctccccccaagacaacccgtcagatcagacgtcagacatcatcgctctgaacgagaaggcttctaatgaacatgatgatctccccactatccccaaacccgagggagatgccccagtcaactctgaactggaccccgacaatccgctgattcgatacagtcgcgctgagctcctcgagattgccacccagtttgcggtggataacgaccttgccgacaaagcggaagcattcagaaagggcgccctagtggcccaagacccttccggtttcgagaacatcgacatacttgatgacgacgacagatactggcttaaccgtgagatcaccaataagtgggatcatcccatgaaggtttactaccttgttgtgtgctgctccttggctgctgctgtccagggtatggatgagactgttatcaacggcgccaacatcattttccctgctcagtttggtatcaaggaggattccggtgttgtgtctcgaaagagttggctgcttggtcttgtcaactctgctccttatttgtgttgtgcatgcatctcgtgctggatgactgaccctatcaacaaagtacttggccgaaaatggacagtgttctggacctgtttctgggccggagccacctgtttctggtctggtttcgtcaacacctggtggcatctgtttattgcccggttcttcctgggattcggtattggtcccaagtccgccacagttcccgtgtacgctgccgagtgtgctcctcccaggattcgaggtgccatggttatgatgtggcagatgtggactgcttttggtatcatgatgggctatgttatggatcttgcattctactacgtcaaggatagaggaactattgtcggcctaaattggagactgatgcttggttctgctttgattcctgctcttctggtctgtatttttattgtcaaatgtcctgagtctcccagatggcacctcgctcgaggagagatccgaaagtcgtttgagtgcatgcgagaaattcgacacactgacatacaagccgctcgagataccttctacgcccacgttcttctgatcgaagagaacgagatgaagaaaggaaagaaccgatttgtggagctctttaccgttcctcgaaaccggcgagcagcctgggcttctttcattgtcatgttcatgcagcagttctgtggtatcaatgttattgcctactactcctccaacattttcatggagtctggttttggtgctatccaagctcttctggcttcgtttggttttggtgctatcaactttgtgtttgcgttgccagctgtttacactatcgacacatttggtagacgggcactattactggcgaccttccctctgatggctatattcttgctatttgctggtttctgtttctacattggccagaacgatcccacccactctcatgctcgtgtcggtttaattgctctaggtatctatctcttctcagcagtttactcctgtggagaaggtccagtgcccttcacctactcggctgaagccttccctttgtacgttcgagatttgggtatgtcgtttgccaccgccgtttgctggctctttaattttgttctagccgtcacgtggccctctctcctggcagccttcactccgcagggtgccttcggatggtatgctgcgtggaatgttgtcggattcttcttggtcctgtgtttcttgcccgagaccaagaacctgactctggaagagcttgacaaggtcttcagtgtccccacccgagtccacatgaagtaccagttcaacgccttcaaaatcaacattcagcgaacaatattacgaaaggatgtgcccaagcctcctccgctctatgcccacgaagccggtattggtggtacttctcactggagctccaagcctcagcccaacgcgaacactgccgagttcgtttaa

SEQ ID NO: 7913 - protein, 659 aa, Yarrowia lipolytica
MVFGREKDDSEGIEHVPSPQDNPSDQTSDIIALNEKASNEHDDLPTIPKPEGDAPVNSELDPDNPLIRYSRAELLEIATQFAVDNDLADKAEAFRKGALVAQDPSGFENIDILDDDDRYWLNREITNKWDHPMKVYYLVVCCSLAAAVQGMDETVINGANIIFPAQFGIKEDSGVVSRKSWLLGLVNSAPYLCCACISCWMTDPINKVLGRKWTVFWTCFWAGATCFWSGFVNTWWHLFIARFFLGFGIGPKSATVPVYAAECAPPRIRGAMVMMWQMWTAFGIMMGYVMDLAFYYVKDRGTIVGLNWRLMLGSALIPALLVCIFIVKCPESPRWHLARGEIRKSFECMREIRHTDIQAARDTFYAHVLLIEENEMKKGKNRFVELFTVPRNRRAAWASFIVMFMQQFCGINVIAYYSSNIFMESGFGAIQALLASFGFGAINFVFALPAVYTIDTFGRRALLLATFPLMAIFLLFAGFCFYIGQNDPTHSHARVGLIALGIYLFSAVYSCGEGPVPFTYSAEAFPLYVRDLGMSFATAVCWLFNFVLAVTWPSLLAAFTPQGAFGWYAAWNVVGFFLVLCFLPETKNLTLEELDKVFSVPTRVHMKYQFNAFKINIQRTILRKDVPKPPPLYAHEAGIGGTSHWSSKPQPNANTAEFV

SEQ ID NO: 7914 - DNA, 1548 bp, Yarrowia lipolytica; identical to SEQ ID NO: 305
  CDS (1)..(1548)

SEQ ID NO: 7915 - protein, 515 aa, Yarrowia lipolytica; identical to SEQ ID NO: 306

SEQ ID NO: 7916 - DNA, 1665 bp, Yarrowia lipolytica; identical to SEQ ID NO: 309
  CDS (1)..(1665)

SEQ ID NO: 7917 - protein, 554 aa, Yarrowia lipolytica; identical to SEQ ID NO: 310

SEQ ID NO: 7918 - DNA, 2364 bp, Kluyveromyces lactis; identical to SEQ ID NO: 317
  CDS (1)..(2364)

SEQ ID NO: 7919 - protein, 787 aa, Kluyveromyces lactis; identical to SEQ ID NO: 318

SEQ ID NO: 7920 - DNA, 1710 bp, Kluyveromyces lactis
  CDS (1)..(1710)
atgaacgatacttcagagcattccagtgatgtctctcccatcattttcgatgatatctctcaaagcaaattgaaagactcatctgaaaatgaaaccacggatagaatcattatcaaaccggtcaatgatgaagatgacacttcagtcatgattactttcaaccaaaagatttctccgtttatcttgatcttgacctttacagcatctatctctggtttcatgtttggttatgatactggttatatatcgagtgcattggtctctataggtacggacttggataataaagctctaacatatggtgataaggaaataattacagctgcaacatctttgggtgccttaatctcagcagtgtttgcagggatttctgccgacatttttggtagaaaaccttgtctaatgttctctaatattctttttgtcattggtgctgcgttgcaggttagtgcacattcattttggcaaatggcagtaggtagattaattatggggttcggtgtcggtattgggtcgttactagcgccattattcatttctgaaatcgcaccaaaacatatcagaggtagactaacggtgataaactcactttggctaacaggtggtcaattgatcgcttatgcatgtggtgctgggttgaataaagttcataacggttggagaattttagtcggactttctttgattccaactgtggtgcaatttacatgcttcagcttcttgccagacactccgcgtttctacgtgataaaaggtaactataagaaggctgcagaagttttacaaaagagttacattaacgctccccaggaacttatcgatcaaaaaatccgtgaactatcagatttgaatgaggctatcccaggtaagacccctgtacacaagttcttcaacactgtcaaagaattacatactgtcccatgcaatttcagggcattggtgatcggttgtgctttacaaggtattcaacaattctgtggttggaattctttaatgtatttctctggtactatttttcaaactgttggtttcgaaaattctactgcagtgtctatcatcgttgccggtactaacttcgtattcactttagtcgctttctttgcgattgataaggtcggtcgtagagcaatccttttgattggcttgcctggtatgatggtttccttggttatgtgtgctatcgccttccatttcctagatataaaattcactggcgctggtgaatcggaagtttccaatggtggattcagttcttggggtatagtcgttatcgtattcatcatggtatatgcagcattctatgctctaggtatcggtactgtaccatggcagcaatctgaattatttgcaacatccgttagaggtgtaggtacttcttattgtacagctactaactgggctggttccctaattattgcatctaccttcctaacaatgttacaaaacataacaccgactggtacattttcattatttgctgcactagctgcagtatctaccgtcttctgttatctctgttatccagaactatctggtctagaattggaggaagtacaaactattttaagtgatggattcaacatcaaagcttccaaacaactagccaagaagagaaagcaacaaaatagcgaaatgcaaaggagatttagagaaaaggacatggaagcttatcaaaaggataaaccctccgatgaactacttgaaagttaa

SEQ ID NO: 7921 - protein, 569 aa, Kluyveromyces lactis
MNDTSEHSSDVSPIIFDDISQSKLKDSSENETTDRIIIKPVNDEDDTSVMITFNQKISPFILILTFTASISGFMFGYDTGYISSALVSIGTDLDNKALTYGDKEIITAATSLGALISAVFAGISADIFGRKPCLMFSNILFVIGAALQVSAHSFWQMAVGRLIMGFGVGIGSLLAPLFISEIAPKHIRGRLTVINSLWLTGGQLIAYACGAGLNKVHNGWRILVGLSLIPTVVQFTCFSFLPDTPRFYVIKGNYKKAAEVLQKSYINAPQELIDQKIRELSDLNEAIPGKTPVHKFFNTVKELHTVPCNFRALVIGCALQGIQQFCGWNSLMYFSGTIFQTVGFENSTAVSIIVAGTNFVFTLVAFFAIDKVGRRAILLIGLPGMMVSLVMCAIAFHFLDIKFTGAGESEVSNGGFSSWGIVVIVFIMVYAAFYALGIGTVPWQQSELFATSVRGVGTSYCTATNWAGSLIIASTFLTMLQNITPTGTFSLFAALAAVSTVFCYLCYPELSGLELEEVQTILSDGFNIKASKQLAKKRKQQNSEMQRRFREKDMEAYQKDKPSDELLES

SEQ ID NO: 7922 - DNA, 1530 bp, Equus caballus
  CDS (1)..(1530): n means a or g or c or t/u, s means g or c
atgccgtcgggttttcaacagatcggctcagaagatggggaaccgnctcagcagcgagtaactgggaccctggtcctcgcagtattttctgctgtgcttggctccctgcagtttggctacaacattggggtcatcaatgccccacagaaggtgattgaacagagctacaatgagacatggctggggaggcaggggcctgaggggcccagctccatcccaccaggcaccctcaccaccctctgggctctctccgtggccatcttttctgtgggcggcatgatctcctccttcctcattggcatcatctctcagtggctgggaaggaaaagggcaatgctggtcaacaatgccctggcagtgctggggggcagcctcatgggcctggctgacactgctgcctcctatgagatgctcattcttggacggttcctcattggcgcctactcagggctgacgtcagggctggtgcccatgtatgtgggggagatcgcccccactcacctgcggggtgccttggggacactcaaccaactggccatcgtcattggcattctgatcgcccaggtgctgggcttggagtctatgctgggcactgccaccctatggccactgctcctgggcatcacagtgctgcctgcccttctgcagttggtcctactgcccttctgcccagaaagccctcgctacctctacatcagccggaacctggaggggcccgccagaaagagtctgaagcgcctgacaggctgggctgacgtgtctggagtgctggctgagctaaaggaagagaagcggaagctggagcgtgagcggccactgtccctgctccagctcctgggcagccgtgtccaccagcagcccctagtcattgcagttgtgctgcagctcagccagcagctatcgggcatcaacgctgttttctattattcaaccagcatcttcgagaaggcaggagtagggcagccagcctatgccaccataggagctggtgtggtcaacacagtcttcaccttggtctcggtgtttttggtagaacgagctgggcgccggacactccatctcctgggcctggcgggaatgtgtggctgtgccatcttgatgactgtggccctgcttctgctggagcgagttccagccatgagctatgtctccatcgtggccatatttggctttgtggcattctttgagattggccctggccccatcccttggttcatcgtggctgagcttttcagccagggaccccgcccggcagccatggctgtggctggcttctccaactggacgtgcaacttcatcattggcatgggcttccagtatgtcgcggatgctatgggtccctacgtcttccttctatttgcggtcctcctgcttggcttcttcatcttcaccttcttaagagtgcctgaaacccgaggccggacgtttgaccagatctcagccgctttccaccggacaccctctcttttagagcaggaggtgaagcccagcacggaacttgagtatttagggccagatgagaacgactga

SEQ ID NO: 7923 - protein, 509 aa, Equus caballus
  Xaa in position 16 is unknown
MPSGFQQIGSEDGEPXQQRVTGTLVLAVFSAVLGSLQFGYNIGVINAPQKVIEQSYNETWLGRQGPEGPSSIPPGTLTTLWALSVAIFSVGGMISSFLIGIISQWLGRKRAMLVNNALAVLGGSLMGLADTAASYEMLILGRFLIGAYSGLTSGLVPMYVGEIAPTHLRGALGTLNQLAIVIGILIAQVLGLESMLGTATLWPLLLGITVLPALLQLVLLPFCPESPRYLYISRNLEGPARKSLKRLTGWADVSGVLAELKEEKRKLERERPLSLLQLLGSRVHQQPLVIAVVLQLSQQLSGINAVFYYSTSIFEKAGVGQPAYATIGAGVVNTVFTLVSVFLVERAGRRTLHLLGLAGMCGCAILMTVALLLLERVPAMSYVSIVAIFGFVAFFEIGPGPIPWFIVAELFSQGPRPAAMAVAGFSNWTCNFIIGMGFQYVADAMGPYVFLLFAVLLLGFFIFTFLRVPETRGRTFDQISAAFHRTPSLLEQEVKPSTELEYLGPDEND

SEQ ID NO: 7924 - DNA, 1850 bp, Oryza sativa
  CDS (99)..(1634)
gactggttcggtgtgagcgagcgagcgagatagccatatcttcgctgtgcgtcgtcgtcgtcgctgcgtggtgaattcttggggaggaggaggacgagatggcgggaggcggcgtggcggcgctgggggtgaagaaggagcgggcggcggagtacaagggccgcatgacgctcgccgtcggcatggcctgcctcgtcgccgccgtcggcggcgccatcttcggctacgacatcggcatctccgggggagtgacgtccatggatccgttcctcaagaagttcttcccggtggtgttccggaagaagaacgacgacggccagaacaactactgcaagtacgacaaccagggcctctcggcgttcacctcctccctctacctcgccggcctcgtctcctcccttgccgcctcgccggtgacgaggaactacggccgccgcgccagcatcgtctgcggcggcctcagcttcctcgccggcgccacgctcaacgccgccgccgttaacctcgtcatgctcatcctcggccgcatcctgctcggcgtcggcatcggcttcggcaaccaggccgtgccgctgtacctgtcggaaatggcgccggcgcacctccgcggcgcgctgaacatgatgttccagctggcgacgacgctgggcatcttcacggcgaacatgatcaactacgggacgcagcacatcaggccgtgggggtggcggctctcgctggggctcgcggcggcgccggcgctgctgatgaccgtcggcgggctgctcctgccggagacgcccaacagcctgatcgagcgcgggcgcgtcgaggagggccgccgcgtgctggagcgcatccggggcaccgccgacgtggacgccgagttcacggacatggcggaggcgagcgagctcgccaactccatcgagcacccgttccgcaacatcctggagccgcgcaaccggccgcagctggtgatggcggtgtgcatgccggcgttccagatcctgacgggcatcaactccatcctcttctacgcgcccgtgctgttccagagcatgggcttcggcggcagcgcgtcgctctactcctcagtcctcaccggcgccgtcctcttctcctccaccatcatctccatctccaccgtcgaccgcctcggccgccgcaagctcctcatcagcggcggcatccaaatgatcatctgccaggtgatagtggcggtgatcttgggggtgaagttcgggacggacaaggagctgacgaggagctactcgatcgcggtggtggtggtgatctgcctgttcgtgctggcgttcgggtggtcgtgggggccgctggggtggacggtgccgagcgagatcttcccgctggagacgaggtcggcggggcagagcatcacggtggcggtgaacctcttcttcaccttcgtcatcgcgcaggcgttcctgtccctgctctgcgcgctcaagttcggcatcttcctcttcttcgccgggtggatcaccgtcatgaccgtcttcgtccacgtcttcctgccggagaccaagggcgtgcccatcgaggagatggtgctcctatggaggaagcactggttctggaagaaggtcatgcccgacctgccgctcgaggacggcgacagtcatcacaagtgaaagaaatgtactctgagatagtatatgggggttacagtagatgagacatgacatgtaggatgaggagattaagattgatcatgtgcggtaatgcattctgtgtgtatgttaattgaagttcatggatcatgatgtctgtttgtcgtggcagagaagagaaatattggaaacacaaaattttatactactcgattattaattgtctgaatcctcgtg

SEQ ID NO: 7925 - protein, 511 aa, Oryza sativa
MAGGGVAALGVKKERAAEYKGRMTLAVGMACLVAAVGGAIFGYDIGISGGVTSMDPFLKKFFPVVFRKKNDDGQNNYCKYDNQGLSAFTSSLYLAGLVSSLAASPVTRNYGRRASIVCGGLSFLAGATLNAAAVNLVMLILGRILLGVGIGFGNQAVPLYLSEMAPAHLRGALNMMFQLATTLGIFTANMINYGTQHIRPWGWRLSLGLAAAPALLMTVGGLLLPETPNSLIERGRVEEGRRVLERIRGTADVDAEFTDMAEASELANSIEHPFRNILEPRNRPQLVMAVCMPAFQILTGINSILFYAPVLFQSMGFGGSASLYSSVLTGAVLFSSTIISISTVDRLGRRKLLISGGIQMIICQVIVAVILGVKFGTDKELTRSYSIAVVVVICLFVLAFGWSWGPLGWTVPSEIFPLETRSAGQSITVAVNLFFTFVIAQAFLSLLCALKFGIFLFFAGWITVMTVFVHVFLPETKGVPIEEMVLLWRKHWFWKKVMPDLPLEDGDSHHK

SEQ ID NO: 7926 - DNA, 1644 bp, Candida glabrata
  CDS (1)..(1644)
atggttgatgagaatagcaataatgagaatgggctagaccaggaggaagaaatagatgtgtattccgatctgtattcgacgtatacgcaggttacttcgttgactactaatgatgttgataacaccacataccccatgacttggaagacagtcgccctttttggcagctccacagtgggtggattactatttggttacgatacaggtgtcatctcgggggtattgctcagtttaaagccacaggaccttggcagagctaccatttctgattgggataaagagctgatcacctccataacatgccttggttgctttgtgggatccctgctggggtctccgctggctgacaagtatggcaggaggataactctggcgatcttttgcgtattatttatagtcgccgcactgtggatggccttggccagcaacttagtactgctggtattcggtaggtttgttgtggggatcgcagtgggtactgccgcgcaatgtactccggtgtacctctgtgagatatcacctgccaaaattagaggtcaaatattagcactgaattccattgctgttactggtgggcagttcttgtcttacatattcgcttatgagctttacgacgtgaatggctcttggagaattttatttggattgtcagccgtgcctgctataatatttttatccatgttagacttcatacctgaatctcctcgttggttggtatctatgtctaaatatgatagcgctaaagcagccttgcgtatgatctatccgactgcgtctcctggtcagataaacctcaaattcaatgaactagtcatcaatctaagcaagctcaaacattaccaagatgagcaaacttcgctgatggttccattatcggtgcgttcctctcgagttacaatcaattctgctgattacggttcggtagcaaacttgagatcattacactctctaatgaatgaaccttctggaacaaatcattctaataagacagttcatcacagaatggagcctaggacaaagagagcattgttaatcggttgcgttcttatgtttttccagcaaattactggtttcaacgcgtttatgtattacgctccgctaatattttcgaaattaaactctcataacccgctacttccagcaatgtcaattgcatttactaactttttattcacctttttagctgtctatctcgttgaccttgttgggagacgttcgatgcttctaaatacaatttggattatgactgttgggttgttactgtctacaattgggtttcaacatgaaaatgttgttgtattattatttgcagtatctatatttgtggcagcatatgcttctgccatgggcaccataccctggagttcagtagaattcctgccactgaatagaaggtcgttcggagcatcatgtatatcatgtactaactggttaacaaattttgttattacagcatcttacctatctgtgatgaataagatcggtacagaagacacaatgttattctttgcattatttagtgtgatggcatggttttttgtgtatttctggtatcctgaagtcaagggactatcactggaagaaattgggaaagtgtttgaaaatggtattgatgtccattatgtttacaggaactattactga

SEQ ID NO: 7927 - protein, 547 aa, Candida glabrata
MVDENSNNENGLDQEEEIDVYSDLYSTYTQVTSLTTNDVDNTTYPMTWKTVALFGSSTVGGLLFGYDTGVISGVLLSLKPQDLGRATISDWDKELITSITCLGCFVGSLLGSPLADKYGRRITLAIFCVLFIVAALWMALASNLVLLVFGRFVVGIAVGTAAQCTPVYLCEISPAKIRGQILALNSIAVTGGQFLSYIFAYELYDVNGSWRILFGLSAVPAIIFLSMLDFIPESPRWLVSMSKYDSAKAALRMIYPTASPGQINLKFNELVINLSKLKHYQDEQTSLMVPLSVRSSRVTINSADYGSVANLRSLHSLMNEPSGTNHSNKTVHHRMEPRTKRALLIGCVLMFFQQITGFNAFMYYAPLIFSKLNSHNPLLPAMSIAFTNFLFTFLAVYLVDLVGRRSMLLNTIWIMTVGLLLSTIGFQHENVVVLLFAVSIFVAAYASAMGTIPWSSVEFLPLNRRSFGASCISCTNWLTNFVITASYLSVMNKIGTEDTMLFFALFSVMAWFFVYFWYPEVKGLSLEEIGKVFENGIDVHYVYRNYY

SEQ ID NO: 7928 - DNA, 2571 bp, Candida glabrata; identical to SEQ ID NO: 329
  CDS (1)..(2571)

SEQ ID NO: 7929 - protein, 856 aa, Candida glabrata; identical to SEQ ID NO: 330

SEQ ID NO: 7930 - DNA, 1713 bp, Candida glabrata
  CDS (1)..(1713)
atggctggtgagaaggtggagttgagctccatggatagtgctatagagataaggcatgtgaaccagcatgccaaggaaatatcgtctgagaacaagtctgagagctatgacgacaataaggagtttgaagggtccaatcgcgtggtgataaagcctgttaacgacgaggacgatgtgtctgttatgataaattttaaccagggtgtgtcacacttcattattatgctgacttttgtcgcttccttgtccggtttcttgttcggttacgacaccggttacatatcctcggcgttgatttccatagggactgacctggacaacaaagagctgacgtacggtgagaaggaaatcaccaccgctgccacctccttgggtgctttgatctttgctttagtggcagggttctccgtagacatattcggcagaaaaccatgtcttatgttctcgaacattatgtttttgatcggtgctattcttcaagtcaccgcacacaagttctggcagatgactgcgggcagattcattatgggtttcggtgtcggtatcggttccttgatcgcaccattgtacattagtgagattgcaccaaaaatgatcagaggtagactgactgtgatcaactcactgtggctgacaggtggccagttgatcgcatacggttgtggtgctggtttgaatcacgtccacaacggttggagaattctggtcggtctctccttgattccaaccgtgctacagttcgtgttctttatcttcctaccagacacgcctagatactacgttatgaaaggtgactatgagaaggccaagagcgtgctgaagagaagttacaacggtgtctctgacgaactaatagacagaaagattgaagaactattagctttgaaccaatctattccaggtaagaatcatgtagaaagaacttggaacgctgtgaaagagttgcataccaaaccagctaactttagagctctgatcatcgcatgtggtttacaaggtatccaacaattcactggttggaactccttggtctatttctccggtactatttttgaatccgttggtttcaagaattcctctgcagtttccattatcgtttctggtacaaatttcatctttacactggtggctttcttctgcatagataaaatcggtagaagaaacattctgattataggtatcccaggtatgaccgtggctcatgttatgtccgctattgcgttccacttcattggaatcaagtttgtcggtaacaccgccatcgttgaacactcaggtttctcctcatggggtattgtaatcattgtgttcattatcatgtttgctgcattctacgctctaggtattggtaccgtgccatggcaacaatctgaactgttcccacaaaacgttagaggtgtcggtactgcttttgctactgctactaactgggccggttccttagttattgcttcaactttcttgactatgttacaaaacatcactcctacaggtacattcggtttctttgcaggcttatgtgtggtttctttcttcttctgttatttctgctacccagaactttcaggtttggaattggaagaagttcaaactattttgcaagatggtttcaatgtgcaagcatctaaggaactggcaaagaagcgtaagaggcaaattgctgttctaaagaaagcaaaacatcaaccaacagaagaaatcattgaagagtga

SEQ ID NO: 7931 - protein, 570 aa, Candida glabrata
MAGEKVELSSMDSAIEIRHVNQHAKEISSENKSESYDDNKEFEGSNRVVIKPVNDEDDVSVMINFNQGVSHFIIMLTFVASLSGFLFGYDTGYISSALISIGTDLDNKELTYGEKEITTAATSLGALIFALVAGFSVDIFGRKPCLMFSNIMFLIGAILQVTAHKFWQMTAGRFIMGFGVGIGSLIAPLYISEIAPKMIRGRLTVINSLWLTGGQLIAYGCGAGLNHVHNGWRILVGLSLIPTVLQFVFFIFLPDTPRYYVMKGDYEKAKSVLKRSYNGVSDELIDRKIEELLALNQSIPGKNHVERTWNAVKELHTKPANFRALIIACGLQGIQQFTGWNSLVYFSGTIFESVGFKNSSAVSIIVSGTNFIFTLVAFFCIDKIGRRNILIIGIPGMTVAHVMSAIAFHFIGIKFVGNTAIVEHSGFSSWGIVIIVFIIMFAAFYALGIGTVPWQQSELFPQNVRGVGTAFATATNWAGSLVIASTFLTMLQNITPTGTFGFFAGLCVVSFFFCYFCYPELSGLELEEVQTILQDGFNVQASKELAKKRKRQIAVLKKAKHQPTEEIIEE

SEQ ID NO: 7932 - DNA, 2289 bp, Candida glabrata; identical to SEQ ID NO: 331
  CDS (1)..(2289)

SEQ ID NO: 7933 - protein, 762 aa, Candida glabrata; identical to SEQ ID NO: 332

SEQ ID NO: 7934 - DNA, 1695 bp, Candida glabrata; identical to SEQ ID NO: 335
  CDS (1)..(1695)

SEQ ID NO: 7935 - protein, 564 aa, Candida glabrata; identical to SEQ ID NO: 336

SEQ ID NO: 7936 - DNA, 1692 bp, Candida glabrata; identical to SEQ ID NO: 341
  CDS (1)..(1692)

SEQ ID NO: 7937 - protein, 563 aa, Candida glabrata; identical to SEQ ID NO: 342

SEQ ID NO: 7938 - DNA, 1707 bp, Candida glabrata; identical to SEQ ID NO: 343
  CDS (1)..(1707)

SEQ ID NO: 7939 - protein, 568 aa, Candida glabrata; identical to SEQ ID NO: 344

SEQ ID NO: 7940 - DNA, 1671 bp, Candida glabrata; identical to SEQ ID NO: 345
  CDS (1)..(1671)

SEQ ID NO: 7941 - protein, 556 aa, Candida glabrata; identical to SEQ ID NO: 346

SEQ ID NO: 7942 - DNA, 1754 bp, Oryza sativa
  CDS (115)..(1677)
attgattccctcctccgcgcagctcgcggcttcgatcgatcgatcgaccgatctcccacgtcgccgccgttcgatcgatccgccgccgccgccgccgccggccggccgggcaagatgccgggggccgtgatcgtgcaccaccacacgcggtacaagacgtaccccggcgaggtcaccggcttcgtcttcttctgctgcctcatcgcctccgtcggcggctgcatcttcggctacgacatcggcctcaccgccgggttgacgtcgacggagtcgttcttggcgatgttcttcccggtgatcttcgagcagcagcaggagcgggtgatcacgaaccagtactgcaagttcgacagccaggtgctgacgctgttcggctcgtcgctcttcctctccgccatggtcgccggcatcttcgcctccccgatgtcccgcgccttcggccgcaagtggaccctcttcgtcgccgccgtcgcctacctcatcggcgccatcctcggcgccatctccttcaacttcatcgttctcctcaccggccgcctcctcctcggcgtcggcgtcggcgtctgcatccacgcgtcaccgctgtacatatcggagatggcgccggcgcagcagcgggggatgctgaacatactgttccagctgatgatcacggtggggatcctgtcggcgagcctgacaacgtactggacgtcgaagatcgccggcgggtgggggtggcgcgtggggctggcgttcgggacggtgccggcggcggtgatcgcgctggggtcgctggccatcccggacacgccggtgtcgctcatcgcgcgcggcgagggcgaggcggcgcgcgcgacgctggccaagatccgcggcgtcgacgacgtgcgcgccgagttcgaggacctgacgacggcgagcgaggagagcaaggcggtggcgcacccgtggcgggagctcttcttcggcggcaggtacaagccgcagctcgcgttcgcggtgctcatccccttcttccagcagctcaccggcatcaacgtcatcatgttctacgcccccgtcctcttcaagaccgtcggcttccgccaggacgcctccctcgtctcctccgtcatcaccggcctcgtcaacgtcttctccaccttcgtcgccgtcatgaccgccgacaaggtcggccgccgcgccctcttcctccaaggtggcacccaaatgatcatctcccagatcttggtgggaacattcatcggattacagttcggggtgagcgggacgggggcgatgtcggagcagtacgcgatgtgcatcgttctgttcgtgtgcgtgtacgtggccgggttcgcgtggtcgtgggggccgatggggtggctgatcccgagcgaggtgtacccgctggcggtgaggtcggcggcgcagagcgtgacggtggcggtgaacatgttcttcacggcgttcatcagccagatcttcctcaccctcctctgccacctccgcttcggcctcttctacttcttcggcgcctgggtcctcctcatgaccgtcttcatcgccaccctcctcccggagaccaagtgcgtgccgctcgaagaggtggcgcacgtctggaggaagcactggttctggcgcaagttcatcgtcgactcccccgaccgcggcggcgccgagatgaggaagaggatagccctagagatgagctagagttctctactaatatactgacgtgcaaagcttttacgcgttcgcgaaaaagagaagagaataaaagcttagctaac

SEQ ID NO: 7943 - protein, 520 aa, Oryza sativa
MPGAVIVHHHTRYKTYPGEVTGFVFFCCLIASVGGCIFGYDIGLTAGLTSTESFLAMFFPVIFEQQQERVITNQYCKFDSQVLTLFGSSLFLSAMVAGIFASPMSRAFGRKWTLFVAAVAYLIGAILGAISFNFIVLLTGRLLLGVGVGVCIHASPLYISEMAPAQQRGMLNILFQLMITVGILSASLTTYWTSKIAGGWGWRVGLAFGTVPAAVIALGSLAIPDTPVSLIARGEGEAARATLAKIRGVDDVRAEFEDLTTASEESKAVAHPWRELFFGGRYKPQLAFAVLIPFFQQLTGINVIMFYAPVLFKTVGFRQDASLVSSVITGLVNVFSTFVAVMTADKVGRRALFLQGGTQMIISQILVGTFIGLQFGVSGTGAMSEQYAMCIVLFVCVYVAGFAWSWGPMGWLIPSEVYPLAVRSAAQSVTVAVNMFFTAFISQIFLTLLCHLRFGLFYFFGAWVLLMTVFIATLLPETKCVPLEEVAHVWRKHWFWRKFIVDSPDRGGAEMRKRIALEMS

SEQ ID NO: 7944 - DNA, 2196 bp, Oryza sativa
  CDS (301)..(1746)
tgaggaaccaacagaagcaaaggtggcattcgttcgtcgcacgagagcaccacagcctcacgacacgagctcatcccccgccatctccgctccgctcctctcctctcctctccgtgctacgccaccaaacccactccccccgagatagagagagagagagagagagatccacagcctcacagcatcaaatcacctcccctttctcccagatccaagccgccgccaccaccccctcgccgtcgccgtcgccccctccggccgatctgatgcccgcgcacgcggcggtggtggtcagcgccgatgcggtggaagcttaagtcgtcggcgtacaagcgcgtgccgtccagggacgccgccatggatctcgacgtcgagacgccagcgaaaatggcggacggcggggccccgtcgtggcgcatgtcgctgccgcacgtgtgcgtcgccacgctcacctccttcctcttcggctaccactccggggtcgtgaacgagccgctcgagagcatctccaccgacctcggcttcgccgggaacaccctcgccgaaggccttgtggtgagcatctgcctgggtggtgcgtttgttgggtgcctgttcagtggatccatcgctgacggaatcggcaggcgtcgcgcgtttcagctcagtgcgctgcccatgatcatcggcgctgccgtaagcgctctcaccaatagtctggagggtatgcttcttggaagatttttggttggaacagggatgggattaggtccaccagtagcttcactgtacataacagaggtttctcctccttcagtgaggggcacatatgggagctttgttcagattgcaacctgccttggaatcgtagtatctctcctaattggtacacctgtgaaggatattgatagatggtggagggtgtgtttctgggttgcagctgttccagcaactttacaagctcttggaatggagttctgtgctgagagcccccagtggctgtataagtgtggaagaacgactgaagcagagatacaatttgaaaaacttctaggtcctcttcatgttaagtctgctatggcagaactctcccgatctgaaagaggcgatgatggagaaaatgtgaagtattcggaattgttttatggtcgcaactttaatgttgtttttattggcacaacgctctttgctttacaacagttatccggcataaattctgtgttctatttctcatcaactgtgttcagaagtgtgggtgtgccccctaaccttgcgaacatatgcatggggatagcaaatttatcaggctcaattgtagctatgcttctaatggacaaactaggaaggaaagtacttctttcagggagcttccttggcatggcctttgcaatgggacttcaggctgttggagcaaatcgtcaccaccttggttctgcaagcgtatatctttcagttggtggcatgctattgtttgtcttgacattttcgttaggagcaggtccagtgccaggacttcttttgcctgagattttcccaaacaaaatacgggccaaggctatggctctgtgcatgtccgtgcattgggtggtaaatttttttgtcagtttgttgttcttgcggcttctggagcaacttggtccacaagttctgtacacaatgttttcctcagcttgtgtggtagcagcaatatttgtgcggcgccatgtggttgaaacaaagggaaagactttgcaagagatagaagtttcgcttctacaaacacaataaagatttcatcagcgagtttgaggcaacaacaacctacatgattagcatctgacactatacttgttgctgaatacctgctgggaaagtctaccgtgaaagttgatcactgaaccaagccaacataccacggacaggcagcgccctacactggaccagggaagtacccagacatgcacctgtgaccagtaagggcgacctagctcgtgcataaaccatccatgtagtgaggttgcatctgtatagttggtcttctgctagatgtatctggtaatctgtgttgtcttcatcatttgtcatttgtacactgtcagtatggagaaaaaaagacgggaagtgtggttactgatggccatagtttgaaccgtggatacgttttttttactgtttaaagaggaataacagcactggctctgccagctacatgaaaataaagtgcgttctgcctgagcc

SEQ ID NO: 7945 - protein, 481 aa, Oryza sativa
MRWKLKSSAYKRVPSRDAAMDLDVETPAKMADGGAPSWRMSLPHVCVATLTSFLFGYHSGVVNEPLESISTDLGFAGNTLAEGLVVSICLGGAFVGCLFSGSIADGIGRRRAFQLSALPMIIGAAVSALTNSLEGMLLGRFLVGTGMGLGPPVASLYITEVSPPSVRGTYGSFVQIATCLGIVVSLLIGTPVKDIDRWWRVCFWVAAVPATLQALGMEFCAESPQWLYKCGRTTEAEIQFEKLLGPLHVKSAMAELSRSERGDDGENVKYSELFYGRNFNVVFIGTTLFALQQLSGINSVFYFSSTVFRSVGVPPNLANICMGIANLSGSIVAMLLMDKLGRKVLLSGSFLGMAFAMGLQAVGANRHHLGSASVYLSVGGMLLFVLTFSLGAGPVPGLLLPEIFPNKIRAKAMALCMSVHWVVNFFVSLLFLRLLEQLGPQVLYTMFSSACVVAAIFVRRHVVETKGKTLQEIEVSLLQTQ

SEQ ID NO: 7946 - DNA, 2048 bp, Equus caballus; identical to SEQ ID NO: 355
  CDS (178)..(1752): n means a or g or c or t/u, s means g or c

SEQ ID NO: 7947 - protein, 524 aa, Equus caballus; identical to SEQ ID NO: 356

SEQ ID NO: 7948 - DNA, 1443 bp, Photobacterium profundum
  CDS (1)..(1443)
atgtcatcaagtgtcgagacatcatcaaaaaaacataacctgagttacatcattcgaatttgttgtatcgctgcattaggggggatcttattaggatatgataccgctgttatttcaggagctatcggaccgataagagaatacttcaacttaacggcggcacaaaccggatgggctgtttccagtgttgtattaggcagtattattggtgcaatcagttctggctggtgtgcgcttaaatatggccgtagaaaagcattattcttagctgctcttttattcatcatttccgcgataggctctgcccttgccgctacctttaccatctatgtgttattcagaattgtagggggtattgcggttggtttagcatgtgttgtctctcctatgtatatgtctgaagtcgccccgaaagatttcagggggcgtgcagtcagcatgttccaacaatctgccgttattggtcaaacgggtgtgttctacgttaactatctgattgcaaaaggcatgtctgaagcgtggcttgttgatataggctggcgttggatgctagcatcagaagttctacctgccttattatttggtagcctgttaattatcattcctgaatcacctcgttggttagtcttaaaaggacaccttgatcaagcaaaagaaaccctttcacgtatttctaaccctgaacatgccgaccgcgttattcttgaaatacaaaaatcattagtacccactaatgcatcaaaaaataataaggtcagcttacgttcaccattactattctccattctggttattggtacttttgttgctgcagcacagcagttaaccggtattaatgtcattatgtactacacaccagaaattctaaatccgattgcgggtggtactgaaaacgcactattacaaaccactttcgtgggtgtcgtctttatttttggtaatgctttaggtatgtacctgattgataaagtgggtcgtttaccactgatgaaatacggtacattcggttgtgcgctaggtatgactattgtgggttatgtgctgtatacgggcactgaaggctatgcggctttattcgcactctgtctatatgttgtcgcatatgctgcatcttggggctgtgcctgctggacaatgatttcagaaatattcccgaatagcatccgttctcgtgcaatggccattgctgttggtgcacaatggtttacgggtttcattgttacccagtctttcccgatgttaaatgaaaatgcttacctaaaagagcactttaatggtgcattcagcttctgggtgttcgcggttctttctatcatgtgtatgtatgttgttgttaagtatgtacctgaaacgaaaggcgttagcttggaagacatggaaaaagtcatggctgaaaaactaggtaaaaataagaaacgtcaagttgcagaagcaagcgcttaa

SEQ ID NO: 7949 - protein, 480 aa, Photobacterium profundum
MSSSVETSSKKHNLSYIIRICCIAALGGILLGYDTAVISGAIGPIREYFNLTAAQTGWAVSSVVLGSIIGAISSGWCALKYGRRKALFLAALLFIISAIGSALAATFTIYVLFRIVGGIAVGLACVVSPMYMSEVAPKDFRGRAVSMFQQSAVIGQTGVFYVNYLIAKGMSEAWLVDIGWRWMLASEVLPALLFGSLLIIIPESPRWLVLKGHLDQAKETLSRISNPEHADRVILEIQKSLVPTNASKNNKVSLRSPLLFSILVIGTFVAAAQQLTGINVIMYYTPEILNPIAGGTENALLQTTFVGVVFIFGNALGMYLIDKVGRLPLMKYGTFGCALGMTIVGYVLYTGTEGYAALFALCLYVVAYAASWGCACWTMISEIFPNSIRSRAMAIAVGAQWFTGFIVTQSFPMLNENAYLKEHFNGAFSFWVFAVLSIMCMYVVVKYVPETKGVSLEDMEKVMAEKLGKNKKRQVAEASA

SEQ ID NO: 7950 - DNA, 2181 bp, Drosophila melanogaster
  CDS (549)..(2015)
tcatttccaacttccatgcggcgtgtttcgggtttatttttcgtctaggtgtaaacatttctaattagtgttgtgtttggtgcagtagttcttccttccaatctttgttatcagtcgcgtagtgctaatcgactctatctcaagtgcgctggtaccgtaaaaggtctccgttctttttttggccaatcacttgtatcaataaataattaggggctatcgctccgtgtttatttcgagacataatttaattccagaaagcagtgaggcggcacataagagctctccggtgctcggcaaacgacaaaactaatttatggcattaaaaatgcatattttctagcagtgcgtcgacagtttttatcatttgccagaaaggcaaaaggcgctatccaccagcagctgtgccagaaaaggaagctaggaagacacgtcggtcgagaattggatttgactgcggaggattttgaatccgagtccgaaagttctttagtcagcaaccgaagaagcgtaggataattcacatttttctcacggcaactggcaacgaaatggctttcctatgtgcaccgggtctcaccttcttcctcacctactcgattttctcggcggtgctgggcatgctgcaattcggctacaacaccggcgtcatcaacgcgcccgaaaagaatatcgagaacttcatgaaggacgtctacaaggaccgctacggcgaggacatcagcgaggagttcatccagcagctctactcggtggcggtatccattttcgccatcggcggcatgctgggcggtttcagcggaggctggatggccaaccgctttggcagaaaaggcggcctactgttgaacaatgtgctcggaattgccggcgcctgtttgatgggatttaccaaagttagtcattcctatgaaatgttattccttggccgatttataattggtgttaattgcggcctcaacacttcgctggtgcccatgtacatctcggagatagcgccactgaatctgcgcggtggcttaggaactgttaatcaattggctgtgactgtaggtttactattatcccaagtgctgggcatcgagcaaatcctcggcaccaacgagggctggcccatcctcctgggcctggccatctgcccggcgatcctgcagctgatcctgctgcccgtctgcccggaatcgcccagatatctgctcattaccaagcagtgggaggaggaggcgcgaaaagccctgcgccgactgcgagcctctgggtccgtggaggaggacatcgaggagatgcgggccgaggagcgcgcccagcagtccgagagccacatatcgaccatggagctgatatgctcgcccaccctgcgccctccgctgatcatcggcatcgtgatgcagctgagccagcaattcagcggcatcaacgccgtcttctactattccacgtcgctgttcatgagctcgggattgactgaggagagcgccaagttcgctacgataggcatcggcgccataatggttgttatgacgctcgtgtccattccgctaatggatcgcacgggtcgccggaccctgcatctctatggtctgggcggaatgttcatcttctcaatcttcatcaccatttcgttcctgatcaaggagttctttggttatgtgcaggaaatgatcgactggatgtcctacctctctgtggtggccactctcggattcgtcgtcttctttgcggtgggacccggttcgataccctggatgattaccgcggagctcttctcccagggaccccggcccagtgccatggctattgcggtgctggtcaactggatggccaactttgtggtcggcattggtttccccagcatgaagactgccctggagaactacacgttcttgccgttcagcgtattcctggccatcttctggatattcacgtacaagaaggtgcccgagacgaagaacaagacgttcgaggagatcctggccctcttccggcacaacaatggcaggtatgtgtccttgcactagctcattctacgctcaaattctgcacacaaatcatggcaatatgtcgaatagttatccagctcataacttaaactcaactttcttaactgacacaagaaatgcgaactataaatactataaaatacaatacagaatctttgtaaaaaaaaaaaaaaaaaaaaaaaaa

SEQ ID NO: 7951 - protein, 488 aa, Drosophila melanogaster
MAFLCAPGLTFFLTYSIFSAVLGMLQFGYNTGVINAPEKNIENFMKDVYKDRYGEDISEEFIQQLYSVAVSIFAIGGMLGGFSGGWMANRFGRKGGLLLNNVLGIAGACLMGFTKVSHSYEMLFLGRFIIGVNCGLNTSLVPMYISEIAPLNLRGGLGTVNQLAVTVGLLLSQVLGIEQILGTNEGWPILLGLAICPAILQLILLPVCPESPRYLLITKQWEEEARKALRRLRASGSVEEDIEEMRAEERAQQSESHISTMELICSPTLRPPLIIGIVMQLSQQFSGINAVFYYSTSLFMSSGLTEESAKFATIGIGAIMVVMTLVSIPLMDRTGRRTLHLYGLGGMFIFSIFITISFLIKEFFGYVQEMIDWMSYLSVVATLGFVVFFAVGPGSIPWMITAELFSQGPRPSAMAIAVLVNWMANFVVGIGFPSMKTALENYTFLPFSVFLAIFWIFTYKKVPETKNKTFEEILALFRHNNGRYVSLH

SEQ ID NO: 7952 - DNA, 2536 bp, Pichia angusta
  CDS (578)..(2203)
gatctctcgtgaaaactctgcgtgatggtgggacgtgtattgtttggaaattcatattcagccattattaatgggcaaacggagtaaatcctgacgtggactacctcaagtggaaattccaaaaatttttgcattgttctatttgctgcacaagcaccccatgatgtagcgtgcacaatagaccacgggctgtttttagaacaacaacaatacggtcactctcgcgactggggaaatgtggggccggccgtgcacggcgttgaaagggtctttatccgagaaatagtcttccaggcgagaaagaagagtgtagtaagacctgttgcaaacttggccatgatgaacagtacgacccacacaggaccgtaagtgaggactatcctgatgtttttacccttcccgttccaaatatttttccattgccttgctgcatgcagcacaacaaaagtccagatttttctccccaccttttctcaaaaaaacctggggggctattggacatccattgtttacccttggtataaatacgtgttgtatccccagcaatttctcccgtatccaatcaactattacaaacatggctggcgacagtattactggtgtggcaggaactgctgacgttaacagagtcgaggctcccttgactgtgagagcttatcttatgtgcgcctttggtgcgtttggaggtatccttttcggatacgactccggttacatttccggtgtcatgggtatggactactttatccatgaattcactggaaaggtgaaacacggcgacgatgactcctcttttgtcgttggatcgtctcaaaaatctcttattacttctattctttctgcaggtaccttttttggtgctgtgtgtgccggagacttggccgacatgtttggaagaagaaccattattgtgaccggctgcagtatctactcggtcggtgttgcgctccaggttgcctccaccacggtggctctgctttccgtaggaagagttatagcaggtgttggtgttggttttgtttcgtccgtggtggttttgtatctgtctgaaatttctccaaagaaaatcagaggtgccatcgtttccggttaccagttcttcgtcaccatcggattgctgctcgcgtcctgtgttgactacggcaccgagcacagaaacgactccggctcctacagaatccctattgctctgcaactcatctgggccatcattcttgctgtcggactcatcttgctcccagaatctcctagatactacgtcctcaagggcaagtttgacagggctgcaaaggtgctctccagacttaggggccagcctatcgattccgactacattcaagaagaactcgccgagatcgtggccaaccacgagtacgagaggagcgtcattccaactacgagctactggcaatcctgggcagcttgtttcaccggaggactcagaagaccatcctcgaacctcagaaagaccatcctcggaacctccatgcagatgatgcagcaatggaccggtgtcaacttcatcttctacttcggtaccaccttcttccagcagcttggcaccatccacaatgagttcctgatctcgatgatcactacgatcgtcaatgtggcctcaactcctctgtccttctacacgatcgagaaattcggtcgtcgtgcgctcatgatctacggtgcagcaggtatggttgtgtgtcagtttatcgtggccattggtggtaccgttgatggcgacaatcagaaaaccgtcagcgccatgatcgccttcatctgcatctacattttcttctttgcttcgacctggggtccgggagcttgggttattatcggagagatcttcccattgccaatcagatcgagaggtgttggtctgtcgaccgcctccaactggttgtggaactgtatcattgccgttatcactccttacatggttgacggcgataagggcaatttgggtgctaaggtgttcttcatctggggctcgctatgtggttgctgtcttctttatgccattatgctgatcccagaaaccaagggcctgactttggagcaagtcgacaagatgcttgaggagaccaccccatggacctctgccaaatggaaacctcactccaccttcgctgccgagatgggtcttgccaaggacgacaagggcgtcacccacgagctcaaggagcacgccagcgttgagagtgtataggcgtttagtatgtatactacggctaatatgacattatgagcgatccgaagagggcggggcacgagagtgccagatacactgtattgcggactctcgggaatggtgccgaatcgatggtgtatttttgtgctctgcaacggtgaattttcggtgagtagttgacctttttttacggccaaatacagattgatcttctcatctcgacatttgcatggtgttcaagcagtcgtagctgatttcaagctgcagcatgtgaggtctaaaacagttttgccaggccgtcgctgttggcctccctgtataatgtccggtcatccaaacgttaaaggttgc

SEQ ID NO: 7953 - protein, 541 aa, Pichia angusta
MAGDSITGVAGTADVNRVEAPLTVRAYLMCAFGAFGGILFGYDSGYISGVMGMDYFIHEFTGKVKHGDDDSSFVVGSSQKSLITSILSAGTFFGAVCAGDLADMFGRRTIIVTGCSIYSVGVALQVASTTVALLSVGRVIAGVGVGFVSSVVVLYLSEISPKKIRGAIVSGYQFFVTIGLLLASCVDYGTEHRNDSGSYRIPIALQLIWAIILAVGLILLPESPRYYVLKGKFDRAAKVLSRLRGQPIDSDYIQEELAEIVANHEYERSVIPTTSYWQSWAACFTGGLRRPSSNLRKTILGTSMQMMQQWTGVNFIFYFGTTFFQQLGTIHNEFLISMITTIVNVASTPLSFYTIEKFGRRALMIYGAAGMVVCQFIVAIGGTVDGDNQKTVSAMIAFICIYIFFFASTWGPGAWVIIGEIFPLPIRSRGVGLSTASNWLWNCIIAVITPYMVDGDKGNLGAKVFFIWGSLCGCCLLYAIMLIPETKGLTLEQVDKMLEETTPWTSAKWKPHSTFAAEMGLAKDDKGVTHELKEHASVESV

SEQ ID NO: 7954 - DNA, 1544 bp, Bos taurus
  CDS (12)..(1541)
cctaagacaagatgccgtcgggcttccaacagatcggctctgaagatggggagccccctcggcagcgagtcactgggaccttggtccttgccgtattctccgctgttcttggctccctgcagtttggctacaacattggggtcatcaatgccccccagaaggtgattgaacagagctacaatgagacctggctggggaggcaggggcctgagggacccggctccatcccaccaggcacactcaccacactctgggctctctccgtggccatcttctctgtgggtggcatgatctcatccttcctgattggcatcatctctcagtggctgggaaggaagagggccatgctgttcaacaacgccctggcagtgctggggggcaccctcatgggcctggccaaggcagctgcctcctatgagatgctcattcttggacggttcttcattggcgcctactcagggctgacgtcggggctggtacccatgtacgtgggggagattgcccctactcacctgcggggcgccctggggacactcaatcaactagccatcgtcactggcatcctaatcgcccaggtgctaggtttggagtccatgctgggcacagccaccttatggccactcctcctgggcatcaccgtgctgcctgccctcctgcagatggtcctgctgcccctctgcccggaaagcccccgctacctctacatcatccggaacctggaggggcccgccagaaagagtctgaagcgcctgacgggctgggccgacgtgtctgaggtgttggctgagctgaaggaggagaagcggaagctggagcgtgagcggcccctgtccttgctccagctcctgggcagccacacccatcggcagcccctcgtcatcgccattatgctgcagctgagccagcagctctcaggcatcaatgcggttttctattattccaccagcatctttgagtcagcgggggtagagaaaccagcctatgccaccattggagccggcgtggtcaacacagtcttcaccttagtctcggtgttcttggtggaacgggctgggcgccggaccctccatctcctgggcctggcaggcatgtgtggctgcgccatcttgatgactgtggctctgcttctgctggagcgggttccagccatgagctatgtctccattgtggccatctttggcttcgtggccttctttgaaattggccctggccccatcccctggttcatcgtggccgagctcttcagccagggaccccgcccagcggccatggcagtggctgggttctccaactggacatgcaacttcatcatcggcatgggtttccagtatgtggcggatgctatgggtccctacgtctttcttctattcgcggtcctcctgcttggcttcttcatcttcaccttcttaaaagtgcctgaaacccgtggcaggacgtttgaccagatctcagccgttttccaccggacaccttctcttctggagcaggaagtgaaacccagcacagaactggagtacttagggccagatgagcatgactgaggg

SEQ ID NO: 7955 - protein, 509 aa, Bos taurus
MPSGFQQIGSEDGEPPRQRVTGTLVLAVFSAVLGSLQFGYNIGVINAPQKVIEQSYNETWLGRQGPEGPGSIPPGTLTTLWALSVAIFSVGGMISSFLIGIISQWLGRKRAMLFNNALAVLGGTLMGLAKAAASYEMLILGRFFIGAYSGLTSGLVPMYVGEIAPTHLRGALGTLNQLAIVTGILIAQVLGLESMLGTATLWPLLLGITVLPALLQMVLLPLCPESPRYLYIIRNLEGPARKSLKRLTGWADVSEVLAELKEEKRKLERERPLSLLQLLGSHTHRQPLVIAIMLQLSQQLSGINAVFYYSTSIFESAGVEKPAYATIGAGVVNTVFTLVSVFLVERAGRRTLHLLGLAGMCGCAILMTVALLLLERVPAMSYVSIVAIFGFVAFFEIGPGPIPWFIVAELFSQGPRPAAMAVAGFSNWTCNFIIGMGFQYVADAMGPYVFLLFAVLLLGFFIFTFLKVPETRGRTFDQISAVFHRTPSLLEQEVKPSTELEYLGPDEHD

SEQ ID NO: 7956 - DNA, 1590 bp, Oryza sativa
  CDS (1)..(1590)
atggccggcggcgtggtggtgaacaacggaggggggaaggactaccccgggaagctcaccatgttcgtcctcttcgcctgcatcgtcgcagccaccggcggcctcatcttcggatatgacatcggcatctccgggggtgtgacgtcgatgaacccgttcctgatcaagttcttcccgtcggtgtaccggaaggagcaggcggcggagaagaaccagagcaaccagtactgcaagttcgacagcccgctgctgaccatgttcacctcgtcgctctacctcgccgcgctcgtcgcctccttcttcgcgtccaccgtcacccgcgtcgcggggcgcaagtggtccatgttcggcggcggcgtcaccttcctcgtcggcgccgcgctcaacggcgccgccaagaacgtgctcatgctcatcctcggccgcgtcctcctcggtgtcggcgtcggcttcgccaaccagtctgtgccgctgtacctgtcggagatggcgccggcgaggctgcgcgggatgctcaacatcgggttccagctgatgatcaccattggcatcctgtgcgccaacctgatcaactacgggactgccaagatcaagggcgggtgggggtggcgcgtgagcctggcgctggcggcggtgccggcggcgatcatcgccgtgggcgcgctcttcctccctgacacgcccaactccctcatcgaccgcggccacaccgacgccgccaagcgcatgctccggcgcgtgcgcggcaccgacgacatcgaggaggagtacaacgacctggtggccgccagcgaggagtccaagctcgtggcgcacccgtggcggaacatcctccagcgccggtacaggccgcagctgaccatggccatcgccatcccgctgttccagcagctgacggggatcaacgtcatcatgttctacgcgccggtgctgttcaagacgctgggattcgccgacgacgcgtccctcatgtccgccgtgatcaccggcctcgtgaacgtcttcgccaccttcgtgtccatcgtgaccgtcgaccgcctcggccgccggaagctgttcctccagggcgggacgcagatgctggcgtgccagatcgtcgtcggaggcctcatcggcgccgagttcgggttctccggcgtggccgacatccccaaggcatacgcggcgttcgtggtgctcttcatctgcgcctacgtcgccgggttcgcgtggtcgtgggggcccctgggctggctcgtccccagcgagatcttcccgctggagatcaggtcggcggggcagagcatcaacgtgtcggtgaacatgctcttcaccttcatcatcgcgcaggcgttcctccccatgctctgccgcttcaagttcatcctcttcttcttcggcgcgtgggtggtgatcatgacgctgttcgtcgccttcttcctgccggagaccaagaacgtgcccatcgaggagatggtgctcgtctggaagtcgcactggtactggggcaggttcatccgcgacgaggacgtgcacgtcggcgccgatgtcgagatgcccgccgccggcaaccgcaacggcaaggtcgacccggccaagctcgccaactga

SEQ ID NO: 7957 - protein, 529 aa, Oryza sativa
MAGGVVVNNGGGKDYPGKLTMFVLFACIVAATGGLIFGYDIGISGGVTSMNPFLIKFFPSVYRKEQAAEKNQSNQYCKFDSPLLTMFTSSLYLAALVASFFASTVTRVAGRKWSMFGGGVTFLVGAALNGAAKNVLMLILGRVLLGVGVGFANQSVPLYLSEMAPARLRGMLNIGFQLMITIGILCANLINYGTAKIKGGWGWRVSLALAAVPAAIIAVGALFLPDTPNSLIDRGHTDAAKRMLRRVRGTDDIEEEYNDLVAASEESKLVAHPWRNILQRRYRPQLTMAIAIPLFQQLTGINVIMFYAPVLFKTLGFADDASLMSAVITGLVNVFATFVSIVTVDRLGRRKLFLQGGTQMLACQIVVGGLIGAEFGFSGVADIPKAYAAFVVLFICAYVAGFAWSWGPLGWLVPSEIFPLEIRSAGQSINVSVNMLFTFIIAQAFLPMLCRFKFILFFFGAWVVIMTLFVAFFLPETKNVPIEEMVLVWKSHWYWGRFIRDEDVHVGADVEMPAAGNRNGKVDPAKLAN

SEQ ID NO: 7958 - DNA, 1548 bp, Oryza sativa
  CDS (1)..(1548)
atggcgggagggttctctgtgtcggggtccggggtggagttcgaggcgaagatcacgccgatcgtcatcatctcctgcatcatggcggccaccggcggcctcatgttcggctacgacgtcggtatctcaggcggagtgacatcgatggatgacttcctgcgcgagttcttcccgacggtgctgaagaagaagcacgaggacaaggagagcaactactgcaagtatgacaaccagggcctgcagctgttcacctcgtcgctgtacctcgccggcctcacggccaccttcttcgcctcctacaccactcgccggctcggccgccgcctcaccatgctcatcgccggcgtcttcttcatcgtcggcgtcatcttcaacggcgccgcccagaacctcgccatgctcatagtcggcaggatcctgctcggctgtggcgtcggctttgccaaccaggccgttccattgttcctgtcggagatcgcgccgacgaggatccgcggcgggctcaacatcctcttccagctcaacgtcaccatcggcatcctcttcgccaacctcgtcaactacggcaccgccaagatccacccgtggggatggcggctgtcgctgtcgctggccggcatcccggcggcgctgctgacgctgggcgcgctgttcgtggtggacacgcccaacagcctgatcgagcgcgggaggctggaggaagggaaggcggtgctgaggaagatccgggggacggacaacgtggagccggagttcaacgagatcgtggaggcgagccgcgtggcgcaggaggtgaagcacccgttccgcaacctgctccagcgccggaaccggccgcagctggtgatcgccgtgctgctgcaaatattccagcagttcacgggcatcaacgccatcatgttctacgcgcccgtgctgttcaacacgctcgggttcaagaccgacgcgtcgctctactccgcggtgatcacgggggccgtgaacgtgctgtccacgctggtgtccgtctactcggcggacagggtggggaggcggatgctgctgctggaggccggcgtgcagatgttcctgtcgcaggtggccatcgccgtcgtgctggggatcaaggtgacggaccggtcggacaacctcggccacgggtgggcgatcatggtggtggtgatggtgtgcacgttcgtgtcctccttcgcgtggtcgtggggcccgctcgggtggctcatccccagcgagacgttcccgctggagacgcggtcggcggggcagagcgtcaccgtgtgcgtcaacctgctcttcaccttcgtcatcgcgcaggcgttcctctccatgctctgccacctcaagtacgccatcttcgccttcttctccgcgtgggtcgtcgtcatgtcgctcttcgtgctcttcttcctgcccgagaccaagaacatccccatcgaggagatgaccgagagggtgtggaagcagcactggttctggaagcgcttcatggacgacgccgacaaacaccacgtcgtccccaatggcgggaagagcaacggcgccaccgtttaa

SEQ ID NO: 7959 - protein, 515 aa, Oryza sativa
MAGGFSVSGSGVEFEAKITPIVIISCIMAATGGLMFGYDVGISGGVTSMDDFLREFFPTVLKKKHEDKESNYCKYDNQGLQLFTSSLYLAGLTATFFASYTTRRLGRRLTMLIAGVFFIVGVIFNGAAQNLAMLIVGRILLGCGVGFANQAVPLFLSEIAPTRIRGGLNILFQLNVTIGILFANLVNYGTAKIHPWGWRLSLSLAGIPAALLTLGALFVVDTPNSLIERGRLEEGKAVLRKIRGTDNVEPEFNEIVEASRVAQEVKHPFRNLLQRRNRPQLVIAVLLQIFQQFTGINAIMFYAPVLFNTLGFKTDASLYSAVITGAVNVLSTLVSVYSADRVGRRMLLLEAGVQMFLSQVAIAVVLGIKVTDRSDNLGHGWAIMVVVMVCTFVSSFAWSWGPLGWLIPSETFPLETRSAGQSVTVCVNLLFTFVIAQAFLSMLCHLKYAIFAFFSAWVVVMSLFVLFFLPETKNIPIEEMTERVWKQHWFWKRFMDDADKHHVVPNGGKSNGATV

SEQ ID NO: 7960 - DNA, 2355 bp, Oryctolagus cuniculus
  CDS (1)..(1530)
atgccgtcgggcttccaacagatcggctccgaagatggggaacccccccagcagcgggtcaccggaaccctggtcctcgccgtgttctcagccgtgcttgggtccctgcagtttggctacaacattggggtcatcaatgccccgcagaaggtgatcgagcagagctacaatgagacctggctcgggaggcaggggcccgagggacccggctccatcccgcccggcaccctcaccacactctgggccctctctgtggccatcttctccgtgggcggcatgatttcctccttcctcatcggcatcatctcccagtggctgggaaggaagagggcgatgctggccaacaacgtcctggccgtgctggggggcaccctcatgggcctggccaacgctgctgcctcctatgagatgctcatccttggacggttcctcattggcgcctactcagggctgacatcagggcttgtgcccatgtacgtgggggagattgcccccactcacctgcgaggtgccttggggacgctcaaccagctggccatcgtcattggcattctgatcgcccaggtgctgggcttggaatccatgctgggcaccgccaccctgtggccgctgctcctgggcatcacggtgctccctgccctcctgcagctgatcctgctgcccttctgccccgagagcccccgctatctctacatcatccggaacctggaggggccggccagaaagagtctgaagcgcctgacaggctgggccgacgtgtctggagccctggcagagctgaaagatgagaagcggaagctggagcgtgagcggccactgtccctgccccaactcctgggcagccgcacccaccggcagcccctcatcattgccgtggtgctgcagctgagccagcagctctcaggcatcaatgctgttttctattattcgaccagcatcttcgagacagcaggggtagggcagcccgcctatgccaccataggagctggagtggtcaacacagtgttcaccctggtctcggtgttcttggtggaacgggctgggcgccggacactccacctcctgggcctggcgggcatgtgtggctgtgccatcttgatgaacgtggctctgcttctgctggagcgggttccagccatgagctacgtttccatcgtggccatcttcggctttgtggcgttctttgagatcggccctggccccatcccctggttcatcgtggccgagctcttcagccaggggccccgccctgcagccatggctgtggctgggttctccaactggacgtgcaacttcatcatcggcatgggattccagtacgttgcggatgcaatggggccctacgtcttcctcctctttgccgtcctcctgctgggcttcttcatcttcaccttcttaagagtacctgaaacccgaggccggaccttcgaccagatctcagctgccttccgccggacgccgtctctcttagagcaggaggtgaagcccagcacggaacttgagtacttggggccagatgagaatgactgagccaggcaggggtggggggaacccgccctccccgcccaccgggaccctcctttcctccgcagcactttaaccccctcctcccggttcctgccagggcggacagacttcccctgcagcctggtggacctgggaggcaggagggaaggggcagtctgagcgcccctcattcccctcgcgtgactcttgggttatttatgtgtgtggttaggctgtggccagcagcgtggcccactctcccctcctgtcttcctccctagcccagccccttcctgcccaccccctacccctccccgaccctgccttctggctagagaagagggattggagggagtgggacaaactgaggcggagagcagctggggagcagaagtcacgttccccaccggccgccagcgggcactttcactggattcttgccacatggactccgggtgaagggagttctgtctcagccctccagggcaaaggatgcacccttgcttctcactgcaggctcagcctcgcggggcgagagggaatgcgaaagcacatgcccatatgtggcgagaggaaggggccctaccccggttgctcgccaaggctgccaagtgggggctccggcgctgtcctctgctcccctcctggaagggtgctgcacccacaggctcttgaccaactagggaaaggggttggaaaggctgcccgtgaacactgggctaggaggagccgtcagatatttttgtatatatttgaagaaggggtagggaggagcagccaaggtctgctgtactaaatgtgtctatagagctgcttctataaagtgactgtataaaaaaaaaaaaaaaa

SEQ ID NO: 7961 - protein, 509 aa, Oryctolagus cuniculus
MPSGFQQIGSEDGEPPQQRVTGTLVLAVFSAVLGSLQFGYNIGVINAPQKVIEQSYNETWLGRQGPEGPGSIPPGTLTTLWALSVAIFSVGGMISSFLIGIISQWLGRKRAMLANNVLAVLGGTLMGLANAAASYEMLILGRFLIGAYSGLTSGLVPMYVGEIAPTHLRGALGTLNQLAIVIGILIAQVLGLESMLGTATLWPLLLGITVLPALLQLILLPFCPESPRYLYIIRNLEGPARKSLKRLTGWADVSGALAELKDEKRKLERERPLSLPQLLGSRTHRQPLIIAVVLQLSQQLSGINAVFYYSTSIFETAGVGQPAYATIGAGVVNTVFTLVSVFLVERAGRRTLHLLGLAGMCGCAILMNVALLLLERVPAMSYVSIVAIFGFVAFFEIGPGPIPWFIVAELFSQGPRPAAMAVAGFSNWTCNFIIGMGFQYVADAMGPYVFLLFAVLLLGFFIFTFLRVPETRGRTFDQISAAFRRTPSLLEQEVKPSTELEYLGPDEND

SEQ ID NO: 7962 - DNA, 2073 bp, Bos taurus
  CDS (96)..(1532)
ggttgccctggctgaaacgccggtgctggccgcactcgcgggacccgtggcagttcaaggcgtcagagccctaaaagcaagcgttgatcgcggacatgacgcctgaggaccaagaggagacccagccgctcctacggccgcccggcggcagcgctccccgcggccgccgcgtcttcctcgctgccttcgccgctgccctgggaccgctcagcttcggcttcgccctcggctacagctccccggccatcccgagcctgaggcgcgccgcgcccccggccccgcacctcgacgaagacgcagcctcctggttcggggccatcgtgaccctgggcgccgcggccgggggcgtgctgggcggctggctcctggaccgcgcggggcgcaagctgagcctagtcctctgcgccttgcccttcgtggccggcttcgccgtcatcaccgcggctcagaacctgtggatgctgctcggaggccgcctgctcaccggcctggcctgcggcattgcctcgctcgtggccccggtctatatctctgaaattgcctaccctgaggtgcgagggctgctcggctcctgtgtgcagctgatggtagtcacaggcatcctcctagcctacctggcaggctgggtgctcgagtggcgctggctggccgtgctgggctgtgtgcccccctccttcatgctgctgctcatgtgtttcatgcctgagacccctcgcttcctgctgtctcagcacaagcaccaggaggccatggccgccatgcagttcctgtggggctatgcccagggttgggaggagcctccccttggggctcagcaccaggacttccacgtggcccagctgcggcgtcctggtgtctacaagcccttcatcatcggcatctccctgatggccttccagcagctgtcaggcgtcaatgccgtcatgttctacgcggagaccatctttgaggaggctaagttcaaggacagcagcctggcctcagtcgtcgtgggcgtcatccaggtgctgttcactgccacggcggccctgatcatggacagagctgggcgaaggctgctcttgaccttgtcaggtgtggtcatggtgttcagcaccagcgcctttggtacctacttcaagctgaccgagggcggccccagcaactcctcccacgtggacctcccggcgctcgtctccatggaggccgccgataccaacgtggggctggcctggctggcggtgggcagcatgtgcctcttcatcgccggcttcgctgtgggctgggggcccatcccgtggctcctcatgtctgagatcttccctctgcatgtcaagggcgtggccaccggcgtctgcgtcctcaccaactggttcatggcctttctggtgaccaaagagttcagcagtctcatggaggtgctcaggccctacggtgccttctggctggcctctgccttctgcatcttcggtgtccttttcactctggcctgtgtccctgagaccaaagggaagactttggagcaaatcacagcccattttgaggggcgatgacagcttcttcctgtgagtgactgcccgtccttgctggaccagctttcagccttggaggggatggagcctacctgtgactccaaactgagcctcagctgggagcctggaacccctggctgtccccagggagtcaggagccaggacagcagcccctcggagccttgtcctctggggtccctccctcctgcccagtgaagcgtggggacaaggttcccagctgctgggtccagtttctactgctgccctgtgatttgggagaaggaacatctcggagacgcttcactgtcctgtggtcagtcctccacatgccggctccatcatgacatgaacgtgacagcggaggaggggggctcttgggtcctgggtttcggacacgctttggcaactgggtgatggcctgtgggttctcctgtcatgtggctgcagtatcagggaggaactttgccaaataaatatttgactctgaaaaaaaaaaaaaaaaaaaaaaaaaagcctttgggggaaacccctttttgccctttaggggggtttttaaaagggg

SEQ ID NO: 7963 - protein, 478 aa, Bos taurus
MTPEDQEETQPLLRPPGGSAPRGRRVFLAAFAAALGPLSFGFALGYSSPAIPSLRRAAPPAPHLDEDAASWFGAIVTLGAAAGGVLGGWLLDRAGRKLSLVLCALPFVAGFAVITAAQNLWMLLGGRLLTGLACGIASLVAPVYISEIAYPEVRGLLGSCVQLMVVTGILLAYLAGWVLEWRWLAVLGCVPPSFMLLLMCFMPETPRFLLSQHKHQEAMAAMQFLWGYAQGWEEPPLGAQHQDFHVAQLRRPGVYKPFIIGISLMAFQQLSGVNAVMFYAETIFEEAKFKDSSLASVVVGVIQVLFTATAALIMDRAGRRLLLTLSGVVMVFSTSAFGTYFKLTEGGPSNSSHVDLPALVSMEAADTNVGLAWLAVGSMCLFIAGFAVGWGPIPWLLMSEIFPLHVKGVATGVCVLTNWFMAFLVTKEFSSLMEVLRPYGAFWLASAFCIFGVLFTLACVPETKGKTLEQITAHFEGR

SEQ ID NO: 7964 - DNA, 1560 bp, Oryza sativa
  CDS (1)..(1560)
atggcgggcggcgcgatggtccagacggtgggtggcaagacgtacccggggaagatgaccgcgttcgtgttcttcacctgcctcgtcgcctcctccggcggcctcatcttcggctacgacatcggcatctccggcggcgtcacctccatggactccttcctcagcgagttcttcccgtcggtgtacgcgcaggcgaaggcgagcaaggacaccaaccagtactgcaagttcgacagccagctgctgacgctcttcacctcgtcgctgtacctggcggcgctggcgacgtcgttcgtggcggcgtgggtcacccgggtgttcggccggaagtggtccatgttctgcggcggcgtcaccttcctcgccggctcggcgctcaacggcgccgccaccgacgtcatgatgctcatcctcggccgcatcctcctcggcatcggcgtcggcttcgccaaccagtccgtgccgctctacctgtcggagatggcgccggcgaacctccgcgggatgctcaacatcggcttccagctcatgaccaccatcggcatcctctccgccaacctcatcaactacgcgacgtcgagcatcgagggcgggtgggggtggcgcatcggcctcggcctcgccggcgtgcccgcgctcatcatcacgctcggcgcgctcgtcctcccggacaccccaaactccctcatcgcccgcggctacgccggcgacgccaagcgcgtcctcgtcaagatccgcggcacggacgacgtccacgacgagtacgacgacatggtagcggcaagcgaagaagccgcctcgatcgagcacccatggcggaacatcctccatcgcaagtaccgcccgcagctcaccatcgccatcctcatcccgtgcttccaacagctcaccggcatcaacgtgatcatgttctacgcgccggtgctcttcctcaccatcggcttcgccggcgacgcgtcgctcatgtccgccgtgatcacgggcctcgtcaacatgttcgccaccgtcgtctcgatcatctccgtggaccgcctcggccgccgcgtgctgttcctccagggcggcacgcagatgttcatctcccaggtggtggtcgggacgctgatcgcgctccagttcggcgtcgcgggcgtcggcgagatgtcgcggtcgtacgccatcttgctcgtgctgttcatctgcatgtacgtggccgggttcgcgtggtcgtgggggcccctggggtggctggtgccgagcgaggtgttcgcgctggagatcaggtcggcggggcagagcatcgcggtgtgcgtcaacatgatgctgacgttcgtcatcgggcaggcgttcctcaccatgctgtgccacctcaagttcggcctcttctacttcttcgccgggtggatgctggtcatgaccaccttcgtcgcgctcttcctgccggagacgaagggggtgcccatcgaggagatgaaccacgtctggagccggcactggttctggggcagctacgtcaccgcccacgacgtcgccggcgccggcgccggaggaggaggaaaccgcagaagccacaacgtctag

SEQ ID NO: 7965 - protein, 519 aa, Oryza sativa
MAGGAMVQTVGGKTYPGKMTAFVFFTCLVASSGGLIFGYDIGISGGVTSMDSFLSEFFPSVYAQAKASKDTNQYCKFDSQLLTLFTSSLYLAALATSFVAAWVTRVFGRKWSMFCGGVTFLAGSALNGAATDVMMLILGRILLGIGVGFANQSVPLYLSEMAPANLRGMLNIGFQLMTTIGILSANLINYATSSIEGGWGWRIGLGLAGVPALIITLGALVLPDTPNSLIARGYAGDAKRVLVKIRGTDDVHDEYDDMVAASEEAASIEHPWRNILHRKYRPQLTIAILIPCFQQLTGINVIMFYAPVLFLTIGFAGDASLMSAVITGLVNMFATVVSIISVDRLGRRVLFLQGGTQMFISQVVVGTLIALQFGVAGVGEMSRSYAILLVLFICMYVAGFAWSWGPLGWLVPSEVFALEIRSAGQSIAVCVNMMLTFVIGQAFLTMLCHLKFGLFYFFAGWMLVMTTFVALFLPETKGVPIEEMNHVWSRHWFWGSYVTAHDVAGAGAGGGGNRRSHNV

SEQ ID NO: 7966 - DNA, 1891 bp, Plantago major; identical to SEQ ID NO: 369
  CDS (146)..(1738)

SEQ ID NO: 7967 - protein, 530 aa, Plantago major; identical to SEQ ID NO: 370

SEQ ID NO: 7968 - DNA, 1987 bp, Plantago major; identical to SEQ ID NO: 371
  CDS (116)..(1705)

SEQ ID NO: 7969 - protein, 529 aa, Plantago major; identical to SEQ ID NO: 372

SEQ ID NO: 7970 - DNA, 1407 bp, Bacillus cereus
  CDS (1)..(1407)
atgaagcaaaaacgaaactcactgtatattttttctattacattagtagctgcaattggaggtttattgtttggttatgatacagctgtaatatctggagcggaagaatcattgaaagtttacttcattgacagccttggattaggttccttagcacatggagttactgtatcaagtgcattaataggatgtattattggaggggtaatatccggctactgtgcttcaaaattcggtcgtaaaagatcacttataattgcagcaatactctttatcgtatcggcgctaggtgcatcttatcctgaatttttattttttacaaagggtgaaccaacaatcgttttgttactagcttttaacctttatcgaatcataggtggaattggcgttggattggcttcagctatttgtccgatatatataggggaaattgctccagctgatattcgtggtaggttagtgtcatttaatcaatttatgattatttttggtatgttagtggtttattttgttaactggggtattgcgaatggagaaacactagaatggataaatgatgtgggctggaggtacatgtttgcgtcaggggtaattccagctataatattcgctatacttttgttatttgtacctgaaacacctcgatatctagcgatacagcatcaggacaaaaaggctctggctatacttacaaagattaatggtcctttagaagctaaagctattttagatgatattaaacaaactatggctataaatgtttcctcagaaaagttattctcttatggaaaattagttattattgtcggagtgttactttctgtatttcaacagtttgtaggcataaatgttgccttatattatgctccccgcatttttgaaagtatgggagcagctaaagattcctctatgatgcaaaccattattatgggattagtaaacgttatatttacagttatcgctattttaacagttgatagatggggaagaaaaccattattaatagtgggttctattggtatggcaattggaatgtttggtgtagcaagcatggcttttgctaatatcattggaattggtactctcatatttattattgtctatacagcttcatttatgatgtcatgggggccgatttgttgggtattaatttcagaaattttccctaataaaatccgtgggcaagctgtagccattgcagtagctgctcaatgggcggctaactatttcatttcatctacatacccaatgatgatggaatatagcgggggactaacatatagtttttatggtttaatgagtgtactttctgccttatttgtctggaagttagttcctgaaacgaaaggtaaaactcttgaacagatggagaatacgtggaaaaaacaaactgaatatataagttaa

SEQ ID NO: 7971 - protein, 468 aa, Bacillus cereus
MKQKRNSLYIFSITLVAAIGGLLFGYDTAVISGAEESLKVYFIDSLGLGSLAHGVTVSSALIGCIIGGVISGYCASKFGRKRSLIIAAILFIVSALGASYPEFLFFTKGEPTIVLLLAFNLYRIIGGIGVGLASAICPIYIGEIAPADIRGRLVSFNQFMIIFGMLVVYFVNWGIANGETLEWINDVGWRYMFASGVIPAIIFAILLLFVPETPRYLAIQHQDKKALAILTKINGPLEAKAILDDIKQTMAINVSSEKLFSYGKLVIIVGVLLSVFQQFVGINVALYYAPRIFESMGAAKDSSMMQTIIMGLVNVIFTVIAILTVDRWGRKPLLIVGSIGMAIGMFGVASMAFANIIGIGTLIFIIVYTASFMMSWGPICWVLISEIFPNKIRGQAVAIAVAAQWAANYFISSTYPMMMEYSGGLTYSFYGLMSVLSALFVWKLVPETKGKTLEQMENTWKKQTEYIS

SEQ ID NO: 7972 - DNA, 1431 bp, Mycobacterium paratuberculosis
  CDS (1)..(1431)
atgcgcgacgacgactcggcaaaccggtggtcaggggtccgcgaggctccgaccgcgccgagtcggcaactgacgggtgccgtggtgatcatcgcgctggtcgccgcgatctcgggcatgctttacggctacgacaccggcgtcatctcctgggccctgctgcagctcacgcaggacttcaacatcaccgagggctggcagcaggtgatcgccgccagcatcctgctcggcgccgtcgccggggcgctgacgtgcagctggctctccgacctgcgcggccggcgcggcacgctgttgatgctggcggtggtgttcatcgtcggcgcgttgtggtgcgccgacgccgcagattccgtgatgctgtcgctgggccggctggtgctggggttcgcggtcgggggcgcgacgcagacggcaccgatgtatgtcgccgagctggcgccgccggcctaccggggacggttggtgctgtgcttccagatcgccattggggtgggcatcctcaccgccaccctggtcggggccggcggctcgatctcttggcgggggccgatcggcctcgcctgcgtgcccgcggcgatcatgctgtggctgctgctgcgcctcccggaaagtccgcgctggctggtcaaaaaggacaaccgagacgccgcccgcgccgtgctggaacacgtccggcccgagggctacgacgtggccgccgagctggatgaggccaccgaactcgcccgcgtagaacgcacggccgccacccgcgggtggcgcgggctgcgcgacgcctgggttcgcccggccctggtcctcggttgcggcatcgcggtgttcacccagctcagcggcatcgagatgatcatctactactcgccgaccatcctgaccgacgacggcgtgtaccggtccgtggcgctgcaggtgtcggtgtgtctgggcgcggcgtacctgatcgcccaactggtcgggctggccatcatcgaccgggtcggccggcgccggctcaccctcatcatggtgccgggcgcggcggtcagcctgttcgcgctgggcctgctgttcatcaccagcgacagcggtcgcgacgtgatcccctacatcatgatctgcctgatcgccttcatgctgttcaacggtggcggcctgcagttgatgggctggctgaccggctcggagacctatccgctggcggtgcgaccggcggccaccgccctgcagtcggccaccctgtgggggaccaacctggtgatcaccttgacgatgctgtcgctgatcaaggcgatcggggtcggccccttgatgtggctctacgcgttgttcaacgtggcggcctggatcttcgtgttcttccgcatgcccgacctcaccggcaaaacccttgaggagatcgaataccagctgtccgaggggaaattccggccgtcggacttcggccgctga

SEQ ID NO: 7973 - protein, 476 aa, Mycobacterium paratuberculosis
MRDDDSANRWSGVREAPTAPSRQLTGAVVIIALVAAISGMLYGYDTGVISWALLQLTQDFNITEGWQQVIAASILLGAVAGALTCSWLSDLRGRRGTLLMLAVVFIVGALWCADAADSVMLSLGRLVLGFAVGGATQTAPMYVAELAPPAYRGRLVLCFQIAIGVGILTATLVGAGGSISWRGPIGLACVPAAIMLWLLLRLPESPRWLVKKDNRDAARAVLEHVRPEGYDVAAELDEATELARVERTAATRGWRGLRDAWVRPALVLGCGIAVFTQLSGIEMIIYYSPTILTDDGVYRSVALQVSVCLGAAYLIAQLVGLAIIDRVGRRRLTLIMVPGAAVSLFALGLLFITSDSGRDVIPYIMICLIAFMLFNGGGLQLMGWLTGSETYPLAVRPAATALQSATLWGTNLVITLTMLSLIKAIGVGPLMWLYALFNVAAWIFVFFRMPDLTGKTLEEIEYQLSEGKFRPSDFGR

SEQ ID NO: 7974 - DNA, 1716 bp, Ashbya gossypii
  CDS (1)..(1716)
atggcacagctaaagtggggcgcggggcgcgcagacgacgggcaagacggccgggaagtggatattgaagagagatggcacgggggcgccaagccggacagcgcggacggcagccggcgcatccagatccaggcggtcaacgacgaggacgacacgtcggagctcatcacgttcaaccaggacgtgtcgtggttcatcgtgatgttgacttttgtggcatcgctctctgggtttttgttcgggtacgacaccgggtacatctccagtgcgttgcagtctgtgggcacagacctcggccaccagctcacgtaccgggacaaggagtacatcacgtcggcgacgtcgctcggcgcgctcatcgcagcgttgggtgcgggcatctgtgcggacctgttcggcaggcgaaagtgcatcatgttctccaacatcctctttgtggttggtaccgtcctccaggtggcggcgttcaacttctggcagatggtggttggccggctagtcatgggctttggtattggcttcggctcgctcatctcgcctttgttcatcagcgagattgcgcccaagatgattcgtgggcgcctcacggtgatcaactcgctttggttgactggcgggcagcttatcgcatacgcatgcggagcaggctttcagcatgtgaagcatggttggcggatacttgttggcatctcgatgttgcccgcggtgctgcagttcgtttccttcatctttttgcccgacaccccgcggttctacgtcatgaaaggcaggctggaggatgcagcaaatgtgctagaacgcacttacgtaggtgctgagcgtgccttgattgaccgcaagatagaggagttggtgctgctaaacaagacgatcccagggcgcacggttttccacagagtctggaacacgattgttgctatccacacggtgcccgccaacctccgcgcgctcattattgcctgtggtttgcagggcatccagcagttctgtggttggaactcgttgatgtacttttcgggcgatatattcagtctggtggggttcaaggaccccgtcgccgtatcgattgtggtcgcagccacaaacttcatctttacgttggtcgcattctttgccatcgacaaaatcggccgccgcatcatacttttgatcgggctacccggcatgacgactgccatgactgtttgcgccatagcattccactacatcaaaaccgaggtggacggcgaaaagttgaagccagtgggtgagagcaacgcttggggtattgtggtggtcatcttcatcattgtctatgccgccttctacgcgctgggcatcggaaccgtgccctggcagcagtcggagttgttcccccagcccgtccgtggcgtaggcacctctttcgccaccgccacaaactgggctggctcgatggtcatcgcatctacgttcctaacgatgttcaagaatatcacgccgacagctacatttggcttctttgccggcatctcggtcatctccttggttgctgtctatctctgctatccagaattgtccggtctcgaactcgaggaggtccaattcgtattgaaggatggcttcaacattaaggcctcgaaagcattagctaagaaacgcaaattccagatggccgagtcgcgtaaacaagccagagagctcgaccttgagtccctccacaaagccaagccatccgacgagtttaccgagtcgtga

SEQ ID NO: 7975 - protein, 571 aa, Ashbya gossypii
MAQLKWGAGRADDGQDGREVDIEERWHGGAKPDSADGSRRIQIQAVNDEDDTSELITFNQDVSWFIVMLTFVASLSGFLFGYDTGYISSALQSVGTDLGHQLTYRDKEYITSATSLGALIAALGAGICADLFGRRKCIMFSNILFVVGTVLQVAAFNFWQMVVGRLVMGFGIGFGSLISPLFISEIAPKMIRGRLTVINSLWLTGGQLIAYACGAGFQHVKHGWRILVGISMLPAVLQFVSFIFLPDTPRFYVMKGRLEDAANVLERTYVGAERALIDRKIEELVLLNKTIPGRTVFHRVWNTIVAIHTVPANLRALIIACGLQGIQQFCGWNSLMYFSGDIFSLVGFKDPVAVSIVVAATNFIFTLVAFFAIDKIGRRIILLIGLPGMTTAMTVCAIAFHYIKTEVDGEKLKPVGESNAWGIVVVIFIIVYAAFYALGIGTVPWQQSELFPQPVRGVGTSFATATNWAGSMVIASTFLTMFKNITPTATFGFFAGISVISLVAVYLCYPELSGLELEEVQFVLKDGFNIKASKALAKKRKFQMAESRKQARELDLESLHKAKPSDEFTES

SEQ ID NO: 7976 - DNA, 1608 bp, Ashbya gossypii; identical to SEQ ID NO: 375
  CDS (1)..(1608)

SEQ ID NO: 7977 - protein, 535 aa, Ashbya gossypii; identical to SEQ ID NO: 376

SEQ ID NO: 7978 - DNA, 1641 bp, Ashbya gossypii; identical to SEQ ID NO: 377
  CDS (1)..(1641)

SEQ ID NO: 7979 - protein, 546 aa, Ashbya gossypii; identical to SEQ ID NO: 378

SEQ ID NO: 7980 - DNA, 1620 bp, Ashbya gossypii; identical to SEQ ID NO: 379
  CDS (1)..(1620)

SEQ ID NO: 7981 - protein, 539 aa, Ashbya gossypii; identical to SEQ ID NO: 380

SEQ ID NO: 7982 - DNA, 1644 bp, Ashbya gossypii; identical to SEQ ID NO: 381
  CDS (1)..(1644)

SEQ ID NO: 7983 - protein, 547 aa, Ashbya gossypii; identical to SEQ ID NO: 382

SEQ ID NO: 7984 - DNA, 1995 bp, Ashbya gossypii; identical to SEQ ID NO: 383
  CDS (1)..(1995)

SEQ ID NO: 7985 - protein, 664 aa, Ashbya gossypii; identical to SEQ ID NO: 384

SEQ ID NO: 7986 - DNA, 1476 bp, Shigella flexneri
  CDS (1)..(1476)
atgaatacccagtataattccagttatatattttcgattaccttagtcgctacattaggtggtttattatttggctacgacaccgccgttatttccggtactgttgagtcactcaataccgtctttgttgctccacaaaacttaagtgaatccgctgccaactccctgttaggattttgcgtagccagcgctctgattggttgcatcatcggcggtgccctcggtggttattgcagtaaccgcttcggccgtcgtgattcacttaagatttctgctgtcctgttttttatttctggtgtaggttctgcctggccagaacttggttttacctctataaacccggacaacacagtacctatttatctggcaggttatgtcccggaatttgttatttatcgtattattggcggtattggcgttggtttagcctcaatgctttcaccaatgtatattgcggaactggctccagctcatattcgcggaaaactggtttcatttaaccagtttgcgattattttcgggcaacttttagtttactgcgtaaactattttattgcccgttccggtgatgccagctggctgaatactgacggcaggcgttatatgtttgcctcggaatgtatccctgcactgctgttcttaatgctgctgtataccgtgccagaaagtcctcgctggctgatgtcacgcggcaagcaagaacagacggaaagtatcctgcgcaaaattatgggcaacacgcttgcaactcaggcagtacaggaaattaaacactccctggatcatggccgcaaaaccggtggtcgtctgctgatgtttggcgtgggcgtgattgtaatcggcgttatgctctccatcttccagcaatttgtcggcatcaatgtggtgctgtactacgcgccggaagtgttcaaaacgctgggggccagcacggatatcgcgctgttgcagaccattattgtcggagttatcaacctcacctttaccgtactggcaattatgactgtggataaatttggtcgtaagccactgcaaattatcggcgcactcggaatggcaatcggtatgtttagcctcggtaccgcgttttacactcaggcatcgggtattgtggcgctactgtcgatgctgttctatgttgccgcctttgccatgtcctggggtccggtatgctgggtactgctgtcggaaatcttcccgaatgctattcgtggtaaagcgctggcaatcgcggtggcggcccagtggctggcgaactacttcgtctcctggaccttcccgatgatggacaaaaactcctggctggtggcccatttccacaacggtttctcctactggatttacggttgtatgggcgttctggcagcactgtttatgtggaaatttgtcccggaaaccaaaggtaaaacccttgaggagctggaagcgctctgggaaccggaaacgaagaaaacacaacaaactgctacgctgtaa

SEQ ID NO: 7987 - protein, 491 aa, Shigella flexneri
MNTQYNSSYIFSITLVATLGGLLFGYDTAVISGTVESLNTVFVAPQNLSESAANSLLGFCVASALIGCIIGGALGGYCSNRFGRRDSLKISAVLFFISGVGSAWPELGFTSINPDNTVPIYLAGYVPEFVIYRIIGGIGVGLASMLSPMYIAELAPAHIRGKLVSFNQFAIIFGQLLVYCVNYFIARSGDASWLNTDGRRYMFASECIPALLFLMLLYTVPESPRWLMSRGKQEQTESILRKIMGNTLATQAVQEIKHSLDHGRKTGGRLLMFGVGVIVIGVMLSIFQQFVGINVVLYYAPEVFKTLGASTDIALLQTIIVGVINLTFTVLAIMTVDKFGRKPLQIIGALGMAIGMFSLGTAFYTQASGIVALLSMLFYVAAFAMSWGPVCWVLLSEIFPNAIRGKALAIAVAAQWLANYFVSWTFPMMDKNSWLVAHFHNGFSYWIYGCMGVLAALFMWKFVPETKGKTLEELEALWEPETKKTQQTATL

SEQ ID NO: 7988 - DNA, 1557 bp, Oryza sativa
  CDS (1)..(1557)
atggccggcggcgcggtggtgagcacgggggcaggcaaggactaccctggcaagctcaccctcttcgtcttcttcacatgcgtcgtcgccgccaccggtggtctcatcttcggatatgacatcggtatatcaggtggtgtgacgtccatggacccgttcctgaggaagttcttcccggaggtgtatcggaagaagcagatggcggacaagaacaaccagtactgcaagtacgacaaccagctgctgcagaccttcacctcgtcgctctacctcgccgccctcgtctcctccttcttcgccgccaccgtcacccgcgtcctcggccgcaagtggtccatgttcgccggcggcctcaccttcctcatcggcgccgccctcaacggcgccgccgagaacgtcgccatgctcatcgtcggtcgtatcctcctcggtgtcggcgtcggcttcgccaatcagtcggtgccggtgtacttgtcggagatggcgccggctcggctgcgggggatgctgaacatcgggttccagctgatgatcaccatcggcatcctggcggcggagctgataaactacgggacggcgaagatcaaggccgggtggggatggcgggtgagcctggcgctggccgccgtccccgccgccatcatcaccctcggctccctcttcctcccggacacccccaactcgctcatcgacaggggccacccggaggcggcggagcgcatgctccggcgcatccgcggctccgacgtggacgtgtcggaggagtacgcggacctggtggcggcgagcgaggagtcgaagctggtgcagcacccgtggcgcaacatcctccgccgcaagtaccgcgcccagctcaccatggccatctgcatccccttcttccagcagctcaccgggatcaacgtcatcatgttctacgcccccgtgctgttcgacaccctgggcttcaagagcgacgcgtcgctcatgtccgccgtcatcacgggcctcgtcaacgtcttcgccacgctggtgtccatcttcaccgtggaccgcctcggccgccgcaagctgttcctgcagggcggggcgcagatggtggtgtgccaggtggtggtggggacgctgatcgccgtcaagttcgggacgagcggcatcggcgacatccccaaggggtacgcggcggtggtggtgctcttcatctgcatgtacgtggcagggttcgcgtggtcgtggggcccactggggtggctcgtccccagcgagatcttcccgctggagatccggccggcggggcagagcatcaacgtgtcggtgaacatgctcttcaccttcgtcatcgcgcaggccttcctcaccatgctctgccacatgaagttcggcctcttctacttcttcgccggatgggtcgtcatcatgaccgtcttcatcgccctcttcctccccgagaccaagaacgtccccatcgaggagatggtgctcgtctggaagtcccactggttctggcgccgattcatcggagaccacgacgtccacgtcggcgccaaccacgtctccaacaataagctccaaccataa

SEQ ID NO: 7989 - protein, 518 aa, Oryza sativa
MAGGAVVSTGAGKDYPGKLTLFVFFTCVVAATGGLIFGYDIGISGGVTSMDPFLRKFFPEVYRKKQMADKNNQYCKYDNQLLQTFTSSLYLAALVSSFFAATVTRVLGRKWSMFAGGLTFLIGAALNGAAENVAMLIVGRILLGVGVGFANQSVPVYLSEMAPARLRGMLNIGFQLMITIGILAAELINYGTAKIKAGWGWRVSLALAAVPAAIITLGSLFLPDTPNSLIDRGHPEAAERMLRRIRGSDVDVSEEYADLVAASEESKLVQHPWRNILRRKYRAQLTMAICIPFFQQLTGINVIMFYAPVLFDTLGFKSDASLMSAVITGLVNVFATLVSIFTVDRLGRRKLFLQGGAQMVVCQVVVGTLIAVKFGTSGIGDIPKGYAAVVVLFICMYVAGFAWSWGPLGWLVPSEIFPLEIRPAGQSINVSVNMLFTFVIAQAFLTMLCHMKFGLFYFFAGWVVIMTVFIALFLPETKNVPIEEMVLVWKSHWFWRRFIGDHDVHVGANHVSNNKLQP

SEQ ID NO: 7990 - DNA, 1774 bp, Anopheles gambiae str
  CDS (94)..(1542)
cgtcggcataccatcgggatatagctggagaagatagaggaaatagagcgcaccgagcatgtcgttctatggttcagtgggcatcagtgttaaatgaatcctgctgaactcaatcagtaccaacctgtcgctacctttgagaagctcgaaacctcacacttctgcaagatggagaagggtagtccatcacgccagtttatggctggcattatcgttaatctggcctcagttatggtcggcacgtcgctaggctggacctcaccggttggacccaagtttgcctcgaaagataccacaccgctcgatacgattccaacggcatcggaaagctcatggatcgcatcactagtagcaatgggtgcattgattgcacccttcattgctggcccattggcggaacgaattggccgtaagttcacactgctggggagctccatctttttcctcgtatcgtttatattgctgctgacgacagaaacggtagtgcaggtgctgattgcccggttcatccaagggctgggcgttggctttgtgatgaccgtccaaaccatgtacattggtgagatcgcgagcaacgagtaccgcggtgcactcggatcacttatgcagttgtgcatcgttactggcatcctgtacgtgtacagcattggcccgtacgtttcgtaccatgcgctgcagtgggcctgcatcgtcctgccgatcgcattcgatgcaacgtttttcttcatgcccgaaacacccgcctactacatctcgaagggtgataaggaaaaggccgtggagtcgttgtgttttttgcgcggcaaaaccgtggacggtgtacaggaggagctgcacgaaatttccaccacggtcgaggagtcgctcaggaacaaaggctccgtaatggatctgttccggaacgcgggcaacgtaaaggcgctgatcatctgtgccggtctgattagcttccagcagctgtccggcatcaacgtgatactgttctacagtcaaaacatcttcgaaagcaccggcagtagcctgtcgccggccgtctcgaccatcctggtcggtgcggtgcaggtgctggcgagcggtgccaccccactgattgtcgatcggctgggacggaagcccatcctgctgacgtccgccggcggtatgtgcatttcgctcggcacgatggggctgtactttttcctcaagcacacggaatcaccgtcggtggacagtctcggctggctgccgatcatgtcgctgatcgtgtttgtgaccgtgtactgcatcgggtttgggccgctgccgtgggccgtgctgggtgagatgttcccggcgaacgtgaaatcgatcgcttcgtcgatcgttgcctccacctgctgggtgttgggctttattattttgcagtttttcgccgacctggataaggcggtcgggtcgcactggtcgttctggatctttggcatcctgtgcgcggttgcgttcgtgtttaccttcaccacgttgatggaaaccaagggcctcagtctgcaggagattcaggatcgactgaatggtaaggtgtaaggtgcggttcgggcctgtagcgaatgactcatgggtttgttttatctactaacaccactattgcgatggtggtagtgtagtgctcaagaaacagatgctattagagtttactgtttgttttcttccttccgcttcgtcagtgtagttagctttcacccgcaccaaagtgatacgttcgttagggacatacgagggaacgaacgactgtgttgaatgtattgtgttaatttac

SEQ ID NO: 7991 - protein, 482 aa, Anopheles gambiae str
MNPAELNQYQPVATFEKLETSHFCKMEKGSPSRQFMAGIIVNLASVMVGTSLGWTSPVGPKFASKDTTPLDTIPTASESSWIASLVAMGALIAPFIAGPLAERIGRKFTLLGSSIFFLVSFILLLTTETVVQVLIARFIQGLGVGFVMTVQTMYIGEIASNEYRGALGSLMQLCIVTGILYVYSIGPYVSYHALQWACIVLPIAFDATFFFMPETPAYYISKGDKEKAVESLCFLRGKTVDGVQEELHEISTTVEESLRNKGSVMDLFRNAGNVKALIICAGLISFQQLSGINVILFYSQNIFESTGSSLSPAVSTILVGAVQVLASGATPLIVDRLGRKPILLTSAGGMCISLGTMGLYFFLKHTESPSVDSLGWLPIMSLIVFVTVYCIGFGPLPWAVLGEMFPANVKSIASSIVASTCWVLGFIILQFFADLDKAVGSHWSFWIFGILCAVAFVFTFTTLMETKGLSLQEIQDRLNGKV

SEQ ID NO: 7992 - DNA, 1785 bp, Neurospora crassa
  CDS (1)..(1785)
atggcgatcttcgccatgggctggcagaagcccgacaatgtcgctggctcatctgccccagcgattatggtcggcctgtttgtcgccacaggcggcttactccttggctatgacactggaaccatcaacggcattcttgccatgaaatcgttcaaagaccacttttcaaccggctacatcgacggcaacggacagcctggcatatacccaaaggagagtgcgttaatcgttgccatgctcagcgccggaaccgccatcggagccttactcgctgcgcctctcggagatcactatggacgtcgccggtcccttattggcgccatcggaattttcgtaataggcgccatcctgcaggtttgtgcatataacatcgatctgttggtggcaggaaggacggttgccggtgttggtatcggcattgtctcagtgcttgtccccttatatcagtctgagatggcacccaagtggattcgaggaacactggtgtgcacctaccaactctccatcaccatggggcttcttgccgctgccgtggtcaacatcctcacatacaaattgaagacagctgctgcctaccgggtaccaataggacttcagctaacctgggcctgcgtcttggccctgggcttgaccgtgttacccgaaactcctcgttacctcatcaaacgtggagacaagaacgccgctgcgctttctctcagtcggctgcgtcgactggacattactcaccctgccttggtcgaggagcttgccgaaatcgaagcaaaccatcaatacgagatggcactgggtcccgactcttacaaggacattctctttggcgaacctcaccttggccgtcgcacgtttacaggttgctgtctgcagatgctacaacagcttaccggcgtgaactttatcatgtactatggaaccaccttttttaataacgctggcgttggaaaccccttcaagatctctctcatcatgcaagtcatcaacacagcatcgaccatacccggattgttcgtagtcgaatcatggggccggcgtcggctcttgatggtgggcgccataggcatggccatctgtcagctgctgatcgctgccttcgcgacggccagcggctccaacaacctatcagcacagaacaaggtcctcattacctttgttgcgatatacatcttcttctttgctgcatcatggggcccagttgtatgggtcgtcacctccgagatttatccgctcaaggttagagccaaatccatgtcgataactacggcttcaaattggttcctcaattttggcatcgcctacggcaccccgtatatgcaaacgaacagtgcagcgagcgacgaaagctcgatagatctcggctctaaagtgtttttcgtatggggcgcgttttgcatagtagcggtcggctttgtatggtgtatggtttacgagactagcaagatcagtctcgaacaaattgatgagatgtacgagagagttgaccatgcgtggcacagcaggcgcttcgaacctagttggagtttccaggagatgcgagaccttggcttctccgatggcggcataccgccaacgcagcagctgcagcagcagccgcagcagccgcagcagcaacaacaacaacaccaccaacaacaacaacaccaactacaagttgacctacagcaatcgcagtcacgcactagcaactccagcacgtctcaaaccgacacgggcgggagcaataacaccggggcgtcacaagacgataaacttgtggcatccttgggcaacatcgatctcagctattga

SEQ ID NO: 7993 - protein, 594 aa, Neurospora crassa
MAIFAMGWQKPDNVAGSSAPAIMVGLFVATGGLLLGYDTGTINGILAMKSFKDHFSTGYIDGNGQPGIYPKESALIVAMLSAGTAIGALLAAPLGDHYGRRRSLIGAIGIFVIGAILQVCAYNIDLLVAGRTVAGVGIGIVSVLVPLYQSEMAPKWIRGTLVCTYQLSITMGLLAAAVVNILTYKLKTAAAYRVPIGLQLTWACVLALGLTVLPETPRYLIKRGDKNAAALSLSRLRRLDITHPALVEELAEIEANHQYEMALGPDSYKDILFGEPHLGRRTFTGCCLQMLQQLTGVNFIMYYGTTFFNNAGVGNPFKISLIMQVINTASTIPGLFVVESWGRRRLLMVGAIGMAICQLLIAAFATASGSNNLSAQNKVLITFVAIYIFFFAASWGPVVWVVTSEIYPLKVRAKSMSITTASNWFLNFGIAYGTPYMQTNSAASDESSIDLGSKVFFVWGAFCIVAVGFVWCMVYETSKISLEQIDEMYERVDHAWHSRRFEPSWSFQEMRDLGFSDGGIPPTQQLQQQPQQPQQQQQQHHQQQQHQLQVDLQQSQSRTSNSSTSQTDTGGSNNTGASQDDKLVASLGNIDLSY

SEQ ID NO: 7994 - DNA, 1620 bp, Neurospora crassa; identical to SEQ ID NO: 387
  CDS (1)..(1620)

SEQ ID NO: 7995 - protein, 539 aa, Neurospora crassa; identical to SEQ ID NO: 388

SEQ ID NO: 7996 - DNA, 1752 bp, Neurospora crassa; identical to SEQ ID NO: 401
  CDS (1)..(1752)

SEQ ID NO: 7997 - protein, 583 aa, Neurospora crassa; identical to SEQ ID NO: 402

SEQ ID NO: 7998 - DNA, 1464 bp, Neurospora crassa
  CDS (1)..(1464)
atgacagacaacccagaagagcccttgatcgccaacactcaatcgacggagagggaccaagatgatggcagccatgatgtcgaacatgcgcatgattcccggggagggaaacagcacatatcaccgcccggcctgttcatctggctactcaccttttccgccggaataagcggtctactcttcggctacgacacaggcgtaataagcgccacccttgtctctatcggtacctccctctcgcaccggcccctgacctcgctcgacaaatccgtcatcacctcatgcacctccctcttcgccctgctcgcgctacccttcgcctccgcgctcgccgacgaccggggccgcaagcgcgttgtcctcttcgccgacaccctcttcatcatcggcgccctctgccaggccgccagccggaccgtcgaggtcatggtaattgggcggtcggttgtcggcatagccatcggcgccgccagcttcgtgacgccgctgtacattgccgagctggcgcctgcgacgcaccgcggccggttggtgacgatgaacattgtgtttatcacgcttgggcaggtggttgcgtacgtggtaggctggatctttgggacgtatggtagtccggagacgacggggtggagatggatggtcgggttgggcgcggtgccggcggtttgtcaggtggtcatcttgttgtggatgccggagagcccgaggtggttggtgaaggacggaaggtcgcaagaggcaagagcggtgattgctaagattgccgcgggggatgatgcgcaggatccgtcgacgaggagggaagtggatgctgtgttgaagagcatcgagattgagggtcttcagcagctgtgcggatttaactcgctcatgtacttctcggccacgatattcacgatggtggggttttcagagccgactttgacctcgctagtcgttgcagtcaccaactttgccttcaccttagttgccctggtgttgatcgaccgggtgggaaggagacgcattctactctggtctcttccctttatgattgcaggtctggtgcttgccggctatggcttttcgttcatcgagctcccgaattcagagaccagctcgccctcgacaacgggaggtcagggcggggccgtcattattttggcgagcatcatgatttatgtggctggctatgccatcggactgggcaatgtgccctggatgcagagcgagctcttctcactgagtgttcggtcagtgggcagtggtgttgcaacagcgaccaactggagcgccaactttgtgattggactgacgttccttccgctgatggaggccttgtcgccgtcttggacgtttgtcctgtacgcagtgatctgcgcggttgggtatggcctgatttggacggtataccctgaaaccgcagggctgagcttggaagatgcggcgacccttctagaagcggatgactggggggtgcggtaa

SEQ ID NO: 7999 - protein, 487 aa, Neurospora crassa
MTDNPEEPLIANTQSTERDQDDGSHDVEHAHDSRGGKQHISPPGLFIWLLTFSAGISGLLFGYDTGVISATLVSIGTSLSHRPLTSLDKSVITSCTSLFALLALPFASALADDRGRKRVVLFADTLFIIGALCQAASRTVEVMVIGRSVVGIAIGAASFVTPLYIAELAPATHRGRLVTMNIVFITLGQVVAYVVGWIFGTYGSPETTGWRWMVGLGAVPAVCQVVILLWMPESPRWLVKDGRSQEARAVIAKIAAGDDAQDPSTRREVDAVLKSIEIEGLQQLCGFNSLMYFSATIFTMVGFSEPTLTSLVVAVTNFAFTLVALVLIDRVGRRRILLWSLPFMIAGLVLAGYGFSFIELPNSETSSPSTTGGQGGAVIILASIMIYVAGYAIGLGNVPWMQSELFSLSVRSVGSGVATATNWSANFVIGLTFLPLMEALSPSWTFVLYAVICAVGYGLIWTVYPETAGLSLEDAATLLEADDWGVR

SEQ ID NO: 8000 - DNA, 1509 bp, Mycobacterium bovis; identical to SEQ ID NO: 425
  CDS (1)..(1509)

SEQ ID NO: 8001 - protein, 502 aa, Mycobacterium bovis; identical to SEQ ID NO: 426

SEQ ID NO: 8002 - DNA, 1455 bp, Rhodopirellula baltica
  CDS (1)..(1455)
atgctagactttggaacggcgggcacgcaaacgctcggtcggcgcgaaatcattggcacggcggttgagcagcgtgcctccgacgagcaacgttccaacatcgggcaatcaaaattgaatcagcgtgttttcctgtggagtttgacgtcgtccttggcggggtttttgttcggctttgacacagtcgttatttccggagctgaaaaagccatccagggtctgtgggcgctgggtgatttccaacacggtcttgctctgagcgccgcgttgtgggggaccgtcatcggatccttggtcggcggttggccaactgacaaatttggacgcaaaaagacgttgctctggatcggaattctgtacttggtttcggcgatctggtcaggtttcgcgaccgacgttttctcgttcatgatcgctcgcttcatcggcggcttaggcgttggaatttctaccgtcgcggctccgctatacatctctgaaatctcgccaccgaaacatcgcgggactttgactggattgtttcaattcaacatcgtctttggaatcatggtcgcgttcgcgtccaattatctgattggcacctggggtaacgagaatgcttggcgatggatgttggcggtggaagcgatccccgctttgatcttcaccgtcatgtgcatttcgttgccatccagccctcgatggttgatcgcggtcaagaaagaccaagcggccggcatgtcggttctgaaacaactacggccagatgcgtccgatgaagaggtgcaaaggacggtcgatgaaattgtcgcctctctccgtgccgagtcggacctgactcccgcggaaccgttttggagccgtcgactattcactcccatatccattgcattcctcgtcgcgtttttcaatcagctttctggaatcaatgccgttctatacttctcaccgcgaatttttgaattggccggtatgggcgaacaagccgctcttttgcaatcgatcggcattggtatcaccaacctgatcttcacctttgtgggcttgtatttgatcgaccgactgggtcgtcgcacgttgctactgattggttcggcgggctacatcctgtcgctggggacgtgcgcctacgcctttcaatccgaaacatttagcattgttcccgcatgcattttcgccttcatcgcatcgcacgcgatggggcagggtgcggtcatttgggtgctgatctcagaagtctttcccaacgagcatcgtgccgcgggtcaatcgctgggaagcttcacgcactggatctttgcggcattgctgacgcttgtttttccggccgtggtggagacgtttcatcccgctgccatcttcggctttttctgcttcatgatggtcctgcaaggactttgggtcatcacgatgttgcctgaaaccaagggcatctcgctggagcaaatggaagcaaaactcggaatccgcgtttaa

SEQ ID NO: 8003 - protein, 484 aa, Rhodopirellula baltica
MLDFGTAGTQTLGRREIIGTAVEQRASDEQRSNIGQSKLNQRVFLWSLTSSLAGFLFGFDTVVISGAEKAIQGLWALGDFQHGLALSAALWGTVIGSLVGGWPTDKFGRKKTLLWIGILYLVSAIWSGFATDVFSFMIARFIGGLGVGISTVAAPLYISEISPPKHRGTLTGLFQFNIVFGIMVAFASNYLIGTWGNENAWRWMLAVEAIPALIFTVMCISLPSSPRWLIAVKKDQAAGMSVLKQLRPDASDEEVQRTVDEIVASLRAESDLTPAEPFWSRRLFTPISIAFLVAFFNQLSGINAVLYFSPRIFELAGMGEQAALLQSIGIGITNLIFTFVGLYLIDRLGRRTLLLIGSAGYILSLGTCAYAFQSETFSIVPACIFAFIASHAMGQGAVIWVLISEVFPNEHRAAGQSLGSFTHWIFAALLTLVFPAVVETFHPAAIFGFFCFMMVLQGLWVITMLPETKGISLEQMEAKLGIRV

SEQ ID NO: 8004 - DNA, 1847 bp, Oryza sativa
  CDS (94)..(1647)
ggctcttgtagtagctagctaccagtccaaccaacaccaacaactgcgcgagtgagcgcgcggctattgcgtgccacggcgtgccgttgagcgatggctggaggtgggttccccgtggccggcggcgccccgccgggcgactatggcggcggcataaccttctccgtcgtcgtcacctgcctcatggccgcctccggcggcctcatcttcggctacgacatcggcatctccgggggagtgacggcgatggagtcgttcctggcggccttcttcccgggggtgctccggcggatggcggcggcgcggcgggacgagtactgcgtctacgacagccacgtgctgacggcgttcacgtcgtcgctgtacctggccgggctggccgcgtcgctggcggccggccgcgtcaccagggcggtcgggaggcaggccgtcatgctcgcgggcggggcgctcttcttcgccggcgccgccgtcaacgccgccgcggtcaacatcgccatgctcatcgtcggccgcatgctgctcggcttcggcattggcttcaccaaccaggcggcgccggtgtacctggcggagacggcgccggcgaagtggcggggtgcattcacgacggggttccagctcttcctcggcatcggcaacctgacggccaacctgacaaactacggcgcggcgcgcatcccgcggtgggggtggcgtctctccctcggcctggcggcggcgccggcgtccgtcatcctcgtcggcacgctgctcatctcggacacccccagcagcctcctcgtgcgcgggcgggtggagcaggcgcgcgccgcgctccggcgcgtgcgcggcgccaaggcggacgtggacgccgagctggagggcgtggcgcgcgcggtcgaggcggcgcgcgccaacgaggagggcgcgtaccgcaggatcctctggaggcagcaccgcccccacctggtgatggccgtcgccgtgccgctgctccagcagctcaccggcgtcatcgtcatcgccttcttctcgccggtgctcttccagacggccgggttcggcagcaacgcgtcgctgatgggggccgtcatcctcggcgccgtcaacctcggctccaccctcgtctccatcgccacggtggaccggtacggccgccgggtgctgttcctgaccggcggcctcgtgatgatcgcctgccaggtcgcggtggcgtggatcatggggtcgcagatcgggcgggacggcgagtcggcgatggcgaggcgctactccgtggcggtgttggcgctgacgtgcgtcttctcggcggcgttcgggtggtcgtggggcccgctgacgtgggtgatccccggcgagatattcccggtggagatccggtcggcggggcaggggatcagcgtggccgtcaacctcggcgccaccttcgtgctcacgcagacgttcctcgccatgctgtgcagcttcaagtacgccacgttcctctactacgcggcgtgggtcgccgtcatgaccgccttcgtgtgggcgttcctgccggagaccaagggggtgccgctcgaggccatgggcgccgtctgggcgcggcactggtactggcggcgcttcgtgcagccgccaccggcggccaaggacgccatgctgccggaggtcctcgtgaactgacaacgtatactgtacgtgttctctgccttgaccgtgtggcggcgctgcattaattcgtgggaagttgtgtaaaattaaatctggtttctggtttaacggttcctacatggttgaataccatcccgtgtttgtcctcttgcgaaaaatttgtattgtttacatatgaacaaatccaaagtccgtgttctattttagtttct

SEQ ID NO: 8005 - protein, 517 aa, Oryza sativa
MAGGGFPVAGGAPPGDYGGGITFSVVVTCLMAASGGLIFGYDIGISGGVTAMESFLAAFFPGVLRRMAAARRDEYCVYDSHVLTAFTSSLYLAGLAASLAAGRVTRAVGRQAVMLAGGALFFAGAAVNAAAVNIAMLIVGRMLLGFGIGFTNQAAPVYLAETAPAKWRGAFTTGFQLFLGIGNLTANLTNYGAARIPRWGWRLSLGLAAAPASVILVGTLLISDTPSSLLVRGRVEQARAALRRVRGAKADVDAELEGVARAVEAARANEEGAYRRILWRQHRPHLVMAVAVPLLQQLTGVIVIAFFSPVLFQTAGFGSNASLMGAVILGAVNLGSTLVSIATVDRYGRRVLFLTGGLVMIACQVAVAWIMGSQIGRDGESAMARRYSVAVLALTCVFSAAFGWSWGPLTWVIPGEIFPVEIRSAGQGISVAVNLGATFVLTQTFLAMLCSFKYATFLYYAAWVAVMTAFVWAFLPETKGVPLEAMGAVWARHWYWRRFVQPPPAAKDAMLPEVLVN

SEQ ID NO: 8006 - DNA, 2251 bp, Oryza sativa; identical to SEQ ID NO: 427
  CDS (152)..(1723)

SEQ ID NO: 8007 - protein, 523 aa, Oryza sativa; identical to SEQ ID NO: 428

SEQ ID NO: 8008 - DNA, 1894 bp, Glycine max
  CDS (163)..(1734)
ctaagtgtctcgcttcacatatcatcatacttagatagtcagatacatcagccaataattaaattaaatacatgctagcactttaacagtactcctttctctaatatctctctcatattttcctttctgcggatattcagctaattaaactaagtcactaagatgactgagggaaagctagttgaagctgcagaagctcataagacacttcaggatttcgatcctccaaagaagcgcaaaaggaacaagtatgcttttgcttgtgctatgctggcctccatgacttccatcttgcttggttatgatattggagtgatgagtggagcagccatatacataaaaagggacctgaaagtctcggacgagcaaatcgagatcctgctcggaatcatcaacctatactctctgataggctcatgtctcgccggcagaacctccgactggataggtcgccgctacacgattggtttgggcggcgccatctttcttgtcgggagcactctcatgggtttctacccccattattcctttctcatgtgtgggcggttcgtcgctggcattggcatcggctacgccctcatgatagcccctgtctacaccgccgaggtctccccggcctcctctcgtggcttcctcacatccttccccgaggtttttattaatggagggatattacttggatacatatcaaactatggattttcgaagctgacactgaaggtgggatggcgaatgatgcttggagtgggtgcaattccttcggtagtcctaacggagggagtgttagcgatgcctgagtccccaaggtggctagtgatgaggggtcgtttgggagaggcaagaaaagtgcttaacaaaacctcagacagcaaggaagaggcccaactaaggctagcggaaatcaaacaagccgcagggatccccgagagttgcaacgacgacgtcgttcaggtaaataaacaaagcaacggtgaaggtgtatggaaagagctcttcctctatccaacgcccgcaattcgtcacatcgtaatcgctgcccttggtattcacttcttccaacaagcgtcgggcgtagacgccgtcgttttgtacagccccaggatcttcgaaaaggctgggattacaaacgacacgcataagcttcttgcaaccgtggccgttggattcgttaagaccgtgttcatcttggcggctacgtttacgttggaccgcgtgggtcgtcgtccgttgttattgtctagtgtcggcggcatggtgctctcgcttctcacgcttgcgatcagcctcactgttattgatcattcggagaggaaattaatgtgggccgttggatcgagcatagccatggtgttggcttacgtggccacgttctccatcggtgcgggtcccatcacgtgggtctatagttctgagatcttcccgttgaggctgcgggcgcagggtgcggccgcgggagttgcggtgaataggaccactagcgcggttgtctcaatgacttttctgtccctcactagagccatcactattggtggagctttcttcctttattgtggcattgctactgttgggtggatattcttttacaccgtcttgcctgagacccggggaaaaacgctcgaagacatggaagggtcttttggtacttttaggtccaaatccaacgccagcaaggctgtagaaaatgagaatgggcaagtagcacaagtccagctaggaactaatgtccaaacttgaaaaatgagtattgggacatccagtaatagtgaagtaatttcgtgattttttttttgttttttactttttagactagttcttcaaatcaaaacgagaagttaaagtgacaagacttgtgtatgaaaaaaaaaaaaaaaaaaaaaaaaaaaaaaaaaaaaaa

SEQ ID NO: 8009 - protein, 523 aa, Glycine max
MTEGKLVEAAEAHKTLQDFDPPKKRKRNKYAFACAMLASMTSILLGYDIGVMSGAAIYIKRDLKVSDEQIEILLGIINLYSLIGSCLAGRTSDWIGRRYTIGLGGAIFLVGSTLMGFYPHYSFLMCGRFVAGIGIGYALMIAPVYTAEVSPASSRGFLTSFPEVFINGGILLGYISNYGFSKLTLKVGWRMMLGVGAIPSVVLTEGVLAMPESPRWLVMRGRLGEARKVLNKTSDSKEEAQLRLAEIKQAAGIPESCNDDVVQVNKQSNGEGVWKELFLYPTPAIRHIVIAALGIHFFQQASGVDAVVLYSPRIFEKAGITNDTHKLLATVAVGFVKTVFILAATFTLDRVGRRPLLLSSVGGMVLSLLTLAISLTVIDHSERKLMWAVGSSIAMVLAYVATFSIGAGPITWVYSSEIFPLRLRAQGAAAGVAVNRTTSAVVSMTFLSLTRAITIGGAFFLYCGIATVGWIFFYTVLPETRGKTLEDMEGSFGTFRSKSNASKAVENENGQVAQVQLGTNVQT

SEQ ID NO: 8010 - DNA, 1648 bp, Orobanche ramosa; identical to SEQ ID NO: 429
  CDS (46)..(1605)

SEQ ID NO: 8011 - protein, 519 aa, Orobanche ramosa; identical to SEQ ID NO: 430

SEQ ID NO: 8012 - DNA, 1975 bp, Oryza sativa
  CDS (96)..(1604)
ggggggcaactaggaagttcctcttcctcctccgagaacgagaacccacacctccataacttcaatttccaagttatatatatataaaaaaggcaatggcggacgatcctctctccaactccaccaccaacaacaagagggcagaggggatccagctccagcacggcgactgcgagagcgagagcactgcgcccttgctgctcgcgccacacgagtcctaccgcctctccgccgcaatcctccccttcctatttccagctttgggcggccttctctatggctacgacatcggagcaacgtctggtgctaccatatcgctcaagtcatccaccttcagtggcaccacatggtacaacttgtcatcgctgcaaaccggccttgtcgtcagtggctcactctatggtgctctcatcggttccatcttggcattcaacattgccgattttctaggacggcgcagagagcttattctttcttctgtctcatatttgattggagctcttctcacagcagcagcacctaacttccctatcatggtggttggccgctttttctatggcataggaataggattggctatgcatgctgctccaatgtacattgcagagactgctccaagtcagataagaggcatgctcatttctctcaaggaattctttattgttcttgggatgcttcttggctacattgcaggcagtctctttgtcgaagtggtttctggttggcgctacatgtatgccaccagtacaccattatgtctcatcatgggaattgggatgtgctggttacctgcttcacctaggtggcttctgttatgtgccatacaagggaagaggaatattatggagtcaaaagaaaatgctacccgttgcttatgtcgattgaggggtcaagcttctcctgatttggtttcggaacaagttgatttgattctggatgaactgtcatacgttgatcaagagaggcaagcaggcttcagtgagatctttcagggaaaatgcctcaaagcaatgataatcggatgtggcttggtgttctttcagcaggttactggtcaaccaagtgtgctatattatgctgcgacaatccttcagagtgctggattctctggtgcatctgatgctactcgtgtatcagttcttcttggcttactgaagttgattatgactggtgtggcagttcttgtggttgacagacttgggagaagaccattactgattggaggtgttagtgggattgctgtttccttgtttttgttatcttcgtactacaccttattgaaggatgctccttatgtggctgtaatagcacttctactctatgttggctgctaccagctgtcattcggtccaattggctggcttatgatttcggaagttttcccattaaggctgcgagggcgtgggttgagtattgctgttcttgtgaattttgcctccaatgcactagtcacttttgctttctccccattggaggatttgattggaactgggatcctcttctctgcgtttggggtgattgcagtggcgtctcttgttttcatattcttcatcgtgcccgagacgaaagggctcaccttggaagaaattgaagccagcctgtagatccagctgccctgcggctgctggcacgtaggagaactgcttattattcagagatgttgcaagctgttggactgactgactgactatctttgtggtgtggtaaggtaacacagtgagatccattgagagtgagttatgttgctttcggtcgttgctttggttggagaaagagtatagttcaaacatatatgtccatactgggttgttgttcataatacatgagcacatcattttttttccttgagaacgatatatgtgtgattaatgctgtacagcaggagcagttggcttatgccatgttattgggcacctgctgaatatttggcatgatctaaaaataataatgtcttcgtcccagaataattacattt

SEQ ID NO: 8013 - protein, 502 aa, Oryza sativa
MADDPLSNSTTNNKRAEGIQLQHGDCESESTAPLLLAPHESYRLSAAILPFLFPALGGLLYGYDIGATSGATISLKSSTFSGTTWYNLSSLQTGLVVSGSLYGALIGSILAFNIADFLGRRRELILSSVSYLIGALLTAAAPNFPIMVVGRFFYGIGIGLAMHAAPMYIAETAPSQIRGMLISLKEFFIVLGMLLGYIAGSLFVEVVSGWRYMYATSTPLCLIMGIGMCWLPASPRWLLLCAIQGKRNIMESKENATRCLCRLRGQASPDLVSEQVDLILDELSYVDQERQAGFSEIFQGKCLKAMIIGCGLVFFQQVTGQPSVLYYAATILQSAGFSGASDATRVSVLLGLLKLIMTGVAVLVVDRLGRRPLLIGGVSGIAVSLFLLSSYYTLLKDAPYVAVIALLLYVGCYQLSFGPIGWLMISEVFPLRLRGRGLSIAVLVNFASNALVTFAFSPLEDLIGTGILFSAFGVIAVASLVFIFFIVPETKGLTLEEIEASL

SEQ ID NO: 8014 - DNA, 2458 bp, Oryza sativa
  CDS (510)..(2255)
gtcccgggctcccggcagcctggggtttctctccccgtttctgtttctcggtgaggtgaagttttccgtctcagcacactgccagttcttcttcttgttcttcctactcgtggcgccgcggcgtcctcacggatcgcaaggtcgggaattatctggggttctcggggtttgtggctcctttccggtgaaaggattcttttttagcgggagatcggttgagtcggtttcttctgtagatcttatcgttgagatttcgttgtttatgttaggcgagtcggggtgagacttatccgcgttcctccctgcgatgaaacacgcgattttggattgtcgttacgtttagggattgtggttttaaggctgttcttccgttgtaaatgttggttgcgccatcctataaaagaaagggactcctgtcgagaaacacaccatgcttcttctgtcctgaaggtttggaaaggcacattctgaggagatttttctgtcctacatcgtagcccttgaatgcaatggaagggggtgcaactctagctgataaggctgaatttaaggaatgtctgcggctgacctggagccagccttacattcttcagcttgttttctctgccggcatcggtggtcttcttttcggatatgatacaggtgtcatatctggagcacttctgtatattcgagatgattttactgcggtcgaaaagagcactgtacttagggaaacgatagtgagtatggctgtagctggagccatagttggagcaggatttggtggctggatgaacgacaagtttggaaggaagccttccatcttgatcgccgattccctgttcctcgcaggtgccttgatcatggcccttgccccaacaccgtttgtcatcattattgggaggatctttgttggtcttggggttggaatggcttccatgacagcacctttgtacatttctgaagcctctccagctagaatcagaggtgcacttgtgagcacaaatggacttcttattaccggagggcagttcatggcatacctcattaatctggccttcactaaggtaaagggaacatggaggtggatgcttggcattgcaggtcttcctgcttttattcagttcatattgatgtgtatgctacctgaatcaccaaggtggctatacagacaggataggaaagaggaggctgaagccatattaaggaagatttaccccgcggctgaggttgaagaagagatcgattcgatgcgccgatcaattgaacatgagaaacaactggagggctccatcggcgagcagagtctggttggcaagctgacgaaggcactgagcagcaaggtcgtccgccgtgggctcatggccggcgtcatcgcgcaggtcgcccagcagttcgtcggcatcaacaccgtcatgtactacagcccgacgatcgtccagctggccggcttcgcgtcgaacaacacggccatggcgctgtccctcatcacctcgggcctcaacgccatcgggtccatcgtcagcatgttcttcgtggacagggccggccgccgtcgcctgatgatcatcagcctcgtcggcatcgtcctgtggctcgccgtgctcggcggcacgttcctcggcgccgcgcaccacgcgccgccggtcagcgacctggagacgcgggtgttcgccaaccagacgtgcccggagtacagcccgagcgcccgctggaactgcatgaactgcctcaaggcccagtccacctgcggcttctgcgcccacggaggaaacaagctcctccccggcgcgtgcctggcggcgggcgaagcgtcgcggcggacgtgccacgcggggaaccgggagttctacacggaagggtgccccaacaacttcgggtggctggcgctggtggcgctcggcgcgtacatcgtctcctactccccgggcatgggcaccgtgccatggatcgtcaactcggagatctacccgctgcggttcaggggcgtctgcggcggcatcgcggcggtggccaactgggtgtccaacctcatcgtcacgcagacgttcctgagcctcaccaaggcgctgggcacgtcggccaccttcttcctcttctgcgccgtctccttcttcgcgctcgtcgtcgtcttcttcaccgtgccggagaccaagggactgcagttcgaggaggtggagaagatgctcggggagaaggactacaagccgtggaagagataccgtcccgacgtgtcgtccaaagggcgcgacatcggcctctctgttccatgaaaggaagaagaacagtgtttggtttcaagttatttgggttttaactagcaataatctgtactcagtttacatgtagagtggccgttgccaatagaaattaatcagttgtttcattgtgtgacacattttagagccttttcccctgtgcttagaacgtttgatgatttttatataagtaaattgcgtcttggtcacctttttcc

SEQ ID NO: 8015 - protein, 581 aa, Oryza sativa
MEGGATLADKAEFKECLRLTWSQPYILQLVFSAGIGGLLFGYDTGVISGALLYIRDDFTAVEKSTVLRETIVSMAVAGAIVGAGFGGWMNDKFGRKPSILIADSLFLAGALIMALAPTPFVIIIGRIFVGLGVGMASMTAPLYISEASPARIRGALVSTNGLLITGGQFMAYLINLAFTKVKGTWRWMLGIAGLPAFIQFILMCMLPESPRWLYRQDRKEEAEAILRKIYPAAEVEEEIDSMRRSIEHEKQLEGSIGEQSLVGKLTKALSSKVVRRGLMAGVIAQVAQQFVGINTVMYYSPTIVQLAGFASNNTAMALSLITSGLNAIGSIVSMFFVDRAGRRRLMIISLVGIVLWLAVLGGTFLGAAHHAPPVSDLETRVFANQTCPEYSPSARWNCMNCLKAQSTCGFCAHGGNKLLPGACLAAGEASRRTCHAGNREFYTEGCPNNFGWLALVALGAYIVSYSPGMGTVPWIVNSEIYPLRFRGVCGGIAAVANWVSNLIVTQTFLSLTKALGTSATFFLFCAVSFFALVVVFFTVPETKGLQFEEVEKMLGEKDYKPWKRYRPDVSSKGRDIGLSVP

SEQ ID NO: 8016 - DNA, 2574 bp, Oryza sativa; identical to SEQ ID NO: 435
  CDS (569)..(2089)

SEQ ID NO: 8017 - protein, 506 aa, Oryza sativa; identical to SEQ ID NO: 436

SEQ ID NO: 8018 - DNA, 1413 bp, Streptomyces avermitilis
  CDS (1)..(1413)
atgaccagcacagcgcaggcgcccggagcccgggaagctcatcccgagcatctcggccatgtcatcttcatcgcggcggcggccgcgatgggcggcttcctcttcggttacgacagtgccgtgatcaacggcgccgtcgaggccatccggagcaagtacgacatcggttccgcgaccctggcccaggtcatcgccatcgcgctgatcggctgcgccgtcggcgccgcgaccgcgggccgcatagccgaccgcatcggccgcatccggtgcatgcagatcgccgccgtgctgttcaccgccagcgccatcggctcggcgctgcccttcgcgctgtgggacctcgcgttctggcgcgtcatcggcggcttcgccatcggtatggcctccgtgatcggccccgcctacatcgccgaggtcgccccggccgcgtaccgcggccgtctcggctccttccagcaggccgcgatcgtcatcggcatcgccatctcgcagctggtcaactgggccatcctgaacgccgccggcggcgaccagcgcggcaagctgctgggcctcgaagcctggcaggtcatgctcggcgtcatggtcgtcccggccgtcctctacggtctgctctccttcgcgatccccgagtcgccgcgctatctgatcgaagcgggcaaggacgcgcgcgcccgtgaggtgctcgaagaggtcgagggcaaggagatcgacctcgacgcccgcgtggaggagatcaggctcgccatgtaccgcgaggagaagccgagcttcaaggacctgctcggcggcaccttcttcttcaagccgatcgtctgggtcggtatcggactctcggtcttccagcagttcgtcggcatcaacgtggcgttctactactcggcgacgctgtggcagtcggtcggcgtcgacccgacggactcgttcctctactcgttcaccacgtcgatcatcaacatcatcggcaccgtgatcgccatgatcttcgtcgacagggtcggccgcaagccgctcgcgatcatcggctccgtgggtatggtcatcggtctcgcgctggaggcctgggccttctcgtacgacctcgtcgacggcaagctgccggccacccagggctgggtggccctgatcgccgcccacgtgttcgtcctcttcttcgccctctcctggggcgtcgtggtctgggtcttcctcggcgagatgttcccgaacaggatccgtgccgccgcgctcggtgtggccgcgtcggcccagtggatcgccaactgggcgatcaccgcgagcttcccgtccctggccgactggagcctctccggcacgtacatcatctacacggtgttcgccgcgctctccatccccttcgtgctcaagttcgtgaaggagaccaagggcaaggcgctggaggagatgggctga

SEQ ID NO: 8019 - protein, 470 aa, Streptomyces avermitilis
MTSTAQAPGAREAHPEHLGHVIFIAAAAAMGGFLFGYDSAVINGAVEAIRSKYDIGSATLAQVIAIALIGCAVGAATAGRIADRIGRIRCMQIAAVLFTASAIGSALPFALWDLAFWRVIGGFAIGMASVIGPAYIAEVAPAAYRGRLGSFQQAAIVIGIAISQLVNWAILNAAGGDQRGKLLGLEAWQVMLGVMVVPAVLYGLLSFAIPESPRYLIEAGKDARAREVLEEVEGKEIDLDARVEEIRLAMYREEKPSFKDLLGGTFFFKPIVWVGIGLSVFQQFVGINVAFYYSATLWQSVGVDPTDSFLYSFTTSIINIIGTVIAMIFVDRVGRKPLAIIGSVGMVIGLALEAWAFSYDLVDGKLPATQGWVALIAAHVFVLFFALSWGVVVWVFLGEMFPNRIRAAALGVAASAQWIANWAITASFPSLADWSLSGTYIIYTVFAALSIPFVLKFVKETKGKALEEMG

SEQ ID NO: 8020 - DNA, 1230 bp, Coxiella burnetii
  CDS (1)..(1230)
atgaatggatttgttgtcagtgccgtactcatcggcgcttttttgggagcgctttttagcggccatttggctgattacattggacgaaaacgtttactcattatcgatgctttgatttttattgttggcacagccatttccagtatgactgtctccattagctggttggtaattggacgtattattgtcggcattgctattggcatcgcttcttacagtgcgccgctttatatttctgaaatctctccccctcatcgccgcggtgctttagtttcgcttaatcagttggccgttacgatcggaatttttctttcgtacgtagtagattattattttgctcgccacgacgcttggcgctcgatgtttgccgctggtgtcatcccggccgctttgttattgctcggtatgatagtgttgccctacagtcctcgctggatattctcccgcggtcacgaagaaaaggctttgtggattttgcgaaaattgcgtggccacggtccccatgcggaacaagaattagagcatatccgcgctagtttgcagcagcaaaaaggcgactggagaacattattttcaaaaatcatccgtcctacgctttttatcgctatcggtttagcggtatttcaacaagtaacgggaattaacacggtactctactacgcccctaccattttaaaaatgactggttttcaggcttcacaaaccgctattttggcgacgatgggtatcggtgcggtgttggtcattatcaccattatcagtctgccattaatcgattcgctcggacgacgcccgttattattcatcggcgttggtgccatgacagttagtttgctcgtcttaagctggtcgtttaaagtgcacgggcatatggattatatgcgatggatcgcctttgggagcttattagtgtttatttcgggattttcaattagcttaggcccgatcatgtggctgatgttttctgaaattttcccgctgagagttcgtgggttaggagcgagcatcggagcttgcaccaactgggcatcgaactggttagttactataacgtttttaacattgatcgaatatcttggtcctagcggtaccttttttatttattttattattagcgtgattactcttattttcatttacacttccgtaccagaaaccaaaggggtaaccttggagcaaattgaagagaatctctatgcaggaaaagacatgcgttatttaggaaaataa

SEQ ID NO: 8021 - protein, 409 aa, Coxiella burnetii
MNGFVVSAVLIGAFLGALFSGHLADYIGRKRLLIIDALIFIVGTAISSMTVSISWLVIGRIIVGIAIGIASYSAPLYISEISPPHRRGALVSLNQLAVTIGIFLSYVVDYYFARHDAWRSMFAAGVIPAALLLLGMIVLPYSPRWIFSRGHEEKALWILRKLRGHGPHAEQELEHIRASLQQQKGDWRTLFSKIIRPTLFIAIGLAVFQQVTGINTVLYYAPTILKMTGFQASQTAILATMGIGAVLVIITIISLPLIDSLGRRPLLFIGVGAMTVSLLVLSWSFKVHGHMDYMRWIAFGSLLVFISGFSISLGPIMWLMFSEIFPLRVRGLGASIGACTNWASNWLVTITFLTLIEYLGPSGTFFIYFIISVITLIFIYTSVPETKGVTLEQIEENLYAGKDMRYLGK

SEQ ID NO: 8022 - DNA, 1407 bp, Shigella flexneri
  CDS (1)..(1407)
atggagggcatcatgcctgacgctaaaaaacaggggcggtcaaacaaggcaatgacgtttttcgtctgcttccttgccgctctggcgggattactctttggcctggatatcggtgtaattgctggcgcactgccgtttattgcagatgaattccagataacttcgcacacgcaagaatgggtcgtaagctccatgatgttcggtgcggcagtcggtgcggtgggcatcggctggctctcctttaaactcgggcgcaaaaagagcctgatgatcggcgcaatcctgtttgttgccggttcactgttctctgcggctgcgccaaacgttgaagtactgattctttcgcgcgttctgctggggctggcggtgggtgtggcctcttataccgcaccactgtacctgtcagaaattgcgccggaaaaaattcgcggcagtatgatctcgatgtatcagttgatgatcactatcgggatcctcggtgcttatctttctgataccgccttcagctacaccggtgcatggcgctggatgctgggtgtgattatcatcccggcaattttgctgctgattggtgtcttcttcctgccagacagcccacgttggtttgccgccaaacgccgttttgttgatgccgaacgcgtgctgctacgcctgcgtgacaccagcgcggaagcgaaacgcgaactggatgaaatccgtgaaagtttgcaggttaaacagagtggctgggcgctgtttaaagagaatagcaacttccgccgcgcggtgttccttggcgtactgttacaggtaatgcagcaattcaccgggatgaacgtcatcatgtattacgcgccgaaaatcttcgaactggcgggttataccaacaccaccgagcaaatgtgggggacagtgattgtcggcctgaccaacgtacttgccacctttatcgcaatcggccttgttgaccgctggggacgtaaaccaacgctaacgctgggcttcctggtgatggctgctggcatgggcgtactcggtacaatgatgcatatcggtatccactctccgtcggcgcagtatttcgccatcgccatgctgctgatgtttattgtcggttttgccatgagtgccggtccgctgatttgggtactgtgctccgaaattcagccgctgaaaggccgcgattttggcatcacctgctccaccgccaccaactggattgccaacatgatcgttggcgcaacgttcctgaccatgctcaacacgctgggtaacgccaacaccttctgggtgtatgcggctctgaacgtactgtttatcctgctgacattgtggctggtaccggaaaccaaacacgtttcgctggaacatattgaacgtaatctgatgaaaggtcgtaaactgcgcgaaatcggcgctcacgattaa

SEQ ID NO: 8023 - protein, 468 aa, Shigella flexneri
MEGIMPDAKKQGRSNKAMTFFVCFLAALAGLLFGLDIGVIAGALPFIADEFQITSHTQEWVVSSMMFGAAVGAVGIGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAALNVLFILLTLWLVPETKHVSLEHIERNLMKGRKLREIGAHD

SEQ ID NO: 8024 - DNA, 1927 bp, Prunus cerasus; identical to SEQ ID NO: 441
  CDS (56)..(1585)

SEQ ID NO: 8025 - protein, 509 aa, Prunus cerasus; identical to SEQ ID NO: 442

SEQ ID NO: 8026 - DNA, 1838 bp, Medicago truncatula
  CDS (112)..(1650)
cccaaccagcatagaattaaactaacagtgattcacccataaagttaagtttggtgctatattttagaaccttaaaggtagatatatccttagacaaaacagcgttcgaaaatggctggtggggttttaccagtggatagtacaccagtggcagtaactgccatcaatattggtggcaagttaacactctcaatcatcattacctgcatagttgctgcatccggtggccttctttatggatatgatctcggagtttcaggaggtgttacaacgatggtgccatttctccaaaaattctttccagacattctgagaaaggcagccagtgccgaagtgaatatgtattgtgtgtatgatagtcaaatattgacactatttacgtcttctctttatctagctggattagtgtcatccattgcagctagcaaagtcacggcggcttatggtcggagaaacgtcatcataataggaggtgctctcttcattgccggtggcgccattaatggtggttcggaaaatatccccatgctcattttgggtcgtgttcttcttgggtttggggttggtttcactaatcaagctgcaccgttgtacctatctgaaactgctcccccaaaatggcgaggcacttttaacacgggctttcagttcttcttgggaattggtgtagtcgctgccggctgcataaactacgccacggccaagcacacatggggatggagactctctcttggacttgcagtggttcctgcagctgtgatgacaatcggttccttcctcattaccgatacaccaaacggcttggtagaacgtggtaagatagagcaagccaaacaagccttacgcaaaattagaggatcctcggttgatattgaacccgagttagaagaacttatcaagtggacagaaattgcgaaatcagtgcaacaagagccctttaaaaccatattaaaaagggaatatcgacctcacttggtgatggcatttgcaatcccgtttttccaacagcttacagggatcaatattgtagccttttattcacccaacctctttcactctgtgggttttggacacgacggagctttactttccgccattatacttggatctgttagccttttgtctaaccttatctctgctggtattgttgatcgaattggtcgaagattcttgttcatatctgggggaattatgatgcttgtctgcttgattgctgtgtccattgtcctggcagtggtgactggtgttgatggtacaaaggacatatccaagggcaatgcaatagtggtattggtgctattgtgtttctactctgcaggttttggttggtcatggggtccattaacatggcttattccaagtgagattttcccagtaaaaataagaaccacaggacaaagcatagctgttgctgtgcaattcataataatctttgtgttatcgcaaacattcttgacaatgttatgccacatgaagtttggggccttcgtcttctatgctttttgggttattgtgatgactctgtttgttatcttcttcttgcctgagaccaaaggaattcctttggagtcaatgtacactatatggggcagacactggttttggtctcggtatgttaaaggacaagaggtcctagaaaatctcccatgaagtttttaacactttttatgattgatttattatttttaaagaagtcaatgcacatgcattatatcttgacaaaattgtgcagcattggcttcataaaaataaatcaataataaaagaaatgtaatcaataataacgtctcaaaaataatgtattgattgttaatgttaaaaaaaaaaaaaaaaaaaaa

SEQ ID NO: 8027 - protein, 512 aa, Medicago truncatula
MAGGVLPVDSTPVAVTAINIGGKLTLSIIITCIVAASGGLLYGYDLGVSGGVTTMVPFLQKFFPDILRKAASAEVNMYCVYDSQILTLFTSSLYLAGLVSSIAASKVTAAYGRRNVIIIGGALFIAGGAINGGSENIPMLILGRVLLGFGVGFTNQAAPLYLSETAPPKWRGTFNTGFQFFLGIGVVAAGCINYATAKHTWGWRLSLGLAVVPAAVMTIGSFLITDTPNGLVERGKIEQAKQALRKIRGSSVDIEPELEELIKWTEIAKSVQQEPFKTILKREYRPHLVMAFAIPFFQQLTGINIVAFYSPNLFHSVGFGHDGALLSAIILGSVSLLSNLISAGIVDRIGRRFLFISGGIMMLVCLIAVSIVLAVVTGVDGTKDISKGNAIVVLVLLCFYSAGFGWSWGPLTWLIPSEIFPVKIRTTGQSIAVAVQFIIIFVLSQTFLTMLCHMKFGAFVFYAFWVIVMTLFVIFFLPETKGIPLESMYTIWGRHWFWSRYVKGQEVLENLP

SEQ ID NO: 8028 - DNA, 1764 bp, Datisca glomerata
  CDS (79)..(1650)
cccttctctctttatctccttttcatcactcccctctttctctcctcgcaaaagaagtcagagataaaggacgaaaacatgccggccgtcggaggaatcgttgtcggtggcagtaaaaaggagtatcccggcaaccttactccttatgtcaccataacatgcattgttgccgctatgggtggtctgattttcggttacgatattggaatttcaggtggggtgacgtcaatggattcattcttgaagaaattcttcccggcggtttaccggaaaaaagagttggattcgacgacgaaccagtactgtcagtacgacagtcagactctgacgatgttcacgtcttctctttatttggctgctctgctcgcttcgatagtggcttccaccatcacccgtaaattcggcaggagattatccatgctcttcggcggcattctgttctgtgccggtgctatcatcaatggcttcgcccaggctgtttggatgctcattctcggtcgtatgtttctcggttttggtattgggttttccaatcagtctgtgccactctacctctcagagatggctccctacaagtacagaggagcattaaacataggcttccaattatcaatcacaattggaatattggtagcaaatgtgttaaattacttctttgccaagatcaggggcggctggggatggcggttgagcttaggtggcgcaatggtcccagcccttatcatcacggtcggatcgctactccttcccgacacacccaactcattaatcgagcgtggcaaccgagacgaagcccgcagcaaactccaaagggttcgaggcgttgatgacgtggacgaggagtttaacgatctggtggcggcaagtgaagagtcaaagcaagtggaacatccttggactaacctgttgaggaggaagtacagacctcatcttgcaatggctatactaattcctttcttccagcaacttaccggcatcaatgtgattatgttttacgcgcctgttttgtttaacaccattgggtttggaagtgatgcttcgctcatgtcggctgtgattactggctgtgttaatgtcgctgggactttggtttctatttatggggttgataagtggggaaggaggttccttttccttgagggtggatttcaaatgttgatttgccaggcggttgtagcagctgcaattggtgctaaatttggagtaaatggaaatccaggagaactgccaaaatggtatgcgatagtggtggtgctgttcatatgcatatatgtagcagggttctcttggtcatggggtcctctaggttggctagtgccaagtgaaagtttccccttagaaatacggtcagctgctcaaagtatcaatgtctctgtcaacatgatcttcacatttgctatagctcaaatcttcttgacaatgctttgccacttgaaattcggtttattcattttcttcgccttcttcgtggttgtcatgtctatcttcgtctacttcttcttgcccgagactaagggaatcccgatcgaagagatgggcagagtatggaagtcacattggtactggtcaagatttgttactgatgctgattacactattggatcaggagttgagatgggaaagggagcgcaggagcttaagaatatttaagtttaatgtttggggggagggttatttttagattatttttttctatctagtaaatagaagtttgggtcaatattaaattaagaacatatgaatgggtcaaatttgatgtatctg

SEQ ID NO: 8029 - protein, 523 aa, Datisca glomerata
MPAVGGIVVGGSKKEYPGNLTPYVTITCIVAAMGGLIFGYDIGISGGVTSMDSFLKKFFPAVYRKKELDSTTNQYCQYDSQTLTMFTSSLYLAALLASIVASTITRKFGRRLSMLFGGILFCAGAIINGFAQAVWMLILGRMFLGFGIGFSNQSVPLYLSEMAPYKYRGALNIGFQLSITIGILVANVLNYFFAKIRGGWGWRLSLGGAMVPALIITVGSLLLPDTPNSLIERGNRDEARSKLQRVRGVDDVDEEFNDLVAASEESKQVEHPWTNLLRRKYRPHLAMAILIPFFQQLTGINVIMFYAPVLFNTIGFGSDASLMSAVITGCVNVAGTLVSIYGVDKWGRRFLFLEGGFQMLICQAVVAAAIGAKFGVNGNPGELPKWYAIVVVLFICIYVAGFSWSWGPLGWLVPSESFPLEIRSAAQSINVSVNMIFTFAIAQIFLTMLCHLKFGLFIFFAFFVVVMSIFVYFFLPETKGIPIEEMGRVWKSHWYWSRFVTDADYTIGSGVEMGKGAQELKNI

SEQ ID NO: 8030 - DNA, 2032 bp, Prunus cerasus; identical to SEQ ID NO: 443
  CDS (74)..(1690)

SEQ ID NO: 8031 - protein, 538 aa, Prunus cerasus; identical to SEQ ID NO: 444

SEQ ID NO: 8032 - DNA, 1784 bp, Malus domestica
  CDS (116)..(1561)
gcacgaggataagaccatcaccggccaagcccaaaacacgagtatcgcagactttgatcccccaaagaaagccaagacaaagaagtttgccattgcctgtggcgttttggcttcaatgacttcaatcttacttggttatgatattggtgtaatgagtggagcgtcactcttcattaaagaaaacctcaaaatcagtgatgttcaagtcgaaattatgaacggtactttgaacctctactcccttattggctccgccttggctggtagaacctccgactggattggacgccggtacaccatagtacttgccggaacaatcttctttattggagctctcctcatgggctttgcccctaactacgccttcctcatgttcgggcgatttgttgccggagttggagttggctacgctcttatgatagctcccgtctacactgccgagatctctccggcctcgtttcgtggcttcctcacatcttttcccgaggtgtttgttaatattggcatattactggggtacgtatccaactatgccttctccaagctccccattcacttgaactggaggatcatgctcggtgtcggcgcatttccatctgttattcttgccgtcggtgtcttagccatgcccgagtcacctcgttggctcgtcatgcaagggcgacttggagacgccaagcgagttctacaaaaaacctcagaatccatagaagagtgtcagctcagactagatgacatcaaagaagccgcaggaatccccaaagagtccaacgacgacgttgttcaggtatctaaacgcagccacggtgaaggcgtgtggaaagaattgctccttcatcccacaccagccgttcgccatattttaatcgcagctcttggtatccacttctttgaacaatcgtcaggtatagactctgtcgttttgtacagccccaggatcttcgaaaaggcaggaatcacctcctacgatcacaagctgctcgcaacggtggctgttggagttgtcaagactatttgcatcttagtcgccacggttttccttgataagtttggaaggcgtcctttgcttttgactagcgtggctggaatggtattttcacttagctgtctcggtgcaagccttacgatcgttgatcaacagcacggaaagatcatgtgggccatcgtgttgtgcatcaccatggtattacttaacgttgcgtttttctccatcgggctggggccgattacatgggtctacagctccgagatcttcccactgcagctgcgcgcgcaagggtgtagtatgggagtggccgtaaatagggtgacgagtggggtcatctccatgacttttatttcattgtataaggccatcacgattgggggagccttctttctttacgcgggaattgctgcggttggttgggtcttcttttatatgttgtacccagagacacagggccgaacccttgaagatatggaggtattgtttggtaaataccataagtggagagaagcaaatgccttgcttcagaaagctaagcaagttgatggcgacgacaagggtcaagtccactaggcataaaatggcgaatgcttaaataatcggtgtttgatgcacttgtttcctgataagaatttctttctttcgaaacgtcataggatatttcacttatatatgtgtaactgttgccaattacatcttatcttccctttcaagttggaagaacttgtgtgtaaagaagacattatgttgtcatatatgtttatacaagtttgatcttcaaaaaaaaaaaaaaaaa

SEQ ID NO: 8033 - protein, 481 aa, Malus domestica
MTSILLGYDIGVMSGASLFIKENLKISDVQVEIMNGTLNLYSLIGSALAGRTSDWIGRRYTIVLAGTIFFIGALLMGFAPNYAFLMFGRFVAGVGVGYALMIAPVYTAEISPASFRGFLTSFPEVFVNIGILLGYVSNYAFSKLPIHLNWRIMLGVGAFPSVILAVGVLAMPESPRWLVMQGRLGDAKRVLQKTSESIEECQLRLDDIKEAAGIPKESNDDVVQVSKRSHGEGVWKELLLHPTPAVRHILIAALGIHFFEQSSGIDSVVLYSPRIFEKAGITSYDHKLLATVAVGVVKTICILVATVFLDKFGRRPLLLTSVAGMVFSLSCLGASLTIVDQQHGKIMWAIVLCITMVLLNVAFFSIGLGPITWVYSSEIFPLQLRAQGCSMGVAVNRVTSGVISMTFISLYKAITIGGAFFLYAGIAAVGWVFFYMLYPETQGRTLEDMEVLFGKYHKWREANALLQKAKQVDGDDKGQVH

SEQ ID NO: 8034 - DNA, 2012 bp, Malus domestica; identical to SEQ ID NO: 445
  CDS (104)..(1579)

SEQ ID NO: 8035 - protein, 491 aa, Malus domestica; identical to SEQ ID NO: 446

SEQ ID NO: 8036 - DNA, 2178 bp, Mesembryanthemum crystallinum
  CDS (512)..(2008)
ctcgttctctttctctctctctctcctctcttgttgttgttgctcccctacacggcagagtagagtagaccattctctgctttgtccttcatctctctctcatttctctcttttcttcaacactgtcacgttcacaacaagcaaaataagtcacgcatcataaaatctcattcacagaaaccagaaaaaaatcactgttactactctttgatcgcttgaaatttttgtgaacgtttcagtcactcaaattgcttcttaaaccagtgttttagtttataaagcttcaatctttgttgggtttttttttctttccattttctgctgagtaagattctgggttttacttcttcaaaactcatttttggacgatttctggggttaaaacccttttatatgtgaattaattttctgggttcattttatttctcatcaatttgggcttgattactgaatttcttgaatttgattctactctgcatttgggaattttgtttggaaaaatttggtgatcatgacacttgattcaatccctgggagttctgggtacttggattcataccctgagaggagaattacgtactttgggaacaaatttgttctggctttgactgttactgctggaattggtggattactctttggctatgatacaggtgtgatatcaggggcactcctgtacataaaagatgaatttccggcagtcaaaaacagcagcttcttgcaggaaacgattgtgagcatggcattggtcggtgcaatgattgggtctgccactgctggatggattaacgatgtatatgggcgtaaaaaagccactcttcttgctgattttatcttcgctattggtgccgtagttatggctgctgctcccgatccatatattctcatagtgggacgattcctggttggattgggtgtcgggctggcatcagtttgtgctcctgtttatattgctgaagcatctcctacggaagtaagaggagggcttgttagcacaaatgtgctaatgataacttttggacaatttgtttcctactgcgtgaaccttgcttttactgaggttcctggaacttggcgttggatgcttggggtatcgggcgtgcctgctgtcttgcaattcggctttatgcttcttttgccagagtccccccgctggctttacttgaagcatgagaaatccaaagctgctgcagtactcgcaaagatatacgacccctttaggctggaagacgagcttgatttgcttgctgctgctgaggaggaggagaagaacaaaccagctgtccatatatcagatgttttcacaaaaagagaactcagatatgcatttattgctggtggtggtctcctggcatttcagcaacttgcgggaatcaacaccgtcatgtattacagccctacgattgtccagatggctggtttcagttccaaccagttagccctcctaatctctctcatcgtcgctgccatgaacgcggtcggaacggtccttggtatataccttatcgaccacatggggcgacgcaaactagccctcacgagcctctcgggcgtgtttgtcgccctcgtcatgctcacgatctccttcatgctccgttcatcgggccccacctccgccctctactcgtggctcgctgtcttggggcttgccctttacattgccttctttgctccagggatgggacctgtcccatgggccatcaactctgagatatacccccaggcttacaggggtttgtgtgggggtatgggtgccacgatctgttggatcgttaacctctttgtttcggagacgttcctctccatcgcagacgccattggaaccggtcccacattcctgataatcgcaggcattgtgattgttgcgtttgtattcgtggtttgcttcgttcccgagaccaaggccttgacattcgaggaggtcgaccagatgttcatggacagagcttatggaaccgaggaaaatactcaaagccttcttgaatcctcgaatcggtctggaaattagcctatttgtcgtgaatcgcgatgaacgtgccatatttatcacaccaccctagttatggctacatgttgttgattatttttgcctcattagtccacatatggagttattataaagagttgtttatgctattgagcagagtcttctttatgtcatgtaaatgatcactatga

SEQ ID NO: 8037 - protein, 498 aa, Mesembryanthemum crystallinum
MTLDSIPGSSGYLDSYPERRITYFGNKFVLALTVTAGIGGLLFGYDTGVISGALLYIKDEFPAVKNSSFLQETIVSMALVGAMIGSATAGWINDVYGRKKATLLADFIFAIGAVVMAAAPDPYILIVGRFLVGLGVGLASVCAPVYIAEASPTEVRGGLVSTNVLMITFGQFVSYCVNLAFTEVPGTWRWMLGVSGVPAVLQFGFMLLLPESPRWLYLKHEKSKAAAVLAKIYDPFRLEDELDLLAAAEEEEKNKPAVHISDVFTKRELRYAFIAGGGLLAFQQLAGINTVMYYSPTIVQMAGFSSNQLALLISLIVAAMNAVGTVLGIYLIDHMGRRKLALTSLSGVFVALVMLTISFMLRSSGPTSALYSWLAVLGLALYIAFFAPGMGPVPWAINSEIYPQAYRGLCGGMGATICWIVNLFVSETFLSIADAIGTGPTFLIIAGIVIVAFVFVVCFVPETKALTFEEVDQMFMDRAYGTEENTQSLLESSNRSGN

SEQ ID NO: 8038 - DNA, 1569 bp, Oryza sativa
  CDS (1)..(1569)
atggcagctgcaaccgcagctgatgttgccgaggatacggccagtgtgtactccggcaagcttaccctctacgtcttcctcacctgcggcgtcgcggcgaccggcggcctcatcatcggctatgacatcggcatctctggtggtgtgacatcgatggacacgttcctggggaagttcttcccgtcggttctccaccaagaacagacggcgcagggcacaagccagtactgcaagttcaacagccagccgctgaccgcgttcacctcgtcgctgtacctcgcggcgctcgtggcctccttcttcgtcgcgtccttcacgcgcgcgctgggcaggaagtggtccatgttcggcggcggcgtctccttcctcgccggtgccaccctcaacggcgccgcgcggaacgtcgccatgctcatcgtcggccgcatcctcctcggcatcggcgtcgccttctgtggtctgtccactccgatatacttgtctgagatggcgccaccgcggctgcgtggcatgctcaacatcggcctccagctgatgatcaccgtgggcatcttctccgccaatctcgtcaactacggtgcggccaagatcaggggtggctgggggtggcgtgtcagcctcggcctcgctgccgccccggcatgcgtcatcgccgtgggctcgctcttcctcccggactcaccgagctccctcatcaaccgtggccgccacgagcaggcgcggcgggtgctgcggcgcatccgtggcaccgacgaggtggacgacgagtacggcgacctcgtcgcagcagccagcgagatcgaggtgtattccggctgctccgcgagacgacggccgtggcgcgacgtcctgcagcgcaggtaccggccgcagctcgccatggccgtcctcatccccttcttccagcagctcaccggcatcaacgtcatcatgttctacgcgcccgtgctgttcaagaccatcggcctcggaggagacgcgtcgctcatgtcggcggtcatcaccgggctggtcaatatcgttgcaacgttcgtgtccatcgccaccgtcgacagccttggccgacgcaagctcttgttccagggaggctgccagatgcttgtgagccaggttatcattggaacgctgatcggtgtggtgtttggtacgagtggcgatggcaacatctcgagggcgttggcggtctgcatcgtggtgttcatctgcgtctacgtcgccggcttcgcttggtcgtggggcccgcttggcgtcctcctgccgagcgagatcttcccgctggaggtccggccggcggggcagagcatcagcgtggccgtgaacatgctctgcacgttcgccgtcgcggaggccttcctcccgatgctctgccacatgaggttcggcctcttctacttctttagcggatgggtgctcgtgatgacgctcttcgtctcggccttcctgcctgagaccaagggcgtgccgatcgagaagatgaccgtcgtgtggagaacgcactggttttggggtagattttactgtaaccaggatgcagatgcacacgttcaagtggcaaacagcaaagtttga

SEQ ID NO: 8039 - protein, 522 aa, Oryza sativa
MAAATAADVAEDTASVYSGKLTLYVFLTCGVAATGGLIIGYDIGISGGVTSMDTFLGKFFPSVLHQEQTAQGTSQYCKFNSQPLTAFTSSLYLAALVASFFVASFTRALGRKWSMFGGGVSFLAGATLNGAARNVAMLIVGRILLGIGVAFCGLSTPIYLSEMAPPRLRGMLNIGLQLMITVGIFSANLVNYGAAKIRGGWGWRVSLGLAAAPACVIAVGSLFLPDSPSSLINRGRHEQARRVLRRIRGTDEVDDEYGDLVAAASEIEVYSGCSARRRPWRDVLQRRYRPQLAMAVLIPFFQQLTGINVIMFYAPVLFKTIGLGGDASLMSAVITGLVNIVATFVSIATVDSLGRRKLLFQGGCQMLVSQVIIGTLIGVVFGTSGDGNISRALAVCIVVFICVYVAGFAWSWGPLGVLLPSEIFPLEVRPAGQSISVAVNMLCTFAVAEAFLPMLCHMRFGLFYFFSGWVLVMTLFVSAFLPETKGVPIEKMTVVWRTHWFWGRFYCNQDADAHVQVANSKV

SEQ ID NO: 8040 - DNA, 1724 bp, Oryza sativa
  CDS (1)..(1578)
atggcggcgaaggttgggttgttcccctcgtcgtcactcaccaccagcccccacgccatcgcggctgcgccgaccaacgctccccgcccacgcggggctcgtggattggcgtctccaggtcgatccgcggcggcgatggacgccttccacgtgtcgtgcggacacatgcgcagggcggcgaggcgccctccagcggtggcgccggagatggcgcggccgggaaggagttctcgtggtcgtccatcatccttccgtaagatagctcccctctccatctctttgtctgctgaactcagtggaaccacttggttcagcctgtcatctatacagctagggctcgtggcaagcggttcactctatggtgctcttggtggttcgcttcttgcatatcgcgttgccgattttctaggaagaagaatagaactggtcacagctgcagctttatatatttctggtgctctggtcactggatttgcacctgattttgtacttctgatcataggccgtctcctctatggtatcggtattggtttggcgatgcacggtgcacctctttatattgcagagacttctccttcgcgaatacgtgggacattgatatctttaaaggagttgtttattgtattaggaatactgactggataccttgtagggagtcttgaaattgatgtggtaggaggatggcgttatatgtttggttttggtgctccactggcagtaataatggctattggtatgtggaatttaccgccttcaccaagatggcttcttctcagggcagttcaaggaaaggcgtcagtggaagataacaaaaagaaggcaattcaggcattgagatcactgagggggcgctttaggagtgacagggtcttagcagatgagattgatgatacccttctctctattaaggctgcttatgcagaacaagaatctgaagggaacatttggaagatgtttgagggagctagcttgaaggcactcatcattggaggaggactggttctcttccagcagataacaggccagccaagtgttctatactatgcaacttccattcttcagactgctgggtttgcagctgcatctgatgctgccaaagtatcaattttgattgggttgttcaagttgttgatgacaggtgttgcagtatttaaagttgacgatcttggaaggcgtccactacttataggaggcattggtggaatagctgtttcactgttcttattagcagcttactacaagattctgaacagcttcccttttgtcgctgttggtgctttacttctgtatgtcggttcttaccaggtatcgtttggtccaataagttggctaatggtttctgagatcttcccactccgaacaagaggacgtgggatcagccttgcagtacttacaaatttcggctcaaatgcactggtgacatttgccttttcacccttgcaggaattccttggaccagccaatattttccttctatttggagccatatcgttgctctcccttgtgtttgtcatcctaaaagttccagagactaaaggacttacattggaggagatcgaatccaagctcctgaagtaagctcactggtactcaagttgtatgtgtgtgtgtgttttttttgagggcaagttgctatgtgttcattagatgaggttgatacgtgtcggtgtaaatttgttcagtcgatttatgtgattaatatagtcgtacatgtagtattttgt

SEQ ID NO: 8041 - protein, 525 aa, Oryza sativa
MAAKVGLFPSSSLTTSPHAIAAAPTNAPRPRGARGLASPGRSAAAMDAFHVSCGHMRRAARRPPAVAPEMARPGRSSRGRPSSFRKIAPLSISLSAELSGTTWFSLSSIQLGLVASGSLYGALGGSLLAYRVADFLGRRIELVTAAALYISGALVTGFAPDFVLLIIGRLLYGIGIGLAMHGAPLYIAETSPSRIRGTLISLKELFIVLGILTGYLVGSLEIDVVGGWRYMFGFGAPLAVIMAIGMWNLPPSPRWLLLRAVQGKASVEDNKKKAIQALRSLRGRFRSDRVLADEIDDTLLSIKAAYAEQESEGNIWKMFEGASLKALIIGGGLVLFQQITGQPSVLYYATSILQTAGFAAASDAAKVSILIGLFKLLMTGVAVFKVDDLGRRPLLIGGIGGIAVSLFLLAAYYKILNSFPFVAVGALLLYVGSYQVSFGPISWLMVSEIFPLRTRGRGISLAVLTNFGSNALVTFAFSPLQEFLGPANIFLLFGAISLLSLVFVILKVPETKGLTLEEIESKLLK

SEQ ID NO: 8042 - DNA, 1422 bp, Pseudomonas syringae
  CDS (1)..(1422)
atgtcttcaagtagcactacagcagcggctgacacgcaaggtcggcaaaacgcctcgcctaaccgactgattttcatctccgtacttgtggcaaccatgggcgcgctcgcgtttggttatgacaccggtattatcgccggcgcattgcccttcatgacgctgccggccgatcagggcgggctgggtttgaatgcctacagcgaagggatgatcacggcttcgctgatcgtcggtgcagccttcggctcactggccagtggctatatttccgaccgtttcggacgacgcctgaccctgcgcctcctgtcggtgctgttcatcgcgggtgcgctgggtacggccattgcgccgtccattccgttcatggtcgccgcgcgcttcctgctgggtatcgcggtgggtggcggctcggcgacggtgccggtgttcattgccgaaatcgccggcccctcgcgtcgtgcgcggctggtcagccgcaacgaactgatgatcgtcagcggccagttgctcgcctatgtgctcagcgcggtcatggccgcgctgctgcacacgccgggcatctggcgctatatgctggcgatcgcgatggtgccgggggtgttgctgctgatcggcaccttcttcgtacctccttcgccgcgctggctggcgtccaaaggccgttttgacgaagctcaggatgtgctggagcaactgcgcagcaacaaggacgatgcgcagcgtgaagtggacgaaatgaaagctcaggacgagcaggcgcgcaatcgtcccaaggcaaaggaattgctgcgtcagcgctgggtcatcaagctgctgctgatcggcatcggtctgggctttaccgcacagctcaccggcgtgaacgccttcatgtattacacaccgatcatcctcaagaataccgggatgggcaccaacgctgcgctgacggccaccatcggcaacggcgtggtgtcggtcatcgcgaccctgctgggcatctgggcaatcggtcgttatggtcgtcgccacttgctcatgaccggtctggtgatggtcatcctgatgcaggccgcgcttggctgcgtactgcaattcatgccgcagaacctgacccagagctacacggccctcgcctgcattctggtgttcctgctgttcatgcaaatgtgcatttcgccggtgtactggctgttgatgtcggaactgttccccatgcaggtgcggggtttgctgaccggcacggcggtgtcgatgcagtggctgttcaacgcctcggtggcgtttaccttcccgattgcagtggataccatcggcaacccgacgttcttcatctttgcggccatcaacgtcggctcgctgatcttcgtgttcctgtgccttcccgagaccaagggcaagtcgcttgaacagatcgagaaacacctgaagaaagagctgtaa

SEQ ID NO: 8043 - protein, 473 aa, Pseudomonas syringae
MSSSSTTAAADTQGRQNASPNRLIFISVLVATMGALAFGYDTGIIAGALPFMTLPADQGGLGLNAYSEGMITASLIVGAAFGSLASGYISDRFGRRLTLRLLSVLFIAGALGTAIAPSIPFMVAARFLLGIAVGGGSATVPVFIAEIAGPSRRARLVSRNELMIVSGQLLAYVLSAVMAALLHTPGIWRYMLAIAMVPGVLLLIGTFFVPPSPRWLASKGRFDEAQDVLEQLRSNKDDAQREVDEMKAQDEQARNRPKAKELLRQRWVIKLLLIGIGLGFTAQLTGVNAFMYYTPIILKNTGMGTNAALTATIGNGVVSVIATLLGIWAIGRYGRRHLLMTGLVMVILMQAALGCVLQFMPQNLTQSYTALACILVFLLFMQMCISPVYWLLMSELFPMQVRGLLTGTAVSMQWLFNASVAFTFPIAVDTIGNPTFFIFAAINVGSLIFVFLCLPETKGKSLEQIEKHLKKEL

SEQ ID NO: 8044 - DNA, 1467 bp, Lactobacillus plantarum
  CDS (1)..(1467)
atgtctgctgaaaaaagtatttcatctgatcatgtaccgctatcagatccagctttaaaaaccatcaatcgaaatgccgggcgtaatctgaatcatattgcatttatttcaacacttggcggtttattatttggggttgataccggtgtcattaacggtgcaatcggatatatggcgacccccgcggaattaaacctctcgcctaataatgaaggactagtcacgagtggcatcactcttggtgctgcattcggtgcagtcttcgcaggacacctctcagaccgaattggtcgaaaacgacttttaaagtacctagccttgcttttctttgtttgcacattagcttgttctcttgcgccgaacgcactgtttatgatcatctcccgggtcctactcgggctagctgtgggtggtgcctccgttatagtgccaacatatctatcagaaatatccacccctgaaataagaggacgtctagtaacacaaaacgagttaatgattgttaccggacaactattagcctttatcgtaaatgctattttaggtaattggtttggccatatttctaatatttggcgttatatgattggctttggcatgattccagctgttgcactcttcttcggtatgatggttgtgccagaatcaccgcggtggctagtaatggtcaatcagcttgataatgcctttgattctcttaggaaaatccgctcccatcccgaaacatgtaacgaagaaattacccagattcaggatacattgaatcaagaaagcgagattaagcaggccactttcaaggacctatcaacaccatggattcgacgcctggtctttattggaatcggtcttggcgtaatgcagcaatttattggcattaatatcatgatgtattacggaacaacaatcctgacgaactccggattcgcacataatgccgctctaattgcaaatataggtaatggtctagtgtcggttatcgctacttttatcggcatgtcaattatgaatcgcgtgaatagacgaagcatgctaatcgctggtattatcggcactaccacttcacttatcttaatcgttggtgtttctgcattccttagccagagcccgctgttaccaatacttgtcgttctttgcaccatgatgtttttgggctttttccaaggttttatctctccattagtttggctcttgctctctgaaatatttccacaaaacttacgtggactgggaatgggtgtctcgacctttttcctgtggtttgcaaactttcttgtaggctactttttcccaatactattgagtgcagtcggaatgacatggacatttttgatcttcgtatttttcaatattctgtcatttatcttcgcatataaatatgcacctgaaacgcgtggaaaatcacttgaattgatccaaatggaatttaaatatggtgataccacgggaattaaccccgaagataaataa

SEQ ID NO: 8045 - protein, 488 aa, Lactobacillus plantarum
MSAEKSISSDHVPLSDPALKTINRNAGRNLNHIAFISTLGGLLFGVDTGVINGAIGYMATPAELNLSPNNEGLVTSGITLGAAFGAVFAGHLSDRIGRKRLLKYLALLFFVCTLACSLAPNALFMIISRVLLGLAVGGASVIVPTYLSEISTPEIRGRLVTQNELMIVTGQLLAFIVNAILGNWFGHISNIWRYMIGFGMIPAVALFFGMMVVPESPRWLVMVNQLDNAFDSLRKIRSHPETCNEEITQIQDTLNQESEIKQATFKDLSTPWIRRLVFIGIGLGVMQQFIGINIMMYYGTTILTNSGFAHNAALIANIGNGLVSVIATFIGMSIMNRVNRRSMLIAGIIGTTTSLILIVGVSAFLSQSPLLPILVVLCTMMFLGFFQGFISPLVWLLLSEIFPQNLRGLGMGVSTFFLWFANFLVGYFFPILLSAVGMTWTFLIFVFFNILSFIFAYKYAPETRGKSLELIQMEFKYGDTTGINPEDK

SEQ ID NO: 8046 - DNA, 1413 bp, Lactobacillus plantarum
  CDS (1)..(1413)
atggacgttagcgaaagtacaaacaaaaagagcaactcgcacacaggtttcctctggttggcgacattcatagccgcaatggggtcgttactctttgggtatgacacagggatcgttaatggatctcttgagtttatggcggtaaaaggacagcttgatttaactgcatttcaacaaggaattgtttcttcaggattgactcttggggccgcttttggtgcgattattggcggaccatttgcagacaaaattgggcgaaaaaagattttaactatcttaggtattatcttttcagtcggtgccctgggatgtgcatttgccacaaacattactattttaatcgtatttcggtttattttaggtttagcggtaggctctgcatcggctaatgtaccagtatatattgccgaaattgcaccaactgaattacgagggaaaatggtaacaactgcgcaagttatgattgtttctggccaatttgttgcttttggtgttaatgctgctctaacgccattgggtgctcaaaatgctgcaatttggcgctggatgttaggattaggaactattcctggcattatcctttggatcggaatgtaccttatcccagaatcaccaagatggttggtttcgcaggggaagatggataaggcattgggtgtgttacggagaattcgttcggctgccagtgtggaatctgaaatgaaggagattcaggataaggataaggccgataaggaactaaatgctgaacaagcaacgtttaaggagctaattagtaaacgctgggttgtacaaattctgattactggtgcaatgttgggtatcattcaacaatttgccggaattaattctattatgtattatggtggtaaaatcattcaagaatctggatttgatacgactgtcgcggcaatattaaatgccggtaatggattcttgtcgattgttggagctgtcttaggaatgttcacgattgattggttaggtagaagaaaattagagtttgcaggcctaacaatttgtggtattacgctggtttctgctggtgttatccatactgttgcgcctaatgctagctgggctggcattacgattgttgttttagtttatctttatattattttcttccagggtacattaggccccgtcacctggctgattaattcagagatttttccacaaagatatcgtggaattggtactggtattacaatctttgtattatggatcggtaattttattgttggtttgttatccccagtattattggaatggaatatgtcgaatacgttttatatttttgctgtgtgctgtgtattaggtattatctttgttgcgttacgagtacctgagacgaaaggcgtaccgctagaagaaattgaaaaatacttccggactaagtatgacaaatga

SEQ ID NO: 8047 - protein, 470 aa, Lactobacillus plantarum
MDVSESTNKKSNSHTGFLWLATFIAAMGSLLFGYDTGIVNGSLEFMAVKGQLDLTAFQQGIVSSGLTLGAAFGAIIGGPFADKIGRKKILTILGIIFSVGALGCAFATNITILIVFRFILGLAVGSASANVPVYIAEIAPTELRGKMVTTAQVMIVSGQFVAFGVNAALTPLGAQNAAIWRWMLGLGTIPGIILWIGMYLIPESPRWLVSQGKMDKALGVLRRIRSAASVESEMKEIQDKDKADKELNAEQATFKELISKRWVVQILITGAMLGIIQQFAGINSIMYYGGKIIQESGFDTTVAAILNAGNGFLSIVGAVLGMFTIDWLGRRKLEFAGLTICGITLVSAGVIHTVAPNASWAGITIVVLVYLYIIFFQGTLGPVTWLINSEIFPQRYRGIGTGITIFVLWIGNFIVGLLSPVLLEWNMSNTFYIFAVCCVLGIIFVALRVPETKGVPLEEIEKYFRTKYDK

SEQ ID NO: 8048 - DNA, 1401 bp, Lactobacillus plantarum
  CDS (1)..(1401)
atgaataagcagaaaaaggtttccagtaaatttattttcttctttggttcgtttggtggcattctctttgggtatgacattggggtaatgacaggcgcattaccgtttctgaagaccgattgggcattgactaatgcaacattggttgggtgggtgacatcagcagtaatgtttggcgcaatttttggtgctgcaattgccggtcagttggcggatcgactaggtcgtcggcggatgatcttgatgtcatcattgatttttgcaattggctcgattctgtgtggcttttcacctaacaacggaacttactatttgattggcatgcggatcttcttggggttagccgtgggtgctgcttctgcactagtacctgcatatatgtctgaaatggcaccagcacgattgcgcggtagtttatctggaattaatcagaccatgattgtgtcggggatgttaatttcttacattgttgattatattctgaaggatctacccgagaatatgtcatggcggctaatgttaggattggcagcggttccagcgattattctctttctgggagtcttgaagttgccggaatccccacggttcttaattaaagccaatcggttagacgaagcccgtcaagttttatcttttgttcgtaaaccagatgaagttgacagtgaagttaaagcgattcaatcaacagcccaaacggaggctaacaatttagaaaagacctcctgggcaaccttgttcaatgggaaatatcggtacttagtcatggcaggtgttggggttgcagcttttcaacaatttcaaggtgctaatgcaatcttttactacattccgttaatcgttgaaaaggcaaccggtagtgctgcaagttcagcactaatgtggccaattgttcaaggcatcttattagttttaggatcattactttacatttggattgctgaaaaattcaatcggcggactttattgatgttgggtggttccgtcatggcattatcattcctgctaccagctgttattaatagtttggtgccaaatgcaagtccaatgatgattgttgtcttcttatcgatttacgtggctttctactcattcacttgggcaccattgacttgggtgctcgtgggtgaagtctttccgcttgcagttcgcggtcgggcatcaggcttagcttcttcattcaattggattgggtcatgggctgtggggttattattcccaattatgacggcttcaatgtcacaagaagcagtttttgcggtgttcggtgtgatctgtgtattaggagtgctattcgttcgattctgtgttccagaaactcgtggtcactcacttgaagagattgaagcagcaggaacgaatcatcacaaacaagtacccgtacaacaagcgagtcattaa

SEQ ID NO: 8049 - protein, 466 aa, Lactobacillus plantarum
MNKQKKVSSKFIFFFGSFGGILFGYDIGVMTGALPFLKTDWALTNATLVGWVTSAVMFGAIFGAAIAGQLADRLGRRRMILMSSLIFAIGSILCGFSPNNGTYYLIGMRIFLGLAVGAASALVPAYMSEMAPARLRGSLSGINQTMIVSGMLISYIVDYILKDLPENMSWRLMLGLAAVPAIILFLGVLKLPESPRFLIKANRLDEARQVLSFVRKPDEVDSEVKAIQSTAQTEANNLEKTSWATLFNGKYRYLVMAGVGVAAFQQFQGANAIFYYIPLIVEKATGSAASSALMWPIVQGILLVLGSLLYIWIAEKFNRRTLLMLGGSVMALSFLLPAVINSLVPNASPMMIVVFLSIYVAFYSFTWAPLTWVLVGEVFPLAVRGRASGLASSFNWIGSWAVGLLFPIMTASMSQEAVFAVFGVICVLGVLFVRFCVPETRGHSLEEIEAAGTNHHKQVPVQQASH

SEQ ID NO: 8050 - DNA, 1383 bp, Bacteroides thetaiotaomicron
  CDS (1)..(1383)
atgaaaagttataataaaaagtttgtctattccatttgtttggtttctgcgatgggcggtctgctctttgggtatgactgggtggtaatcggaggagcgaaacctttctatgaactctatttcggtattgccgattcgccgacgatgcagggactggctatgagtgtagccttgcttggctgtctgatcggtgctatggtagccggtatgatggctgaccgctatggcaggaaacctctcttgctgatttccgcatttatctttttatcttccgcatacgctaccggtgcattttccgtattcagctggtttttggcagcacgctttttgggaggtatcggcatcggtatcgcttcggggctgtctccgatgtacattgccgaagtagctcctacttccatccgggggaaactggtatccctcaatcaactgactattgtattaggaatccttggcgcacaaatagccaactggctgatagccgagcctatacctgccgactttacgcctgccgatatctgtgcttcatggaacgggcagatgggatggcgctggatgttttggggagcagcatttccggcagcggtattcttgctgctagcctgttttattcccgaaagtccccgttggctggcaatgaaaggcaagagagagaaagcatggagtgtacttagccggataggaggaaaccgctatgcggagcaggaacttcagatggtggaacaaacttctgcttccaagtcggaaggaggattgaaattattgttcagtcgcccgttccgtaaggtactcgtactgggtgttatcgtggctgtgttccagcaatggtgcggtacgaatgtgattttcaattatgcacaggaaatattccagtcggcgggttattcgctgggtgatgtactctttaatattgtggtgaccggtgtagcgaatgtgatctttacgtttgtggctatctatacggtcgaacgtttggggcgccgtgctttgatgcttttgggggctggaggactggcaggtatttatctggttctcggcacgtgttacttttttcaggtcagcggtttctttatggtagtgctggtagtgttggcgatagcttgttatgccatgtctctggggcctatcacgtgggtactgcttgctgagatattccccaaccgcgtgcgtggtgtggctatggcaacctgtactttcgctttgtgggtcggtagtttcacgcttacctacacatttccgttgctgaatactgcattgggcagttacggcacattctggatttattcggctatctgcgtcttcggcttccttttcttcctgcgtgcattgcctgagacaaaagggaaatcgctggagacattggagaaagatctgataaaataa

SEQ ID NO: 8051 - protein, 460 aa, Bacteroides thetaiotaomicron
MKSYNKKFVYSICLVSAMGGLLFGYDWVVIGGAKPFYELYFGIADSPTMQGLAMSVALLGCLIGAMVAGMMADRYGRKPLLLISAFIFLSSAYATGAFSVFSWFLAARFLGGIGIGIASGLSPMYIAEVAPTSIRGKLVSLNQLTIVLGILGAQIANWLIAEPIPADFTPADICASWNGQMGWRWMFWGAAFPAAVFLLLACFIPESPRWLAMKGKREKAWSVLSRIGGNRYAEQELQMVEQTSASKSEGGLKLLFSRPFRKVLVLGVIVAVFQQWCGTNVIFNYAQEIFQSAGYSLGDVLFNIVVTGVANVIFTFVAIYTVERLGRRALMLLGAGGLAGIYLVLGTCYFFQVSGFFMVVLVVLAIACYAMSLGPITWVLLAEIFPNRVRGVAMATCTFALWVGSFTLTYTFPLLNTALGSYGTFWIYSAICVFGFLFFLRALPETKGKSLETLEKDLIK

SEQ ID NO: 8052 - DNA, 1407 bp, Bacteroides thetaiotaomicron; identical to SEQ ID NO: 453
  CDS (1)..(1407)

SEQ ID NO: 8053 - protein, 468 aa, Bacteroides thetaiotaomicron; identical to SEQ ID NO: 454

SEQ ID NO: 8054 - DNA, 1455 bp, Bacteroides thetaiotaomicron
  CDS (1)..(1455)
atgaataatacaacgaacgaaggaagtaaactctacttgtattcgattacttctgttgctattttgggcggtttgctcttcggttatgatacggcggttatatccggcgcggaaaaagggctcgaagccttcttcctgtccgcttccgattttcagtataataaggtaatgcatggcattacttcttccagcgcattgataggctgcgtgctggggggggctttatccggtgtctttgcttcccgtttgggacgtcgtaactcattgcggcttgctgctgtattatttttcctctcggctcttggctcttattatccggaagttcttttcttcgaatacggaaaaccgaatatggatttgttgatagcattcaatctgtatcgtgttctgggaggtatcggagtaggactggcttcagcggtatgtccgatgtatattgctgaaattgctccttccaatattcgtggaacccttgtttcgtgcaatcagtttgccattatctttggtatgttggttgtgtactttgtgaactatctgattatgggtgaccatcagaatccgattattctgaaagatgctgccggtgtgttgtcagtaagtgctgagtcggatatgtggacagttcaggaaggatggcgttatatgtttggttcggaagccttcccggccgctttcttcggcctgttgctgttctttgttccaaagactccccgttatttggttcttgtacagcaggaagaaaaggcttacactattctggagaaaatcaacggtaagaagaaagctcaggaaattcttaatgatattaaggctactgctcaggaaaaaacagagaaactctttacttatggagtaacagtgattgtgatcggtattctactgtccgtattccagcaggcgatcggtattaatgcagtactttactatgctccgcgtattttcgaaaatgcaggtgccgaaggtggtggtatgatgcagacagtgattatgggtattgtaaacattatctttacgctggttgctatctttacggtagaccgctttggtcgtaaaccattgctgattatcggatctattggtatggctgtaggagcatttgcagtggcaatgtgtgatagtatggcaatcaaaggtgttcttccggtactttctatcatcgtatacgctgctttcttcatgatgtcatggggaccgatttgctgggtattgatttcagaaatcttcccgaatactattcgtggtaaagcagttgctattgcagtggctttccaatggatattcaactacatcgtatcttctactttcccggcattgtatgacttcagtccgatgtttgcatatagcttatacggaatcatctgtgtcgctgccgctatctttgtttggcgttgggtacccgagactaaagggaagacgctggaagatatgagtaagctttggaagaaaaacaaataa

SEQ ID NO: 8055 - protein, 484 aa, Bacteroides thetaiotaomicron
MNNTTNEGSKLYLYSITSVAILGGLLFGYDTAVISGAEKGLEAFFLSASDFQYNKVMHGITSSSALIGCVLGGALSGVFASRLGRRNSLRLAAVLFFLSALGSYYPEVLFFEYGKPNMDLLIAFNLYRVLGGIGVGLASAVCPMYIAEIAPSNIRGTLVSCNQFAIIFGMLVVYFVNYLIMGDHQNPIILKDAAGVLSVSAESDMWTVQEGWRYMFGSEAFPAAFFGLLLFFVPKTPRYLVLVQQEEKAYTILEKINGKKKAQEILNDIKATAQEKTEKLFTYGVTVIVIGILLSVFQQAIGINAVLYYAPRIFENAGAEGGGMMQTVIMGIVNIIFTLVAIFTVDRFGRKPLLIIGSIGMAVGAFAVAMCDSMAIKGVLPVLSIIVYAAFFMMSWGPICWVLISEIFPNTIRGKAVAIAVAFQWIFNYIVSSTFPALYDFSPMFAYSLYGIICVAAAIFVWRWVPETKGKTLEDMSKLWKKNK

SEQ ID NO: 8056 - DNA, 1407 bp, Bacteroides thetaiotaomicron; identical to SEQ ID NO: 455
  CDS (1)..(1407)

SEQ ID NO: 8057 - protein, 468 aa, Bacteroides thetaiotaomicron; identical to SEQ ID NO: 456

SEQ ID NO: 8058 - DNA, 1404 bp, Staphylococcus epidermidis; identical to SEQ ID NO: 457
  CDS (1)..(1404)

SEQ ID NO: 8059 - protein, 467 aa, Staphylococcus epidermidis; identical to SEQ ID NO: 458

SEQ ID NO: 8060 - DNA, 1392 bp, Oceanobacillus iheyensis
  CDS (1)..(1392)
atgattcaagataagaaaatatcaagtaagttcatttatttttttggagcttttggaggtattctctttggttatgatattggtgttatgacaggagctttaccttttctgcaaagtgattggaatcttcaaaacgatcctactgcaataggatggattacttcatcgttaatgctaggtgcaatctttggaggggcgctatcaggtcaattatcagatcgtataggaagacgtaagatgattttaatcgcttctattatttttgcactaggttctattatggctgggatttctcctcataatggcattctatttatgattgtatctcgcattattttaggacttgctgtaggagcagcttcagctctagtaccagcatatatgtctgaaatggcccctgcacgtttacgtggacgtttatcaggaattaatcaaacgatgatagtttcagggatgttactctcgtatatcgttgcatttgtattaaaagatttaccggaaacaatggcttggcgcttaatgcttagtttggcagcggtaccagcgttaattttattcttcggagtattaagattaccagaatcacctcgttttctaatcaaaaataataaaataaacgaagctcgtaaagtattgagttatattcgtccaaaagaaaaaattgaaagcgaaatctctcaaattcaagcatcaacaaaatatgaagaaaaagcaagccaaaaaacatcttggggaacactgttaagcggtaaatatcgttatttagtaattgctggtttaggtgtagctgctttccaacaattccagggtgcaaatgctattttttattacatcccgttaattgtagagaatgcgacagggaatgcagcaagttcagctcttatgtggccgataattcaagggataatattagtactaggttcgctcctattcctactaattgctgacaagttcaatcgacgtacattattaacacttggtggaactgttatgggattatcgtttatattaccggcgattttaaatatcgttatcccgaatgcaagtccaatgatgatcgttgtattcttaagtatctacgttgctttttattcgttcacatgggctcctttaacttgggttatagttggagaaatcttcccgctagtcattagaggacgttcttcgggattagcgtcatcgtttaattggatcggatctttcttagttggattattattcccagttatggttgcttcgatggcacaagaagcagttttcgcaatttttggtgcgatttgtctgctaggtgtactatttgttcgattatgtgtacctgaaacgcgtggtcgttctcttgaggaaattgagaaaataggagaaagtaaacagcttcataagaaaacagtttaa

SEQ ID NO: 8061 - protein, 463 aa, Oceanobacillus iheyensis
MIQDKKISSKFIYFFGAFGGILFGYDIGVMTGALPFLQSDWNLQNDPTAIGWITSSLMLGAIFGGALSGQLSDRIGRRKMILIASIIFALGSIMAGISPHNGILFMIVSRIILGLAVGAASALVPAYMSEMAPARLRGRLSGINQTMIVSGMLLSYIVAFVLKDLPETMAWRLMLSLAAVPALILFFGVLRLPESPRFLIKNNKINEARKVLSYIRPKEKIESEISQIQASTKYEEKASQKTSWGTLLSGKYRYLVIAGLGVAAFQQFQGANAIFYYIPLIVENATGNAASSALMWPIIQGIILVLGSLLFLLIADKFNRRTLLTLGGTVMGLSFILPAILNIVIPNASPMMIVVFLSIYVAFYSFTWAPLTWVIVGEIFPLVIRGRSSGLASSFNWIGSFLVGLLFPVMVASMAQEAVFAIFGAICLLGVLFVRLCVPETRGRSLEEIEKIGESKQLHKKTV

SEQ ID NO: 8062 - DNA, 1548 bp, Escherichia coli O6
  CDS (1)..(1548)
atggaatatccatcacataacgacatgtcgcagcaatttaatccatatttatgctatttccgacctgacacctgtgtgagttgttcacgtattttttcactatgtcttactctctgctggcaggaaaaaatggttactatcaatacggaatctgctttaacgccacgtcctctgcgggatacgcggcgtatgaatatgtttgtttcggtagctgctgcggtcgcaggattgttatttggtcttgatatcggcgtaatcgccggagcgttgccgttcattaccgatcactttgtgctgaccagccgtttgcaggaatgggtggtcagtagcatgatgctcggcgcagcaattggtgcgctgtttaatgggtggctgtcgttccgcctggggcgtaaatacagcctgatggcgggggccatcctgtttgtactcggttcgatagggtccgcttttgcgaccagcgtagagatgttaatcgccgctcgtgtggtgttgggcattgctgttgggatcgcgtcttacaccgctcctctatatctttctgaaatggcaagtgaaaacgttcgcggtaagatgatcagcatgtaccagttgatggtcacactcggcatcgtgctggcgtttttatccgatacagcgttcagttatagcggtaactggcgcgcaatgttgggggttcttgctttaccagcagtcctgctgattattctggtggtcttcctgccaaatagcccgcgctggctggcggaaaaggggcgtcatattgaggcggaagaagtgttgcgtatgctgcgcgatacgtcggaaaaagcgcgagaagaactcaacgaaattcgtgaaagcctgaagttaaaacagggcggttgggcactgtttaagatcaaccgtaacgtccgtcgtgctgtatttctcggtatgttgttgcaggcgatgcagcagtttaccggtatgaacatcatcatgtactacgcgccacgtatcttcaaaatggcgggctttacgaccacagaacaacagatgattgcgactctggtcgtggggctgacctttatgttcgctaccttcattgcggtctttacggtagataaagcagggcgtaagccggctctgaaaattggtttcagcgtgatggcgttaggcactctggtgctgggttactgcctgatgcagtttgataacggtacggcttccagtggcttgtcctggctctctgttggcatgacgatgatgtgtattgccggttatgcgatgagcgccgcgccagtggtgtggatcttgtgctctgaaattcagccgctgaaatgccgcgattttggcatcacctgctcaacgacgacaaactgggtgtcgaatatgattatcggcgcgaccttcctgacactgcttgatagcattggcgctgccggtacgttctggctctacactgcgctgaacattgcgtttgtgggcatcactttctggctcattccggaaaccaaaaatgtcacgctggaacatatcgagcgcaaactgatggcaggcgaaaagttgagaaatatcggcgtctga

SEQ ID NO: 8063 - protein, 515 aa, Escherichia coli O6
MEYPSHNDMSQQFNPYLCYFRPDTCVSCSRIFSLCLTLCWQEKMVTINTESALTPRPLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFVGITFWLIPETKNVTLEHIERKLMAGEKLRNIGV

SEQ ID NO: 8064 - DNA, 1554 bp, Bifidobacterium longum
  CDS (1)..(1554)
atgacgacgacaacggcatcacccgtatcgaaacagacggcatccgcggcgcaggaaaccagcgcaaccggtgcggcggccaccgcaatcgaaaccatcgaaaccggcgtggccggagtggcgggcgcggccacaaacgcggcagccaacgcaatcgaggacctcgaagccgccgaatcgcacggcttctccacgcgcttcccgctcaacagcgcattcatcttcaccttcggcgcgctcggcggcatgctgttcggtttcgacaccggcatcatctccggcgcctccccgcttatcgaatcggacttcggcctgagcgtctctcagaccggcttcatcacctcctcggtgctgatcggctcgtgcgcaggcgcgctgtcgatcggcgcactgtctgaccggttcggccgcaagaagctgctcatcgtctccgcgctgctgttcctgctcggctcaggcctgtgcgcctcctccaccggattcgcgatgatggtgtgcgcccgcatcatcctgggtctcgccgtcggcgcggcctccgccctgaccccggcgtacttggccgaactggcgccgaaggagcgtcgcggctcactgtccacgctgttccagctcatggtcaccttcggcattctgctggcctacgcctccaacctcggattcctgaaccacaacctcttcggcatccgcgactggcgctggatgctcggttcggcgctggtgccggccgccttgttgctgctcggcggcctgttgctgcccgaatccccgcgttatctggtgaacaagggcgacacccgcaacgccttcaaagtgcttacgctgattcgcaaggacgtggatcagacccaggtgcagattgagctggacgaaatcaaggccgtggccgcacaggacaccaagggtggtgtgcgcgaactgttccgtatcgctcgtccggcgctggtggccgccatcggtatcatgctgttccagcagctcgtgggcatcaactcggtgatctacttcctgccgcaggtgttcatcaagggcttcggcttccctgaaggcgacgcgatctgggtgtcggtgggcatcggcgtggtgaacttcgtgagcaccatcgtggccacgcttatcatggatcgtttcccgcgcaagggcatgctgatcttcggttccatcgtgatgaccgtttcgctcgcggtgctcgccgtgatgaacttcgtgggcgacgtggccgtgctggcagtgccgacgatgattctcatcgctttctatatcctcggctttgcggtctcgtggggcccgatcgcctgggtgcttatcggcgagatcttcccgctgagcgtgcgcggcatcggctcatccttcggctcggcggcgaactggctgggcaacttcatcgtctcccagttcttcctcgtgctgctcgatgcgttcggcaacaatgtgggcggcccgttcgcgattttcggcgtgttctcggccctgtccatcccgttcgtgctgcgcttggtgcccgagaccaagggcaagtcgctggaggaaatcgagaaggaaatgaccaagcgctag

SEQ ID NO: 8065 - protein, 517 aa, Bifidobacterium longum
MTTTTASPVSKQTASAAQETSATGAAATAIETIETGVAGVAGAATNAAANAIEDLEAAESHGFSTRFPLNSAFIFTFGALGGMLFGFDTGIISGASPLIESDFGLSVSQTGFITSSVLIGSCAGALSIGALSDRFGRKKLLIVSALLFLLGSGLCASSTGFAMMVCARIILGLAVGAASALTPAYLAELAPKERRGSLSTLFQLMVTFGILLAYASNLGFLNHNLFGIRDWRWMLGSALVPAALLLLGGLLLPESPRYLVNKGDTRNAFKVLTLIRKDVDQTQVQIELDEIKAVAAQDTKGGVRELFRIARPALVAAIGIMLFQQLVGINSVIYFLPQVFIKGFGFPEGDAIWVSVGIGVVNFVSTIVATLIMDRFPRKGMLIFGSIVMTVSLAVLAVMNFVGDVAVLAVPTMILIAFYILGFAVSWGPIAWVLIGEIFPLSVRGIGSSFGSAANWLGNFIVSQFFLVLLDAFGNNVGGPFAIFGVFSALSIPFVLRLVPETKGKSLEEIEKEMTKR

SEQ ID NO: 8066 - DNA, 1515 bp, Arabidopsis thaliana
  CDS (1)..(1515)
atggccggtggagctcttaccgatgaaggaggcctaaagagagctcatctctatgaacatcggatcacttcttacttcatcttcgcttgcatcgtcggatccatgggaggctctcttttcggctatgatcttggagtctctggtggtgttacatcaatggacgatttcttgaaagagttcttcccagggatctacaaaagaaagcaaatgcatctaaacgaaacagattactgcaaatacgacaatcaaatcctcacactcttcacttcttctctctacttcgccggtttaatctcaactttcggagcttcttacgtcaccagaatctacggtaggagaggaagcatcctcgttggctctgtcagcttcttcctcggaggagtgattaacgctgcagccaaaaacatcctcatgttaatccttggtcgaatcttcctcggcataggcattggattcggaaaccaggcggttccgctatacctctcggagatggctccagcgaagattagaggaactgtgaatcagcttttccagctaacaacttgcattggaattctagttgctaatttgataaactacaaaacagagcaaatccatccatggggatggagactctctctcggtctcgccaccgtcccagctatactcatgttcctcggtggactcgttttgcctgaaacacccaatagtcttgtcgagcaagggaagctcgagaaggctaaagccgtgctgatcaaagtacgtggcacaaacaatatagaagctgagtttcaggatcttgtcgaagccagtgacgctgctagagccgtgaagaatccgtttcgcaatcttcttgctagaagaaacagaccgcagctagtgattggagccattgggcttcctgcgtttcagcaactaaccggaatgaattcgatcctgttttatgctccggttatgtttcagagcttagggtttggtggatctgcgtcgcttatctcgtctaccattacaaatgctgcgcttgttgtcgcggcgatcatgtctatgtattcagctgataaatttggaagaaggtttcttcttcttgaagctagcgtggagatgttctgttacatggttgtagtaggagtaacactagccttgaagtttggggaaggtaaggagctaccaaaatcgctcggtctgattcttgtggtccttatctgtctatttgtattggcgtatggtcgatcttggggtccaatgggatggttagttccgagcgagcttttccctctagagactcgatcagccggtcagagcgttgtggtgtgcgtgaaccttttcttcacggctctaatcgcgcagtgtttcctggtgtcgctgtgccatctcaagtacggaatgttccttttattcgccggacttatattggggatgggaagcttcgtttactttctgttgccggagacgaaacaggttccgattgaagaggtttatcttctttggagacagcattggttatggaagaaatatgtcgaagatgttgatgaataa

SEQ ID NO: 8067 - protein, 504 aa, Arabidopsis thaliana
MAGGALTDEGGLKRAHLYEHRITSYFIFACIVGSMGGSLFGYDLGVSGGVTSMDDFLKEFFPGIYKRKQMHLNETDYCKYDNQILTLFTSSLYFAGLISTFGASYVTRIYGRRGSILVGSVSFFLGGVINAAAKNILMLILGRIFLGIGIGFGNQAVPLYLSEMAPAKIRGTVNQLFQLTTCIGILVANLINYKTEQIHPWGWRLSLGLATVPAILMFLGGLVLPETPNSLVEQGKLEKAKAVLIKVRGTNNIEAEFQDLVEASDAARAVKNPFRNLLARRNRPQLVIGAIGLPAFQQLTGMNSILFYAPVMFQSLGFGGSASLISSTITNAALVVAAIMSMYSADKFGRRFLLLEASVEMFCYMVVVGVTLALKFGEGKELPKSLGLILVVLICLFVLAYGRSWGPMGWLVPSELFPLETRSAGQSVVVCVNLFFTALIAQCFLVSLCHLKYGMFLLFAGLILGMGSFVYFLLPETKQVPIEEVYLLWRQHWLWKKYVEDVDE

SEQ ID NO: 8068 - DNA, 1545 bp, Aspergillus niger; identical to SEQ ID NO: 459
  CDS (1)..(1545)

SEQ ID NO: 8069 - protein, 514 aa, Aspergillus niger; identical to SEQ ID NO: 460

SEQ ID NO: 8070 - DNA, 1752 bp, Aspergillus niger; identical to SEQ ID NO: 463
  CDS (1)..(1752)

SEQ ID NO: 8071 - protein, 583 aa, Aspergillus niger; identical to SEQ ID NO: 464

SEQ ID NO: 8072 - DNA, 1584 bp, Emericella nidulans; identical to SEQ ID NO: 467
  CDS (1)..(1584)

SEQ ID NO: 8073 - protein, 527 aa, Emericella nidulans; identical to SEQ ID NO: 468

SEQ ID NO: 8074 - DNA, 1512 bp, Arabidopsis thaliana
  CDS (1)..(1512)
atggggtttgatcccgagaaccaatcgatctcttccgttggacaggttgttggtgattcttcttcaggtgggattactgctgaaaaggaacctttgttaaaggaaaaccacagcccagagaactactctgttcttgcagccattcctccgtttctctttccagctcttggagcattgctttttggttatgaaattggtgcaacatcttgtgctatcatgtctcttaagtcgcctactctaagtggaatttcatggtacgacttgtcttcagtggatgttggtataattaccagtggctcactgtatggtgccttaattggctccattgttgcatttagtgttgccgacattataggaaggagaaaggagctgattttggctgcattcttgtatcttgttggagccattgtgactgtagtagcacctgtcttttccatactgataattggacgagttacgtatggcatggggattggactgaccatgcacgcggctccaatgtacattgcagagactgctccaagtcaaatacgtggacggatgatatcactaaaggaattctccactgtccttgggatggttgggggttatggaatcggtagcctttggattacggttatttctggttggcgttacatgtacgcaacaattctcccttttccagttattatgggaactggaatgtgttggctaccagcatctccgaggtggcttttactgcgcgctctccagggacaaggaaatggggagaatcttcaacaggctgcgattagatctctttgtcgccttagagggtctgtcatagctgactcagcagctgaacaagtaaacgaaatattggctgaactttcccttgtgggtgaagacaaagaagctacatttggtgaattatttcgaggcaaatgcttgaaagctctcactatagcaggagggttagtcttgttccaacagataactgggcaaccaagtgtactatattatgcaccatcaatactacagactgccggcttttctgctgcagctgatgcaactcggatctcaattctgctcggcctattgaagttggttatgacaggagtttctgtgatagttatcgacagagttggaaggagacctttacttctttgtggtgttagcggaatggtgatctcattgttcctcctgggatcctactacatgttttataaaaatgtaccagctgttgctgtagctgcattgctactgtatgtaggctgttaccagctgtcctttggccctattggttggctgatgatttcagagatatttcccttaaaattaagaggtagaggaatcagtctagcagtgcttgtgaattttggcgcaaacgcacttgtgacattcgctttctcaccgctaaaggagctgttaggagctggaatactgttctgtgcatttggagtgatatgtgtcgtgtctctcttcttcatatactacattgtgccagagacaaagggtctcactcttgaagaaattgaagccaaatgtctctaa

SEQ ID NO: 8075 - protein, 503 aa, Arabidopsis thaliana; identical to SEQ ID NO: 472

SEQ ID NO: 8076 - DNA, 1837 bp, Arabidopsis thaliana
  CDS (131)..(1699)
atctaatatctctttctcaatttcggttccactttcctttcgtttgcaaaaacccatcccatcaaaaataaacaagaggccctaaagaagaatcctaaagactttacgggacttgtttaggataaaagaaatgcctgccggtggattcgtcgtcggggatggccaaaaggcttatcccggcaaactcactccctttgttctcttcacttgcgttgttgctgccatgggcggtctcatcttcggatacgatatcggaatctccggtggtgtgacgtcgatgccgtctttcctcaagcgattcttcccgtcggtgtatcggaaacaacaagaggacgcgtcaacgaaccagtactgtcagtacgatagcccgacgctaacgatgttcacatcgtctctatatctagcggcgctaatttcgtcgctggtggcttccaccgtgacaagaaagttcggacggcggctctcgatgctcttcggcggcatactcttctgcgccggagctctcattaatggtttcgccaaacatgtttggatgctcatcgtcggtcgtatcttgcttggtttcggtatcggtttcgctaatcaggctgtgccactgtacctctctgagatggctccatacaaatacagaggagctttaaacattggtttccaactctcaattacaatcggaatcctcgtcgccgaagtgctcaactacttcttcgccaagatcaaaggcggttggggatggcggctcagtctcggaggcgcggtggttcctgccttgatcataaccatcggctccctcgtcctccctgacactcccaattcaatgatcgagcgtggccaacacgaagaagccaaaaccaagctcagacgaatccgtggtgtcgatgacgtcagccaagagtttgacgatttggtcgccgctagtaaagagtcgcagtcgatagagcacccgtggagaaacctcctccgccgcaaataccgaccacatctcactatggccgttatgattccgttctttcaacagctaaccggaatcaatgtgattatgttttacgctccggttttgttcaacaccattggtttcacgaccgatgcttctctcatgtccgctgtggtcactggctcggttaacgtggccgctacgcttgtttctatctacggtgttgacagatggggacgtcggtttctctttcttgaaggtggtacacaaatgcttatatgccaggctgtggttgcagcttgcataggggccaagtttggggtagacgggacccctggtgagctaccgaagtggtatgctatagtggttgtaacgttcatttgcatctatgtggcgggttttgcgtggtcgtggggcccactagggtggttagtaccgagtgaaatcttcccgttggagataaggtcggcggcgcagagtatcaccgtgtccgtgaacatgatcttcacgttcattatcgcgcaaatcttcttgacgatgctttgtcatttgaagtttgggttattcctcgttttcgcctttttcgtggtggtgatgtcgatctttgaatacattttcttgccggagacgaaagggattccgatagaggagatgggtcaagtgtggaggtcacactggtattggtcaaggtttgtggaggatggtgagtatgggaatgcgcttgagatgggcaagaacagtaaccaagctggaacgaagcatgtttgatttatcattgtttttaatgagagttttaagaaagaaagaaaaaagatttgtaatttctaatgtcgtaaaggaaaaagtgtattagcctagatatatattggtgtttatataattcaataccacatggagaaattatgc

SEQ ID NO: 8077 - protein, 522 aa, Arabidopsis thaliana
MPAGGFVVGDGQKAYPGKLTPFVLFTCVVAAMGGLIFGYDIGISGGVTSMPSFLKRFFPSVYRKQQEDASTNQYCQYDSPTLTMFTSSLYLAALISSLVASTVTRKFGRRLSMLFGGILFCAGALINGFAKHVWMLIVGRILLGFGIGFANQAVPLYLSEMAPYKYRGALNIGFQLSITIGILVAEVLNYFFAKIKGGWGWRLSLGGAVVPALIITIGSLVLPDTPNSMIERGQHEEAKTKLRRIRGVDDVSQEFDDLVAASKESQSIEHPWRNLLRRKYRPHLTMAVMIPFFQQLTGINVIMFYAPVLFNTIGFTTDASLMSAVVTGSVNVAATLVSIYGVDRWGRRFLFLEGGTQMLICQAVVAACIGAKFGVDGTPGELPKWYAIVVVTFICIYVAGFAWSWGPLGWLVPSEIFPLEIRSAAQSITVSVNMIFTFIIAQIFLTMLCHLKFGLFLVFAFFVVVMSIFEYIFLPETKGIPIEEMGQVWRSHWYWSRFVEDGEYGNALEMGKNSNQAGTKHV

SEQ ID NO: 8078 - DNA, 1536 bp, Oryza sativa
  CDS (1)..(1536)
atgacgagccagctgggctcggcacggaggccttccaagttccaacctttacaaattaattacatatgcggggcgtcgctgttcatcaaggaggacatgaagatcacggacgtcgaggtggagatcctgctcggcatcctcaacctctactccctcgtcggctccttcgccgccggccggacctccgactggatcggccgccgcctcaccatcatcctcgccgcggtcatcttcttcgtcggcgccatcatgatgggcctctccgtcaactaccccatgctcatggccggccgcttcgtcgccggcatcggcgtcggctacgccttcatgatcgcgcccgtctacaccgccgaggtctcgccggcgtcgtcgcgcggcttcctcacctccttcccggaggtgttcatcaacttcggcatcctcctcggctacgtctccaactacgccttctcgcgcctccgcctgcagctcggctggcgcctcatgctcggcgtcggcgcggcgccgtccgtcgccctcgcgctcatggtgctcgccatgccggagtcgccgcggtggctcgtcatgaagggccgcctcgccgacgccaaggtcgtcctcggcgagacctcggacacggcggaggaggccgccacccgcctcgcggaaatcaaggaggcggtggccatcccggccgacctcgacggtgacgtcgtggccgtgccgaagagggccggcggcgagaggcgcgtgtggaaggagctgatcctgtcgccgacgccggccgtccggcgcgtgctcctgtcggcgctcggcatccacttcttccagcagtcgtcgggcatcgacgccgtcgtgctctacagcccgcgcgtgttccagagcgccgggatcaccgacaagaacaagctgctcggcacgacgtgcgccgtgggcgtcaccaagacgctcttcatcctggtggcaacgttcacgctcgaccgcttcggccggcggccgctgctgctggccagcgccggcggcatgatcgccaccctcgtcaccctcggcttaggcctcaccgtcatcggtgaggacgccaccggcggcggctgggccatcgccgtgtccatcgcctccatcctcgccttcgtcgccttcttctccatcggcctcggccccatcacctgggtgtacagctccgagatcttcccgctccacctccgcgccctcggctgcgctctcggcgtcggcctcaaccgcgtcaccagcggcgtcatctccatgaccttcctctccctctccaaggccatcaccatcggcggcagcttcttcctctacgccggcgtcgcctcgcttgcttggctcttcttcttcacctacctcccggagactcgtggacgcacgctcgagcagatgggcgagctcttccgcatccacaacatggccggcgacgacgactctgccgccactcgaccgccgtcgccggaggaggaggagaagatcaccaactacgtggagatggcggcgccgtcgtcgtcgtcgtcgacggccactagcagccatcatgcaaagtga

SEQ ID NO: 8079 - protein, 511 aa, Oryza sativa
MTSQLGSARRPSKFQPLQINYICGASLFIKEDMKITDVEVEILLGILNLYSLVGSFAAGRTSDWIGRRLTIILAAVIFFVGAIMMGLSVNYPMLMAGRFVAGIGVGYAFMIAPVYTAEVSPASSRGFLTSFPEVFINFGILLGYVSNYAFSRLRLQLGWRLMLGVGAAPSVALALMVLAMPESPRWLVMKGRLADAKVVLGETSDTAEEAATRLAEIKEAVAIPADLDGDVVAVPKRAGGERRVWKELILSPTPAVRRVLLSALGIHFFQQSSGIDAVVLYSPRVFQSAGITDKNKLLGTTCAVGVTKTLFILVATFTLDRFGRRPLLLASAGGMIATLVTLGLGLTVIGEDATGGGWAIAVSIASILAFVAFFSIGLGPITWVYSSEIFPLHLRALGCALGVGLNRVTSGVISMTFLSLSKAITIGGSFFLYAGVASLAWLFFFTYLPETRGRTLEQMGELFRIHNMAGDDDSAATRPPSPEEEEKITNYVEMAAPSSSSSTATSSHHAK

SEQ ID NO: 8080 - DNA, 1673 bp, Drosophila melanogaster
  CDS (88)..(1554)
ctaaagctgtattagctacattcgccgcctcgttgccagaaaaaaacgatttcagttcgtgattcagattaactatacagcaccgcaatgaagatcctgatgcgagcggacacccatgtgtccttctccgtgcccgccgatgggctcaaggccaattttaccttttcccaggtcttggctgctctgagtgtctcgctgtgctccttggtggtcggatttgtcagcgcttacacgtcgcctgcacttgtgtcgatgaccgatcgaaccatcacctcctttgaggtcacaaaagatgctggttcctgggttggtggcatcatgccactggctgcattagcaggtggcataacaggaggacccttgatcgaatatctgggcaggcgcagcaccatcctggccactgcggtgcccttcatcgtatcatcactgctgattgcgtgtgctgtgaatgtgatcatgattctgtgcggacgattcctaactggattctgcgttggcattgcctctttatccctgcccgtctatctgggtgagactttgcagccggaagtgcggggcactttgggtttgctgcccaccgctcttggtaacataggcatcctggtttgctatgtggcgggatcctttatgaattggtcgatgctggccttcttgggagctgctctgcccgttcccttcctgattttgatgatcattatccccgaaactccgcgctggtttgtgaaccgtggtcaggaagagcgcgccaggaaggctttgaaatggctgcgtggcaaggaggcggatgtggagcccgaactaaaggagttgatgcaatctcaggccgatgccgatcgtcaggccactcagaacacctgtttggagctgtttaagcgaaacaatctgaagccactttccatttccttgggtctgatgttctttcaacagttcagcggtatcaacgcggttatcttctacacggtccagatcttcaaggatgcgggatccacaattgatagcaatctttccacgatcatcgtgggtgtagttaacttttttgctacgtttatgggcatcattctgattgatcggttgggcagaaagattcttctgtatgtatccgacatcgccatgatcgtgaccctgtccattctgggcggcttcttctactgcaaggcgcatggtccggatgtgtcccatttgggttggttgccactcacttgcttcgttatctacattctgggattctccctgggcttcggacccattccctggctgatgatgggtgagattctgccggccaagattcgaggaccggctgcctcggtggtcacggctttcaactggttctgcacgtttgtggtaaccaagaccttccaggacctcacggttgctatgggcgcgcatggagccttctggctattcggcgccatctgcatcgtgggtctgttctttgtgattatttttgtgcccgaaacgcggggcaaatcgttggaggaaattgagcgaaagatgatgggccgtgtgcccatgtcctcggtggtcaacatcaagccatttcctttcaacatgtaaatggcgtgttgctaaggatagggtagtgtcttggtgcttaaattgtgaatttttaggcaagcgaaataaatcaaaattacccttgaaaaataaaaaaaaaaaaaaaaaaaaaaaaaaaa

SEQ ID NO: 8081 - protein, 488 aa, Drosophila melanogaster
MKILMRADTHVSFSVPADGLKANFTFSQVLAALSVSLCSLVVGFVSAYTSPALVSMTDRTITSFEVTKDAGSWVGGIMPLAALAGGITGGPLIEYLGRRSTILATAVPFIVSSLLIACAVNVIMILCGRFLTGFCVGIASLSLPVYLGETLQPEVRGTLGLLPTALGNIGILVCYVAGSFMNWSMLAFLGAALPVPFLILMIIIPETPRWFVNRGQEERARKALKWLRGKEADVEPELKELMQSQADADRQATQNTCLELFKRNNLKPLSISLGLMFFQQFSGINAVIFYTVQIFKDAGSTIDSNLSTIIVGVVNFFATFMGIILIDRLGRKILLYVSDIAMIVTLSILGGFFYCKAHGPDVSHLGWLPLTCFVIYILGFSLGFGPIPWLMMGEILPAKIRGPAASVVTAFNWFCTFVVTKTFQDLTVAMGAHGAFWLFGAICIVGLFFVIIFVPETRGKSLEEIERKMMGRVPMSSVVNIKPFPFNM

SEQ ID NO: 8082 - DNA, 2234 bp, Kluyveromyces lactis; identical to SEQ ID NO: 473
  CDS (402)..(2102)

SEQ ID NO: 8083 - protein, 566 aa, Kluyveromyces lactis; identical to SEQ ID NO: 474

SEQ ID NO: 8084 - DNA, 1476 bp, Corynebacterium glutamicum
  CDS (1)..(1476)
atggctagtaccttcattcaggccgacagccctgaaaaaagtaagaagctgcccccactcacagaaggtccgtatagaaagcggctattctacgttgcactagttgcgacgtttggtgggctgctcttcggatatgacaccggagtaatcaacggtgcactcaacccaatgacacgtgagctcggactaaccgcgttcaccgagggtgttgtaacttcttccctgctgtttggtgcagcagctggtgcgatgtttttcggtcgcatttccgacaactggggtcgccggaaaacaatcatctcacttgcagtagctttctttgtcggcaccatgatctgcgtgtttgctccatcttttgcagtaatggttgtcggacgtgtgcttcttggactcgcagttggtggcgcttccactgttgtccctgtctacctggctgaacttgctccttttgaaatccgtggctcactggctggccgtaatgagttgatgattgttgttggtcagctcgcagcttttgtcatcaatgcgattattggaaatgtttttggacaccacgatggtgtgtggcgctacatgctggcaattgccgcaatcccagcaattgccctcttctttggaatgctccgagttccagaatccccacgctggcttgttgagcgaggacgcattgatgaggctcgcgcagttcttgaaaccattcgccctctagaacgtgcccatgcagaagttgctgatgttgaacacctagcaagagaagagcacgccgtttccgagaagtccatgggcttaagggaaattttgtccagcaagtggcttgtgcgcatcctcctggtaggtatcggattgggtgtcgcacagcagctgaccggcatcaactccatcatgtactacggccaggttgttctcattgaggctggtttctccgagaatgcagctctgatcgccaacgtggcgccaggagtgatcgcagttgtcggtgcattcatcgcactgtggatgatggatcgtatcaaccgccgtaccaccctcattaccggttattctctcaccaccattagccacgtattgatcggtatcgcatccgtagcattcccagtcggcgatcctcttcgcccctacgttatcttgactctggttgtggtcttcgtgggatccatgcagaccttcctcaacgtagctacctgggttatgctctctgagctcttcccgctggcaatgcgcggtttcgcaatcggtatctcagtgttcttcctctggatcgcaaacgcgttcctcggattgttcttcccaaccatcatggaagcagtaggactaaccggaaccttcttcatgttcgccggaatcggtgtggttgccttgatcttcatctacacccaggttcctgaaactcgtggacgtaccttggaggagattgatgaggatgttacttccggtgtcattttcaacaaggacatccgaaaaggaaaggtgcactag

SEQ ID NO: 8085 - protein, 491 aa, Corynebacterium glutamicum; identical to SEQ ID NO: 476

SEQ ID NO: 8086 - DNA, 1446 bp, Xanthomonas campestris
  CDS (1)..(1446)
atgtttccaggtgaacccatgtccagtgtctccattgacggcgcccccgatgccggcgagaacacccgtttcatcatcctgatcagctgcgtggccacgatcggcggctttctgttcggcttcgacagtggcgtgatcaatggcaccgtcgacgggctcaagcagaccttccagtccagcgccgccgagaccggcttcgaagttgcctcgatgctgctggggtgcgccatcggcgccttctttgccggccgcctggccgaccgctggggccgccgtgctgtcctgatcatttctgcggcgctgttcctgctctcggctatcggtgccggtgcctcgcacagctccggcttcttcatctttgcccgcgtgatgggcggctttgcggtaggcgcagccagcgtcatttcgccggcctacatcgccgaggttgcctccgcgcgctatcgcggccggctcgccaccatgcagcagatcgccatcatcagcgggctgttctgcgcgttcttgagcaactacctgctggccaatgccgccggtgcgtccaccgagccgttatggggcgggcaggcggcctggcgctggatgttctggatgcaggccatcccgtcgctgctgttcctgctgctgttgctggtcatccccgaaagcccgcgctacctggtggtcaagggccgtcgcgagcaggcgctggtggtgctcaagcggctgtacggtaacgcggccgcgcagaccaagctgggcgaaatctccgcctcgatgtcggccgaccagcacaagcccaagttctccgacctgatcagcaagaccaccggcaagatccgcccgatcgtatggattggcgtcggcctggcggtgttccagcaactggtcggcatcaacgtggtgttctattacggcgcggtgctgtggcaggcagtgggcttctccgaacaggacgccttgctgatcaacgtgctctccggcggcctcagcattggtgcctgcctggtcacggtgatgctggtcgacaagatcggccgcaagccgttgctgtggatcggctcggccggtatggcggtatcgctggcactggtgacctacgccttcgccaccgcctcgctggatcccaacggcaagctcgcgatgtccgatgccatgggcatgctcgcgctggttgccgccaacgtctacgtggtgttcttcaatgcctcgtggggcccggtgatgtgggtgatgctgggcgagatgtttcccaaccagatccgcggttcgggcctggccattgccggcgctgcacagtggacttccaacttcgccatcaccgtcagcttcccgatcctgctcggcagcatcggtcttgccggcgcctacggcatctacaccgttgccgccttcatctcggtgttcttcgtgctcaagtacgtctacgagacgaagggcaaggagctggagcagatggagggctga

SEQ ID NO: 8087 - protein, 481 aa, Xanthomonas campestris
MFPGEPMSSVSIDGAPDAGENTRFIILISCVATIGGFLFGFDSGVINGTVDGLKQTFQSSAAETGFEVASMLLGCAIGAFFAGRLADRWGRRAVLIISAALFLLSAIGAGASHSSGFFIFARVMGGFAVGAASVISPAYIAEVASARYRGRLATMQQIAIISGLFCAFLSNYLLANAAGASTEPLWGGQAAWRWMFWMQAIPSLLFLLLLLVIPESPRYLVVKGRREQALVVLKRLYGNAAAQTKLGEISASMSADQHKPKFSDLISKTTGKIRPIVWIGVGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 8088 - DNA, 1428 bp, Xanthomonas axonopodis
  CDS (1)..(1428)
atgtccagtgtttccattgacggcgcccccgatgccggcgagaacacccgtttcatcatcctgattagttgcgtggccacgatcggtggcttcctgttcggcttcgacagcggcgtgatcaatggcaccgtcgacggcctgaaacagaccttccagtccactgccgcagagacgggcttcgaggtcgcctcgatgctgctgggctgcgccatcggcgccttctttgccggccgcctggccgaccgctggggccgccgcgcggtcctgatcatttccgcggcgctgttcctgctctcggccatcggggccggcgcctcgcacagctctgcctttttcatctttgcgcgcgtgatgggcggctttgcggtgggcgcggccagcgtcatttcgccggcctacatcgccgaggtcgcctccgcgcgctaccgcggccggctcgccacgatgcagcagatcgccatcatcagcgggctgttctgcgcattcctgagcaactacctgctggccaacgccgccggtgcctccaccgagccgctctgggccgggcaggccgcctggcgctggatgttctggatgcaggcggttccctccatcctgttcctgttgctgctgctggtcatcccggaaagcccgcgctatctggtggtcaagggtcgccgcgagcaggcgctggtggtgctcaagcgcctgtacggcaacgccgccgcgcagaccaagctgggcgagatttccgcctcgatggcggccgaccagcacaagcccaagttctccgacctgatcaacaaggccaccggcaagatccgccccatcgtctggatcggcattggcctggcggtgttccagcaactggtcggcatcaacgtggtgttctactacggcgcggtgttgtggcaggcagtgggcttctccgagcaggatgcgctgttgatcaacgtgctttccggcggcctcagcatcggtgcctgcctggtcacggtgatgctggtggacaagatcggccgcaagccgctgctgtggatcggctcggccggcatggccgtctcgctggccttggtgacctacgcgtttgccactgcctcgctggatcccaacggcaagcttgcgatgtccgatgccatgggcatgctcgccctggtggccgccaacgtctatgtggtgttcttcaacgcctcgtggggcccggtgatgtgggtgatgctgggcgaaatgttccccaaccagatccgcggctcgggcctggccattgccggtgccgcgcagtggacgtccaacttcgccatcaccgtcagcttcccgatcctgctcggcagtatcggtctggccggtgcctacggcatctacaccgtcgccgccttcatctcggtgttcttcgtactcaagtacgtctacgagaccaagggcaaggagctggagcagatggagggctga

SEQ ID NO: 8089 - protein, 475 aa, Xanthomonas axonopodis
MSSVSIDGAPDAGENTRFIILISCVATIGGFLFGFDSGVINGTVDGLKQTFQSTAAETGFEVASMLLGCAIGAFFAGRLADRWGRRAVLIISAALFLLSAIGAGASHSSAFFIFARVMGGFAVGAASVISPAYIAEVASARYRGRLATMQQIAIISGLFCAFLSNYLLANAAGASTEPLWAGQAAWRWMFWMQAVPSILFLLLLLVIPESPRYLVVKGRREQALVVLKRLYGNAAAQTKLGEISASMAADQHKPKFSDLINKATGKIRPIVWIGIGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 8090 - DNA, 1778 bp, Apium graveolens var
  CDS (79)..(1650)
tcggcaccagatcacactccatgttcatgtgccacattgtaccctaaaacagtacttagctcttcatctctcttaaagatggctggagctttcaatgtttccggtgacgattccggcggctctaaagatgtaggatcacctgtaatatttgatgctgtcaagaaacctaaacgaaataaatatgcttttggttgcgctattttagcttccatgacttccgttttgcttggttatgatattggagtgatgagtggagcagcaatttacataaaagatcagctccatgtgtcggacgtaaaactggagattgttgtcggaataattaacttcttttcacttgttgggtctgctcttgccggaagaacctccgactggattggcaggcgttacacaatggtgctagccggtgctatattttttgttggagcaatacttatgggatttgcaaccaactattcatttctgatgtttggtcgattcgtcgccggaatccggagtaggttatgccctcatgattgctccggtgtacacggccgaggtttcttcagcatcatctcgtggatttcttacttcattcccggaagtttcattaatatcggtgtactgctcggatatgtctcgaattatgcattttccaaactccctgccaacttgggctggcgattcatgcttggaatcggagcaataccttcaatcggtttagcgattggtgtcctaggcatgcccgaatcacctcgttggctcgtcatgaaaggccgtctcggcgaagctagacaagtcctagacaaaacctcagattccaaagaagaatctcgccttagattatccgacatcaaacaggctgctggcatacccgaagaatgcaacgacgatatcgttgtaatgcctaaacggaggaatgacgaggcagtgtggaaagagttgcttctccatcctacaccatcagtccgtcacgcgttcattgctggcgttggtctacattttttccaacaatcaagtggcatagacgctggtggtttgtacagtcctcgaattttcgaaaaggctggaatcacgagtaccgacttaaaactgctagcaacaatagctgttggaatctcgaagacactcttcatcctagtagctacatttttactcgatcgaatcggacgacgtccattgcttctcacaagcatgggaggaatgatcatatccttaactctcctgggaacatccttggctgttattgccactcagatcacacagttcattgggccggggcattggcaatcttcggaggtttaccatacgtgggccgtttttttttggctagggccaattgcatggggttatagttcagaggtgttcccattacgactaagggcccaaggatgtagcattggagtagctgttaacaggggtacaagtggaattatctcgatgacatttttgtcgctatacaaagccataagtatagcaggggcattctatttatttgcagctattgcaggagtggcatggatatttatattcacattacttcctgaaacacaagggaggagccttgaagaaatggggttactgtttggaacctattttggttggagaaaaactttgaagggtttgaagaacagagaagctgaggaagctaaaaatgctaatgtcatatagaaagtttatatttgtcaagtatgggtagtctactttatatgactctgttaccggtacataattttgtaaaataatgtgaattcgggaacaaatccatgtgtgatgagaccaaaaaaaaaaaaaaaaaa

SEQ ID NO: 8091 - protein, 523 aa, Apium graveolens var
MAGAFNVSGDDSGGSKDVGSPVIFDAVKKPKRNKYAFGCAILASMTSVLLGYDIGVMSGAAIYIKDQLHVSDVKLEIVVGIINFFSLVGSALAGRTSDWIGRRYTMVLAGAIFFVGAILMGFATNYSFLMFGRFVAGIRSRLCPHDCSGVHGRGFFSIISWISYFIPGSFINIGVLLGYVSNYAFSKLPANLGWRFMLGIGAIPSIGLAIGVLGMPESPRWLVMKGRLGEARQVLDKTSDSKEESRLRLSDIKQAAGIPEECNDDIVVMPKRRNDEAVWKELLLHPTPSVRHAFIAGVGLHFFQQSSGIDAGGLYSPRIFEKAGITSTDLKLLATIAVGISKTLFILVATFLLDRIGRRPLLLTSMGGMIISLTLLGTSLAVIATQITQFIGPGHWQSSEVYHTWAVFFWLGPIAWGYSSEVFPLRLRAQGCSIGVAVNRGTSGIISMTFLSLYKAISIAGAFYLFAAIAGVAWIFIFTLLPETQGRSLEEMGLLFGTYFGWRKTLKGLKNREAEEAKNANVI

SEQ ID NO: 8092 - DNA, 2118 bp, Homo sapiens
  CDS (110)..(1603)
agcggggctgagcgaagccgcggggcccaaccgcagtcgcggggtctgggaggaagcagtaccttgaagagaaattggagagggagtcaattcctaggatagcagagagatggacaacagacagaatgtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagatttttgctcattaacagaaaaaaagaggagaatgctacgcggatcctccagcggttgtggggcacccaggatgtatcccaagacatccaggagatgaaagatgagagtgcaaggatgtcacaagaaaagcaagtcaccgtgctggagctctttagagtgtccagctaccgacagcccatcatcatttccattgtgctccagctctctcagcagctctctgggatcaatgctgtgttctattactcaacaggaatcttcaaggatgcaggtgttcaacagcccatctatgccaccatcagcgcgggtgtggttaatactatcttcactttactttctctatttctggtggaaagggcaggaagaaggactctgcatatgataggccttggagggatggctttttgttccacgctcatgactgtttctttgttattaaagaatcactataatgggatgagctttgtctgtattggggctatcttggtctttgtggcctgttttgaaattggaccaggccccattccctggtttattgtggccgaactcttcagccagggcccccgcccagctgcgatggcagtggccggctgctccaactggacctccaacttcctagtcggattgctcttcccctctgctgcttactatttaggagcctacgtttttattatcttcaccggcttcctcattaccttcttggcctttaccttcttcaaagtccctgagacccgtggcaggacttttgaggatatcacacgggcctttgaagggcaggcacacggtgcagatagatctgggaaggacggcgtcatggggatgaacagcatcgagcctgctaaggagaccaccaccaatgtctaagtcatgcctccttccacctccctcccggcatgggaaagccacctctccctcaacaagggagagactttatcaggatgaacccaggactgcttctgaatgctgctacttgatttctttctcatcccacgcactccatgagcaccccaaggctgcagtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactagaggatataggagaggaaaagtaaggtgcagttgccccaacctcagacttaccaggaagcagatacatatgagtgtggaagccggagggtgtttatgtaagagcaccttcctcacttccatacagctctacgcggcaaattaacttgagttttatttatcttatcctctggtttaattacataaatatttatttttta

SEQ ID NO: 8093 - protein, 497 aa, Homo sapiens
MDNRQNVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPMYIGEISPTALRGAFGTLNQLGIVIGILVAQIFGLELILGSEELWPVLLGFTILPAILQSAALPCCPESPRFLLINRKKEENATRILQRLWGTQDVSQDIQEMKDESARMSQEKQVTVLELFRVSSYRQPIIISIVLQLSQQLSGINAVFYYSTGIFKDAGVQQPIYATISAGVVNTIFTLLSLFLVERAGRRTLHMIGLGGMAFCSTLMTVSLLLKNHYNGMSFVCIGAILVFVACFEIGPGPIPWFIVAELFSQGPRPAAMAVAGCSNWTSNFLVGLLFPSAAYYLGAYVFIIFTGFLITFLAFTFFKVPETRGRTFEDITRAFEGQAHGADRSGKDGVMGMNSIEPAKETTTNV

SEQ ID NO: 8094 - DNA, 1449 bp, Arabidopsis thaliana
  CDS (1)..(1449)
atggccattagggaaatcaaagatgtagagaggggtgaaatagtgaataaggtagaagatcttgggaaaccatttttgactcatgaagatgatgaaaaagagagtgagaataatgaatcatatttgatggttctcttcagtacttttgttgctgtctgtggctcctttgagtttggctcttgtgttggatactcagcgcctactcagtcatctataagacaagatctcaatctctcccttgcagagttctccatgtttggatccatcttaactatcggtgcaatgcttggtgctgttatgagtgggaaaatttcagatttctccggccgaaaaggggcaatgaggacatcagcttgcttctgcattacaggttggctcgctgtcttcttcaccaagggggcattgttacttgatgtaggaaggttctttacaggatatggaattggagttttttcttatgtggtccctgtgtacattgctgagatatctcccaagaatctccgaggtggactcacaacactgaaccaactcatgattgtgatcggctcatcggtttctttcttgatcggatctctcatttcttggaaaactcttgccctaaccggacttgctccctgcattgttttgctctttggcttgtgcttcatacccgaatctcctcgatggctggcaaaagcaggccatgagaaagagtttcgcgtagccctgcaaaagctgcgaggaaaagatgcagatatcacaaatgaagcagacggtattcaagtctcgattcaagctctagagattcttccaaaagcaagaatccaagaccttgtgtccaagaaatatggtcgatctgtcatcattggtgtttccctgatggtattccaacagtttgttggaatcaatgggatcggattctacgcaagtgaaacgtttgtaaaagccggatttacctctgggaaactaggaacaatcgctatcgcttgtgttcaggtgccaataactgttcttggaacaatcttgatagataaatctggacgaaggccactaattatgatttcagctggtggtatcttcttgggatgcatactcacaggcacatctttcttactcaagggacagagcttgttgcttgaatgggtcccttccttagccgttggaggtgtacttatctatgtagctgctttctccatcggaatgggacctgttccttgggtgataatgtctgagatatttccgataaacgtaaagggaatcgccggaagcttagtggtactagtgaattggtctggtgcttgggctgtttcttacactttcaacttcctcatgagctggagctctccaggtacattctatttgtactcggcttttgcagctgcgacgataatatttgtggcgaagatggtgccagagacgaaagggaagacactggaagagatccaagcttgtattcgaagagaaacataa

SEQ ID NO: 8095 - protein, 482 aa, Arabidopsis thaliana; identical to SEQ ID NO: 482

SEQ ID NO: 8096 - DNA, 1561 bp, Arabidopsis thaliana
  CDS (1)..(1530)
atgacattgacgatcccaaacgcacctgggagctccgggtacttggatatgttcccagagagaaggatgtcgtattttgggaattcttacattctgggtttgactgtcactgccggaatcggtggccttctgttcggttatgatacaggtgtaatttccggtgcccttttgtacattaaggatgatttcgaagttgttaagcagagcagtttcttacaggaaactattgtaagtatggctttagttggtgccatgattggtgctgcagctggaggttggatcaatgactactacggtcgtaaaaaggcgactctttttgcagatgttgtctttgcagctggagctatcgttatggctgctgctcctgatccgtatgttttgatatcgggtcgtctcttggtcggtttaggagttggtgttgcttctgtgactgctccggtttatatagcggaagcatctccatcggaagttagaggtggacttgtgagcaccaacgtattgatgatcactggtggacagtttctttcatatctcgttaattctgctttcacacaggttccaggaacatggagatggatgcttggtgtttcaggcgttcccgctgtgattcagttcatcctcatgcttttcatgccagaatcccctcgatggcttttcatgaaaaatcgtaaagcggaagccatccaagtgctcgccagaacctatgacatctcgcggttagaagacgagattgatcatctttcagcggctgaagaggaagaaaaacaaaggaagcgcactgttggctacttggatgttttcagatccaaagaattgagacttgcatttcttgccggagcaggacttcaggcgtttcagcagttcactggtatcaatacagttatgtactacagccctacgatagtccaaatggctggatttcactcaaaccagctcgctttgttcctgtctctcattgttgctgccatgaatgctgctggaacagtcgtggggatttacttcatcgatcattgtggaaggaaaaagctagctctctcaagtttatttggcgtcattatatcactcttaatcctctcagtctcgtttttcaaacaatctgagacatcatctgatggagggctctatggttggctcgctgtgcttggcttagctctatacattgttttctttgcaccgggaatgggaccagtcccatggacggtgaactcagagatataccctcaacaataccgaggcatatgcggaggcatgtcagctacagttaactggatcagcaatttgattgtggcacaaacattcttgacaatcgcggaagctgctggaacaggaatgactttcttgattttggcgggaattgcggttcttgctgtaatctttgtgattgtgtttgtccctgagactcaagggctaacgttttcggaagttgaacagatttggaaagaaagagcttatggaaatatcagtggctggggcagtagcagtgatagcaacaacatggaagggttactcgagcagggatctcaatcttaaagatcttggatggctcatgagtcatgcatga

SEQ ID NO: 8097 - protein, 509 aa, Arabidopsis thaliana
MTLTIPNAPGSSGYLDMFPERRMSYFGNSYILGLTVTAGIGGLLFGYDTGVISGALLYIKDDFEVVKQSSFLQETIVSMALVGAMIGAAAGGWINDYYGRKKATLFADVVFAAGAIVMAAAPDPYVLISGRLLVGLGVGVASVTAPVYIAEASPSEVRGGLVSTNVLMITGGQFLSYLVNSAFTQVPGTWRWMLGVSGVPAVIQFILMLFMPESPRWLFMKNRKAEAIQVLARTYDISRLEDEIDHLSAAEEEEKQRKRTVGYLDVFRSKELRLAFLAGAGLQAFQQFTGINTVMYYSPTIVQMAGFHSNQLALFLSLIVAAMNAAGTVVGIYFIDHCGRKKLALSSLFGVIISLLILSVSFFKQSETSSDGGLYGWLAVLGLALYIVFFAPGMGPVPWTVNSEIYPQQYRGICGGMSATVNWISNLIVAQTFLTIAEAAGTGMTFLILAGIAVLAVIFVIVFVPETQGLTFSEVEQIWKERAYGNISGWGSSSDSNNMEGLLEQGSQS

SEQ ID NO: 8098 - DNA, 1420 bp, Arabidopsis thaliana
  CDS (1)..(1389)
atggaaggagagaataatatggagaaaggattgttattggcaaaaaaggaagacagtgcaaatacaactccacttcttatcttctccaccttcatcattgtctctgcctccttcacctttggcgctgccataggttatactgcagatacaatgtcctccattatgtcagacttggatctttctctcgcacaattttcgctgtttggttcgttgtcgacgtttggaggaatgatcggtgcaatattcagcgccaaagctgcaagtgccttcggtcataaaatgacgttgtgggtggctgatttattctgcataactggttggcttgcaatttcactagccaaggatattatttggcttgacatggggcgatttttggtgggaattggagttggtctcattagctacgtggttcctgtatatattgcagaaataacacccaagcacgtaagaggggcttttacatttagcaatcagcttttgcaaaactgtggagttgcagtcgtatattactttggaaatttcttgtcatggagaactttagccataataggtagtattccatgttggatacaagttattggtttgttcttcatacctgagtctccaagatggctggcgaaaaaaggtcgtgataaagaatgtgaagaagttcttcaaaagttaagaggaagaaaatacgatattgtgcctgaagcttgcgaaatcaagatttcagttgaagcttcgaagaaaaattcgaatatcaacattcgtagtcttttcgaaaagagatatgctcatcaacttacaatcggcattggtttgatgcttctgcaacagttatgtggaactgcaggaataagttcttacggaagcactctatttaaacttgccgggtttcctgctcggattgggatgatggtgttatctcttatcgtcgtaccaaaatctttaatgggtctaatcctcgtggatcgatggggaagacgcccacttcttatgacttcagcgttggggttgtgtttaagctgtatcacattggcagtagcgtttggagttaaagatgtcccgggaattggaaaaattactccaattttctgtttcattggaatattgtcgtttacgatgatgttcgcaattggaatgggagcgttaccatggattataatgtctgagatatttccaatggatataaaggtattagctgggagtttagtgaccatagcaaattggttcactggttggatcgccaactatgctttcaattttatgttggtttggagcccaagcgggacttttataatatccgctataatctgtggagcaacaattgtattcacatggtgcttggtgccggagactcgaagattaacgttagaagaaatccaactgtcgtttgtcaatgtttagggttcatcggaagcattcatatatacatcat

SEQ ID NO: 8099 - protein, 462 aa, Arabidopsis thaliana
MEGENNMEKGLLLAKKEDSANTTPLLIFSTFIIVSASFTFGAAIGYTADTMSSIMSDLDLSLAQFSLFGSLSTFGGMIGAIFSAKAASAFGHKMTLWVADLFCITGWLAISLAKDIIWLDMGRFLVGIGVGLISYVVPVYIAEITPKHVRGAFTFSNQLLQNCGVAVVYYFGNFLSWRTLAIIGSIPCWIQVIGLFFIPESPRWLAKKGRDKECEEVLQKLRGRKYDIVPEACEIKISVEASKKNSNINIRSLFEKRYAHQLTIGIGLMLLQQLCGTAGISSYGSTLFKLAGFPARIGMMVLSLIVVPKSLMGLILVDRWGRRPLLMTSALGLCLSCITLAVAFGVKDVPGIGKITPIFCFIGILSFTMMFAIGMGALPWIIMSEIFPMDIKVLAGSLVTIANWFTGWIANYAFNFMLVWSPSGTFIISAIICGATIVFTWCLVPETRRLTLEEIQLSFVNV

SEQ ID NO: 8100 - DNA, 1998 bp, Oryza sativa
  CDS (197)..(1717)
gacacatcgatattatccaaacaccatataaacctttctcaccttccggattccggccatcttcgtttctcgtcttcgccggcggccgccgcatttctgatcggccgatatatatcggatcttcagactggtcgcagcagctcgtgtgtgattgagaagtacacaaggagaagaaggagaagacgacgcagctgccatgggagaagagaagcagaatgacgagaggaagaacaagtacgccgtcgggtgctccatcatcggctccatcatctcggtcctcatgggctatgacactggtgtgatgagtggggcgatgctgttcatcaaggaggacctgaagacgaacgacacgcaggtgcaggtcctcgccgggatcctcaacgtgtgcgcgctcgtcggctccctcaccgccggccgcgtctccgactgcgtcggccgccgcctcaccatctccctcgccgcctgcatcttcctcgtgggctccgtcctcatgggcctcgcgcccaacttcgccacgctcctcgccggccgctgcgtcgccggcgtcggcgtcggctacgcgctcatgattgcgccggtgtacgccgccgagatcgcctccgccgacatccgcggctcgctcacctcgctcccggagatctgcatcagcttcgggatactcatcggctacgtggccaactacctgctcgccaagctgccgctggtgtacgggtggcgcgccatgctcggcctcggcgcgctcccgagcgccgcgctcgcgctcggcgtgctcgccatgcccgagtccccgcggtggctcgtcgtccagggccgcgccgaggaggcgctctccgtgctccgccgcgtgtgcgacaggcccagcgaggccgacgcgcggctcgcggagatcaaggccgcggcggggctcgccgacgacgacggcgccgccgccaacgcgggcagcggcggcaagggcgtgtggagggagctgttcctgcacccgacgccgccggtgcggcgcatcgtcatcgccgccctggggatccacttcttccagcacctcaccggcatcgaggccgtggtgctctacagcccgcgcatcttcaaggcggccggcatcgccagccgcaactcggtgctcgctgcgaccatcggcgtgggcgtcaccaagacggcgttcatcctcaccgccatcctcctcgtcgaccgcataggccggcggccgctctacctgtcaagcctcgccggcatcatcgcctcgctcgcctgcctcggcatgggcctcaccgtcatcgagcggtcgccgccgcaccactcgccggcgtgggccgtcgtgctcgccatcgccaccgtgttcaccttcgtcgcctccttctccatcggcgtcgggccgatcacctgggcctacagctcggaggtgtacccgctccgcctccgcgcgcagggcgccagcgtcggcgtcgccatcaaccgcgtgatgaacgccggcgtgtccatgacgttcgtgtcgctctacaaggccatcaccatcggcggcgccttcttcctcttcgccgggctcgccgtcgccgccgccacgttcttctacctcctgtgcccggagacgcagggcaagccgctggaggagatcgaggaggtgttcagccaggggtggcgcgcgcggcgccgggcgtcggcggcggccgtcgagatgccggcctccggcggcggcggcggcggcggcgccccgatggcgtagtgcgaagtgcaccgcggtgcgcgtgcgtgaacaaagtgcaacgcacgcgtgtggatgacgtggaagtgtttgtcacttggggaaaagaacgaatattcgctagctagctagtggtacagatggctagagattgaaatggaagggacctgatactactactgttgcatttgtaggaaacgactactagctaacaatgtcattctggtgtcgtgtggtgtttagaaaaaacaaaatcgttgaaatacagtaaaaaaaattaagaaaataaaaatttgtgctac

SEQ ID NO: 8101 - protein, 506 aa, Oryza sativa
MGEEKQNDERKNKYAVGCSIIGSIISVLMGYDTGVMSGAMLFIKEDLKTNDTQVQVLAGILNVCALVGSLTAGRVSDCVGRRLTISLAACIFLVGSVLMGLAPNFATLLAGRCVAGVGVGYALMIAPVYAAEIASADIRGSLTSLPEICISFGILIGYVANYLLAKLPLVYGWRAMLGLGALPSAALALGVLAMPESPRWLVVQGRAEEALSVLRRVCDRPSEADARLAEIKAAAGLADDDGAAANAGSGGKGVWRELFLHPTPPVRRIVIAALGIHFFQHLTGIEAVVLYSPRIFKAAGIASRNSVLAATIGVGVTKTAFILTAILLVDRIGRRPLYLSSLAGIIASLACLGMGLTVIERSPPHHSPAWAVVLAIATVFTFVASFSIGVGPITWAYSSEVYPLRLRAQGASVGVAINRVMNAGVSMTFVSLYKAITIGGAFFLFAGLAVAAATFFYLLCPETQGKPLEEIEEVFSQGWRARRRASAAAVEMPASGGGGGGGAPMA

SEQ ID NO: 8102 - DNA, 2145 bp, Homo sapiens
  CDS (46)..(1479)
ggcggttcaggcgccagagctggccgatcggcgttggccgccgacatgacgcccgaggacccagaggaaacccagccgcttctggggcctcctggcggcagcgcgccccgcggccgccgcgtcttcctcgccgccttcgccgctgccctgggcccactcagcttcggcttcgcgctcggctacagctccccggccatccctagcctgcagcgcgccgcgcccccggccccgcgcctggacgacgccgccgcctcctggttcggggctgtcgtgaccctgggtgccgcggcggggggagtgctgggcggctggctggtggaccgcgccgggcgcaagctgagcctcttgctgtgctccgtgcccttcgtggccggctttgccgtcatcaccgcggcccaggacgtgtggatgctgctggggggccgcctcctcaccggcctggcctgcggtgttgcctccctagtggccccggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatggaggtcctcaggccctatggagccttctggcttgcctccgctttctgcatcttcagtgtccttttcactttgttctgtgtccctgaaactaaaggaaagactctggaacaaatcacagcccattttgaggggcgatgacagccactcactaggggatggagcaagcctgtgactccaagctgggcccaagcccagagcccctgcctgccccaggggagccagaatccagccccttggagccttggtctgcagggtccctccttcctgtcatgctccctccagcccatgacccggggctaggaggctcactgcctcctgttccagctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcagtcgctcctctcacgcggctgccttatcgggaaggaaatttgtttgccaaataaagactgacacagaaaatcaggtcagtgtctctgggctttgtgcaagctcagtttgaaaagggtttattcccatcactgcccaggacaccctgtggctttacttgctcatggtcagccaagcttacccttcacactgagaagtcatttctggctacttccttgggctcagttccctgggtcatcagccatcaaatcttgttgagtttaaaaaataaacagcaaaaaaaaacaaaccaaaaaaaaaaaaaaaaaaaaaaaaaaaaaaa

SEQ ID NO: 8103 - protein, 477 aa, Homo sapiens
MTPEDPEETQPLLGPPGGSAPRGRRVFLAAFAAALGPLSFGFALGYSSPAIPSLQRAAPPAPRLDDAAASWFGAVVTLGAAAGGVLGGWLVDRAGRKLSLLLCSVPFVAGFAVITAAQDVWMLLGGRLLTGLACGVASLVAPVYISEIAYPAVRGLLGSCVQLMVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFPLHVKGVATGICVLTNWLMAFLVTKEFSSLMEVLRPYGAFWLASAFCIFSVLFTLFCVPETKGKTLEQITAHFEGR

SEQ ID NO: 8104 - DNA, 1419 bp, Salmonella typhimurium
  CDS (1)..(1419)
atggtctctattaatcatgactctgctttaacgccgcgttcgcttcgcgacacacgacgtatgaatatgtttgtttcggtttctgcagcggtagcgggactgttatttggtctggatatcggcgttatcgccggggcgctgccttttattaccgaccatttcgtactgaccagccggctgcaggaatgggtcgtcagcagcatgatgcttggcgcggcaattggcgcattatttaacggctggctttcattccggctggggcgtaagtatagcctgatggctggcgcgattttgttcgtgctcggctcgctggggtcggcgtttgcttccagcgtggaagtattgattggcgcccgcgtgatactgggcgtagcagtagggattgcctcctataccgcgccgctttatctctctgaaatggcaagtgaaaatgttcgcggcaaaatgatcagtatgtatcaactgatggtgacgttaggcattgtgctggcttttttatccgatacggcattcagctacagcggcaactggcgcgcgatgttgggcgtgctggcgctgcctgcggtgttgctcattattctggtggtattcctgccgaatagtccgcgttggctggcgcaaaaaggtcgccatattgaagcggaagaggtgctgcgtatgctgcgcgatacctcggaaaaagcccgtgatgaactgaatgagattcgggaaagcctcaaactcaagcagggagggtgggcattatttaaagctaaccgcaatgttcgccgcgccgtgttcctcggtatgctgctacaggcaatgcagcagttcaccggcatgaacatcattatgtactatgcgccgcgcatttttaaaatggccggctttaccaccacggaacagcaaatgatcgccacgctggtggtcggactgacttttatgttcgcgacgtttatcgccgtctttacggtcgataaggccgggcgtaaaccggcgttaaaaatcggtttcagcgtaatggcgttagggacattggtgttgggctactgcctgatgcagtttgataacggtacggcatcaagcggtctctcctggctttccgttgggatgacgatgatgtgtatcgccggttacgcgatgagcgccgctccggtggtgtggatactgtgttcggaaatccagccgctgaaatgccgtgattttggcattacctgttcaaccacgacaaactgggtatcgaacatgatcatcggcgcgacattcctgacactgttggacagcattggcgcggcaggtacattctggctctacaccgcgctgaatatcgcttttatcggcatcactttctggctgattccggaaaccaaaaatgtcaccctggagcacatcgaacgcaagctgatggcgggcgagaagctaagaaatattggcgtgtaa

SEQ ID NO: 8105 - protein, 472 aa, Salmonella typhimurium
MVSINHDSALTPRSLRDTRRMNMFVSVSAAVAGLLFGLDIGVIAGALPFITDHFVLTSRLQEWVVSSMMLGAAIGALFNGWLSFRLGRKYSLMAGAILFVLGSLGSAFASSVEVLIGARVILGVAVGIASYTAPLYLSEMASENVRGKMISMYQLMVTLGIVLAFLSDTAFSYSGNWRAMLGVLALPAVLLIILVVFLPNSPRWLAQKGRHIEAEEVLRMLRDTSEKARDELNEIRESLKLKQGGWALFKANRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFIGITFWLIPETKNVTLEHIERKLMAGEKLRNIGV

SEQ ID NO: 8106 - DNA, 2039 bp, Olea europaea
  CDS (133)..(1767)
acgcggggggaccttccaaagttactctatctacctgccacataaactataaccacactgcaatcacatacgaagtggaagtgccgacaataatctcaaatcaactttctaatttggtcaaattggtggaaaatgcaggtttctacacatgctgttaaaggaaatttatgccttggattacaaaaccttaggccgttgccgagttcgcgtgaattgagagagaataatttaggtttcgctgttagtgagcttcggatgacaaaaaggagcagttgcttcggaattggcctagactcaattgccatgggagcaagggggaattggcctaaaagtgtgtacggatcattggccaaggccagatcagtcagagctcaagcttatgaaggagatgttgaggatgttgcacctgccaaaatccaagtgaaatcatctggaactgttctgccatatgttggtgttgcttgtttgggagccattctttttggatatcatctaggggtggttaatggtgctctagagtatcttgccaaggatcttggaattgctgaaaatgctgtgttgcaaggttgggtggttagcacacttcttgctggtgccactgttggttcattcactgggggttctttggctgataaatttgggcgaacaaagacttttctgttggatgcaattccacttgcagttggagcatttctttgtgccactgcacagaacatagagacaatgataattggtcgcttacttgctggaattggaattggtatatcgtctgctattgtgccactttatatatctgagatctcaccaactgaaatccgtggaacacttggatctgtaaaccagctatttatatgtattgggattctggcagcattggtagctggattgcctttagctggaaatcctttgtggtggaggacgatgtttggtgttgcgattattccgtccatattattggcacttggaatggctttttctcctgaaagcccacggtggctttatcagcaagggaaaatttctgaagctgaagtgtccatcagaaagctaaatggaaaagaaagggttgctgaggttatgagtgatttggatgcagcagctcaaggttcctctgaaccagaagctgggtggtttgatcttttcagtagtcgctattggaaagttgttagcgttggtgcagctctcttcttgttccagcagcttgctgggataaatgccgtagtatactattctacttctgttttccgcagtgctggaattacatctgatgttgctgccagtgctctagttggggcggcaaatgtttttgggacaaccattgcgtcctccttgatggataagcaaggaaggaaaagtcttctgcttacaagctttgctggcatggctgtttccatgttgctgctttccttaaccttcacttggaagactctggcaccatatgcaggcacccttgctgttcttggcactgttctttatgtattatccttctctcttggtgctggtcctgtgcctgctcttctgcttccagagatttttgcctctagaattagagcaaaagcagtggcattgtctttaggcatgcattggatatcgaattttgtcattggcctgtacttcttgagcgttgtaactaagtttggaataagtacagtgtacctgggatttgcatctgtttgtcttctagcagtcatgtacatagcaggtaatgttgtggaaactaagggacgatcactggaggaaatagagcgcgctcttactgctgctccttgaggggaataatgttgtagcaccaagggaagtatttgccgtttcccctatcgcagattatccgagaatcatctttccagttttcattatgtgacaaatggactgttggtaagcatttgatgaacctgcgttttgattttggctttgttattttgattgtaactagtgtggggggcgttgtctcgacttttatcacatcagtagatgggtgttggggacagtttgatgtaaattagatagttctttcactaataaggatttagatttgagaaatt

SEQ ID NO: 8107 - protein, 544 aa, Olea europaea
MQVSTHAVKGNLCLGLQNLRPLPSSRELRENNLGFAVSELRMTKRSSCFGIGLDSIAMGARGNWPKSVYGSLAKARSVRAQAYEGDVEDVAPAKIQVKSSGTVLPYVGVACLGAILFGYHLGVVNGALEYLAKDLGIAENAVLQGWVVSTLLAGATVGSFTGGSLADKFGRTKTFLLDAIPLAVGAFLCATAQNIETMIIGRLLAGIGIGISSAIVPLYISEISPTEIRGTLGSVNQLFICIGILAALVAGLPLAGNPLWWRTMFGVAIIPSILLALGMAFSPESPRWLYQQGKISEAEVSIRKLNGKERVAEVMSDLDAAAQGSSEPEAGWFDLFSSRYWKVVSVGAALFLFQQLAGINAVVYYSTSVFRSAGITSDVAASALVGAANVFGTTIASSLMDKQGRKSLLLTSFAGMAVSMLLLSLTFTWKTLAPYAGTLAVLGTVLYVLSFSLGAGPVPALLLPEIFASRIRAKAVALSLGMHWISNFVIGLYFLSVVTKFGISTVYLGFASVCLLAVMYIAGNVVETKGRSLEEIERALTAAP

SEQ ID NO: 8108 - DNA, 1521 bp, Arabidopsis thaliana
  CDS (1)..(1521)
atggccggtggaggattggctcttgatgtctccagcgccggaaacattgatgccaagatcacagccgcagttgtcatgagttgcattgtggctgcctcatgtggtctcatttttggctatgacatcggaatctcagggggtgtgacgactatgaagccgtttcttgagaaattctttccatcggttcttaaaaaagcttcggaagctaagacgaatgtctactgcgtctacgacagccaacttcttacggccttcacatctagcctttatgttgccggcttagtagcttccttagtggctagccgtctcacagcggcttatggtcgccgaaccaccatgatccttggcggtttcactttcctctttggtgctctgatcaatggcttagctgctaacatcgccatgctcatctccggtcggattttgctaggatttggtgtcggtttcaccaaccaggcggctccggtatatctatcggaagtagcaccaccgcgatggcgtggagcattcaacatcggcttttcatgcttcatcagtatgggagtagtagcagccaatctaataaattacggtaccgatagtcaccgtaacggctggcgtatctcgctaggtctagctgctgtaccagccgcgatcatgaccgtgggatgtctattcatttccgacacaccttctagcctcttggcgcgtgggaaacacgatgaagctcacacgtcgctgcttaagctacgtggcgtcgaaaacatagctgacgtggaaaccgagctagcagagttggttaggtcaagccagctagccattgaggctagagccgaactgtttatgaagacgatattgcagagacggtataggcctcatcttgtggttgctgtggtgataccatgttttcaacagttaactggaataacggtgaacgcgttctatgcgccggttctgtttcgatcggttgggtttggttctggtccggctcttattgcgacgttcatactcgggtttgttaatcttggttcgcttcttctctcaacaatggttattgaccggtttggtagacggtttttgttcattgctggcggtattctgatgcttctctgtcagattgcagtggctgtgttactagctgtgacagtgggagccaccggggacggagagatgaagaagggttacgccgtgacggtggtggtgttactttgcatatacgcagctgggtttggatggtcgtgggggccattaagctggcttgtcccaagtgagatattcccactcaagatacgaccagctggtcagagcttaagcgttgccgtgaacttcgccgcaacgtttgctctctctcaaacgttcttagcaacgctctgcgatttcaagtacggtgctttcttgttttacggcggttggatctttacaatgacgatattcgtcatcatgttcttgcccgagaccaaagggatacctgtggattctatgtatcaagtttgggagaagcattggtattggcaacggtttactaaaccgacgtcaacttaa

SEQ ID NO: 8109 - protein, 506 aa, Arabidopsis thaliana
MAGGGLALDVSSAGNIDAKITAAVVMSCIVAASCGLIFGYDIGISGGVTTMKPFLEKFFPSVLKKASEAKTNVYCVYDSQLLTAFTSSLYVAGLVASLVASRLTAAYGRRTTMILGGFTFLFGALINGLAANIAMLISGRILLGFGVGFTNQAAPVYLSEVAPPRWRGAFNIGFSCFISMGVVAANLINYGTDSHRNGWRISLGLAAVPAAIMTVGCLFISDTPSSLLARGKHDEAHTSLLKLRGVENIADVETELAELVRSSQLAIEARAELFMKTILQRRYRPHLVVAVVIPCFQQLTGITVNAFYAPVLFRSVGFGSGPALIATFILGFVNLGSLLLSTMVIDRFGRRFLFIAGGILMLLCQIAVAVLLAVTVGATGDGEMKKGYAVTVVVLLCIYAAGFGWSWGPLSWLVPSEIFPLKIRPAGQSLSVAVNFAATFALSQTFLATLCDFKYGAFLFYGGWIFTMTIFVIMFLPETKGIPVDSMYQVWEKHWYWQRFTKPTST

SEQ ID NO: 8110 - DNA, 1557 bp, Arabidopsis thaliana
  CDS (1)..(1467)
atgagttttagggatgataatacggaagagggaagaaatgatcttcggcgaccgttcttacacacaggaagttggtatcggatgggttcgagacaatctagtatgttggaatcgtctcaagttattcgagacagctcaatttctgtcttagcttgtgttttgattgttgctcttggtcctattcaattcggattcacttgtggttattcctcaccaactcaagctgccattactaaggatcttggtttaactgtatcagagtactctgtgtttgggtctctatccaatgtgggtgctatggttggagcaattgcgagtggtcagattgctgaatacgttggacggaaagggtctctgatgattgctgcaattcccaatattattggatggctttcgatatcatttgcaaaagatacttcttttctttacatgggaagattgttagaaggcttcggagttgggattatctcctatacggttcccgtatatatagctgagatcgctccacagaccatgagaggagccttaggttcagttaaccagctttctgtaacaattgggataatgctggcgtatttactcggtctctttgttccatggagaattcttgcagttttgggagtattgccatgtacattgttgataccgggtctttttttcattcctgaatctcctcggtggttggcaaagatgggtttgacagatgatttcgaaacttcattgcaagttcttcgtggatttgagactgatattaccgttgaggttaatgaaatcaagagatctgtggcatcatctagcaaacgttctgcagttcggtttgtagacctcaagcgcaggagatactatttcccactgatggttggtatagggctgcttgcacttcaacaacttggaggaatcaatggtgtcttgttctattcgagtacaatttttgaatctgcaggggtgacatcaagtaatgtggcgacatttggagttggcgttgttcaggtagtggcgactgggatagcgacatggttggtggataaagcaggtcgtcggcttctactcatgatctcttctatcggaatgacgataagcctcgtgattgtagcagttgcattttaccttaaggaatttgtatcacctgattccaacatgtacaacattctaagcatggtttccgtagttggagttgtggctatggttatttcttgctctctaggaatgggaccaattccatggctgattatgtctgagattctgccagtgaatataaagggtttagccggaagtatagcaactttgttaaactggttcgtgtcatggttagtgacaatgactgcaaatatgctgttagcatggagcagtgggggaactttcactctctacgctttggtttgtggattcactgtggtttttgtgagtctttgggttcctgagactaaaggaaaaacgcttgaagagatccaagctttgttcagatgatcaaaacaagaagaggaagaagaagacaaaattttcactttttgctttctccattacagatcattcttttgtcccttccctgtgtctgta

SEQ ID NO: 8111 - protein, 488 aa, Arabidopsis thaliana
MSFRDDNTEEGRNDLRRPFLHTGSWYRMGSRQSSMLESSQVIRDSSISVLACVLIVALGPIQFGFTCGYSSPTQAAITKDLGLTVSEYSVFGSLSNVGAMVGAIASGQIAEYVGRKGSLMIAAIPNIIGWLSISFAKDTSFLYMGRLLEGFGVGIISYTVPVYIAEIAPQTMRGALGSVNQLSVTIGIMLAYLLGLFVPWRILAVLGVLPCTLLIPGLFFIPESPRWLAKMGLTDDFETSLQVLRGFETDITVEVNEIKRSVASSSKRSAVRFVDLKRRRYYFPLMVGIGLLALQQLGGINGVLFYSSTIFESAGVTSSNVATFGVGVVQVVATGIATWLVDKAGRRLLLMISSIGMTISLVIVAVAFYLKEFVSPDSNMYNILSMVSVVGVVAMVISCSLGMGPIPWLIMSEILPVNIKGLAGSIATLLNWFVSWLVTMTANMLLAWSSGGTFTLYALVCGFTVVFVSLWVPETKGKTLEEIQALFR

SEQ ID NO: 8112 - DNA, 1876 bp, Arabidopsis thaliana
  CDS (87)..(1727)
ctcagcaatcacaatctatctggtttaagccctcactatcctctctctcaaatcgcggagtctccgaagtttctctgtcagacaaaatgcagtcgtcaacgtatgcggttaaaggaaacgctgcgtttgcgtttcagagacggaccttctcttctgacagatcgacgacttctaccggaattcgcttcgctggttataagagcttagccaccaccgggccactctactgttctggttctgaagccatgggagcgacgcttgctcgtgctgataacgggatccagagcgttatgagtttctcttctgtcaaagctcgatcggtcagagctcaagcctcatctgatggagatgaagaagaagctatacctctgagatctgaagggaaaagctctggaacagttttgccttttgttggtgttgcttgtcttggtgctatactctttggttatcatctcggggtggttaatggtgctcttgaatatcttgctaaggatcttgggatcgccgaaaatactgttttgcaaggatggattgttagttctctgcttgctggtgctacggtaggttcattcactggaggtgcattagctgacaaatttggacgaacaagaacttttcaattggatgctatcccgcttgccattggagctttcttatgtgcaacagctcagagtgtgcagactatgattgtgggacgtctgctcgctggaattggaattggaatctcatcagcgattgtaccactttacatatctgagatatcaccaactgaaatccgtggagcactcggatctgtgaaccagttgttcatctgtataggaatacttgcagccttgatagctggattaccccttgcagcaaaccctctatggtggaggacgatgtttggtgttgcagttatcccttccgttctattggccataggaatggctttttctccagaaagcccaaggtggctcgttcagcaaggaaaagtctctgaagctgaaaaggcgatcaaaactttgtatggcaaagaaagagtggttgaactagttcgcgacttatcagcctctggccaaggttcttctgagccggaggcaggatggtttgatctattcagcagccgctactggaaagttgtaagcgtaggtgcggctctcttcttgtttcaacagttagccgggataaacgcagttgtgtattactccacatcggtattccgtagtgcgggaatccaatcagatgttgcagccagtgctctcgttggagcatcaaatgtctttggcactgctgttgcttcatcgttgatggataaaatgggaaggaaaagtcttttactgacaagctttggtggaatggctttgtcaatgctgttactctccttgtccttcacatggaaggctcttgctgcctattctggaacccttgccgttgttggaactgttctatatgtcctgtcattctcacttggtgctggcccggtaccggctcttcttcttccagagatatttgcatcccgaatcagagcaaaagccgtcgctctttctctcggcatgcactggatatcaaactttgtgatcggactatacttcttaagcgttgtgactaaattcggaatcagcagtgtctacttgggttttgctggagtctgcgtccttgcggtcctctacattgcaggaaacgtcgtcgagactaaaggtcgatcactggaggaaatagagcttgctcttacatctggagcttgaaattaaacaaaagaaatcagcagaacaaaaaccagtttgtttcatcatttagtttgtgagtctttctctaatctgctactcttaaattgtacaatggacgacgttatcaataacgagaaatcttttcatgaccaaaaaaaaaaaaaaaa

SEQ ID NO: 8113 - protein, 546 aa, Arabidopsis thaliana
MQSSTYAVKGNAAFAFQRRTFSSDRSTTSTGIRFAGYKSLATTGPLYCSGSEAMGATLARADNGIQSVMSFSSVKARSVRAQASSDGDEEEAIPLRSEGKSSGTVLPFVGVACLGAILFGYHLGVVNGALEYLAKDLGIAENTVLQGWIVSSLLAGATVGSFTGGALADKFGRTRTFQLDAIPLAIGAFLCATAQSVQTMIVGRLLAGIGIGISSAIVPLYISEISPTEIRGALGSVNQLFICIGILAALIAGLPLAANPLWWRTMFGVAVIPSVLLAIGMAFSPESPRWLVQQGKVSEAEKAIKTLYGKERVVELVRDLSASGQGSSEPEAGWFDLFSSRYWKVVSVGAALFLFQQLAGINAVVYYSTSVFRSAGIQSDVAASALVGASNVFGTAVASSLMDKMGRKSLLLTSFGGMALSMLLLSLSFTWKALAAYSGTLAVVGTVLYVLSFSLGAGPVPALLLPEIFASRIRAKAVALSLGMHWISNFVIGLYFLSVVTKFGISSVYLGFAGVCVLAVLYIAGNVVETKGRSLEEIELALTSGA

SEQ ID NO: 8114 - DNA, 1377 bp, Arabidopsis thaliana
  CDS (1)..(1377)
atggaagaaggacttcttcggcatgaaaacgacagagatgatcgtcgtatcacagcttgtgttatcctcagcacttttgttgctgtttgtagttccttcagctatggatgtgctaatggttatacttccggcgctgaaactgcaatcatgaaagagttagacctttctatggcacaattttcagcgtttggttcctttttgaacttgggaggtgcggtgggagctttgtttagcggtcaattagcagtcatccttggcagaagacgaacgttgtgggcatgcgatttgttctgcatttttggttggctctccattgcttttgcaaagaatgtcttgtggctggacttgggaagaatttctttaggcatcggagtgggcttgactagctacgtggtccctgtctatattgcggaaatcactcctaaacatgttcgtggcgcattttctgcttcaaccctgcttcttcaaaacagtggaatttctctgatttattttttcggaactgtaattaattggcgggttctggctgttataggtgctcttccatgtttcattccagtgatcggtatatatttcataccggaatcaccaagatggttggctaaaatcggttcagttaaagaagtagaaaactctctgcatcgccttagagggaaagatgctgatgtttcagatgaagccgctgaaattcaggttatgacaaaaatgcttgaagaagattcaaagtccagtttttgtgacatgtttcagaagaagtatagacgaactctagtggttggaattggtttaatgttgatacaacaattatctggagctagcggtatcacatattattcaaatgccatatttagaaaagctggcttttcagagagacttggatcaatgatatttggtgtgttcgtgatcccaaaagctttggttggtctgattcttgtggatagatggggaagacgaccactcctattggcttctgctgttggaatgtctatcggatccttgcttattggggttagcttcacgttacaggaaatgaatctgtttcctgaatttattccagttttcgtcttcataaatattctggtctactttggattttttgcaatcggtataggagggctaccttggatcattatgtctgagatatttccgataaatataaaagtttcagcagggtcaatcgttgcattaacatcgtggaccactgggtggttcgttagttatggtttcaactttatgtttgaatggagcgcacaaggaaccttttacatatttgcgatggtggggggattgtcattgctttttatatggatgctcgtgccggaaaccaaaggacagtcgcttgaagaattgcaagcatcccttacggggacaacctaa

SEQ ID NO: 8115 - protein, 458 aa, Arabidopsis thaliana
MEEGLLRHENDRDDRRITACVILSTFVAVCSSFSYGCANGYTSGAETAIMKELDLSMAQFSAFGSFLNLGGAVGALFSGQLAVILGRRRTLWACDLFCIFGWLSIAFAKNVLWLDLGRISLGIGVGLTSYVVPVYIAEITPKHVRGAFSASTLLLQNSGISLIYFFGTVINWRVLAVIGALPCFIPVIGIYFIPESPRWLAKIGSVKEVENSLHRLRGKDADVSDEAAEIQVMTKMLEEDSKSSFCDMFQKKYRRTLVVGIGLMLIQQLSGASGITYYSNAIFRKAGFSERLGSMIFGVFVIPKALVGLILVDRWGRRPLLLASAVGMSIGSLLIGVSFTLQEMNLFPEFIPVFVFINILVYFGFFAIGIGGLPWIIMSEIFPINIKVSAGSIVALTSWTTGWFVSYGFNFMFEWSAQGTFYIFAMVGGLSLLFIWMLVPETKGQSLEELQASLTGTT

SEQ ID NO: 8116 - DNA, 1608 bp, Oryza sativa
  CDS (1)..(1608)
atggcagggacgggagcctccgttaagatgattcgttgcgttgtaaagtgcggcgggcagcagcagcacgtcgtcgtcgctgcgcgcggtgatcggaagtcgccggcgatcgcggcgccaccaccagcgaccgtgcggatgccgggccgcgtgctctgctgcggcatgaggtcgcgcggggcggatctcgccggcgtcgagatggcggcggggccgcagccgcagggcggcgtctcggggctcttccgcggcccgcgctcgagcccgcgctactcccgcgtgcgcgccaccgccacagttgatcctgaggatattccattggagaaggttcaagctaaatcttctggaagtgttctgccatatgtgggcgttgcttgtttgggggctattttatttggttatcatcttggagtggtcaacggcgctcttgaatatcttgcaaaggaccttggaatttctgagaatgctgtgttacaaggatgggtggttagcacaaccctggctggtgcgacagcaggttcttttactggaggtgctttagctgacaaatttggacgaacacggacgttcatcctggatgcaatccctctcgctgtaggtgcattcctgagtgcaacagctcatgatgttcgcacaatgattattggccgattacttgctgggattggtattggcatatcttctgctcttgtgcccctttacatatctgaggtatttcacccactgaaatacgtggagcacttggttctgttaatcagctttttatctgcattggaattcttgctgctctggtggaggacaatgttcggaatttcaattgttccatccattttgcttgctcttgggatggctgtttcacctgaaagccctcgttggctattccagcaaggaaaactttctcaggcagaaacagctattaaaaaactatatggaagagaaaaagttgctgaagttatgtatgacctaaaagctgccagccaaggttcttctgagccagatgctggctgtgtgggcgcagctatgttcttgttccaacagcttgccggtataaatgctgttgtatattactctacatcggtgttccgcagtgcaggcattgcatctgatgttgcagcgagtgcccttgttggagcagccaatgtttttggtacaatgattgcatcttctctgatggacaagcaaggaaggaagagccttctgataacaagcttttctggcatggctgcctcaatgttacttctatcattgtccttcacgtggaaggctttggcaccttattcaggccctcttgctgttgctggcactgttttgtatgtgctgtcttttgctcttggagctggcccagttccagcattgctccttcctgaaatatttgcctccagaataagggctaaagctgttgcattatctctgggcatgcactgggtttcgaacttctttattggcctctacttcttgagcgtcgtcaacaaattcggaatcagcactgtgtatttgggatttgcatctgtttgcgctcttgctgttgtctacatagctggaaatgtggttgagaccaaggggcgttctctggaagagattgagcgggctctaagttcagcaagctga

SEQ ID NO: 8117 - protein, 535 aa, Oryza sativa
MAGTGASVKMIRCVVKCGGQQQHVVVAARGDRKSPAIAAPPPATVRMPGRVLCCGMRSRGADLAGVEMAAGPQPQGGVSGLFRGPRSSPRYSRVRATATVDPEDIPLEKVQAKSSGSVLPYVGVACLGAILFGYHLGVVNGALEYLAKDLGISENAVLQGWVVSTTLAGATAGSFTGGALADKFGRTRTFILDAIPLAVGAFLSATAHDVRTMIIGRLLAGIGIGISSALVPLYISEVFHPLKYVEHLVLLISFLSALEFLLLWWRTMFGISIVPSILLALGMAVSPESPRWLFQQGKLSQAETAIKKLYGREKVAEVMYDLKAASQGSSEPDAGCVGAAMFLFQQLAGINAVVYYSTSVFRSAGIASDVAASALVGAANVFGTMIASSLMDKQGRKSLLITSFSGMAASMLLLSLSFTWKALAPYSGPLAVAGTVLYVLSFALGAGPVPALLLPEIFASRIRAKAVALSLGMHWVSNFFIGLYFLSVVNKFGISTVYLGFASVCALAVVYIAGNVVETKGRSLEEIERALSSAS

SEQ ID NO: 8118 - DNA, 1606 bp, Arabidopsis thaliana
  CDS (18)..(1454)
gttgtatcattacatgcatgcataaaatgatggtggtggagaaagaaagaagcatagaagaaaggcttttgcagctcaagaaccaaaacgacgattcagaatgtcgtattactgcttgtgttatccttagtactttcatcgctgtgtgtggttctttctcctttggtgtctctcttggttatacttcaggtgcagagataggaattatgaaggacttggatctttctatcgcgcaattttcagcatttgcttcattatccactttgggagctgcaattggagctttgtttagcggtaaaatggcgatcatccttggcagaagaaaaacaatgtgggtgtccgatctcctctgtatcattggttggttctccatcgctttcgctaaggatgtgatgtggttgaacttcggaagaatctcctcagggataggactcggcttaattagctatgtggtacctgtctatatagcagaaatttcaccaaaacatgttcgtggtacatttacctttacaaatcagctccttcaaaactctggactcgcaatggtttatttttctgggaattttctcaactggaggatattggctttattaggtgctttaccatgcttcattcaagtaatcggtttattcttcgtaccagagtccccaagatggctggcaaaagttggctccgataaagaactagaaaattcacttcttcgtcttagggggggaaatgctgatatttcacgtgaagcctcagacattgaagttatgaccaaaatggtagaaaatgattcaaagtcgagtttttgtgatttgttccagagaaaatatagatacactctcgtggtaggaatcgggctaatgttgatacaacaattttcaggaagttctgcagtgctctcatatgccagtaccattttacggaaagcaggtttttcggtgaccattggatcgacgctactaggtctcttcatgataccaaaagccatgattggtgtcattcttgtcgataaatggggcagacggcctctcttgttgacttctgtatctgggatgtgcataacttccatgcttattggagtcgccttcacattacagaaaatgcaattgctaccggagctaacaccagtattcacgtttatatgcgttacgctgtatattggaacttatgctataggcttgggaggccttccttgggtaattatgtctgagatatttccaatgaatataaaagtaactgcaggaagtatagtaacgttagtatcatggtcaagtagttcgatcgtcacttatgctttcaactttctgctcgagtggagcactcaaggaacattttacgtatttggagcagtcggaggactagcattgctttttatttggttgctcgttccggaaacgaaaggattatcacttgaagaaatacaagcttcgcttattcgtgagcccgatagaataaatcaaagttagattgaaacgtttaagttttattttaatagataaataattaaaatcaatttatgatactgtgctaagaaagtaattttttttttcattatgtaatcactatttaatttttctaatacttagaattttttatgtataaaaaaaaaaaaaaaaaa

SEQ ID NO: 8119 - protein, 478 aa, Arabidopsis thaliana
MHKMMVVEKERSIEERLLQLKNQNDDSECRITACVILSTFIAVCGSFSFGVSLGYTSGAEIGIMKDLDLSIAQFSAFASLSTLGAAIGALFSGKMAIILGRRKTMWVSDLLCIIGWFSIAFAKDVMWLNFGRISSGIGLGLISYVVPVYIAEISPKHVRGTFTFTNQLLQNSGLAMVYFSGNFLNWRILALLGALPCFIQVIGLFFVPESPRWLAKVGSDKELENSLLRLRGGNADISREASDIEVMTKMVENDSKSSFCDLFQRKYRYTLVVGIGLMLIQQFSGSSAVLSYASTILRKAGFSVTIGSTLLGLFMIPKAMIGVILVDKWGRRPLLLTSVSGMCITSMLIGVAFTLQKMQLLPELTPVFTFICVTLYIGTYAIGLGGLPWVIMSEIFPMNIKVTAGSIVTLVSWSSSSIVTYAFNFLLEWSTQGTFYVFGAVGGLALLFIWLLVPETKGLSLEEIQASLIREPDRINQS

SEQ ID NO: 8120 - DNA, 1787 bp, Arabidopsis thaliana
  CDS (100)..(1524)
gctctcttggttttttgctaaaaacagagcattttctctctagctctcactgtttctttaccagaagtttcgtcatattagtacatgcaagtgtaagggatggtgatggaggaaggaagaagcatagaagaagggcttttgcagctcaagaacaaaaacgacgattcagagtgtcgtattactgcttgtgttatccttagcacttttgtcgccgtttgtggctccttctcttttggtgttgctactggttacacttcaggtgctgagacaggagttatgaaggacttggatctttctatcgcgcaattttcagcttttggctcattcgccactttaggagctgcaattggtgcactgttctgcggtaatctggcaatggtcattggcagaagagggacaatgtgggtctccgatttcctatgcatcactggttggctctccatcgcttttgctaaggaagtaatgttgctgaacttcggaagaatcatttcagggataggtttcggcttgacgagctatgtggtacctgtctacatagcagaaattacgccaaaacatgttcgtggtacatttacgttttcaaaccagcttcttcaaaacgctggactcgccatgatttatttttgtgggaacttcatcaattggaggacgttggctttattaggtgctttaccatgcttcattcaagtaatcggtttattcttcgtgccagagtctccaagatggctggccaaagttggctccgataaagaactagaaaattcactgtttcggcttagaggaagagatgctgatatttcacgtgaagcctcagaaattcaagtaatgaccaaaatggtggaaaatgattcaaagtcgagtttttcagatttgttccagagaaagtatagatacaccctcgtggtaggaatcgggctaatgttgatacaacaattctcaggaagtgctgctgtaatctcttatgcaagtaccatttttagaaaagctggtttttcggtggccattggaacgacgatgctaggtatcttcgtgattccaaaagccatgattggcctcattcttgtcgataaatggggcagacgtcctctcttgatgacttcagcgtttgggatgagcatgacttgcatgctacttggggtcgccttcacattacagaaaatgcaattgctttcggaactaactccaatattatcgtttatatgcgtaatgatgtatattgcaacttatgcaataggcttgggaggtctaccttgggtaattatgtcggagatatttccaataaatataaaagtaactgcaggaagtatagttacgttagtctcattttcaagtagttcaatcgtcacttacgctttcaactttctgttcgaatggagcactcaaggaacgtttttcatattcgcgggtatcggtggagcagcgttgctttttatatggttgctcgttccagaaacgaaaggattatcactcgaagaaatacaagtttcacttattcatcagcccgatgaaagaaatcaaacttaatttgaattattttattttattataaaaatgatcaaattcagtttatggtgttatatttgtttatttacaaacaaggattttttttttttcattatgtaattactactttatttttctgggtaattagccccatttttatgatgtatatttacgagatgtaaaacttggcctacgtacatgtgtattttatctctaaaattgcaaatgtaatatttttcggacatatattaaagaagagattgatttctaaaaaaaaaaaaaaa

SEQ ID NO: 8121 - protein, 474 aa, Arabidopsis thaliana
MVMEEGRSIEEGLLQLKNKNDDSECRITACVILSTFVAVCGSFSFGVATGYTSGAETGVMKDLDLSIAQFSAFGSFATLGAAIGALFCGNLAMVIGRRGTMWVSDFLCITGWLSIAFAKEVMLLNFGRIISGIGFGLTSYVVPVYIAEITPKHVRGTFTFSNQLLQNAGLAMIYFCGNFINWRTLALLGALPCFIQVIGLFFVPESPRWLAKVGSDKELENSLFRLRGRDADISREASEIQVMTKMVENDSKSSFSDLFQRKYRYTLVVGIGLMLIQQFSGSAAVISYASTIFRKAGFSVAIGTTMLGIFVIPKAMIGLILVDKWGRRPLLMTSAFGMSMTCMLLGVAFTLQKMQLLSELTPILSFICVMMYIATYAIGLGGLPWVIMSEIFPINIKVTAGSIVTLVSFSSSSIVTYAFNFLFEWSTQGTFFIFAGIGGAALLFIWLLVPETKGLSLEEIQVSLIHQPDERNQT

SEQ ID NO: 8122 - DNA, 1539 bp, Oryza sativa
  CDS (1)..(1539)
atggagaacgccggcgccggcgatggcgcgcccaagcactacccgggcaagatgaccgtcttcgtcttcatcgcctgcctcgtcgcctcctccggcggcctcatcttcggctacgacatcggcatctccggtggcgtgacgtcgatggacccgttcctgtcgcggttcttcccgtcggtgtacgccaaggagaaggaggtggtggacacgaaccagtactgcaagttcgacagcgagccgctcacgctcttcacctcgtcgctctacctcgccgcgctcatcgcttccctcttcgcctccgtcatcacccgcaagttaggccgcaagatgaccatgctcggcggcggcttcatcttcctcatcggcgccgtcctcaacggagccgccgtcaacgtcgccatgctcatcattggccgcatcttgctcggcatcggcgtcggcttcagcatccaggctgtgccgctgtacctgtcggagatggcgccggcgaagatgaggggcatgctgaacatcatcttccagctcatgatcaccgtcggcatcctcttcgccaacctcatcaactacttcaccgacaagatcgccggcggctggggatggcgcgtcagcctcggcctcgccgccgtcccggccgtcatcatgaccgtcggctccatcctcctccccgacacccccaactcgctcctgtcccgcggcaaggagaacgaggcacgcaccatgctccgccgcatccgtggcaccgaggacatcggcccggagtacgacgacctcgtcgccgccagcgaggccaccaaggccatcgagaacccgtggcgcacgctcctcgagcgccggtacaggccgcagctggtgatgtcggtgctgatcccgacgctgcagcagctcaccggcatcaacgtcgtcatgttctacgcgcccgtgctgttcaagaccatcggattcggcggcacggcctcgctcatgtccgccgtcatcaccggcctcgtcaacatgttcgccaccttcgtctccatcgccaccgtcgaccgattcggccgccgcgtgctcttcatccagggcggcatccaaatgatcatagcgcagtttattcttgggacactgatcgccgtcaagttcgggacggcgggcgtggcgaacatctcgcagggttacgccatcgtggtggtgctgttcatctgcctgttcgtgtcggcgttcgcgtggtcgtgggggcccctggggtggctggttcccagcgagatcttcccgctggagatcaggtcggcggcgcagagcgtggtggtggtgttcaacatggcgttcaccttcttcatcgcgcagatcttcctgatgatgctgtgccgcctcaagttcgggctcttcttcttcttcggcgccatggagctgatcatgacggggttcgtcttggtcttcctgccggagaccaaggggatccccatcgaggagatggacaggatctggggggagcactggtactggagccgcttcgtcggcgccggccgcaaccgggtcatgcagatggcctccaccaacgtgtga

SEQ ID NO: 8123 - protein, 512 aa, Oryza sativa
MENAGAGDGAPKHYPGKMTVFVFIACLVASSGGLIFGYDIGISGGVTSMDPFLSRFFPSVYAKEKEVVDTNQYCKFDSEPLTLFTSSLYLAALIASLFASVITRKLGRKMTMLGGGFIFLIGAVLNGAAVNVAMLIIGRILLGIGVGFSIQAVPLYLSEMAPAKMRGMLNIIFQLMITVGILFANLINYFTDKIAGGWGWRVSLGLAAVPAVIMTVGSILLPDTPNSLLSRGKENEARTMLRRIRGTEDIGPEYDDLVAASEATKAIENPWRTLLERRYRPQLVMSVLIPTLQQLTGINVVMFYAPVLFKTIGFGGTASLMSAVITGLVNMFATFVSIATVDRFGRRVLFIQGGIQMIIAQFILGTLIAVKFGTAGVANISQGYAIVVVLFICLFVSAFAWSWGPLGWLVPSEIFPLEIRSAAQSVVVVFNMAFTFFIAQIFLMMLCRLKFGLFFFFGAMELIMTGFVLVFLPETKGIPIEEMDRIWGEHWYWSRFVGAGRNRVMQMASTNV

SEQ ID NO: 8124 - DNA, 1702 bp, Oryza sativa
  CDS (87)..(1628)
ggactggtgagtactgatcgtagtccagccttgttctcctctctctctctctctcctcactcctcgcacacttcggaattcccatcatggccggcggcgccatgaccgacaccgatggcgctcacaagaactacccggggaagatgaccatcttcgtcttcctcgcctgcctcgtcgcctcctccggcggcctcatcttcggctacgacatcggcatctccggcggcgtgacgtcgatggactcgttcctgatcaagttcttcccgtcggtgtacgccaaggagaaggagatggtggagacgaaccagtactgcaagttcgacagcgagctgctcaccctcttcacctcgtcgctctacctcgccgcgctcatcgcctcgctcttcgcttccgtcatcacccgcaagttcggccgcaggatcaccatgctcggcggcggcgtcatcttcctcgtcggcgccatcctcaacggagccgccgccgacgtcgccatgctcatcatcggccgcatcctcctcggcatcggcgtcggcttcagcaaccaggctgtgccactgtacctgtcggagatggcgccggcgaggatgcggggcatgctgaacatcagcttccagctcatgatcaccgtcggcatcctcgccgccaacctcatcaactacttcaccgacaagatcgccggagggtgggggtggcgcgtcagcctcggcctcgccgccgtcccggccgtcatcatggccggcggctccctcttcctccccgacacccccaactcgctcctctcccgcggcaaggagaacgaggcgcgcgccatgctccgccgcatccgtggcaccgacgacgtcggcccggagtacgacgacctcgtcgccgccagcgaggcgtccaaggccatcgagaacccgtggcgcacgctcctcgagcgccggtacaggccgcagctggtgatgtcggtgctgatcccgacgctgcagcagctcaccggcatcaacgtcgtcatgttctacgcgccggtcctcttcaagaccatcggattcggcggcacggcctcgctcatgtccgccgtcatcaccggcctcgtcaacatgttcgccaccttcgtctccatcgccaccgtcgaccgcctcggccgccgcaagctcctccttcagggcggcgtccaaatgatctttgcgcagttcattcttgggacgctgatcgccgtcaagttcgggacggcgggcgtggcgaacatctcgcggggttacgccatcgtggtggtgctgtgcatctgcgtgttcgtgtcggcgttcgcgtggtcgtggggacccctcgggtggctggttcccagcgagatcttcccgctggagatcaggtcggcggcgcagagcgtggtggtggtgttcaacatggccttcaccttcatcatcgcgcagatcttcctgatgatgctgtgccacctcaagttcggcctcttctacttcttcggcgccatggagctcatcatgacggggttcgtcttcttcttcctgccggagacgaaggggattcccatcgaggagatggacaggatctggggtaagcactggtactggagacggttcgtcggcgctggggccggcggcaaggtcgagattacctccacagtatgacattcgtgccgtaaacgtttatctttcaatttgttttcggattacgtaattgaatctgctggctacatcgatcc

SEQ ID NO: 8125 - protein, 513 aa, Oryza sativa
MAGGAMTDTDGAHKNYPGKMTIFVFLACLVASSGGLIFGYDIGISGGVTSMDSFLIKFFPSVYAKEKEMVETNQYCKFDSELLTLFTSSLYLAALIASLFASVITRKFGRRITMLGGGVIFLVGAILNGAAADVAMLIIGRILLGIGVGFSNQAVPLYLSEMAPARMRGMLNISFQLMITVGILAANLINYFTDKIAGGWGWRVSLGLAAVPAVIMAGGSLFLPDTPNSLLSRGKENEARAMLRRIRGTDDVGPEYDDLVAASEASKAIENPWRTLLERRYRPQLVMSVLIPTLQQLTGINVVMFYAPVLFKTIGFGGTASLMSAVITGLVNMFATFVSIATVDRLGRRKLLLQGGVQMIFAQFILGTLIAVKFGTAGVANISRGYAIVVVLCICVFVSAFAWSWGPLGWLVPSEIFPLEIRSAAQSVVVVFNMAFTFIIAQIFLMMLCHLKFGLFYFFGAMELIMTGFVFFFLPETKGIPIEEMDRIWGKHWYWRRFVGAGAGGKVEITSTV

SEQ ID NO: 8126 - DNA, 1569 bp, Uromyces fabae; identical to SEQ ID NO: 487
  CDS (1)..(1569)

SEQ ID NO: 8127 - protein, 522 aa, Uromyces fabae; identical to SEQ ID NO: 488

SEQ ID NO: 8128 - DNA, 1380 bp, Sulfolobus tokodaii
  CDS (1)..(1380)
atggtaaaaagattagataacgctgaagttataagactacatattttagcaactattataggtgcactagggggatttctatttggatatgatactggaataatagggagcgtgttggtatacgttacacctctttttcatttaacgccgccagaagttgcaatattaacttctggcacatcattattagcaggcatcggtgcacttgcggctggacctataactgataaatatggaagaaaatcactactagttacagatggcataatgtatgctgtcttcgctctgctatctgcgatagctataaactcatttctccttattttatggagaagtttagtaggtttcgctataggtgcagataccgcaatagctactgcttatatatccgaattttcacccaagagatggagagggagattagcgataactcaacaattaatgatattttcgggaattactgcttctttctgggcaggatatctactttctttctcagctaactggagactaatgttaggcttaggagtaattccagcggtaattttagtagctttaagagcgtttttacctgaaagtcccagatggttattacttaatggaatggaagaaaaagcaaagaacatactaagaaaatttggagttaatatcgcagaaaatgaacatattgcagctccatctaaagaattatcatttaaggaaatgttcaacaataaagcaattagaaccgctataatattggtaggtctatggttagcatttcaacaaataacaggtataaatgttatattatattatggtcctactatatataaatatctaggattaaccggaccgagagctattcttaatacagcaatctcagaatcattaggagcaatagaatatgcaatttcattttatcttatagataaatggggaagaagaaagctaggaatttttggatatgctggattagtaggatctttagctataatgttaataggcctaagagcctttacgtcaggtatcgtatttgctggtgtagctttagtttttactgcaatgacattatttctactgttcttccatgtaggtgtaggcggagtaggatgggttctacaaggagaaacaataccaacggaagtaagaggaagaggtgccggtttattagcagcaatagactggttcgcaaattttgtaataatatttatttttccatactggaaggcagcgtttggagtttattcattcttcgcattagaacttgtactatctatattagcaatagcaatagtatacttattcatgccagagaccaaaggagtatcattggaagacatgttaaaagtatttgaaagagggttaagtgtacaaaggcaaaaacagtatgctaaataa

SEQ ID NO: 8129 - protein, 459 aa, Sulfolobus tokodaii
MVKRLDNAEVIRLHILATIIGALGGFLFGYDTGIIGSVLVYVTPLFHLTPPEVAILTSGTSLLAGIGALAAGPITDKYGRKSLLVTDGIMYAVFALLSAIAINSFLLILWRSLVGFAIGADTAIATAYISEFSPKRWRGRLAITQQLMIFSGITASFWAGYLLSFSANWRLMLGLGVIPAVILVALRAFLPESPRWLLLNGMEEKAKNILRKFGVNIAENEHIAAPSKELSFKEMFNNKAIRTAIILVGLWLAFQQITGINVILYYGPTIYKYLGLTGPRAILNTAISESLGAIEYAISFYLIDKWGRRKLGIFGYAGLVGSLAIMLIGLRAFTSGIVFAGVALVFTAMTLFLLFFHVGVGGVGWVLQGETIPTEVRGRGAGLLAAIDWFANFVIIFIFPYWKAAFGVYSFFALELVLSILAIAIVYLFMPETKGVSLEDMLKVFERGLSVQRQKQYAK

SEQ ID NO: 8130 - DNA, 1503 bp, Thermoplasma volcanium
  CDS (1)..(1503)
atggatatatttcatatattttctgacaaaagattaaatacagtctatttatcgaagaatatggaatatcatgaagttatagaaaaacttgacttcagcaaagtcacaaggttctattggctactgaccttactcgcaactatcggtggttttctcttcggttacgatacttctaatatcggcacagcgttggtgtttattccataccctgtgcagggtttcatagaaggatacctagttgcaggtgcatctctgggggctgccgtaggagctttgattgcagctggtctcacggataggtacggcaggaaatatctattgatagcagatgcagctatttatgcggctggtgcaatactatcagcatttaccatagatctcgccatgcttctcctatcaagaacacttataggtttggcggtcggtgctgattctggtatagctacagcttatatatccgagtatgcccctaaagacaggagaggttcactcggaatactgcagcagtggatgataactataggaatacttggtgcttatattgtaggaatggccacactctatgctgcaccaggtctagcttcagttttagactggaggataatgcttggtgttgcggccatacctgctctcattggcctaggctttaggtttatgatgcccgaatctccaagatggttaatgatcaacggaaaatacaaggaagcctcagaggctttcaagaaactcggattaaatctaagtgttgatgagctaaaggaggttaagtttaggcagagagctaagatcacaaacggtgtgaagagagcatttctagttgtcgcccttttctttgtattccaacagattactggcataaatataccgttctattatgggccaatagtaattgaaaaattacacctgtttggctcggcaacgcaatctttagtatttacacaaatatatgctgtagcagctgcaacaatactcgcagtgattaacgtggcagcaacatacataggcttcaggtacatagatacggtcggaagaaggaagttagccctactaggatactccggtatgacgttcttcggtttactgggcgggcttttgctctaccttaaatttgatgttggtttactaattgcatttgccggcttcataatcttctttgcattcggtgtcggtggtacaggttggatgattcagggtgagtacttcccaaccaatatgagaggcctctatgcatctcttggagcttttgtagattggatcgctaactttgccataatagaaatattccctgtactcgaagcattaataacaataaaaaatgtaatgtttgttttcggcatcctttcattaatagcagtattgatcttttattatataatgccagaaaccaaagaattgtccgtggaacaaattagcgacttattcgagaataacggcctatcgtcgttgagaaaagcctctatgagctacaataagagctcatccggatccagcggcaagaaatag

SEQ ID NO: 8131 - protein, 500 aa, Thermoplasma volcanium
MDIFHIFSDKRLNTVYLSKNMEYHEVIEKLDFSKVTRFYWLLTLLATIGGFLFGYDTSNIGTALVFIPYPVQGFIEGYLVAGASLGAAVGALIAAGLTDRYGRKYLLIADAAIYAAGAILSAFTIDLAMLLLSRTLIGLAVGADSGIATAYISEYAPKDRRGSLGILQQWMITIGILGAYIVGMATLYAAPGLASVLDWRIMLGVAAIPALIGLGFRFMMPESPRWLMINGKYKEASEAFKKLGLNLSVDELKEVKFRQRAKITNGVKRAFLVVALFFVFQQITGINIPFYYGPIVIEKLHLFGSATQSLVFTQIYAVAAATILAVINVAATYIGFRYIDTVGRRKLALLGYSGMTFFGLLGGLLLYLKFDVGLLIAFAGFIIFFAFGVGGTGWMIQGEYFPTNMRGLYASLGAFVDWIANFAIIEIFPVLEALITIKNVMFVFGILSLIAVLIFYYIMPETKELSVEQISDLFENNGLSSLRKASMSYNKSSSGSSGKK

SEQ ID NO: 8132 - DNA, 1440 bp, Zymomonas mobilis; identical to SEQ ID NO: 493
  CDS (1)..(1440)

SEQ ID NO: 8133 - protein, 479 aa, Zymomonas mobilis; identical to SEQ ID NO: 494

SEQ ID NO: 8134 - DNA, 1865 bp, Arabidopsis thaliana
  CDS (66)..(1742)
gaagatgagagataagcgaccaaaattagcgggagaatcctcacttgtctcactccgatccgatcatggctttcgctgtctcggttcagtcacatttcgcaatcagagcgttaaaacgagaccacttcaagaacccttctcctcgtactttctgctcgtgttttaaatcgaggcctgactcgtcttaccttagtttaaaggaacgtacttgcttcgtttccaaaccgggtttagtcactactagatacagacatatattccaggtcggagctgagacgggaggagagttcgccgacagtggagaagtagctgattcgcttgcttctgatgcaccagagtcattttcttggtcttctgtgatactcccgtttatcttcccggctttgggaggattattgtttgggtatgacattggggctacctccggtgctacgctctcacttcagtcacctgcgcttagcggaactacatggtttaacttctcacctgttcagctaggacttgtggttagcggatccttgtatggagcccttcttggctcaatttctgtctatggcgttgctgatttccttggaagaaggcgggaacttattatagctgctgttctctatctcctcgggtctctgatcactggctgtgcccctgatcttaatattctcttagttggaaggcttctctatggctttggtattggtttggcaatgcatggggctcccctctatattgctgagacatgcccatctcaaatccgtggaactttgatatctctgaaagaactcttcatcgtattgggaattttgttgggtttttctgttggaagcttccagattgatgtagttggagggtggcgttacatgtatggatttggtacgcctgttgctttgctgatgggactaggcatgtggagtctccctgcatctcctcgctggttgctgcttagagctgtccaaggtaaaggacaattacaagaatacaaagagaaggccatgcttgccctcagcaaattacgtggcagacctccaggtgataaaatctcagagaagttggtagatgatgcctatttatctgtgaaaacggcctatgaagatgagaaatctgggggaaacttcctggaagtattccaagggcctaatttgaaagctttgacaattggtggaggtttagtcctcttccaacagataactggacagcctagtgttctttattatgcgggttcgattcttcagactgctggattctctgctgctgctgatgcaactcgagtctctgttattattggtgttttcaagttactgatgacatgggtagctgttgcgaaagttgatgatctcggcagacgacctttactgattggaggtgtcagcggcattgcgttgtccttgtttctactgtcagcatactacaagtttctcggaggctttccccttgtcgctgttggtgcactgcttctctatgttggttgttaccagatctcatttggacccatcagctggctaatggtgtcagagattttcccgctccgcacaagagggagagggatcagtcttgcagttcttacaaactttggctccaatgctattgtgacatttgcattttcacctttaaaggaatttcttggagccgagaatcttttccttctctttgggggcatagcactggtatcactgctgtttgtaatactagtagttccagagaccaagggtctcagcttggaagaaattgaatcaaaaatcttgaagtgaaacgttgaagaacatatttgttatagttgattctggtgaaatacatgtatgaggatgtgactattctctttgtaacataatatgtttcgtaatcaatgggaaaaccaaacctttttcatgatt

SEQ ID NO: 8135 - protein, 558 aa, Arabidopsis thaliana
MAFAVSVQSHFAIRALKRDHFKNPSPRTFCSCFKSRPDSSYLSLKERTCFVSKPGLVTTRYRHIFQVGAETGGEFADSGEVADSLASDAPESFSWSSVILPFIFPALGGLLFGYDIGATSGATLSLQSPALSGTTWFNFSPVQLGLVVSGSLYGALLGSISVYGVADFLGRRRELIIAAVLYLLGSLITGCAPDLNILLVGRLLYGFGIGLAMHGAPLYIAETCPSQIRGTLISLKELFIVLGILLGFSVGSFQIDVVGGWRYMYGFGTPVALLMGLGMWSLPASPRWLLLRAVQGKGQLQEYKEKAMLALSKLRGRPPGDKISEKLVDDAYLSVKTAYEDEKSGGNFLEVFQGPNLKALTIGGGLVLFQQITGQPSVLYYAGSILQTAGFSAAADATRVSVIIGVFKLLMTWVAVAKVDDLGRRPLLIGGVSGIALSLFLLSAYYKFLGGFPLVAVGALLLYVGCYQISFGPISWLMVSEIFPLRTRGRGISLAVLTNFGSNAIVTFAFSPLKEFLGAENLFLLFGGIALVSLLFVILVVPETKGLSLEEIESKILK

SEQ ID NO: 8136 - DNA, 1545 bp, Arabidopsis thaliana
  CDS (1)..(1545)
atggcaggaggggcatttatagacgagagtggccatggaggagactacgaaggtcgtgtaaccgcgtttgtcatgataacctgcattgtagctgcaatgggtggtctcctctttggttacgacattggtatctcaggaggagtgatatcaatggaggactttctaacgaaattcttccctgacgtgcttcgtcaaatgcaaaacaaaagagggcgtgaaacagaatattgtaaatatgacaatgagcttcttactctcttcacttcctctctttacctcgctgctttgttcgcttctttccttgcctccaccattacaaggctttttggccggaaggtctcaatggttatcgggtctctcgcttttctctctggagctcttctcaacggtttagctatcaacctcgagatgttgatcatcgggcggttatttctcggtgtaggtgtcggattcgctaaccaatctgttcctctttacctctctgagatggctcctgctaagatcagaggagctctcaacattggttttcaattagcaatcacgatcgggatcttagccgcgaacattgtcaattacgtgaccccaaagctccagaacgggatcggatggagattatctctcggtttagctggagttccggccgttatgatgcttgtcggatgctttttcttgccagatacgccaaactcaatccttgaacgtggaaacaaagaaaaggctaaggagatgctgcagaagatcagaggaaccatggaggttgagcatgagtttaatgaactttgcaacgcgtgtgaagccgcgaagaaagttaagcatccatggacgaacataatgcaagctcgttatcgaccgcagctcacgttttgtaccttcatcccattcttccagcagctaaccgggatcaatgtcattatgttctatgcacctgttctgtttaagaccatcggttttggaaatgacgcctctctcatatccgcagttatcaccggtcttgtcaatgtcctttccaccattgtctccatctactccgttgacaaattcggacgaagagctttgtttcttcaaggtggttttcagatgatcgtgacccagatcgcggtcgggtcgatgatcggatggaaatttggattcaacggggaaggaaatttgtcaggggttgatgcggatataatcttggcactgatatgtctctatgtggcgggtttcgcgtggtcatggggaccgttgggatggttagtgccgagtgagatatgtccattggaaattagatcagcaggacaatcgttaaacgtttcggtgaacatgttctttacattcttcattggacaattcttcttgacgatgctttgccatatgaagtttggtttgttctatttcttcgcgggtatggtcttgatcatgaccattttcatttacttcttgttgccggagacaaaaggtgttccgattgaggagatggggaaagtgtggaaagagcatagatattgggggaaatatagtaataatgatgatggtgatgatgttgatgatgatgcttatttttag

SEQ ID NO: 8137 - protein, 514 aa, Arabidopsis thaliana
MAGGAFIDESGHGGDYEGRVTAFVMITCIVAAMGGLLFGYDIGISGGVISMEDFLTKFFPDVLRQMQNKRGRETEYCKYDNELLTLFTSSLYLAALFASFLASTITRLFGRKVSMVIGSLAFLSGALLNGLAINLEMLIIGRLFLGVGVGFANQSVPLYLSEMAPAKIRGALNIGFQLAITIGILAANIVNYVTPKLQNGIGWRLSLGLAGVPAVMMLVGCFFLPDTPNSILERGNKEKAKEMLQKIRGTMEVEHEFNELCNACEAAKKVKHPWTNIMQARYRPQLTFCTFIPFFQQLTGINVIMFYAPVLFKTIGFGNDASLISAVITGLVNVLSTIVSIYSVDKFGRRALFLQGGFQMIVTQIAVGSMIGWKFGFNGEGNLSGVDADIILALICLYVAGFAWSWGPLGWLVPSEICPLEIRSAGQSLNVSVNMFFTFFIGQFFLTMLCHMKFGLFYFFAGMVLIMTIFIYFLLPETKGVPIEEMGKVWKEHRYWGKYSNNDDGDDVDDDAYF

SEQ ID NO: 8138 - DNA, 1766 bp, Apium graveolens var; identical to SEQ ID NO: 495
  CDS (17)..(1558)

SEQ ID NO: 8139 - protein, 513 aa, Apium graveolens var; identical to SEQ ID NO: 496

SEQ ID NO: 8140 - DNA, 2041 bp, Mesembryanthemum crystallinum; identical to SEQ ID NO: 497
  CDS (118)..(1785)

SEQ ID NO: 8141 - protein, 555 aa, Mesembryanthemum crystallinum; identical to SEQ ID NO: 498

SEQ ID NO: 8142 - DNA, 1961 bp, Saccharomyces pastorianus
  CDS (192)..(1904)
ttccggtggtactgactgagatgacaaaaatacattttgttgaaatgtttcgaaaatttgtgatataaaagccagtagaaattgtcttgtttgtcaacttcttgcaattgcagattatgtattagtttgtttaatggaaagatcatcagtgaacaacgtatataaacaaaagaatataaaaagaaataataatgtcacatgttaacgcgtcgtatgcgcattcgcaaggatcctcgacaagcgtttctcgtgtagagatggagaagccagcaacaaaggaagtctttgaagatcctaccccaaaaaagtttgaattggacgatgatgaggccggtaagacatcatctgtattcaatccagacctaaatctagaagaagaagtgagagccttggatgaattaggtgattcattcaaaagagatcgctccttttggggcaaaatgaaagctttggaattcgaagttgaatttgaaaataaaaaaaatatggttttaatgctgggaacttttgcagcatttgctggtattctatctggtatagatcaatctattatctctggtgcttccattggtatgaacaaaatgttgcacctttctacacatgaagcatcactagtttcttctttaatgcctctaggtgctgtcgctggttctatattgctaactccctttagtgaatattttggtcgtaaaaagtctttggctatttcttgtgtcttttacacaattggtgctattgtttgtgcagctgcttctaaccatcacgaaatgtatgctggtagatttttgatcggtgtcggtgttggtttagaaggtggtggtattggtgtatacattgcagaatctgttccgtcttcagttagaggtagtctggtgtccctgtatcaatttaatattgcgctgggcgaattgtttggttatattgttggtgtgattttctttgatgttaagggaggctggagatacatggtcggttcgtcgcttgtgttctcgaccacattgtttattggtttattattcctgcctgaatctccacgttggttgatgcataagggccgtgtcggtgaatcctggaacgtctggaaaagactaagagatgtgaaagaagaaggcaataaaatcgaatttttggaactcagagacgttgcttcgcacgacagagagttacatgcaaacgaatcaagatttcaatcattgtttgatttggtccgtgttccacgtaaccgccgtgctttggtatattcttgtatgatgattggtctgggtcaattaactggtattaatgccatcatgtattacatgtccacgctaatgaagaatattgggttcgatgataaacaatctgtagcaatgtcaatggttggtggtgcagcactattaattggtaccgttcctgctattttatggatggatagatttggtagacgtacatgggcaatgacaatcattatatttatcgttggtttggtgctcgtcggtgtcggctatcaaataaacttgaaaacacacatggcagcagcagaaggtgtgtatttgactggtcaaatcatatataacatggcttttggatcatatgcagcattaacatgggtcctaccttcagagtcattttcattgggaaccagatcagctggtatgacagtgtcttctgctttgctttacttgtttgcctttaccgtgacttacaacttcgaaaaaatgaaagaagcaatgacatatacaggtttaaccttagggttttacggtggtatcgctcttgcaattggtatcccataccaattgctatgtatgccagaaacaaagaatagaactttagaggaaattgatgacatctttgagaagccaacaagtcaaattataaaggagaatattgcatacttgaagaagggccaattgagctattagagagtcaagtttattccacctttttttattgtctaagtaaatgcatatttgcttaga

SEQ ID NO: 8143 - protein, 570 aa, Saccharomyces pastorianus
MSHVNASYAHSQGSSTSVSRVEMEKPATKEVFEDPTPKKFELDDDEAGKTSSVFNPDLNLEEEVRALDELGDSFKRDRSFWGKMKALEFEVEFENKKNMVLMLGTFAAFAGILSGIDQSIISGASIGMNKMLHLSTHEASLVSSLMPLGAVAGSILLTPFSEYFGRKKSLAISCVFYTIGAIVCAAASNHHEMYAGRFLIGVGVGLEGGGIGVYIAESVPSSVRGSLVSLYQFNIALGELFGYIVGVIFFDVKGGWRYMVGSSLVFSTTLFIGLLFLPESPRWLMHKGRVGESWNVWKRLRDVKEEGNKIEFLELRDVASHDRELHANESRFQSLFDLVRVPRNRRALVYSCMMIGLGQLTGINAIMYYMSTLMKNIGFDDKQSVAMSMVGGAALLIGTVPAILWMDRFGRRTWAMTIIIFIVGLVLVGVGYQINLKTHMAAAEGVYLTGQIIYNMAFGSYAALTWVLPSESFSLGTRSAGMTVSSALLYLFAFTVTYNFEKMKEAMTYTGLTLGFYGGIALAIGIPYQLLCMPETKNRTLEEIDDIFEKPTSQIIKENIAYLKKGQLSY

SEQ ID NO: 8144 - DNA, 1458 bp, Thermoplasma acidophilum
  CDS (1)..(1458)
atggaaaatggagtcagatattccgatctcatcgaaaggctagacatgagcagggtaaccaggttttactggttgctgaccattctggccacgataggtggttttctattcggatacgatacctctaacataggctctgcactgccattgcttgaaagaatatacccaggtataagtggttttgttgagggctacttggttgctggggcctcgcttggtgccgctgtaggcgcgataatagctgcgggactaacggacaggtacgggagaaagtacctgctcatagccgatgcggctatttacgcagccggtgcattgctctcagcattcaccgtggatctggtcatgctgctgctttccaggacgctaatagggattgctgtcggcgcagactccggcatagcgacagcttatatagcggaatatgctccaaaggccaggagaggaagcctcggcattctgcagcagtggatgatcaccatcggcattctggcagcttacctaatcggaatggcaaccctgttcttcgcacccggcttggcttatgcagttggttggaggataatgctgggcgttgccgccataccagctatcataggtctcgccttcaggttcatgatgccagaatcgcctaggtggctcctcgttaatggaaaatacaaggaagcatccgcttccctgaagaggctcggcctcaacatgagcgaggaagatctgaaatctgtaaagctatcacagccccacaagatcactcctggcgtaaagcgtgctctcctcatcgtgggcctgttctttgttttccagcagatcaccggaattaacataccgttttactacggcccggttgtgctggagaaccttcacatagttggaaaatcgacatcgctcgtttacagtatatactattcaatcgccgcatccgcaatactggcgatcataaacgtggctgcaacgtatataggcttccgctacatagactccgtcggaaggagaaaactggcgctgatgggatacgctggcatgacattcttcggaatacttggtggaatactgctgtacctcaagttagacataggcctgttcatagccttcgctggcttcataatattctttgccttcggtgttggcggcaccggctggatgatacagggagaatacttcccgaccagcatgagggggctgtatgcttcccttggtgcgttcatagactggatagccaacttcgcaataatagagcttttccctgtcatggactccgccataacgataaagaatgtggagtttgttttcggcgtcctctcgctgatagcgctgatactcttctactatataatgccggagacgaaagggctgtccgtcgagcagatagacacgctttttgaaaacaacagcctcgggcagatgaagcatgcctctatatccatgaagaaggagagcgttccagcagacccgaaatga

SEQ ID NO: 8145 - protein, 485 aa, Thermoplasma acidophilum
MENGVRYSDLIERLDMSRVTRFYWLLTILATIGGFLFGYDTSNIGSALPLLERIYPGISGFVEGYLVAGASLGAAVGAIIAAGLTDRYGRKYLLIADAAIYAAGALLSAFTVDLVMLLLSRTLIGIAVGADSGIATAYIAEYAPKARRGSLGILQQWMITIGILAAYLIGMATLFFAPGLAYAVGWRIMLGVAAIPAIIGLAFRFMMPESPRWLLVNGKYKEASASLKRLGLNMSEEDLKSVKLSQPHKITPGVKRALLIVGLFFVFQQITGINIPFYYGPVVLENLHIVGKSTSLVYSIYYSIAASAILAIINVAATYIGFRYIDSVGRRKLALMGYAGMTFFGILGGILLYLKLDIGLFIAFAGFIIFFAFGVGGTGWMIQGEYFPTSMRGLYASLGAFIDWIANFAIIELFPVMDSAITIKNVEFVFGVLSLIALILFYYIMPETKGLSVEQIDTLFENNSLGQMKHASISMKKESVPADPK

SEQ ID NO: 8146 - DNA, 1413 bp, Lactobacillus casei
  CDS (1)..(1413)
atgtatcaatcaaaaacacacaatcatcgatttaccggtcaccttgcgagtgcgaagacacggttgcggctagtagcattgatttcaacgatgggtggcctgctttttggctatgacactggggtgatcaatggcgcattgccttttatttcttcggaactgaaacttgcccctggatcacagggttgggtcaccagtagcttgacgctgggtgctgcttttggtgctatcttagtcggtcgtttaagtgatcgctatgggcgcaggcggctcatcaccatgttagcgggcttattttttctggcaacggtagcctcgtcactttccccgagtgctggctggctgattggcgcacggctgatccttggattagccgttggcggcgtctctgtgctggttccaagctttttagcagagattgccccaacgagtcatcgtgggcggttagtcacacaaaatgagctgatggtcgtgactggccagttacttgcttttgttctcaatgcctttttaggaaccacttttggtaacgttcctggtatctggcgctggatgattgtattggcagtcattccggcaattatcttaggtatcgggacttattttgttccggaatctcctcgttggttaatgatgaaaggacggccggcagcagcacgttcaagtttggaagtgttgcgatctgctgctgaagtgccagcagagattgaccatttgaaacagaatcttgccgaagatgctaaacataagcaggcgagtgttcgagcattgaaaaccaaatggattcgccgactggttctgattggcatcggcctaggcgtcattcagcaaattgctggtatcaatgtcatgatgtattatggcacctcaattttacaaatgacgggttttgggcgagatagcgccttgatcgccaacattgccaatggggttactgccgttgctgcaacgattgtgacgttgcaattgttgaagcatgttccgcggcggccaatgctgattgtgggattgattggctcaaccgtggcgattactggtgtcaccttcgctagtcgactaccagcgggttcgccattccgggcatttgcgacaatcgggatgatgatgctgttcttggcgttcttccaaggcgctatcagtccaatgacttggctgctgatgtctgaaatcttccctgaacaggttcggggcatagggatgggcgctgcaaccttctgcttgtggttagctaactttggtgttggcgttctgttcccgattggtctggcccaaataggcatgttctggacattcgtttgcttcatcgggacaaatttgatttcattgcttttcgttctgatttttgtgccggaaacggctggacgctccctcgaaactttgcaccgagaggagaaagcccgcttaaatcattaa

SEQ ID NO: 8147 - protein, 470 aa, Lactobacillus casei
MYQSKTHNHRFTGHLASAKTRLRLVALISTMGGLLFGYDTGVINGALPFISSELKLAPGSQGWVTSSLTLGAAFGAILVGRLSDRYGRRRLITMLAGLFFLATVASSLSPSAGWLIGARLILGLAVGGVSVLVPSFLAEIAPTSHRGRLVTQNELMVVTGQLLAFVLNAFLGTTFGNVPGIWRWMIVLAVIPAIILGIGTYFVPESPRWLMMKGRPAAARSSLEVLRSAAEVPAEIDHLKQNLAEDAKHKQASVRALKTKWIRRLVLIGIGLGVIQQIAGINVMMYYGTSILQMTGFGRDSALIANIANGVTAVAATIVTLQLLKHVPRRPMLIVGLIGSTVAITGVTFASRLPAGSPFRAFATIGMMMLFLAFFQGAISPMTWLLMSEIFPEQVRGIGMGAATFCLWLANFGVGVLFPIGLAQIGMFWTFVCFIGTNLISLLFVLIFVPETAGRSLETLHREEKARLNH

SEQ ID NO: 8148 - DNA, 1699 bp, Lycopersicon esculentum
  CDS (24)..(1466)
aaggcctaagaagaaaaaaaattatgaaggaagatatagagcacagtgagaacagagtaaatgaagaaataacaactcctcttataattcaaacaaataaaagagtaaaagaagaaaatggatgttatgagaagaaacaagataggtgcatggtttaccttagcacattagtggctgttaggggttcatattcattgggatcttgtgctggatattcatcaccaacacaatccgccatcagagaggatcttaacttatctatagcacagatctcgctctttggttcaatatggacatttggtgcaatgattggagcaatcacaagtggtccaatcgctgattatattggtcgcaaaggggcaatgagaatgtcaagtggtttctgtgttgctggatggttagctattttcttcgctcagggagcacttgctctggacattggaagattggcaacaggatatggaatgggagttttctcttatgtggtgccggtatttatagctgaaattgcacctaaagatttacgaggagctttgacaaccataaaccagctgatgatatgttgtggagtctcagtttccttcattataggaactatgatgacatggaggacgttggcgttaacaggattaattccatgtgctattctgcttttcggtctatttatcattccagagtcacctaggtggttggcaaaaataggacatcaaaaggagtttgaacttgcactacgtaaacttcgaggcaaagatgctgatatatctgaggaggcagctgaaatcaaggattatatagaaacacttgaaaagcttccgaaagtgaacttgtttgatttgttccaaagaagatactcgagctcacttatagtgggagttggacttatggtgtttcaacagtttggtggaatcaatggaatctgtttctacaccggtagcatatttgagtcctcaggtttctcctctgatattggaactataatctatgcaattatacaggttcccatcaccgcgttgggtgcagccttaatcgacagaactggaagaaaacctcttttattggtttcaggaacaggacttgtcataggctgtatactaacaggaatctcattctatatgaagggacatgaaatggcaataaaggcagcaccgatacttgctgtaacaggcatactggtctatatcggttccttttcagtaggaatgggagcagttccgtgggttgtgatgtcagagatatatcctataaatattaaaggtgctgctgggagccttgcaacactagtgaattggttcggagcatgggcgtgctcctacactttcaacttcctcatgacctggaattcttttggtacgttcgttctgtatgctgcagtgaatgcactgtccatattatttgtgataaaaatagtacctgaaaccaaaggaagaactttggaacaaatccaggctgctatcaatgcatcatgaaataccttagccttcatcgattcatctttcgtactgaaatttactttatcagagagagttgacacaattcatgttgtcgtttgaaactacattcgatctgattctcatcctcaaatttaagacatttgagtgtttgttgtatcatggatcacatattttcatttgtactcattgattcatctcacttaaaaaaggagaattttaaagtttaaaaaaaaaaaaaaaaaaaaaaa

SEQ ID NO: 8149 - protein, 480 aa, Lycopersicon esculentum
MKEDIEHSENRVNEEITTPLIIQTNKRVKEENGCYEKKQDRCMVYLSTLVAVRGSYSLGSCAGYSSPTQSAIREDLNLSIAQISLFGSIWTFGAMIGAITSGPIADYIGRKGAMRMSSGFCVAGWLAIFFAQGALALDIGRLATGYGMGVFSYVVPVFIAEIAPKDLRGALTTINQLMICCGVSVSFIIGTMMTWRTLALTGLIPCAILLFGLFIIPESPRWLAKIGHQKEFELALRKLRGKDADISEEAAEIKDYIETLEKLPKVNLFDLFQRRYSSSLIVGVGLMVFQQFGGINGICFYTGSIFESSGFSSDIGTIIYAIIQVPITALGAALIDRTGRKPLLLVSGTGLVIGCILTGISFYMKGHEMAIKAAPILAVTGILVYIGSFSVGMGAVPWVVMSEIYPINIKGAAGSLATLVNWFGAWACSYTFNFLMTWNSFGTFVLYAAVNALSILFVIKIVPETKGRTLEQIQAAINAS

SEQ ID NO: 8150 - DNA, 2013 bp, Mesembryanthemum crystallinum
  CDS (131)..(1876)
acctcccttcagtagttcccttagtttttctttctactccaagtctcgaaccgcccacagaataagaagacacgggtatcaacaggcgttgagggaagaagttgaatgattaatcatcaacagtgcaaagatggtagaaggtggaattgtgaaggcagataagacagagttcacagaatgtttcagaacaatcgggaaaacaccctatatcttgaggcttgccttctctgctggcattggtggtcttctttttggatatgacactggtgttatctctggcgctcttctttacattaaagaagacttcaaagaggtggaaaggaaaacatggctgcaggaaaccattgtagccatggcagttgcaggggcaattataggagcaggagtcggagggtacctaaacgataagtttgggagaaaacctgcaattataattgctgacattttgttcttcattggtgcaataattatgtcactggcccctgcaccatggatgatcatactcggaagaatcttcgttggtttaggggttggaatggcttccatgacatcacctttgtacatatcagagacttcccctactagaatccgaagtgctcttgttagtacaaatggtttgctgatcacgggaagccagttcttatcctaccttatcaacctcggtttcactagggttaaggggacgtggagatggatgcttggggtagctgcggttccagcattcgtgcagcttctcttgatgctgtccctcccagagtctcctagatggctgtatagaaagaataaagtcgtggaagctgaagcgatcttggctagaatttatcccccagaagaagtggaagaggagatgagagcacttaaggcatcaattgagtacgaaatggcagaggaaggagaaattggtggtgggagtatgttaagcaaagtaaggaaagcttggggtaacaaaatagttcgaagggggctatatgctggcattacagttcaagttgctcaacagtttgtgggtatcaacactgtcatgtattacagccccacaattgtgcaattagcaggatttgcctctaacagcactgccttggctctttctttggtcacctctggcttaaatgcaattgggtccattgttagcatgatgtttgtcgataggcatgggagaagacgacttatgatcatctctatgtttggtattattacgtgcctcattgtcttggctattggattcttccaagctgctgctcatgctccgaagatcagccatgctgaatcgacccattttggactgaactctacatgccctgcttacaccaccactcgaaaccctgcaacttggaactgtatgacatgtttgcaagctgcctcagagtgtgcattttgtaccaataaaggaaaccagctgcttcctggcggatgtgtgtcgcgaacagatgccatgaaggtggcatgccacggagagaaaagagtgtacttcacagaaggttgtcctagcaaattcgggtttttggccgtgatacttctaggggcatacattatatcctactctcctgggatgggcacagtgccatggattgtcaattcagagatttacccattaaggtacagaggagtcggaggagggattgcagccgtgtctaattggacatcaaacctaatagtgagcgaaacatttttgaccttgacggaggctctaggagctgcaggcacgttccttctgtttgccgggttctcagctatcgggctcgtgttcatctacttattggtgcctgagaccaaagggcttcccattgaagaggtggagcatatgctggaaaacggcttcaagcctagcattttcaggggtaacaaggataaggagaccaaagctagtggaacttgagtggttgtgtgatcatcttgaagaccaaagctcttatcacttctgtaagttctattttactttatttggattgaatttggtcattttggggatgattgaacttagccacttgaaagtgaaaaagtgtgaataagaga

SEQ ID NO: 8151 - protein, 581 aa, Mesembryanthemum crystallinum
MVEGGIVKADKTEFTECFRTIGKTPYILRLAFSAGIGGLLFGYDTGVISGALLYIKEDFKEVERKTWLQETIVAMAVAGAIIGAGVGGYLNDKFGRKPAIIIADILFFIGAIIMSLAPAPWMIILGRIFVGLGVGMASMTSPLYISETSPTRIRSALVSTNGLLITGSQFLSYLINLGFTRVKGTWRWMLGVAAVPAFVQLLLMLSLPESPRWLYRKNKVVEAEAILARIYPPEEVEEEMRALKASIEYEMAEEGEIGGGSMLSKVRKAWGNKIVRRGLYAGITVQVAQQFVGINTVMYYSPTIVQLAGFASNSTALALSLVTSGLNAIGSIVSMMFVDRHGRRRLMIISMFGIITCLIVLAIGFFQAAAHAPKISHAESTHFGLNSTCPAYTTTRNPATWNCMTCLQAASECAFCTNKGNQLLPGGCVSRTDAMKVACHGEKRVYFTEGCPSKFGFLAVILLGAYIISYSPGMGTVPWIVNSEIYPLRYRGVGGGIAAVSNWTSNLIVSETFLTLTEALGAAGTFLLFAGFSAIGLVFIYLLVPETKGLPIEEVEHMLENGFKPSIFRGNKDKETKASGT

SEQ ID NO: 8152 - DNA, 2422 bp, Mesembryanthemum crystallinum
  CDS (386)..(2131)
accttacccttagttccttttttttttttctttcatctttctctctctttttttctctctctaacaacccctttttgccagatcccactctgcaccagagagagatcacccacataaccaaaacacacacaagtttaagtgagagaagacgaagaagaagaacaacaacacagaagaagaaaaatacaaaaacagaacaaaataaatataaaaaagggtttttgttcttaatttcgtttactggcggcacgtattctgggcgcaaacttgttcaatcaacgtccaccatattgcttctcctttctttggagagattcggattaatagctttgaacgttgttaatttgatcctttggagaaaaagaaaaaaaaaaacacattgaagatggtggaaggtggtgtagtcaaggtagacaaaactgaatttacagaatgtttcagaactgtagggaagacaccttatatcatgagattggctttttctgcgggaatcggaggacttttatttggctatgacactggtgttatttcgggtgcccttctttacatcaaagaagacttcaaggaagtggcacagaaaacatggctacaggaaaccattgtagctatggcagtggctggagctattgtaggagcagggttgggcgggttcttaaatgacaagtttgggaggaaaccggccatgattgtggcggatattctgtttctaaccggagccataatcatgtcagttgctcctgctccttgggtgattatcatagggcgaattgtcgttggtttaggagttggcatggcgtctatgacagcgcccctgtatatatcggagacttccccagcgaagatccgaggtgcccttggtgcgaccaacggcttgctcattactggtggacagtttgtttcctacctcgtcaatcttggctttactcgggtcaagggaacgtggagatggatgcttggagtagcagctgttccagccgcgattcaagttgttttgatgctcactcttcctgagtctcctagatggctatacagacagaacaagatatcggaggcagaggagatcctaggccggatttatcctccagagcaagtcaaggaagagatggattcattgaagacatccattgaaaatgaaatggccgataggaaagcagttggcgagggcaatgcttttgtgagggcaaagagagcctgggacaataaggtggttcgaaggggtttgattgcaggtatctcagttctagtggcccagcaattcgtaggtatcaacactgtcatgtactatagccccacaatcatccaactggcaggttttgcttctaacagcactgcccttgccctttcattggtcacctctggccttaatgcggtgggatcgattgtgagcatgatgtttgtggacaggtttgggaggcgaaggctcatgatcatctctatgtttgctatcattacttgtcttgttgtcttgtccggcctcttttatggggctgcccaagctgctcccaaaatcagccagcttgaatcttctcactttggggccaactctacttgccctgcttttgcctctgcaacatctcctgatagatggaattgtatgacttgcttgaaggcttccgactgtgctttctgttccaatagtgctagtgagttccatcccggagcatgtgtggcacaaactagcacaatgaaaaatgcatgtttgggagagaagaggatctattttacagaaggatgccctagcaaatttggttttatggccattattgtacttgggctatacatcatcacctactctcctggtatggggacggttccatggatcctcaactctgaaatctatccattaagatacagaggcatatgtggaggaattggagccgtgaccctatggtgtgctaaccttatagtgagcgaaacttttctgaccttgaccgaagctttaggttcctcgggcactttccttctctatgcaggattttcgcttattgggctcatcgtcatattcttgctagtccccgagactaaaggattgccaattgaggacatcgagaaaatgttagagaagggtttttggccgagtttgtgcggtggcaacaaggacaaggacaacaaggaagaacaacaagcataataatacatactatgcctgccttatttttttcttctcgaattttggagtgaagagagggtgaggtttctaataattagctatgtttctagttagttacacacctctgaacaaattattttggtgttgttggatgttttaattttgattgctagtttttgctgctctatgtaatgggtttatattaatcttagattataatatgatgcaatagtaatttcaagaaagattgttgaaaacagctgatgccccataaaacttgtgaatgctaagagcgaacaactcttttgcttt

SEQ ID NO: 8153 - protein, 581 aa, Mesembryanthemum crystallinum
MVEGGVVKVDKTEFTECFRTVGKTPYIMRLAFSAGIGGLLFGYDTGVISGALLYIKEDFKEVAQKTWLQETIVAMAVAGAIVGAGLGGFLNDKFGRKPAMIVADILFLTGAIIMSVAPAPWVIIIGRIVVGLGVGMASMTAPLYISETSPAKIRGALGATNGLLITGGQFVSYLVNLGFTRVKGTWRWMLGVAAVPAAIQVVLMLTLPESPRWLYRQNKISEAEEILGRIYPPEQVKEEMDSLKTSIENEMADRKAVGEGNAFVRAKRAWDNKVVRRGLIAGISVLVAQQFVGINTVMYYSPTIIQLAGFASNSTALALSLVTSGLNAVGSIVSMMFVDRFGRRRLMIISMFAIITCLVVLSGLFYGAAQAAPKISQLESSHFGANSTCPAFASATSPDRWNCMTCLKASDCAFCSNSASEFHPGACVAQTSTMKNACLGEKRIYFTEGCPSKFGFMAIIVLGLYIITYSPGMGTVPWILNSEIYPLRYRGICGGIGAVTLWCANLIVSETFLTLTEALGSSGTFLLYAGFSLIGLIVIFLLVPETKGLPIEDIEKMLEKGFWPSLCGGNKDKDNKEEQQA

SEQ ID NO: 8154 - DNA, 1864 bp, Spinacia oleracea; identical to SEQ ID NO: 501
  CDS (61)..(1716)

SEQ ID NO: 8155 - protein, 551 aa, Spinacia oleracea; identical to SEQ ID NO: 502

SEQ ID NO: 8156 - DNA, 1822 bp, Arabidopsis thaliana; identical to SEQ ID NO: 503
  CDS (65)..(1684)

SEQ ID NO: 8157 - protein, 539 aa, Arabidopsis thaliana; identical to SEQ ID NO: 504

SEQ ID NO: 8158 - DNA, 1545 bp, Arabidopsis thaliana
  CDS (1)..(1545)
atggcaggaggagcttttgtatcagaaggaggaggtggtggaagaagttatgaaggaggagtcaccgcattcgttatcatgacatgtatcgtcgccgccatgggaggtctgctctttggttatgaccttggaatctcaggaggtgttacatcaatggaagagtttcttaccaagttcttccctcaagtagagagccagatgaaaaaggcgaagcacgacacggcttactgtaaatttgataaccaaatgctccaattgttcacttcttctctctacctcgcagctcttgtagcttcctttatggcttcagttatcactaggaagcatggacgtaaagtctctatgtttattggtggacttgctttcctcatcggtgcactttttaacgcatttgccgttaatgtttcaatgctcatcatcggtagactgttgcttggtgttggtgttggatttgctaatcagtctactccggtgtacctatctgaaatggctccagcgaagataagaggagctttaaacatcggttttcagatggctataaccattggaatcctagtggcgaatctgattaactatggaacatcaaagatggctcaacatggatggagggtttctttaggtttagcagctgttccagctgttgttatggtgattggatcatttattttgcccgatacaccaaactcgatgctcgagagaggcaaaaatgaggaagcaaaacaaatgttgaagaagatacgtggagctgacaatgttgatcatgagtttcaagatctcattgatgctgttgaagctgccaaaaaggtggaaaatccatggaagaacatcatggagagtaaatatagaccagctttaatcttctgctcggccattccctttttccaacagatcactggaatcaatgtcattatgttctacgctcctgttctcttcaagactcttggttttggtgatgatgctgctcttatgtctgctgttataaccggtgttgtcaacatgctttcaacctttgtctcaatttacgcggttgatagatatggtagaaggttgcttttcctcgaaggtggcattcaaatgttcatttgtcagcttcttgttggttctttcatcggtgcaagattcggaacctcaggaaccggaacattgacgccagcaacagcagactggattcttgctttcatatgtgtgtacgttgcaggatttgcatggtcatggggtccattgggatggttggtaccgagtgagatatgtccattggaaattagaccagcgggacaagccatcaacgtctcggtcaacatgttcttcacttttctcattggtcaattctttttgacaatgctttgtcacatgaagtttggtctattctacttctttgcaagcatggttgcgatcatgacggttttcatttactttttgttgccggagaccaaaggtgttcctattgaagagatgggaagagtttggaagcaacattggttctggaaaaagtatatcccagaagatgctattattggtggacatgatgacaacaataccaattaa

SEQ ID NO: 8159 - protein, 514 aa, Arabidopsis thaliana
MAGGAFVSEGGGGGRSYEGGVTAFVIMTCIVAAMGGLLFGYDLGISGGVTSMEEFLTKFFPQVESQMKKAKHDTAYCKFDNQMLQLFTSSLYLAALVASFMASVITRKHGRKVSMFIGGLAFLIGALFNAFAVNVSMLIIGRLLLGVGVGFANQSTPVYLSEMAPAKIRGALNIGFQMAITIGILVANLINYGTSKMAQHGWRVSLGLAAVPAVVMVIGSFILPDTPNSMLERGKNEEAKQMLKKIRGADNVDHEFQDLIDAVEAAKKVENPWKNIMESKYRPALIFCSAIPFFQQITGINVIMFYAPVLFKTLGFGDDAALMSAVITGVVNMLSTFVSIYAVDRYGRRLLFLEGGIQMFICQLLVGSFIGARFGTSGTGTLTPATADWILAFICVYVAGFAWSWGPLGWLVPSEICPLEIRPAGQAINVSVNMFFTFLIGQFFLTMLCHMKFGLFYFFASMVAIMTVFIYFLLPETKGVPIEEMGRVWKQHWFWKKYIPEDAIIGGHDDNNTN

SEQ ID NO: 8160 - DNA, 1624 bp, Arabidopsis thaliana
  CDS (73)..(1464)
gatctaaaaacacggtgccttctcatttcctccgggcattttacgaagaaaatggagacaagaaaagacgacatggagaaaaggaacgacaaatccgagccgttgctgctgccggagaatggatccgacgtctcagaagaagcatcatggatggtttatctaagcacgatcattgccgtttgcggttcctacgagtttggaacatgcgtgggatactccgctccaacacagtttgggattatggaagagcttaatttatcatattcccagttttcggttttcggatcgatattgaatatgggagcagtgctcggcgccattacatcggggaagatttctgatttcatcggtcggaaaggggccatgcggttgtcttcagtgatctctgccatcggctggctgataatttacttggccaagggtgacgtacctttggatttcggaagatttctaacgggttatggttgcggtaccctttcctttgtggtaccggtcttcatcgccgaaattagtccgagaaaattgagaggagccttagcgacgcttaaccagctctttatcgtaatcggattagcttctatgttcctcataggcgccgtcgtaaattggagaactcttgcactaaccggagttgcaccgtgcgtggttctattctttgggacttggttcatccctgaatcacccagatggctggaaatggttggccgccacagtgattttgaaattgcgttgcaaaaactgaggggtcctcaggccaatatcacaagagaagccggggaaattcaggagtacttagcgagtcttgctcacctcccgaaagccacattgatggaccttattgacaaaaagaatattcgatttgtgatagttggagttggtttgatgtttttccaacaattcgttggaattaatggcgttatcttctacgcacaacaaatattcgtatcagcaggagcatccccaactcttggaagcattctatactcgatcgaacaagtcgttctcacagcactaggcgcaacattgctaattgatcggcttggaagaaggccacttcttatggcttcagctgttgggatgctgattggatgtttgctcatcggaaattcatttcttttgaaggctcatggtttagcacttgacatcattccggctctggcagttagtggtgtcttggtctacatcggttcgttctctattggaatgggtgcaatcccatgggttataatgtctgagatatttccaataaatttgaaaggaactgccggaggacttgtcactgtagtaaattggctaagttcatggcttgtctcattcactttcaactttctcatgatttggagccctcatggtacattttatgtgtatggtggggtatgtgtattggctattatcttcatagcaaaacttgttcctgaaactaaaggcagaaccttggaagagattcaagcaatgatgatgtaactctgtaaatatataatacatgttaattttttattttttttattaaggtataactatctacatgcaaacgcataccattatcaatataaccgaaaggctttatatgtattttatgaatttaattttggattttcagatttcgtaaatcgaaagaattatg

SEQ ID NO: 8161 - protein, 463 aa, Arabidopsis thaliana
MEKRNDKSEPLLLPENGSDVSEEASWMVYLSTIIAVCGSYEFGTCVGYSAPTQFGIMEELNLSYSQFSVFGSILNMGAVLGAITSGKISDFIGRKGAMRLSSVISAIGWLIIYLAKGDVPLDFGRFLTGYGCGTLSFVVPVFIAEISPRKLRGALATLNQLFIVIGLASMFLIGAVVNWRTLALTGVAPCVVLFFGTWFIPESPRWLEMVGRHSDFEIALQKLRGPQANITREAGEIQEYLASLAHLPKATLMDLIDKKNIRFVIVGVGLMFFQQFVGINGVIFYAQQIFVSAGASPTLGSILYSIEQVVLTALGATLLIDRLGRRPLLMASAVGMLIGCLLIGNSFLLKAHGLALDIIPALAVSGVLVYIGSFSIGMGAIPWVIMSEIFPINLKGTAGGLVTVVNWLSSWLVSFTFNFLMIWSPHGTFYVYGGVCVLAIIFIAKLVPETKGRTLEEIQAMMM

SEQ ID NO: 8162 - DNA, 1578 bp, Arabidopsis thaliana
  CDS (1)..(1434)
atgacgatgtcggagaactcaagaaacttggaagctggtttgctactgaggaagaaccaaaacgacatcaacgaatgtcgtatcactgctgttgtacttttcagtactttcgtttctgtttgtggctctttctgcttcggttgtgcggcaggttattcatcagttgctcaaacagggatcataaatgatttaggtctctctgttgcacaatactccatgtttggttcaatcatgacttttggaggaatgattggtgccatcttcagcgggaaagttgcagatctcatgggtcgaaaagggactatgtggtttgctcaaattttctgcatcttcggttgggttgcagtagcattagcaaaagactccatgtggcttgatattggaagactatccacaggatttgcagttggtttattaagctatgtgataccagtttacattgcagaaataacaccaaaacatgttcgaggagcgtttgtatttgctaatcagctgatgcagagttgtggattgtctttattctacgtcattggaaattttgttcattggcgtaacttggccttaatcggtctcattccatgtgcgttgcaagttgtgactttgttctttattccagagtcccctagactactgggaaaatggggacatgaaaaagaatgtagagcttcattgcaaagtcttcgcggagatgatgcagatatctctgaagaagccaacactatcaaagaaaccatgatcttgtttgatgaaggaccaaaatcgcgggttatggatttgtttcagagaagatatgctccatctgttgttattggtgtgggactaatgcttctacaacaactctctggaagctcaggacttatgtactatgtcggtagcgtatttgataaaggagggtttccaagcagcattggctcaatgattcttgcagtgatcatgataccaaaagctctattgggtctgattttggttgagaaaatgggacgaagaccacttctattgatgaatgatctttatttacaggcctctaccggtggaatgtgctttttcagcttgctcctcagtttttccttctgctttcggtcatatggcatgcttgatgagctcactccgattttcacatgtatcggtgtagtgggtttcatctcttcatttgccgtaggcatgggaggcttaccatggatcatcatgtctgagatattcccaatgaatgttaaagtttctgctgggactctgggtaccttagccaactggtcctttggttggattgttgctttcgcctacaacttcatgctagagtggaacgcatcaggaacgttcttgatcttctttactatatgtggtgcgggtatagtctttatttatgcgatggtacccgaaactaaaggaagaacattggaagatatacaagcttctcttacagattttctacaatgagatcaagtttgacttgtttaaagttattcattttttcttagattacaattggggggaggtttatagttttttgttgtaattgttacctcatttgatgtgcaattgagaaagagatcacttgaacataaaaaaaaaaaaaaaaaa

SEQ ID NO: 8163 - protein, 477 aa, Arabidopsis thaliana
MTMSENSRNLEAGLLLRKNQNDINECRITAVVLFSTFVSVCGSFCFGCAAGYSSVAQTGIINDLGLSVAQYSMFGSIMTFGGMIGAIFSGKVADLMGRKGTMWFAQIFCIFGWVAVALAKDSMWLDIGRLSTGFAVGLLSYVIPVYIAEITPKHVRGAFVFANQLMQSCGLSLFYVIGNFVHWRNLALIGLIPCALQVVTLFFIPESPRLLGKWGHEKECRASLQSLRGDDADISEEANTIKETMILFDEGPKSRVMDLFQRRYAPSVVIGVGLMLLQQLSGSSGLMYYVGSVFDKGGFPSSIGSMILAVIMIPKALLGLILVEKMGRRPLLLMNDLYLQASTGGMCFFSLLLSFSFCFRSYGMLDELTPIFTCIGVVGFISSFAVGMGGLPWIIMSEIFPMNVKVSAGTLGTLANWSFGWIVAFAYNFMLEWNASGTFLIFFTICGAGIVFIYAMVPETKGRTLEDIQASLTDFLQ

SEQ ID NO: 8164 - DNA, 1524 bp, Arabidopsis thaliana
  CDS (1)..(1524)
atggctgttgttgtgtctaatgccaatgctccggcctttgaggccaagatgactgtctatgtattcatctgcgttatgattgccgctgtcggcggtttgatcttcggttacgacatcggaatttccggtggagtaagtgcaatggacgatttcctgaaggaatttttcccagcggtgtgggagaggaagaagcacgtacacgagaacaactactgcaagtacgataaccagttcttgcaactgttcacctcgtctctttacctagctgcactcgtggccagtttcgtcgcgtccgccacctgttctaaacttggacgcaggccgacgatgcagtttgcttctatcttcttcttgattggtgtcggtctcactgcaggagccgttaacctcgtcatgttgatcattggaagactctttcttggctttggtgttggatttggcaatcaggcagtgcctcttttcctgtctgagattgctccagcacagctccgaggaggtctcaacattgtattccaactcatggttacaatcggaatcctaattgccaacattgtcaactacttcactgccacggttcacccttacggatggaggattgctctcggtggagctggaattcccgctgttatcctcctcttcggttcactacttatcattgagactcccacaagtctcatcgagcgcaacaagaacgaagaaggaaaagaagccctaaggaagatcagaggagttgatgatatcaatgacgagtatgagtctatcgtccatgcatgtgacatcgcgagtcaagtcaaggacccttacaggaaactgttgaagcccgcgagtcgcccaccgttcatcatcggaatgcttctccagcttttccaacaatttaccggaatcaatgcgattatgttctatgcgccggtcttattccaaactgttgggttcggaagcgacgcagcccttctctctgcggttatcaccggatcgatcaatgttctcgccacgttcgttgggatttacctcgttgacagaaccggcaggaggttccttcttctccaatcttccgttcacatgctcatctgccagttgatcattggaatcatcctagcaaaggacttgggcgtaacgggaacactcgggaggccacaagccctagtagtggtgatctttgtgtgcgtttacgtgatgggatttgcatggtcatggggacctttgggatggctaattcctagcgagacgtttcctctagaaacacgtagcgcaggattcgctgttgcagtctcatgcaacatgttcttcacttttgtaatcgctcaagccttcctatcgatgctttgcgggatgagatctggaatattcttcttcttcagcggttggatcattgtgatgggactgtttgcgtttttcttcataccagagacaaaaggaatcgccattgatgacatgagggagagtgtgtggaagccacattggttctggaaaaggtatatgcttccagaggacgaccaccatgacatagagaagagaaatgcttga

SEQ ID NO: 8165 - protein, 507 aa, Arabidopsis thaliana
MAVVVSNANAPAFEAKMTVYVFICVMIAAVGGLIFGYDIGISGGVSAMDDFLKEFFPAVWERKKHVHENNYCKYDNQFLQLFTSSLYLAALVASFVASATCSKLGRRPTMQFASIFFLIGVGLTAGAVNLVMLIIGRLFLGFGVGFGNQAVPLFLSEIAPAQLRGGLNIVFQLMVTIGILIANIVNYFTATVHPYGWRIALGGAGIPAVILLFGSLLIIETPTSLIERNKNEEGKEALRKIRGVDDINDEYESIVHACDIASQVKDPYRKLLKPASRPPFIIGMLLQLFQQFTGINAIMFYAPVLFQTVGFGSDAALLSAVITGSINVLATFVGIYLVDRTGRRFLLLQSSVHMLICQLIIGIILAKDLGVTGTLGRPQALVVVIFVCVYVMGFAWSWGPLGWLIPSETFPLETRSAGFAVAVSCNMFFTFVIAQAFLSMLCGMRSGIFFFFSGWIIVMGLFAFFFIPETKGIAIDDMRESVWKPHWFWKRYMLPEDDHHDIEKRNA

SEQ ID NO: 8166 - DNA, 1976 bp, Lycopersicon esculentum
  CDS (87)..(1658)
attttatttttcttatataaaaaacatatcatcttcttattgttattttaactaccacatttgaagccggaaaacttagtaacacgatggccggtggaggatttacgacctccggtaacggaggcacgcatttcgaggctaaaatcacaccaattgttatcatatcttgtattatggctgctaccggaggtctcatgtttggttatgatgttggagtttctggtggtgttacatcaatggatccatttttaaaaaaattctttccaacagtttataagagaacaaaggagccaggattagacagtaattactgtaaatacgataatcaagggttacaattatttacttcatcgttatacctagctggtttaacggcgacgttttttgcttcttacactacaagaaaacttggccggagattaactatgttaatcgccggttgttttttcattattggagttgtactaaatgctgctgctcaagatttagctatgcttattattggaagaattctccttggttgtggcgttggtttcgccaatcaggctgttccattatttttatcagaaatagcacctacaagaattcgtggaggacttaacattttgttccaacttaacgtaactattggtattctttttgccaatctcgtcaactacggaacagccaagattagtggaggatggggatggagattatcattagggttagctggatttccagcagtattgttgactttgggcgcattatttgttgttgaaaccccaaacagtttgattgaaagaggttacttagaagaaggcaaagaagtacttcgaaaaatcagaggtaccgacaacattgaacctgaattcttggaacttgttgaggctagtcgtgttgctaaacaagtcaaacaccctttcagaaatttactccaacgtaaaaatagacctcaattaatcatctctgttgccctccagatattccaacaatttacaggaatcaacgctattatgttctacgcacctgttttattttcaacactagggtttggaaacagcgcagctctttactcagctgtcatcaccggagcagtcaacgttctctccaccgttgtctcagtctactccgttgacaagctcggacgacgagtcctcctcctggaagctggggtccaaatgttactatctcaaataataatcgctataatcctaggtatcaaagttactgatcattcagacaaccttagccatggttggggaatcttcgtagtagttctgatctgtacatatgtatcggctttcgcatggtcatggggcccacttggatggttaattcctagcgagacgttccctttggaaactcgttcagctggtcaaagtgtaacagtgtgtgttaacttgcttttcacgtttgttatggcacaagcatttctctcaatgctttgtcatttcaagtatgggatattcttgttcttctcggggtggatttttgtgatgtcgttgttcgttttcttcttgttgcctgagacgaagaatgttcctattgaggagatgacggagagggtgtggaagcaacattggctgtggaagaggtttatggtggatgaagatgatgttgatatgattaaaaagaatggacatgctaacggatatgatcccacttctcggttgtaaaataaaaaataaaagaatattagcggtgttttacgttgattttatcatagtaaagatgcgtagaaataaatcaaacatgcaagagagagatcagagtctactgtctagtctagtgatatcgataagtgtttctcacaaaataggtgtgcatttggattttttttactgcttgttttcctcctttatatcgttcaatgtagtagaaattgtttagccaaagtgtaagagatgcaatatggtgataatttatgtaaccatatagcctatgtatattagagatttggtataattcattttgggaaaaaaaaaaaaaaaaaa

SEQ ID NO: 8167 - protein, 523 aa, Lycopersicon esculentum
MAGGGFTTSGNGGTHFEAKITPIVIISCIMAATGGLMFGYDVGVSGGVTSMDPFLKKFFPTVYKRTKEPGLDSNYCKYDNQGLQLFTSSLYLAGLTATFFASYTTRKLGRRLTMLIAGCFFIIGVVLNAAAQDLAMLIIGRILLGCGVGFANQAVPLFLSEIAPTRIRGGLNILFQLNVTIGILFANLVNYGTAKISGGWGWRLSLGLAGFPAVLLTLGALFVVETPNSLIERGYLEEGKEVLRKIRGTDNIEPEFLELVEASRVAKQVKHPFRNLLQRKNRPQLIISVALQIFQQFTGINAIMFYAPVLFSTLGFGNSAALYSAVITGAVNVLSTVVSVYSVDKLGRRVLLLEAGVQMLLSQIIIAIILGIKVTDHSDNLSHGWGIFVVVLICTYVSAFAWSWGPLGWLIPSETFPLETRSAGQSVTVCVNLLFTFVMAQAFLSMLCHFKYGIFLFFSGWIFVMSLFVFFLLPETKNVPIEEMTERVWKQHWLWKRFMVDEDDVDMIKKNGHANGYDPTSRL

SEQ ID NO: 8168 - DNA, 1653 bp, Pichia stipitis; identical to SEQ ID NO: 505
  CDS (1)..(1653)

SEQ ID NO: 8169 - protein, 550 aa, Pichia stipitis; identical to SEQ ID NO: 506

SEQ ID NO: 8170 - DNA, 2169 bp, Drosophila melanogaster
  CDS (579)..(2024)
cagttttatctggaactttgccgccgtcagtcatttccaacttccatgcggcgtgtttcgggtttatttttcgtctaggtgtaaacatttctaattagtgttgtgtttggtgcagtagttcttccttccaatctttgttatcagtcgcgtagtgctaatcgactctatctcaagtgcgctggtaccgtaaaaggtctccgttctttttttggccaatcacttgtatcaataaataattaggggctatcgctccgtgtttatttcgagacataatttaattccagaaagcagtgaggcggcacataagagctctccggtgctcggcaaacgacaaaactaatttatggcattaaaaatgcatattttctagcagtgcgtcgacagtttttatcatttgccagaaaggcaaaaggcgctatccaccagcagctgtgccagaaaaggaagctaggaagacacgtcggtcgagaattggatttgactgcggaggattttgaatccgagtccgaaagttctttagtcagcaaccgaagaagcgtaggataattcacatttttctcacggcaactggcaacgaaatggctttcctatgtgcaccgggtctcaccttcttcctcacctactcgattttctcggcggtgctgggcatgctgcaattcggctacaacaccggcgtcatcaacgcgcccgaaaagaatatcgagaacttcatgaaggacgtctacaaggaccgctacggcgaggacatcagcgaggagttcatccagcagctctactcggtggcggtatccattttcgccatcggcggcatgctgggcggtttcagcggaggctggatggccaaccgctttggcagaaaaggcggcctactgttgaacaatgtgctcggaattgccggcgcctgtttgatgggatttaccaaagttagtcattcctatgaaatgttattccttggccgatttataattggtgttaattgcggcctcaacacttcgctggtgcccatgtacatctcggagatagcgccactgaatctgcgcggtggcttaggaactgttaatcaattggctgtgactgtaggtttactattatcccaagtgctgggcatcgagcaaatcctcggcaccaacgagggctggcccatcctcctgggcctggccatctgcccggcgatcctgcagctgatcctgctgcccgtctgcccggaatcgcccagatatctgctcattaccaagcagtgggaggaggaggcgcgaaaagccctgcgccgactgcgagcctctgggtccgtggaggaggacatcgaggagatgcgggccgaggagcgcgcccagcagtccgagagccacatatcgaccatggagctgatatgctcgcccaccctgcgccctccgctgatcatcggcatcgtgatgcagctgagccagcaattcagcggcatcaacgccgtcttctactattccacgtcgctgttcatgagctcgggattgactgaggagagcgccaagttcgctacgataggcatcggcgccataatggttgttatgacgctcgtgtccattccgctaatggatcgcacgggtcgccggaccctgcatctctatggtctgggcggaatgttcatcttctcaatcttcatcaccatttcgttcctgatcaaggaaatgatcgactggatgtcctacctctctgtggtggccactctcggattcgtcgtcttctttgcggtgggacccggttcgataccctggatgattaccgcggagctcttctcccagggaccccggcccagtgccatggctattgcggtgctggtcaactggatggccaactttgtggtcggcattggtttccccagcatgaagactgccctggagaactacacgttcttgccgttcagcgtattcctggccatcttctggatattcacgtacaagaaggtgcccgagacgaagaacaagacgttcgaggagatcctggccctcttccggcacaacaatggcaggtatgtgtccttgcactagctcattctacgctcaaattctgcacacaaatcatggcaatatgtcgaatagttatccagctcataacttaaactcaactttcttaactgacacaagaaatgcgaactataaatactataaaatacaatacagaatctttgtacta

SEQ ID NO: 8171 - protein, 481 aa, Drosophila melanogaster
MAFLCAPGLTFFLTYSIFSAVLGMLQFGYNTGVINAPEKNIENFMKDVYKDRYGEDISEEFIQQLYSVAVSIFAIGGMLGGFSGGWMANRFGRKGGLLLNNVLGIAGACLMGFTKVSHSYEMLFLGRFIIGVNCGLNTSLVPMYISEIAPLNLRGGLGTVNQLAVTVGLLLSQVLGIEQILGTNEGWPILLGLAICPAILQLILLPVCPESPRYLLITKQWEEEARKALRRLRASGSVEEDIEEMRAEERAQQSESHISTMELICSPTLRPPLIIGIVMQLSQQFSGINAVFYYSTSLFMSSGLTEESAKFATIGIGAIMVVMTLVSIPLMDRTGRRTLHLYGLGGMFIFSIFITISFLIKEMIDWMSYLSVVATLGFVVFFAVGPGSIPWMITAELFSQGPRPSAMAIAVLVNWMANFVVGIGFPSMKTALENYTFLPFSVFLAIFWIFTYKKVPETKNKTFEEILALFRHNNGRYVSLH

SEQ ID NO: 8172 - DNA, 1587 bp, Drosophila melanogaster
  CDS (47)..(1444)
caaggaaacacctataaaaaccaatttaaaaaaaaaacccctcgccatgtccaagggatcggtgttgccacaatatattgctggcttgtcggccagctttggtgccctctgcatgggcgcctccattggttggtcctcgcccgtggagaatatgataacggtgaacacggaatacggctttcccattagctccagtcagttcggctgggtatcctcgctgctgaccctgggcgccactgtgatctgcattcccattggtttcgccatcgattggatcggcaggagacccactatgttagccctaattccaccgtacatggtgggctgggtgctgatgctgttcgccaaaaacgtgaccatgctctacttcggacgattcattcttggcatgtgcggcggagccttttgcgtaacagctcccatgtactgtacagagattacggcgacagcactacgaggcaccatcggatcctttttccagctgctgattgtgtcgggcgtgctgtacggctatttggtgggcgccttcctgcccctgctcaccatcaatatcctgtgcgctattctgcccgtaatctttgctatcatacacttcttcatgccggagtcacccgtctacctggccatgaagggacgcaacgatgatgccgccaaggccttgcagtggctgcgcggcaaggatgccgatatcgatgacgagctcaaggagatcctggaggagtcccagaagcagattgatatgccacaggtcaacattctgtcctcccttcgtcgacccatcgtcctgaagggtcttggaatcgctgtgctcctgcaggtcttccagcagtggacgggaatcaacgccgttctcttctactccgcctccattttcgaggatacgggctctgacataagtggcagcgatgccacgcttatcattggagtcacccaagtgaccagcacgctggttgccgtggccattatcgacaaggctggccgtcgcatcctgctccttatctctggcgttctgatggccgtgtccactgcactgatgggcgtgtactttcagctaaaggagaacgatccggcttcaatggacaatttcggttggttgccgatcagcagtatctgcattttcataatcttcttctcgattggattcggaccggtgccgtggctggtgatggcggaactcttctcggaggatgtgaagagtgtggcaggatcgattgccggcaccagcaactggctgtcggccttcgtggtcacgctgctcttcccaatcctcaagagctcgatcgggccgggtccgaccttttggatctttaccgcgatcgcggtcatcgccttcttctactctctgttcttcgtgccggagaccaagggcaagacaataatcgaaatccaggacctgctgtccggaggaaagggtgtcaaaagtgatgacaagagccagacgtgatgatgtcgcgtagtcttagtcgtagcgatactttttcatattctccttaagccaataagaaaatgttatgtataagaagtgaagagcataatcaataaagtagaatcaccatgtatataaactaaaaaaaaaaaaaaaaaaaa

SEQ ID NO: 8173 - protein, 465 aa, Drosophila melanogaster
MSKGSVLPQYIAGLSASFGALCMGASIGWSSPVENMITVNTEYGFPISSSQFGWVSSLLTLGATVICIPIGFAIDWIGRRPTMLALIPPYMVGWVLMLFAKNVTMLYFGRFILGMCGGAFCVTAPMYCTEITATALRGTIGSFFQLLIVSGVLYGYLVGAFLPLLTINILCAILPVIFAIIHFFMPESPVYLAMKGRNDDAAKALQWLRGKDADIDDELKEILEESQKQIDMPQVNILSSLRRPIVLKGLGIAVLLQVFQQWTGINAVLFYSASIFEDTGSDISGSDATLIIGVTQVTSTLVAVAIIDKAGRRILLLISGVLMAVSTALMGVYFQLKENDPASMDNFGWLPISSICIFIIFFSIGFGPVPWLVMAELFSEDVKSVAGSIAGTSNWLSAFVVTLLFPILKSSIGPGPTFWIFTAIAVIAFFYSLFFVPETKGKTIIEIQDLLSGGKGVKSDDKSQT

SEQ ID NO: 8174 - DNA, 2514 bp, Drosophila melanogaster
  CDS (463)..(2082)
tgcggttaaagatacaaagatactcccggcgcacaaataagatactcgcgagtggcactgcggaaacatcgatgagccaaccgatacatatccaaaaatatccatatatcttaaacgaaactcgtgtcatatcgcccagtttactggctaattagaggggcaaagaagggccaaaataatacattttttggccagcaacatgtttgattgttgatgcgcatgcgccctaaagtattccatgctacgtgggtggccgacgtgttaaaggacaaaaaacgcaagccaaaggacatttcacagacattgacgcattgctcaacattatcacatcgccaaagctaaagtgcagttccaagtgagaaaagcgggcagaagttaacggataatcgccgaagaatattgaaatacatatcccccatcgtaactgtgcaatcctaccgaagtttacataatcccttcgatatgtccaccgcatcgtcgagcaactccagcggcgaggaggccaacaaaaagtccggctccaacaacgaggagagctcccacctgctggaatccgccgaaaatggagccaagtacggctccagacagccggtcaaaatcgtcaaagccagcgataatggacgcaccagctccacaccacatgatcaggagaatctactgggcaacatggtgcacacgtctacttcgaataactcccagaagtggccacaatatgtggccgcattggccgctgctggtggcgccttcgccgccggtaccgtcctgggttggacatcgccggccgaaacggagatcgtggatcgcggcgaaggatacgatttccctgtcgacaaggatcagttttcgtgggtaggatctgccatgaccctgggtgccgcctgtgtgtgcattcccattggcttcctgatcaacatgattggccgaaagtggaccatgctgtttctggtgctgcccttcattctcggttggaccatgctcatctgggcggtcaatgtcagtatgctgtatgcctcgcgcttcatcctcggtatcgccggtggagctttctgtgtgaccgctcccatgtacacgggtgagattgctcagaaggagattcgcggaacgctgggcagcttcttccagttgatgataaccattggtatcctgttcgtctatgccgtcggagctggtgtgaaaatattctggttgagcatcatttgcggcattctgcccctcatctttggcgccatcttctttttcatgccggaatcgcccacctacttggtttccaaagatcggtcggagaacgccatcaagtccattcaatggctgcgtggcaaggaatacgattacgagccagagctggcggagctgcgtgaaaccgaccgggaaaccaaggccaacaaggtcaacgtgtgggctgctctgaaccgacccgtcacccggaaggctttggccatcagcatgggtcttatgttcttccagcaggtctgcggaatcaatgctgttattttctacgcttcgaggatctttttggaagccaacactggcatcgaggctgagtgggcaacgatcctgatcggtatcatgcaagtggtggccaccttcgtctccaccctggtagtagacaagctgggccgtcgcatcctgctgttggcctcaggaatttccatggccatttccaccaccgccatcggagtgtacttcttcctccagaaacaggacgcggcacaagtggtgagtctgggctggctcccagtggccagtctgtgcctgttcatcatcatgttctcgatcggctatggaccggtgccatggctgatgatgggagagctcttcgccaccgacatcaagggatttgctggatcgctggccggaacatccaactggcttttggcattcgtggtgaccaagacgtttgtgaacttgaacgatggcctgggaattggcggaaccttctggctattcgctggtctgactgttgtgggtgtgatattcgtttatttcgccgtgccggaaaccaagggcaagagtctcaacgagattcagcaggagctggctggcaaccggtcgactccacaagctattcccgcggaaaagtaaaggggcaatgtccacctgaggagcccgaaaggcaaatcgcgattcgcaatccggaaggcgaaagacggaccggaaatcactgttaacttgctgttaatatacgttcgatttaagttcgcgtttagtgcaagtcttttggcgttttcgatggatgaatttgtttatagaatttaatatgcgcatagattttcgtttaagcatagcaagattcagatgaagatgaagaaaattgcaggaaactataactaagagcgaagactgaaggtcaactgcagaaaagccgcgataatatttttttgcagccatagaaaagacaacagcaatttaagaaaaaacatatatacctatatatatatccatataatgtatgtatgcttatttagtgttattcattcaaccaacgaaatctgttttacaaaattttaagccata

SEQ ID NO: 8175 - protein, 539 aa, Drosophila melanogaster
MSTASSSNSSGEEANKKSGSNNEESSHLLESAENGAKYGSRQPVKIVKASDNGRTSSTPHDQENLLGNMVHTSTSNNSQKWPQYVAALAAAGGAFAAGTVLGWTSPAETEIVDRGEGYDFPVDKDQFSWVGSAMTLGAACVCIPIGFLINMIGRKWTMLFLVLPFILGWTMLIWAVNVSMLYASRFILGIAGGAFCVTAPMYTGEIAQKEIRGTLGSFFQLMITIGILFVYAVGAGVKIFWLSIICGILPLIFGAIFFFMPESPTYLVSKDRSENAIKSIQWLRGKEYDYEPELAELRETDRETKANKVNVWAALNRPVTRKALAISMGLMFFQQVCGINAVIFYASRIFLEANTGIEAEWATILIGIMQVVATFVSTLVVDKLGRRILLLASGISMAISTTAIGVYFFLQKQDAAQVVSLGWLPVASLCLFIIMFSIGYGPVPWLMMGELFATDIKGFAGSLAGTSNWLLAFVVTKTFVNLNDGLGIGGTFWLFAGLTVVGVIFVYFAVPETKGKSLNEIQQELAGNRSTPQAIPAEK

SEQ ID NO: 8176 - DNA, 1560 bp, Vitis vinifera
  CDS (1)..(1560)
atgccggctgtcggaggctttgataagggtaccgggaaggcctatcccggtaaccttactccttacgtgactgtgacatgtgttgttgcagccatgggtggtttgatctttggttacgatattggaatttctggtggggtcacgtccatggctccgttcttgcagaagttcttcccttctgtgtaccggaaggaggctttggacaagtccacgaatcagtactgtaagtttgatagtgagacactgacgttgttcacatcgtcgctttatctggctgctcttctctcgtcgctggtggccgcgacggtgacccgaaagttcgggagaaagctgtcaatgctattcggaggactgctcttttgtgccggtgccatcatcaatggcgctgctaaagctgtttggatgttgattgtcggtcgtatactgctgggttttggtattgggtttgccaatcagtctgtgccgctctacctctctgagatggctccatacaaatacagaggagccctcaacattggcttccaattatccatcacaattggtattcttgtggccaatatattgaactacttctttgcaaagatcaaggggggttggggatggaggttgagcttgggtggcgctgtggtccctgcgctcatcatcaccgtcgggtcccttgtcctcccggacacacccaactccatgatcgagcgtgggcagcacgagggagcgaaaacaaaactgagaagaatccggggtgtcgatgatgttgaagaggaattcaatgaccttgttgtagccagtgaagcctccaagcttgttgagcacccctggagaaatctcttgcagaggaagtacaggccacacctcacaatggccatcctcattcccttcttccagcagcttaccgggattaatgtcattatgttttatgcccctgttctcttcaaaaccattggctttgcggatgatgcttccctgatgtctgctgtgataaccggcggggttaatgttcttgcaaccatagtttcaatctacggtgttgataagtggggaagaaggtttcttttccttgagggtggcactcaaatgctcatatgtcaggttattgtggcaacgtgcattggtgttaaattcggagtggatggagaacctggtgctttgcccaagtggtatgccatagttgtggtgctgttcatttgcgtctatgtttcagggtttgcatggtcctggggtcctctaggttggttggtccctagtgaaattttccccctggaaatccgatctgctgcacagagtgtaaacgtctccgttaacatgtttttcacattcatcatagcccaaatcttcttaaatatgctgtgtcacatgaagtttggtttgttcctcttctttgccttctttgtggtggtgatgtccttcttcatttacttcttcttgcctgagaccaagggcatcccaattgaagagatggctgaagtatggaaaagtcactggttctggtcccggtatgtcaacgatggttcttacagcggcgtcgaactggtcaaggaaaactaccctgttaagaatgtatga

SEQ ID NO: 8177 - protein, 519 aa, Vitis vinifera
MPAVGGFDKGTGKAYPGNLTPYVTVTCVVAAMGGLIFGYDIGISGGVTSMAPFLQKFFPSVYRKEALDKSTNQYCKFDSETLTLFTSSLYLAALLSSLVAATVTRKFGRKLSMLFGGLLFCAGAIINGAAKAVWMLIVGRILLGFGIGFANQSVPLYLSEMAPYKYRGALNIGFQLSITIGILVANILNYFFAKIKGGWGWRLSLGGAVVPALIITVGSLVLPDTPNSMIERGQHEGAKTKLRRIRGVDDVEEEFNDLVVASEASKLVEHPWRNLLQRKYRPHLTMAILIPFFQQLTGINVIMFYAPVLFKTIGFADDASLMSAVITGGVNVLATIVSIYGVDKWGRRFLFLEGGTQMLICQVIVATCIGVKFGVDGEPGALPKWYAIVVVLFICVYVSGFAWSWGPLGWLVPSEIFPLEIRSAAQSVNVSVNMFFTFIIAQIFLNMLCHMKFGLFLFFAFFVVVMSFFIYFFLPETKGIPIEEMAEVWKSHWFWSRYVNDGSYSGVELVKENYPVKNV

SEQ ID NO: 8178 - DNA, 1686 bp, Arabidopsis thaliana
  CDS (130)..(1521)
gtcctccgcttttccattttactcttcttgtatgtttctgtcttcttactcaacttttgcttcaggcttcgtctcttttgcaatttttgagttagccaagtgctcaagggagatacataatacctgaagatgtccaaggcaagtgatgccgtcagagaaccattggtggacaagaatatggctggatcaaaaccagaccagccgtggatggtttatctcagcacattcgttgcggtctgtggttcttttgcgttcggttcttgtgcgggatactcttcacctgctcaggctgcaattaggaatgacctttcattgactatagctgagttttcactctttggttctttactaacttttggcgcaatgatcggtgctataacaagcgggcctatagctgatttagttggaagaaagggggcgatgagagtttcctctgcattttgtgtagtcgggtggctagcaatcatctttgccaagggagtagtggctctggaccttggaagactggcaacgggatatggaatgggagcattttcctatgtggtgccaatctttatagcagaaattgcacctaaaactttcagaggggctctaaccacactgaaccagattctgatctgcactggagtgtcggtttccttcatcataggcacactagtgacgtggagagtcttggcattaataggaatcatcccatgcgctgcctccttccttggcctcttttttatccctgagtctccaagatggctggcaaaagtggggcgtgatacggagtttgaagctgcactgaggaagctccgtgggaagaaggctgatatttcggaggaggcagcagagatccaggattatatcgaaactctggaaaggctaccgaaagccaagatgctggatttgtttcagaggagatacatacgctctgttcttatagctttcgggttgatggtgtttcagcagtttggaggaatcaacggaatatgtttctacacaagctcgatatttgagcaagcaggttttcccacaagacttgggatgataatatatgctgttcttcaggtggtaatcactgcgcttaatgcaccgatagttgacagagccggaagaaaaccattgctactggtttctgcaacagggttagtgataggctgtttgatagcagcggtttctttctatctcaaggttcacgacatggcgcacgaagcagtcccagtcctggctgttgttggtataatggtgtacataggatcgttttcagcaggaatgggagcaatgccgtgggtggtcatgtctgagatatttcccataaacataaaaggagtagcaggaggcatggcgacgctggtgaactggtttggagcgtgggctgtttcttacactttcaacttcctcatgtcctggagctcttacggaactttcctcatttacgctgccatcaacgcgctggccattgtcttcgtcattgccatcgtgcctgagacaaaagggaagacattggagcagatccaagctatagtcaatccatagctcaaacacttcctagatgttcgtttctattagccagctgggacataaattgcaatcttggatctctttgcttttatgattctttactgagttcaattgttatcactctctctatttctaatctcttcttaatgaactttggacttcaatttgatgtttttccat

SEQ ID NO: 8179 - protein, 463 aa, Arabidopsis thaliana
MSKASDAVREPLVDKNMAGSKPDQPWMVYLSTFVAVCGSFAFGSCAGYSSPAQAAIRNDLSLTIAEFSLFGSLLTFGAMIGAITSGPIADLVGRKGAMRVSSAFCVVGWLAIIFAKGVVALDLGRLATGYGMGAFSYVVPIFIAEIAPKTFRGALTTLNQILICTGVSVSFIIGTLVTWRVLALIGIIPCAASFLGLFFIPESPRWLAKVGRDTEFEAALRKLRGKKADISEEAAEIQDYIETLERLPKAKMLDLFQRRYIRSVLIAFGLMVFQQFGGINGICFYTSSIFEQAGFPTRLGMIIYAVLQVVITALNAPIVDRAGRKPLLLVSATGLVIGCLIAAVSFYLKVHDMAHEAVPVLAVVGIMVYIGSFSAGMGAMPWVVMSEIFPINIKGVAGGMATLVNWFGAWAVSYTFNFLMSWSSYGTFLIYAAINALAIVFVIAIVPETKGKTLEQIQAIVNP

SEQ ID NO: 8180 - DNA, 2468 bp, Mus musculus; identical to SEQ ID NO: 515
  CDS (34)..(1605)

SEQ ID NO: 8181 - protein, 523 aa, Mus musculus; identical to SEQ ID NO: 516

SEQ ID NO: 8182 - DNA, 2355 bp, Canis familiaris; identical to SEQ ID NO: 517
  CDS (201)..(1688)

SEQ ID NO: 8183 - protein, 495 aa, Canis familiaris; identical to SEQ ID NO: 518

SEQ ID NO: 8184 - DNA, 1485 bp, Ovis aries; identical to SEQ ID NO: 519
  CDS (1)..(1485)

SEQ ID NO: 8185 - protein, 494 aa, Ovis aries; identical to SEQ ID NO: 520

SEQ ID NO: 8186 - DNA, 2425 bp, Kluyveromyces lactis; identical to SEQ ID NO: 523
  CDS (539)..(2194)

SEQ ID NO: 8187 - protein, 551 aa, Kluyveromyces lactis; identical to SEQ ID NO: 524

SEQ ID NO: 8188 - DNA, 2353 bp, Chlorella kessleri
  CDS (57)..(1679)
cccggccttgcagcaatccacatacccctcatcgacgcgacatccataaagggaccatggcagggggcggaccagtagcgagcaccacaaccaaccgcgcgagccagtatggctacgccaggggcggcctcaactggtacatcttcattgtggccttgaccgcaggcagcggcggcctgctgttcggctatgacattggtgtgactggcggcgtcacctccatgcctgagttcctgcagaagttcttcccctccatctatgaccgcacacagcagcccagcgacagcaaggacccctactgcacctatgacgaccagaagctgcagctcttcacctcctccttcttcctggccggcatgtttgtctccttctttgccggctccgtggtccgccgctggggccgcaagcccaccatgctcatcgcctccgtcctcttcctggctggcgccggcctcaacgccggtgcccaggaccttgccatgctcgtcatcggccgtgtgctgctcggttttggcgtcggcggcggcaacaacgccgtgcctctgtacctatcagagtgcgccccccccaagtaccgcggcggcctcaacatgatgttccagctggctgtcaccattggcatcatcgttgcccagctggtcaactacggcacccagaccatgaacaacggctggcgcctgtccctgggccttgccggcgtgcccgccatcatcctgctgattggctccctgctgctccctgagacccccaactccctcattgagcgcggccaccgccgcaggggccgcgctgtgctggcacgcctgcgccgcactgaggctgtcgacaccgagtttgaggacatttgcgccgcagctgaggagtccacccgctacaccctgcgccagtcctgggccgccctgttctcccgccagtactcgcccatgctcatcgtgacctccctcatcgccatgctgcagcagctgaccggcattaacgcgatcatgttctacgtgcccgtcctcttcagctcctttggcactgctcgccacgccgccctgctgaacaccgtcatcatcggcgctgtcaatgtggccgccacctttgtttccatcttctccgttgacaagtttggccgccgcggcctcttcctggagggtggcattcagatgttcatcggccaggtggtgaccgctgctgtgctgggcgtggagctgaacaagtacggcaccaacctgccctcctccactgccgctggcgtgctggtggtcatctgcgtttacgtggccgcctttgcctggtcctgggggcccctgggctggctggtgccttctgagatccagacgctggagacccgcggtgccggcatgtccatggccgtcattgtcaacttcctattctcattcgtgattggccaagcgttcctgtccatgatgtgcgccatgcgctggggcgtgttcctcttctttgccggctgggtggtcatcatgaccttctttgtctacttctgcctaccagagaccaagggtgtgcctgtggagaccgtgcccaccatgtttgcccgccactggctgtggggccgcgtcatgggagagaagggccgcgcactggtggctgctgacgaggcccgcaaggctggcaccgtggcatttaaggtggagagcggctctgaggacggcaagcctgcctctgaccagtaagcttgggctgtctgtccccaagctgccaactaacgtcttccttcttttttccctctgaaacgctagcaactaggaatgtcgtgcaaactctctcgcttgcagccgtctttcttgcgctgagctgtcagcaggcagaattttgaagcgcagactgtttctccctgccagtctgccctctgcctgcttttgatcgtgtgatggtgaactggactgaacccgtcttgcccgcccttccccactggaaaggagcttgaatgccgttgcacctgggacaggtgtttttatagcctgcattgcagcgctcttggcaatttttatgctggaagctcaccgcttgcacctggacaggtgtttttatagcctgctctgcagcgctgttggcattttttttcctgagtgcgcaccgttgattgagccctacagcagttttcttagcgctaggcaggcgtctttctgccactgttttgctgtggcgcttccacgctgagatgacggggaggagtgttagcgaggtagttgcttctgggtaccttattcattcatacacttggctgcgtgcctttcatgagtctggctaccttcttcatttggcatgaggttgtcacctacatagccacatattgaatgatcttgggtttatatacatggccagccttgcagcagtctacattgcc

SEQ ID NO: 8189 - protein, 540 aa, Chlorella kessleri
MAGGGPVASTTTNRASQYGYARGGLNWYIFIVALTAGSGGLLFGYDIGVTGGVTSMPEFLQKFFPSIYDRTQQPSDSKDPYCTYDDQKLQLFTSSFFLAGMFVSFFAGSVVRRWGRKPTMLIASVLFLAGAGLNAGAQDLAMLVIGRVLLGFGVGGGNNAVPLYLSECAPPKYRGGLNMMFQLAVTIGIIVAQLVNYGTQTMNNGWRLSLGLAGVPAIILLIGSLLLPETPNSLIERGHRRRGRAVLARLRRTEAVDTEFEDICAAAEESTRYTLRQSWAALFSRQYSPMLIVTSLIAMLQQLTGINAIMFYVPVLFSSFGTARHAALLNTVIIGAVNVAATFVSIFSVDKFGRRGLFLEGGIQMFIGQVVTAAVLGVELNKYGTNLPSSTAAGVLVVICVYVAAFAWSWGPLGWLVPSEIQTLETRGAGMSMAVIVNFLFSFVIGQAFLSMMCAMRWGVFLFFAGWVVIMTFFVYFCLPETKGVPVETVPTMFARHWLWGRVMGEKGRALVAADEARKAGTVAFKVESGSEDGKPASDQ

SEQ ID NO: 8190 - DNA, 1731 bp, Saccharomyces cerevisiae
  CDS (1)..(1731)
atgtctgaagaagctgcctatcaagaggatacagcagtccaaaatactccagctgatgctttgtcgccagttgaatccgattctaattccgctttgtctactccatccaacaaagctgaaagagatgacatgaaagatttcgacgagaatcacgaagaatctaataactacgttgaaattccaaagaagcccgcctccgcctacgttacagtttccatctgttgtttaatggttgctttcggtggttttgttttcggttgggatactggtaccatttctggttttgttgctcaaactgattttatcagaagatttggtatgaagcaccacgatggtacttattatttgtctaaggttagaactggtttaattgtctccattttcaacattggttgtgccattggtggtattattttagcaaaattaggtgatatgtatggtcgtaaaatgggtttgattgtcgttgttgtcatctacattatcggtatcattatccaaattgcctcaatcaacaagtggtaccaatatttcattggtagaattatctctggtttaggtgtcggtggtattgccgttttatctcctatgttgatttctgaagtctctccaaagcatattagaggtactttggtttcatgttaccaacttatgattactttgggtattttcttgggttactgtacaaactacggtaccaagacctacaccaattctgtccaatggagagttccattaggtctaggtttcgcttgggctttgtttatgattggtggtatgacattcgttccagaatctccacgttatttagttgaagtcggtaaaattgaagaagctaagcgttctattgctctttcaaataaggtcagcgcagacgatccagctgttatggctgaagtcgaagttgttcaagctacagttgaagctgaaaaattagctggtaatgcctcctggggtgaaatatttagcactaagactaaggttttccaacgtttgatcatgggtgctatgattcaatcattgcaacaattgacaggtgataactatttcttctattacggtactaccgttttcactgctgtcggtttggaagattcttttgaaacttctattgtcttgggtattgtcaactttgcttccacctttgttggtattttcttagtcgaaagatatggtcgtcgtagatgtttattatggggtgctgcttccatgacagcttgtatggttgttttcgcttctgttggtgttacaagattgtggccaaatggtaagaagaacgggtcttctaagggtgctggtaactgtatgattgtcttcacatgtttctacttattctgttttgccactacctgggctccaattccatttgttgttaactctgaaactttcccattgagagttaagtccaagtgtatggctattgctcaagcttgtaactggatctggggtttcttgattggtttctttactccatttatttcaggtgctattgatttctactacggttatgttttcatgggctgtttggtcttttcttacttctacgtcttcttcttcgttccagaaactaaaggtttgactttagaagaagttaacaccttatgggaagaaggtgttttgccatggaaatcaccttcttgggttccaccaaacaagagaggtactgactacaacgctgatgatctaatgcatgatgatcaaccattttacaagaagatgttcggaaaaaagtag

SEQ ID NO: 8191 - protein, 576 aa, Saccharomyces cerevisiae; identical to SEQ ID NO: 526

SEQ ID NO: 8192 - DNA, 3261 bp, Homo sapiens
  CDS (109)..(1998): n means a or g or c or t/u, r means g or a, w means a or t/u
ctgccggcccgcggagccgcgtccccccgggcagccccgggcccctgccctatgtcccgcaaggcaagcgagaatgtggagtacacgctgcggagcctgagcagcctgatgggcgagcggcgcaggaagcagccggagccggacgcggcgagcgcggccggggagtgcagcctcctggctgccgccgaatcgagcaccagcctgcagagcgcgggcgcgggcggcggcggcgtcggggacctggagcgcgcggcgcggcggcagttccagcaggacgagacccccgccttcgtgtacgtggtggccgtcttctccgcgctgggcggcttcctgtttggctatgacaccggggtggtgtcaggggccatgctgctgctcaagcggcagctcagtctggacgcgctgtggcaggagctgctggtgtccagcacggtgggggcggctgccgtctcggcgctggccggaggcgccctcaacggcgtcttcggccgccgcgctgccatcctcctggccagtgccctcttcaccgccggctccgcggtgctggctgcggccaacaacaaggagacactgctcgccggccgcctggtcgtgggactcggcatcggcattgcttctatgacagtgccagtgtacattgcggaggtctcaccacccaatttaagaggccgattagtcaccattaataccctcttcatcacaggagggcagttctttgcaagtgttgttgatggagccttcagttatctccagaaggatggatggaggtacatgttgggacttgcarcagttccggcggttatacagttttttggctttctctttttgcctgaaagccctcgatggcttattcagaaaggacagactcagaaggcccgtagaattttatctcagatgcgtggtaaccagaccattgatgaggaatatgatagcatcaaaaacaacattgaagaggaggaaaaagaggttggctcagctggacctgtgatctgcagaatgctgagttatcccccaactcgccgagctttaattgtgggttgtggcctacaaatgttccagcagctctcaggcattaacaccatcatgtactacagtgcaaccattctgcagatgtctggtgttgaagatgatagacttgcaatatggctggcttcagttacagccttcacaaatttcattttcacacttgtgggagtctggcttgttgagaaggtgggccgcagaaagcttacctttggtagtttagcaggtaccaccgtagcactcattattcttgccttgggatttgtgctatcagcccaagtttccccacgcatcacttttaagccaatagctccgtcaggtcagaacgccacttgcacaagatacagttactgtaatgaatgtatgttggatccagactgcggtttctgctwcaagatgaacaaatcaactgtcattgactcctcctgtgttccagttaataaagcatctacaaatgaggcagcctggggcaggtgtgaaaatgaaaccaagttcaaaacagaagatatattttgggcttacaatttctgccctactccatactcctggactgcacttctgggccttattttatatcttgtcttctttgcacctggaatgggaccaatgccttggactgtgaattctgaaatatatcccctttgggcaagaagtacaggaaatgcatgttcatctggaataaactggattttcaatgtcctggtttcactaacatttttacacacagcagagtatcttacatactatggagctttcttcctctatgctggatttgctgctgtgggactccttttcatctatggctgtcttcctgagaccaaaggcaaaaaattagaggaaattgaatcactctttgacaacaggctatgtacatgtggcacttcagattctgatgaagggagatatattgaatatattcgggtaaagggaagtaactatcatctttctgacaatgatgcttctgatgtggaataattttcagctgctcatatatttagttatttaaacaaactggggggagaagaacagcaattggtgacttcactgccctgcttctaatctggttctttccacagcctagttttgattgacttcatattctagaatacttgattaggaggaagatacaaccatgatgactttttttttccacaaggaacaatattttaaaaaatatttacagagattttaatctaataattcttaagcaaatgtgtgtaatgccttcctgaaatagtctaaaatgaatattgtacccagtgacttcagtggtatccttttttcctaagaccatttataattattagtggcaacagagtcagtgctaatctagccaaattacatatgtataatatatttataaaggattctgggagatggtccaagggtgttctgtgtcaaaagatggcctattggccctcagttttcctacagagtagtggcttatctctgatcagctgttacaaactaaattccatgtaagctttcatcaacaaattccaaagtgcctcctacaagggcacagctgtccgtatctcctttggattccatatttttgtttctctccaattcagatattgggagttcttcagatactgactctgcacactatcttttgaacattatgaaaatataatctgtcgggttgttttcatacttcctttttttgcatcagtgataaggcatacatttgcgcagatgagctaggaagttttgagaagtaccttttatgttcagaaagtaacagattaaaggtttttatgggttccaaattggttagtcacttaggtatgcaattataaatgcaaaatagtgccagatctttaactgtatatcagggtcagtttttgttcatgcccaaatcactacaccttcctcattggccttggagtcctactattttgtgccttcatttgtgttacatacatagctgcaagcaaaccatttttcccctttcttttattcaaacaataatttttgaaacaaaaaagaggaaggaaatcagtggcagaaataatcctgctgttattggtgtttgtttaataaaaataatgggacttttttcttaactttttattagctcttcctaagggaaatgtcacatattattatttaattgtacttgtctttttttactttaagagcataaactcgtttttattttgcacacttttctcattttcctgagaatttaccagaaaaaaaaagatacatagatttgtctctgtgtttttctta

SEQ ID NO: 8193 - protein, 629 aa, Homo sapiens
  Xaa in position 227 and 436 is unknown
MGERRRKQPEPDAASAAGECSLLAAAESSTSLQSAGAGGGGVGDLERAARRQFQQDETPAFVYVVAVFSALGGFLFGYDTGVVSGAMLLLKRQLSLDALWQELLVSSTVGAAAVSALAGGALNGVFGRRAAILLASALFTAGSAVLAAANNKETLLAGRLVVGLGIGIASMTVPVYIAEVSPPNLRGRLVTINTLFITGGQFFASVVDGAFSYLQKDGWRYMLGLAXVPAVIQFFGFLFLPESPRWLIQKGQTQKARRILSQMRGNQTIDEEYDSIKNNIEEEEKEVGSAGPVICRMLSYPPTRRALIVGCGLQMFQQLSGINTIMYYSATILQMSGVEDDRLAIWLASVTAFTNFIFTLVGVWLVEKVGRRKLTFGSLAGTTVALIILALGFVLSAQVSPRITFKPIAPSGQNATCTRYSYCNECMLDPDCGFCXKMNKSTVIDSSCVPVNKASTNEAAWGRCENETKFKTEDIFWAYNFCPTPYSWTALLGLILYLVFFAPGMGPMPWTVNSEIYPLWARSTGNACSSGINWIFNVLVSLTFLHTAEYLTYYGAFFLYAGFAAVGLLFIYGCLPETKGKKLEEIESLFDNRLCTCGTSDSDEGRYIEYIRVKGSNYHLSDNDASDVE

SEQ ID NO: 8194 - DNA, 2504 bp, Rattus norvegicus
  CDS (145)..(2001)
ggcacgaggcggctcagcagctggcagcgagtgcgcggcgccccacggaacttccccgcagccgcccgggcggcgtccgtctgtcccatgtcccgcaaggcgagcgaggacgtggagtacacgctgcgcagcctgagcagcctgatgggcgagaggcgccgccggcagccggagcccggggcgccgggcggggagcgcagcctcctggccgccgagtcggccgccagcctgcagggcgcggagctggagcgcgcggcgcgcaggcagttccagcgcgacgagacccccgccttcgtgtacgcggccgccgccttctccgctctcggcggcttcctgttcggctacgacaccggcgtggtgtcgggggccatgctgctgctgcggcgccagatgcgcctgggcgcgatgtggcaggagctgctggtgtcgggcgcggtgggcgcggccgccgtcgcggcgctggccggaggggccctgaacggcgccctcggtcggcgaagcgccatcctgctggccagcgccctgtgcaccgtgggctccgccgtgctggccgccgccgccaacaaggagacgctgctggccggccgcctggtcgtggggctcggcatcggcatcgcatccatgacagtgcccgtgtacatcgccgaggtctctccacccaacctgagaggtcgcttggtcaccatcaacaccctcttcatcaccggcggacagttctttgcgagcgttgttgatggagcctttagttacctgcagaaggatggatggaggtacatgttgggacttgcggccattccagccgttatacaattcctcggattcctctttttgcccgaaagtcctcggtggctgatacagaaaggacagactcagaaggcccgccgaattttgtcccagatgcgtgggaatcagaccattgacgaggagtatgacagcatcaggaacagcatcgaggaggaggagaaggaagccagcgcagctggacctataatctgcagaatgctgagttaccccccaactcgccgagcgttagctgtgggatgtggcttacagatgttccagcagctctcgggcatcaacactatcatgtactacagcgcgaccatcctgcagatgtccggcgtggaagatgatagacttgcaatatggctggcttccattacagcgttcaccaatttcattttcacactggtgggcgtctggctcgtggagaaggtgggccgcaggaagctcacctttggcagtttggcaggtaccacagtagcacttacaattcttgccttgggatttctgctctcagctcaggtctcaccacgggtcactttcagaccaacggctccctcgggtcaaaatgccacctgcacagaatacagttactgtaatgagtgtatgctggatccagactgcggtttctgctacaagatcaacagttcggctgtcattgattcctcctgtgttccggtgaacaaagcttccaccaatgaagcagcctggggcaggtgtgaaaacgaaaccaagttcaaagcagaagatgttcactgggcttacagtttctgccctaccccatactcctggacagcactcgtgggcctggtgttatatcttgttttctttgcacccggaatgggaccaatgccctggaccgtgaactctgaaatctatcctctctgggcaagaagtacaggaaatgcgtgctcagctggaataaactggattttcaacgtgctggtttcactgacctttttacacacagcggagtatcttacatactatggagcgttcttcctctacgccggattcgccgctgtgggactgcttttcgtctatggctgtcttcctgaaaccaaagggaaaaaactagaggaaatcgaatcgctcttcgaccaccggctgtgcacctgcggcaccgcggactcggacgagggcaggtacatcgagtacatccgcgtgaagggaagtaactaccatctctccgacaacgacgcctcggacgtggagtgacttccacccgatggctttccagttactgaagtgaacgtgtcgggaaggccagcggttggtcactgccctgctcacaagccgagtctccccaccgtccttgccaatgactccatattccagaagacttgatgagcagaaaaatacaactctggtgatgtttattttcatacacagaaatgctaaaaaaaaaaaataaataaataaccacagatttttcttaggcaaatgtgtacaagcccttcccgagacaatctaaacactactgttgtacccagcgacttcagttggggtccctttctccttaaaccacacataattagtggcaatacagtcagtgcttacctaggcagattatttacgtatatttataaaggattatttaaaacgatctaagaatatttaatgtcaaaacacggcctattgaccctaaattttcatatcaggtagtggcttttctctgatcagtacagagtgaatcccatctaaacttccccctcgtgccg

SEQ ID NO: 8195 - protein, 618 aa, Rattus norvegicus
MGERRRRQPEPGAPGGERSLLAAESAASLQGAELERAARRQFQRDETPAFVYAAAAFSALGGFLFGYDTGVVSGAMLLLRRQMRLGAMWQELLVSGAVGAAAVAALAGGALNGALGRRSAILLASALCTVGSAVLAAAANKETLLAGRLVVGLGIGIASMTVPVYIAEVSPPNLRGRLVTINTLFITGGQFFASVVDGAFSYLQKDGWRYMLGLAAIPAVIQFLGFLFLPESPRWLIQKGQTQKARRILSQMRGNQTIDEEYDSIRNSIEEEEKEASAAGPIICRMLSYPPTRRALAVGCGLQMFQQLSGINTIMYYSATILQMSGVEDDRLAIWLASITAFTNFIFTLVGVWLVEKVGRRKLTFGSLAGTTVALTILALGFLLSAQVSPRVTFRPTAPSGQNATCTEYSYCNECMLDPDCGFCYKINSSAVIDSSCVPVNKASTNEAAWGRCENETKFKAEDVHWAYSFCPTPYSWTALVGLVLYLVFFAPGMGPMPWTVNSEIYPLWARSTGNACSAGINWIFNVLVSLTFLHTAEYLTYYGAFFLYAGFAAVGLLFVYGCLPETKGKKLEEIESLFDHRLCTCGTADSDEGRYIEYIRVKGSNYHLSDNDASDVE

SEQ ID NO: 8196 - DNA, 3642 bp, Saccharomyces cerevisiae; identical to SEQ ID NO: 7728
  CDS (749)..(3205)

SEQ ID NO: 8197 - protein, 818 aa, Saccharomyces cerevisiae
MTSVFTDDISTIDDNSILFSEPPQKQSMMMSICVGVFVAVGGFLFGYDTGLINSITSMNYVKSHVAPNHDSFTAQQMSILVSFLSLGTFFGALTAPFISDSYGRKPTIIFSTIFIFSIGNSLQVGAGGITLLIVGRVISGIGIGAISAVVPLYQAEATHKSLRGAIISTYQWAITWGLLVSSAVSQGTHARNDASSYRIPIGLQYVWSSFLAIGMFFLPESPRYYVLKDKLDEAAKSLSFLRGVPVHDSGLLEELVEIKATYDYEASFGSSNFIDCFISSKSRPKQTLRMFTGIALQAFQQFSGINFIFYYGVNFFNKTGVSNSYLVSFITYAVNVVFNVPGLFFVEFFGRRKVLVVGGVIMTIANFIVAIVGCSLKTVAAAKVMIAFICLFIAAFSATWGGVVWVISAELYPLGVRSKCTAICAAANWLVNFICALITPYIVDTGSHTSSLGAKIFFIWGSLNAMGVIVVYLTVYETKGLTLEEIDELYIKSSTGVVSPKFNKDIRERALKFQYDPLQRLEDGKNTFVAKRNNFDDETPRNDFRNTISGEIDHSPNQKEVHSIPERVDIPTSTEILESPNKSSGMTVPVSPSLQDVPIPQTTEPAEIRTKYVDLGNGLGLNTYNRGPPSLSSDSSEDYTEDEIGGPSSQGDQSNRSTMNDINDYMARLIHSTSTASNTTDKFSGNQSTLRYHTASSHSDTTEEDSNLMDLGNGLALNAYNRGPPSILMNSSDEEANGGETSDNLNTAQDLAGMKERMAQFAQSYIDKRGGLEPETQSNILSTSLSVMADTNEHNNEILHSSEENATNQPVNENNDLK

SEQ ID NO: 8198 - DNA, 1374 bp, Lactobacillus brevis
  CDS (1)..(1374)
atgcgaaaagtttcgaccggatttgtttacttcttcggagcgctgggtgggttactttttgggtatgacactggggttatttccggagctattctctttattcagaaacagatgaacttaggatcttggcaacaaggctgggtcgttagtgcggttttgttaggggccattttaggggctgccatcattgggccttcgtctgaccgatttggtcggcggaaattattactgctttctgctattattttcttcgttggggcgttaggttccgccttttcaccagagttttggacgttaattatctcccgaattatcctggggatggccgttggggctgcttcagcattgattccgacgtatttggctgaattggcaccgtctgataagcgaggaacggtttccagtctatttcagttaatggttatgactgggattctcttggcctacatcacgaactacagtttctcaggtttctataccggctggcggtggatgttaggtttcgcggcaattcctgctgctttgctgttcttgggtgggctaattctccccgagagtccccggttcttggttaagagtgggcatctggatgaagctcggcacgtgctagacaccatgaacaagcatgaccaagtggcggtcaataaagaaattaatgatattcaagaatccgctaaaattgtgagcggtggttggtcagagttatttggtaagatggttcggccttcattgatcatcgggattggtttagccattttccaacaggtgatgggctgtaacacggtactgtactacgcaccaacaatcttcacggatgttggcttcggagtttcagccgcactgttagcgcatattggaattgggatctttaacgtgattgtgaccgcgattgcggtagccatcatggataagatcgaccggaaaaagatcgtaaatattggtgctgttgggatgggaatctccctgttcgttatgagcatcgggatgaagttctcaggtgggtcacagaccgcggcaatcatctctgtgattgctttgacagtttacatcgccttcttctccgcaacttggggtcctgtaatgtgggtcatgattggggaagtcttcccattgaacattcggggcttaggtaactcctttgctagtgtgatcaactggacagcaaacatgattgtttccttgacgttcccatctctgttggacttctttggaaccgggagcttgttcattggttacgggattctctgctttgcttccatctggttcgtccaaaagaaagtgttcgaaacacggaatcggtctttggaagatatcgaagccaccttacgtgctaagacaggcgaagatgctgctgaactaagcacgaccaaataa

SEQ ID NO: 8199 - protein, 457 aa, Lactobacillus brevis
MRKVSTGFVYFFGALGGLLFGYDTGVISGAILFIQKQMNLGSWQQGWVVSAVLLGAILGAAIIGPSSDRFGRRKLLLLSAIIFFVGALGSAFSPEFWTLIISRIILGMAVGAASALIPTYLAELAPSDKRGTVSSLFQLMVMTGILLAYITNYSFSGFYTGWRWMLGFAAIPAALLFLGGLILPESPRFLVKSGHLDEARHVLDTMNKHDQVAVNKEINDIQESAKIVSGGWSELFGKMVRPSLIIGIGLAIFQQVMGCNTVLYYAPTIFTDVGFGVSAALLAHIGIGIFNVIVTAIAVAIMDKIDRKKIVNIGAVGMGISLFVMSIGMKFSGGSQTAAIISVIALTVYIAFFSATWGPVMWVMIGEVFPLNIRGLGNSFASVINWTANMIVSLTFPSLLDFFGTGSLFIGYGILCFASIWFVQKKVFETRNRSLEDIEATLRAKTGEDAAELSTTK

SEQ ID NO: 8200 - DNA, 1500 bp, Xenopus laevis
  CDS (1)..(1500)
atggacgggaaaatgaaacagcaaaagaacctgactgggaccctgttgtttgctgtctttacagctgtgttggcctcactgcagttcggatatggtattggtgtcatcaatgctcctcaaaagattattgagaatcactatacacgggttttactagaaggcagtgcaaatgagaccgatacaaaatctgtacaaccgtctgtcaaaatgtactggtccctctctgtatctgtgttctccttgggagggatggtgtcttcattctttgttggatggattgcagataaactgggaaggataaaagccatgatggctgtaaacagtctggcagttattggggctattctgatggggctggctcccttaggtcaagcacatgctcttgtcattgctggcagattaattacaggtctttactgcggtctggcatcaggactggttcccatgtatgtcggagagatctccccaacagcacttcgaggagctttaggaacgttgcatcagttggctattgtcacagggattctcattagtcaggtggtcggacttgaatttattttgggtagtgagactctttggcctgttctgttaggcttgtcgggagtccctgctattgtgcagaccatcctgctgttcttttgccctgaaagccccagatttctgttaatcaaacttgggaagatggaagcagctaaaagaaacttaataaggctcagaggagactatgatccaacaaaagacattgaagagatgaaaaaggaaaaggaagaagtcgaaagtgaaaaaaaagtgtctatcatacagttattcaagtcttctaattaccgccagcctctaattgtttctcttgtgcttcatatctctcagcagttttccggaatcaatgggatcttttactactctacaagcatctttactagagcgggtattagccaaccagtatatgcaactattggagtcggcgctgttaacacagttttcacagtggtttcggtgttccttatagagaaggcaggtagaagatccctctatctggttggcttagccggcatgggcatctgcgctattgttatgactattgcgttggcacttctgactcagcatgcttggatgagttacctaagtatggtcgccattttccttttcgtggttttctttgaagttggcccaggtcctattccttggttcattgtcgcagaattgttcagtcaaggtccacgacctgcagctatggcagtgtctgggtgctgtaactggacatgcaactttatcattgggatgtgttttgaatacatagctgatgcctgtgggccatatgtattcatcatttttgctgtactcctttttatattcaccattttcacatactttaaagtcccggagactaagggcaagtcatttgatgagatagctgccgagttccgaaagaagaaacttgcatcccgcaaaggacttaaatcgactgaaatggagtatctgggaaccagttcggaagcataa

SEQ ID NO: 8201 - protein, 499 aa, Xenopus laevis
MDGKMKQQKNLTGTLLFAVFTAVLASLQFGYGIGVINAPQKIIENHYTRVLLEGSANETDTKSVQPSVKMYWSLSVSVFSLGGMVSSFFVGWIADKLGRIKAMMAVNSLAVIGAILMGLAPLGQAHALVIAGRLITGLYCGLASGLVPMYVGEISPTALRGALGTLHQLAIVTGILISQVVGLEFILGSETLWPVLLGLSGVPAIVQTILLFFCPESPRFLLIKLGKMEAAKRNLIRLRGDYDPTKDIEEMKKEKEEVESEKKVSIIQLFKSSNYRQPLIVSLVLHISQQFSGINGIFYYSTSIFTRAGISQPVYATIGVGAVNTVFTVVSVFLIEKAGRRSLYLVGLAGMGICAIVMTIALALLTQHAWMSYLSMVAIFLFVVFFEVGPGPIPWFIVAELFSQGPRPAAMAVSGCCNWTCNFIIGMCFEYIADACGPYVFIIFAVLLFIFTIFTYFKVPETKGKSFDEIAAEFRKKKLASRKGLKSTEMEYLGTSSEA

SEQ ID NO: 8202 - DNA, 1470 bp, Gadus morhua
  CDS (1)..(1470)
atggcggagggaaagaaagtgaccttccagctgatgctggccgtgggagccgctgtgattggctctctccagttcggctacaacaccggcgtcatcaacgcccctcagaaggtgatcgagaacttcatcaacgagacctggtcggaacggaacgagcagcccatcgaccagaccaccctcaccaccatctggtcggtgtccgtggccatcttctccgtcgggggcatcttcgggtccttctcagtcggcctgttcgtcaaccgcttcgggaggaagaactccatgctgatggccaacatcctggccttcgcctcggccgcgctgatgggcttctcccagatggccaagtcgtacgagatgctgatcatcggccgcttcgtggtggggctctactccggcctctccaccggcttcgtgcccatgtacgtgggcgaggtggcccccacagccctgcggggggcgctgggcacgctgcaccagctgggcatcgtcctggggatcctcatggctcaggtgtttggcatcgagtccttcatggggaacaaggccctctggcccctcctgctgggcttcaccttcttcccggccgtggtgcagtgcgccgtcctccccttctgtccagagagcccccgcttcctgctgctcaacaagaacgaggagaacaaggccaagagcgtgctgaagaagctccgggggtccgcggacgtgagcgccgacatgcaggagatgaagagcgagcaccggcagatgatgagggagaagaaggtgaccatccccgagctgttccgctcgccgctgtaccgccagcccatcttcatcgccatcgtgctgcagctgtcccagcagctgtcgggcatcaacgccgtcttctactactccaccagtatctttgagaaggcgggcgtggcccagcccgtctacgccaccatcggcgccggcgtggtgaacaccgccttcaccgtggtctcgctgttcgtggtggagcgcgccggccgccgctcgctgcacatgatcggcctggcgggcatggccttctctgccgtcctgatgaccatcgccctctccctgctggagaagctgccgtggatgtcgtacgtcagcatcgtggccatcttcggcttcgtggcgttcttcgagatcggcccgggccccatcccctggttcatcgtggccgagctcttctcccaggggccgcggccctccgccttcgccgtggccggcttctccaactggacggccaacttcatcgtgggaatgggcttccagtatgtcgagatggtgtgtgggccctacgtcttcatcatcttcacggtgctgctgctcttcttcctcgtcttcacgtacttcaaggtcccggagacgcgcggccgcaccttcgacgagatctcctcgggcttccggcagagcgccgggggggagaagcactcccccgaggagctggcccacagcctgggcgactcccagctctga

SEQ ID NO: 8203 - protein, 489 aa, Gadus morhua
MAEGKKVTFQLMLAVGAAVIGSLQFGYNTGVINAPQKVIENFINETWSERNEQPIDQTTLTTIWSVSVAIFSVGGIFGSFSVGLFVNRFGRKNSMLMANILAFASAALMGFSQMAKSYEMLIIGRFVVGLYSGLSTGFVPMYVGEVAPTALRGALGTLHQLGIVLGILMAQVFGIESFMGNKALWPLLLGFTFFPAVVQCAVLPFCPESPRFLLLNKNEENKAKSVLKKLRGSADVSADMQEMKSEHRQMMREKKVTIPELFRSPLYRQPIFIAIVLQLSQQLSGINAVFYYSTSIFEKAGVAQPVYATIGAGVVNTAFTVVSLFVVERAGRRSLHMIGLAGMAFSAVLMTIALSLLEKLPWMSYVSIVAIFGFVAFFEIGPGPIPWFIVAELFSQGPRPSAFAVAGFSNWTANFIVGMGFQYVEMVCGPYVFIIFTVLLLFFLVFTYFKVPETRGRTFDEISSGFRQSAGGEKHSPEELAHSLGDSQL

SEQ ID NO: 8204 - DNA, 25 bp, artificial sequence
  primer
atgggaatacacataccatatctca

SEQ ID NO: 8205 - DNA, 26 bp, artificial sequence
  primer
ctatatatcctctataatctcttgag

SEQ ID NO: 8206 - DNA, 1164 bp, Saccharomyces cerevisiae; identical to SEQ ID NO: 1121
  CDS (1)..(1164)

SEQ ID NO: 8207 - protein, 387 aa, Saccharomyces cerevisiae; identical to SEQ ID NO: 1122

SEQ ID NO: 8208 - DNA, 1041 bp, Pseudomonas aeruginosa; identical to SEQ ID NO: 1123
  CDS (1)..(1041)

SEQ ID NO: 8209 - protein, 346 aa, Pseudomonas aeruginosa; identical to SEQ ID NO: 1124

SEQ ID NO: 8210 - DNA, 1077 bp, Listeria monocytogenes; identical to SEQ ID NO: 1125
  CDS (1)..(1077)

SEQ ID NO: 8211 - protein, 358 aa, Listeria monocytogenes; identical to SEQ ID NO: 1126

SEQ ID NO: 8212 - DNA, 1053 bp, Agrobacterium tumefaciens; identical to SEQ ID NO: 1127
  CDS (1)..(1053)

SEQ ID NO: 8213 - protein, 350 aa, Agrobacterium tumefaciens; identical to SEQ ID NO: 1128

SEQ ID NO: 8214 - DNA, 1002 bp, Salmonella enterica subsp. enterica serovar Typhi; identical to SEQ ID NO: 1129
  CDS (1)..(1002)

SEQ ID NO: 8215 - protein, 333 aa, Salmonella enterica subsp. enterica serovar Typhi; identical to SEQ ID NO: 1130

SEQ ID NO: 8216 - DNA, 1038 bp, Nostoc sp. PCC 7120; identical to SEQ ID NO: 1131
  CDS (1)..(1038)

SEQ ID NO: 8217 - protein, 345 aa, Nostoc sp. PCC 7120; identical to SEQ ID NO: 1132

SEQ ID NO: 8218 - DNA, 1032 bp, Thermotoga maritima; identical to SEQ ID NO: 1133
  CDS (1)..(1032)

SEQ ID NO: 8219 - protein, 343 aa, Thermotoga maritima; identical to SEQ ID NO: 1134

SEQ ID NO: 8220 - DNA, 978 bp, Bacillus halodurans; identical to SEQ ID NO: 1135
  CDS (1)..(978)

SEQ ID NO: 8221 - protein, 325 aa, Bacillus halodurans; identical to SEQ ID NO: 1136

SEQ ID NO: 8222 - DNA, 1032 bp, Caulobacter crescentus; identical to SEQ ID NO: 1137
  CDS (1)..(1032)

SEQ ID NO: 8223 - protein, 343 aa, Caulobacter crescentus; identical to SEQ ID NO: 1138

SEQ ID NO: 8224 - DNA, 1035 bp, Clostridium acetobutylicum; identical to SEQ ID NO: 1139
  CDS (1)..(1035)

SEQ ID NO: 8225 - protein, 344 aa, Clostridium acetobutylicum; identical to SEQ ID NO: 1140

SEQ ID NO: 8226 - DNA, 1074 bp, Halobacterium sp. NRC-1; identical to SEQ ID NO: 1141
  CDS (1)..(1074)

SEQ ID NO: 8227 - protein, 357 aa, Halobacterium sp. NRC-1; identical to SEQ ID NO: 1142

SEQ ID NO: 8228 - DNA, 1029 bp, Deinococcus radiodurans; identical to SEQ ID NO: 1143
  CDS (1)..(1029)

SEQ ID NO: 8229 - protein, 342 aa, Deinococcus radiodurans; identical to SEQ ID NO: 1144

SEQ ID NO: 8230 - DNA, 1032 bp, Vibrio cholerae; identical to SEQ ID NO: 1145
  CDS (1)..(1032)

SEQ ID NO: 8231 - protein, 343 aa, Vibrio cholerae; identical to SEQ ID NO: 1146

SEQ ID NO: 8232 - DNA, 1280 bp, Escherichia coli; identical to SEQ ID NO: 1147
  CDS (61)..(1062)

SEQ ID NO: 8233 - protein, 333 aa, Escherichia coli; identical to SEQ ID NO: 1148

SEQ ID NO: 8234 - DNA, 1005 bp, Pseudomonas aeruginosa; identical to SEQ ID NO: 1149
  CDS (1)..(1005)

SEQ ID NO: 8235 - protein, 334 aa, Pseudomonas aeruginosa; identical to SEQ ID NO: 1150

SEQ ID NO: 8236 - DNA, 1080 bp, Leishmania major; identical to SEQ ID NO: 1151
  CDS (1)..(1080)

SEQ ID NO: 8237 - protein, 359 aa, Leishmania major; identical to SEQ ID NO: 1152

SEQ ID NO: 8238 - DNA, 1302 bp, Caenorhabditis elegans; identical to SEQ ID NO: 1153
  CDS (1)..(1302)

SEQ ID NO: 8239 - protein, 433 aa, Caenorhabditis elegans; identical to SEQ ID NO: 1154

SEQ ID NO: 8240 - DNA, 1212 bp, Streptomyces coelicolor; identical to SEQ ID NO: 1155
  CDS (1)..(1212)

SEQ ID NO: 8241 - protein, 403 aa, Streptomyces coelicolor; identical to SEQ ID NO: 1156

SEQ ID NO: 8242 - DNA, 1131 bp, Schizosaccharomyces pombe; identical to SEQ ID NO: 1157
  CDS (1)..(1131)

SEQ ID NO: 8243 - protein, 376 aa, Schizosaccharomyces pombe; identical to SEQ ID NO: 1158

SEQ ID NO: 8244 - DNA, 1017 bp, Aeromonas jandaei; identical to SEQ ID NO: 1159
  CDS (1)..(1017)

SEQ ID NO: 8245 - protein, 338 aa, Aeromonas jandaei; identical to SEQ ID NO: 1160

SEQ ID NO: 8246 - DNA, 1152 bp, Tolypocladium inflatum; identical to SEQ ID NO: 1161
  CDS (1)..(1152)

SEQ ID NO: 8247 - protein, 383 aa, Tolypocladium inflatum; identical to SEQ ID NO: 1162

SEQ ID NO: 8248 - DNA, 1104 bp, Debaryomyces hansenii; identical to SEQ ID NO: 1163
  CDS (1)..(1104)

SEQ ID NO: 8249 - protein, 367 aa, Debaryomyces hansenii; identical to SEQ ID NO: 1164

SEQ ID NO: 8250 - DNA, 1128 bp, Debaryomyces hansenii; identical to SEQ ID NO: 1165
  CDS (1)..(1128)

SEQ ID NO: 8251 - protein, 375 aa, Debaryomyces hansenii; identical to SEQ ID NO: 1166

SEQ ID NO: 8252 - DNA, 1071 bp, Yarrowia lipolytica; identical to SEQ ID NO: 1167
  CDS (1)..(1071)

SEQ ID NO: 8253 - protein, 356 aa, Yarrowia lipolytica; identical to SEQ ID NO: 1168

SEQ ID NO: 8254 - DNA, 1188 bp, Kluyveromyces lactis; identical to SEQ ID NO: 1169
  CDS (1)..(1188)

SEQ ID NO: 8255 - protein, 395 aa, Kluyveromyces lactis; identical to SEQ ID NO: 1170

SEQ ID NO: 8256 - DNA, 1182 bp, Kluyveromyces lactis; identical to SEQ ID NO: 1171
  CDS (1)..(1182)

SEQ ID NO: 8257 - protein, 393 aa, Kluyveromyces lactis; identical to SEQ ID NO: 1172

SEQ ID NO: 8258 - DNA, 1161 bp, Candida glabrata; identical to SEQ ID NO: 1173
  CDS (1)..(1161)

SEQ ID NO: 8259 - protein, 386 aa, Candida glabrata; identical to SEQ ID NO: 1174

SEQ ID NO: 8260 - DNA, 1026 bp, Staphylococcus aureus subsp; identical to SEQ ID NO: 1175
  CDS (1)..(1026)

SEQ ID NO: 8261 - protein, 341 aa, Staphylococcus aureus subsp; identical to SEQ ID NO: 1176

SEQ ID NO: 8262 - DNA, 1008 bp, Photobacterium profundum; identical to SEQ ID NO: 1177
  CDS (1)..(1008)

SEQ ID NO: 8263 - protein, 335 aa, Photobacterium profundum; identical to SEQ ID NO: 1178

SEQ ID NO: 8264 - DNA, 1026 bp, Bdellovibrio bacteriovorus; identical to SEQ ID NO: 1179
  CDS (1)..(1026)

SEQ ID NO: 8265 - protein, 341 aa, Bdellovibrio bacteriovorus; identical to SEQ ID NO: 1180

SEQ ID NO: 8266 - DNA, 1101 bp, Rhodopseudomonas palustris; identical to SEQ ID NO: 1181
  CDS (1)..(1101)

SEQ ID NO: 8267 - protein, 366 aa, Rhodopseudomonas palustris; identical to SEQ ID NO: 1182

SEQ ID NO: 8268 - DNA, 1083 bp, Rhodopseudomonas palustris; identical to SEQ ID NO: 1183
  CDS (1)..(1083)

SEQ ID NO: 8269 - protein, 360 aa, Rhodopseudomonas palustris; identical to SEQ ID NO: 1184

SEQ ID NO: 8270 - DNA, 1855 bp, Mus musculus; identical to SEQ ID NO: 1185
  CDS (128)..(1330)

SEQ ID NO: 8271 - protein, 400 aa, Mus musculus; identical to SEQ ID NO: 1186

SEQ ID NO: 8272 - DNA, 1080 bp, Listeria monocytogenes; identical to SEQ ID NO: 1187
  CDS (1)..(1080)

SEQ ID NO: 8273 - protein, 359 aa, Listeria monocytogenes; identical to SEQ ID NO: 1188

SEQ ID NO: 8274 - DNA, 1023 bp, Desulfovibrio vulgaris; identical to SEQ ID NO: 1189
  CDS (1)..(1023)

SEQ ID NO: 8275 - protein, 340 aa, Desulfovibrio vulgaris; identical to SEQ ID NO: 1190

SEQ ID NO: 8276 - DNA, 1023 bp, Thermus thermophilus; identical to SEQ ID NO: 1191
  CDS (1)..(1023)

SEQ ID NO: 8277 - protein, 340 aa, Thermus thermophilus; identical to SEQ ID NO: 1192

SEQ ID NO: 8278 - DNA, 1053 bp, Wolbachia pipientis wMel; identical to SEQ ID NO: 1193
  CDS (1)..(1053)

SEQ ID NO: 8279 - protein, 350 aa, Wolbachia pipientis wMel; identical to SEQ ID NO: 1194

SEQ ID NO: 8280 - DNA, 1050 bp, Wolbachia pipientis wMel; identical to SEQ ID NO: 1195
  CDS (1)..(1050)

SEQ ID NO: 8281 - protein, 349 aa, Wolbachia pipientis wMel; identical to SEQ ID NO: 1196

SEQ ID NO: 8282 - DNA, 1056 bp, Treponema denticola; identical to SEQ ID NO: 1197
  CDS (1)..(1056)

SEQ ID NO: 8283 - protein, 351 aa, Treponema denticola; identical to SEQ ID NO: 1198

SEQ ID NO: 8284 - DNA, 1056 bp, Geobacter sulfurreducens; identical to SEQ ID NO: 1199
  CDS (1)..(1056)

SEQ ID NO: 8285 - protein, 351 aa, Geobacter sulfurreducens; identical to SEQ ID NO: 1200

SEQ ID NO: 8286 - DNA, 1047 bp, Geobacter sulfurreducens; identical to SEQ ID NO: 1201
  CDS (1)..(1047)

SEQ ID NO: 8287 - protein, 348 aa, Geobacter sulfurreducens; identical to SEQ ID NO: 1202

SEQ ID NO: 8288 - DNA, 1056 bp, Yersinia pestis; identical to SEQ ID NO: 1203
  CDS (1)..(1056)

SEQ ID NO: 8289 - protein, 351 aa, Yersinia pestis; identical to SEQ ID NO: 1204

SEQ ID NO: 8290 - DNA, 1140 bp, Ashbya gossypii; identical to SEQ ID NO: 1205
  CDS (1)..(1140)

SEQ ID NO: 8291 - protein, 379 aa, Ashbya gossypii; identical to SEQ ID NO: 1206

SEQ ID NO: 8292 - DNA, 1008 bp, Vibrio vulnificus; identical to SEQ ID NO: 1207
  CDS (1)..(1008)

SEQ ID NO: 8293 - protein, 335 aa, Vibrio vulnificus; identical to SEQ ID NO: 1208

SEQ ID NO: 8294 - DNA, 1038 bp, Porphyromonas gingivalis; identical to SEQ ID NO: 1209
  CDS (1)..(1038)

SEQ ID NO: 8295 - protein, 345 aa, Porphyromonas gingivalis; identical to SEQ ID NO: 1210

SEQ ID NO: 8296 - DNA, 1035 bp, Gloeobacter violaceus; identical to SEQ ID NO: 1211
  CDS (1)..(1035)

SEQ ID NO: 8297 - protein, 344 aa, Gloeobacter violaceus; identical to SEQ ID NO: 1212

SEQ ID NO: 8298 - DNA, 1029 bp, Chromobacterium violaceum; identical to SEQ ID NO: 1213
  CDS (1)..(1029)

SEQ ID NO: 8299 - protein, 342 aa, Chromobacterium violaceum; identical to SEQ ID NO: 1214

SEQ ID NO: 8300 - DNA, 1047 bp, Fusobacterium nucleatum subsp; identical to SEQ ID NO: 1215
  CDS (1)..(1047)

SEQ ID NO: 8301 - protein, 348 aa, Fusobacterium nucleatum subsp; identical to SEQ ID NO: 1216

SEQ ID NO: 8302 - DNA, 1083 bp, Neurospora crassa; identical to SEQ ID NO: 1217
  CDS (1)..(1083)

SEQ ID NO: 8303 - protein, 360 aa, Neurospora crassa; identical to SEQ ID NO: 1218

SEQ ID NO: 8304 - DNA, 1020 bp, Bordetella pertussis; identical to SEQ ID NO: 1219
  CDS (1)..(1020)

SEQ ID NO: 8305 - protein, 339 aa, Bordetella pertussis; identical to SEQ ID NO: 1220

SEQ ID NO: 8306 - DNA, 1376 bp, Oryza sativa; identical to SEQ ID NO: 1221
  CDS (115)..(1233)

SEQ ID NO: 8307 - protein, 372 aa, Oryza sativa; identical to SEQ ID NO: 1222

SEQ ID NO: 8308 - DNA, 1242 bp, Streptomyces avermitilis; identical to SEQ ID NO: 1223
  CDS (1)..(1242)

SEQ ID NO: 8309 - protein, 413 aa, Streptomyces avermitilis; identical to SEQ ID NO: 1224

SEQ ID NO: 8310 - DNA, 1071 bp, Streptomyces avermitilis; identical to SEQ ID NO: 1225
  CDS (1)..(1071)

SEQ ID NO: 8311 - protein, 356 aa, Streptomyces avermitilis; identical to SEQ ID NO: 1226

SEQ ID NO: 8312 - DNA, 1005 bp, Vibrio parahaemolyticus; identical to SEQ ID NO: 1227
  CDS (1)..(1005)

SEQ ID NO: 8313 - protein, 334 aa, Vibrio parahaemolyticus; identical to SEQ ID NO: 1228

SEQ ID NO: 8314 - DNA, 1077 bp, Vibrio parahaemolyticus; identical to SEQ ID NO: 1229
  CDS (1)..(1077)

SEQ ID NO: 8315 - protein, 358 aa, Vibrio parahaemolyticus; identical to SEQ ID NO: 1230

SEQ ID NO: 8316 - DNA, 1005 bp, Pseudomonas syringae; identical to SEQ ID NO: 1231
  CDS (1)..(1005)

SEQ ID NO: 8317 - protein, 334 aa, Pseudomonas syringae; identical to SEQ ID NO: 1232

SEQ ID NO: 8318 - DNA, 1041 bp, Pseudomonas syringae; identical to SEQ ID NO: 1233
  CDS (1)..(1041)

SEQ ID NO: 8319 - protein, 346 aa, Pseudomonas syringae; identical to SEQ ID NO: 1234

SEQ ID NO: 8320 - DNA, 1041 bp, Pseudomonas putida; identical to SEQ ID NO: 1235
  CDS (1)..(1041)

SEQ ID NO: 8321 - protein, 346 aa, Pseudomonas putida; identical to SEQ ID NO: 1236

SEQ ID NO: 8322 - DNA, 1026 bp, Clostridium tetani; identical to SEQ ID NO: 1237
  CDS (1)..(1026)

SEQ ID NO: 8323 - protein, 341 aa, Clostridium tetani; identical to SEQ ID NO: 1238

SEQ ID NO: 8324 - DNA, 1083 bp, Bradyrhizobium japonicum; identical to SEQ ID NO: 1239
  CDS (1)..(1083)

SEQ ID NO: 8325 - protein, 360 aa, Bradyrhizobium japonicum; identical to SEQ ID NO: 1240

SEQ ID NO: 8326 - DNA, 1044 bp, Bradyrhizobium japonicum; identical to SEQ ID NO: 1241
  CDS (1)..(1044)

SEQ ID NO: 8327 - protein, 347 aa, Bradyrhizobium japonicum; identical to SEQ ID NO: 1242

SEQ ID NO: 8328 - DNA, 1014 bp, Bacteroides thetaiotaomicron; identical to SEQ ID NO: 1243
  CDS (1)..(1014)

SEQ ID NO: 8329 - protein, 337 aa, Bacteroides thetaiotaomicron; identical to SEQ ID NO: 1244

SEQ ID NO: 8330 - DNA, 1077 bp, Vibrio vulnificus; identical to SEQ ID NO: 1245
  CDS (1)..(1077)

SEQ ID NO: 8331 - protein, 358 aa, Vibrio vulnificus; identical to SEQ ID NO: 1246

SEQ ID NO: 8332 - DNA, 1026 bp, Streptococcus agalactiae; identical to SEQ ID NO: 1247
  CDS (1)..(1026)

SEQ ID NO: 8333 - protein, 341 aa, Streptococcus agalactiae; identical to SEQ ID NO: 1248

SEQ ID NO: 8334 - DNA, 1014 bp, Shewanella oneidensis; identical to SEQ ID NO: 1249
  CDS (1)..(1014)

SEQ ID NO: 8335 - protein, 337 aa, Shewanella oneidensis; identical to SEQ ID NO: 1250

SEQ ID NO: 8336 - DNA, 1002 bp, Escherichia coli O6; identical to SEQ ID NO: 1251
  CDS (1)..(1002)

SEQ ID NO: 8337 - protein, 333 aa, Escherichia coli O6; identical to SEQ ID NO: 1252

SEQ ID NO: 8338 - DNA, 1026 bp, Bifidobacterium longum; identical to SEQ ID NO: 1253
  CDS (1)..(1026)

SEQ ID NO: 8339 - protein, 341 aa, Bifidobacterium longum; identical to SEQ ID NO: 1254

SEQ ID NO: 8340 - DNA, 1116 bp, Rhizobium loti; identical to SEQ ID NO: 1255
  CDS (1)..(1116)

SEQ ID NO: 8341 - protein, 371 aa, Rhizobium loti; identical to SEQ ID NO: 1256

SEQ ID NO: 8342 - DNA, 1074 bp, Xanthomonas campestris; identical to SEQ ID NO: 1257
  CDS (1)..(1074)

SEQ ID NO: 8343 - protein, 357 aa, Xanthomonas campestris; identical to SEQ ID NO: 1258

SEQ ID NO: 8344 - DNA, 1065 bp, Xanthomonas axonopodis; identical to SEQ ID NO: 1259
  CDS (1)..(1065)

SEQ ID NO: 8345 - protein, 354 aa, Xanthomonas axonopodis; identical to SEQ ID NO: 1260

SEQ ID NO: 8346 - DNA, 1041 bp, Thermoanaerobacter tengcongensis; identical to SEQ ID NO: 1261
  CDS (1)..(1041)

SEQ ID NO: 8347 - protein, 346 aa, Thermoanaerobacter tengcongensis; identical to SEQ ID NO: 1262

SEQ ID NO: 8348 - DNA, 1023 bp, Fusobacterium nucleatum; identical to SEQ ID NO: 1263
  CDS (1)..(1023)

SEQ ID NO: 8349 - protein, 340 aa, Fusobacterium nucleatum; identical to SEQ ID NO: 1264

SEQ ID NO: 8350 - DNA, 1533 bp, Arabidopsis thaliana; identical to SEQ ID NO: 1265
  CDS (303)..(1379)

SEQ ID NO: 8351 - protein, 358 aa, Arabidopsis thaliana; identical to SEQ ID NO: 1266

SEQ ID NO: 8352 - DNA, 1098 bp, Ralstonia solanacearum; identical to SEQ ID NO: 1267
  CDS (1)..(1098)

SEQ ID NO: 8353 - protein, 365 aa, Ralstonia solanacearum; identical to SEQ ID NO: 1268

SEQ ID NO: 8354 - DNA, 1038 bp, Ralstonia solanacearum; identical to SEQ ID NO: 1269
  CDS (1)..(1038)

SEQ ID NO: 8355 - protein, 345 aa, Ralstonia solanacearum; identical to SEQ ID NO: 1270

SEQ ID NO: 8356 - DNA, 1002 bp, Salmonella typhimurium; identical to SEQ ID NO: 1271
  CDS (1)..(1002)

SEQ ID NO: 8357 - protein, 333 aa, Salmonella typhimurium; identical to SEQ ID NO: 1272

SEQ ID NO: 8358 - DNA, 1047 bp, Rhizobium meliloti; identical to SEQ ID NO: 1273
  CDS (1)..(1047)

SEQ ID NO: 8359 - protein, 348 aa, Rhizobium meliloti; identical to SEQ ID NO: 1274

SEQ ID NO: 8360 - DNA, 1092 bp, Rhizobium loti; identical to SEQ ID NO: 1275
  CDS (1)..(1092)

SEQ ID NO: 8361 - protein, 363 aa, Rhizobium loti; identical to SEQ ID NO: 1276

SEQ ID NO: 8362 - DNA, 1313 bp, Arabidopsis thaliana; identical to SEQ ID NO: 1277
  CDS (91)..(1158)

SEQ ID NO: 8363 - protein, 355 aa, Arabidopsis thaliana; identical to SEQ ID NO: 1278

SEQ ID NO: 8364 - DNA, 1059 bp, Arabidopsis thaliana; identical to SEQ ID NO: 1279
  CDS (1)..(1059)

SEQ ID NO: 8365 - protein, 352 aa, Arabidopsis thaliana; identical to SEQ ID NO: 1280

SEQ ID NO: 8366 - DNA, 1071 bp, Streptomyces coelicolor; identical to SEQ ID NO: 1281
  CDS (1)..(1071)

SEQ ID NO: 8367 - protein, 356 aa, Streptomyces coelicolor; identical to SEQ ID NO: 1282

SEQ ID NO: 8368 - DNA, 1113 bp, Arabidopsis thaliana; identical to SEQ ID NO: 1283
  CDS (1)..(1113)

SEQ ID NO: 8369 - protein, 370 aa, Arabidopsis thaliana; identical to SEQ ID NO: 1284

SEQ ID NO: 8370 - DNA, 1327 bp, Drosophila melanogaster; identical to SEQ ID NO: 1285
  CDS (79)..(1230)

SEQ ID NO: 8371 - protein, 383 aa, Drosophila melanogaster; identical to SEQ ID NO: 1286

SEQ ID NO: 8372 - DNA, 1014 bp, Zymomonas mobilis; identical to SEQ ID NO: 1287
  CDS (1)..(1014)

SEQ ID NO: 8373 - protein, 337 aa, Zymomonas mobilis; identical to SEQ ID NO: 1288

SEQ ID NO: 8374 - DNA, 1149 bp, Ashbya gossypii; identical to SEQ ID NO: 1289
  CDS (1)..(1149)

SEQ ID NO: 8375 - protein, 382 aa, Ashbya gossypii; identical to SEQ ID NO: 1290

SEQ ID NO: 8376 - DNA, 1530 bp, Candida albicans; identical to SEQ ID NO: 1291
  CDS (117)..(1241)

SEQ ID NO: 8377 - protein, 374 aa, Candida albicans; identical to SEQ ID NO: 1292

SEQ ID NO: 8378 - DNA, 1041 bp, Pseudomonas sp; identical to SEQ ID NO: 1293
  CDS (1)..(1041)

SEQ ID NO: 8379 - protein, 346 aa, Pseudomonas sp; identical to SEQ ID NO: 1294

SEQ ID NO: 8380 - DNA, 1170 bp, Cochliobolus carbonum; identical to SEQ ID NO: 1295
  CDS (1)..(1170)

SEQ ID NO: 8381 - protein, 389 aa, Cochliobolus carbonum; identical to SEQ ID NO: 1296

SEQ ID NO: 8382 - DNA, 25 bp, artificial sequence
  primer
atgactgaattcgaattgcctccaa

SEQ ID NO: 8383 - DNA, 26 bp, artificial sequence
  primer
tcagtatttgtaggtttttatttcgc

SEQ ID NO: 8384 - DNA, 2772 bp, Saccharomyces cerevisiae; identical to SEQ ID NO: 2477
  CDS (1)..(2772)

SEQ ID NO: 8385 - protein, 923 aa, Saccharomyces cerevisiae; identical to SEQ ID NO: 2478

SEQ ID NO: 8386 - DNA, 2296 bp, Rattus norvegicus (Norway rat); identical to SEQ ID NO: 2479
  CDS (63)..(2039)

SEQ ID NO: 8387 - protein, 658 aa, Rattus norvegicus (Norway rat); identical to SEQ ID NO: 2480

SEQ ID NO: 8388 - DNA, 2255 bp, Homo sapiens (man); identical to SEQ ID NO: 2481
  CDS (102)..(2078)

SEQ ID NO: 8389 - protein, 658 aa, Homo sapiens (man); identical to SEQ ID NO: 2482

SEQ ID NO: 8390 - DNA, 4377 bp, Rattus norvegicus (Norway rat); identical to SEQ ID NO: 2483
  CDS (103)..(2424)

SEQ ID NO: 8391 - protein, 773 aa, Rattus norvegicus (Norway rat); identical to SEQ ID NO: 2484

SEQ ID NO: 8392 - DNA, 2300 bp, Mus musculus (house mouse); identical to SEQ ID NO: 2485
  CDS (69)..(2045)

SEQ ID NO: 8393 - protein, 658 aa, Mus musculus (house mouse); identical to SEQ ID NO: 2486

SEQ ID NO: 8394 - DNA, 2013 bp, Saccharomyces cerevisiae; identical to SEQ ID NO: 2487
  CDS (1)..(2013)

SEQ ID NO: 8395 - protein, 670 aa, Saccharomyces cerevisiae; identical to SEQ ID NO: 2488

SEQ ID NO: 8396 - DNA, 2064 bp, Saccharomyces cerevisiae; identical to SEQ ID NO: 2489
  CDS (1)..(2064)

SEQ ID NO: 8397 - protein, 687 aa, Saccharomyces cerevisiae; identical to SEQ ID NO: 2490

SEQ ID NO: 8398 - DNA, 1941 bp, Caenorhabditis elegans; identical to SEQ ID NO: 2491
  CDS (1)..(1941)

SEQ ID NO: 8399 - protein, 646 aa, Caenorhabditis elegans; identical to SEQ ID NO: 2492

SEQ ID NO: 8400 - DNA, 2415 bp, Emericella nidulans; identical to SEQ ID NO: 2493
  CDS (1)..(2415)

SEQ ID NO: 8401 - protein, 804 aa, Emericella nidulans; identical to SEQ ID NO: 2494

SEQ ID NO: 8402 - DNA, 2601 bp, Debaryomyces hansenii; identical to SEQ ID NO: 2495
  CDS (1)..(2601)

SEQ ID NO: 8403 - protein, 866 aa, Debaryomyces hansenii; identical to SEQ ID NO: 2496

SEQ ID NO: 8404 - DNA, 1899 bp, Debaryomyces hansenii; identical to SEQ ID NO: 2497
  CDS (1)..(1899)

SEQ ID NO: 8405 - protein, 632 aa, Debaryomyces hansenii; identical to SEQ ID NO: 2498

SEQ ID NO: 8406 - DNA, 2259 bp, Debaryomyces hansenii; identical to SEQ ID NO: 2499
  CDS (1)..(2259)

SEQ ID NO: 8407 - protein, 752 aa, Debaryomyces hansenii; identical to SEQ ID NO: 2500

SEQ ID NO: 8408 - DNA, 2244 bp, Yarrowia lipolytica; identical to SEQ ID NO: 2501
  CDS (1)..(2244)

SEQ ID NO: 8409 - protein, 747 aa, Yarrowia lipolytica; identical to SEQ ID NO: 2502

SEQ ID NO: 8410 - DNA, 2598 bp, Kluyveromyces lactis; identical to SEQ ID NO: 2503
  CDS (1)..(2598)

SEQ ID NO: 8411 - protein, 865 aa, Kluyveromyces lactis; identical to SEQ ID NO: 2504

SEQ ID NO: 8412 - DNA, 2079 bp, Kluyveromyces lactis; identical to SEQ ID NO: 2505
  CDS (1)..(2079)

SEQ ID NO: 8413 - protein, 692 aa, Kluyveromyces lactis; identical to SEQ ID NO: 2506

SEQ ID NO: 8414 - DNA, 2034 bp, Kluyveromyces lactis; identical to SEQ ID NO: 2507
  CDS (1)..(2034)

SEQ ID NO: 8415 - protein, 677 aa, Kluyveromyces lactis; identical to SEQ ID NO: 2508

SEQ ID NO: 8416 - DNA, 1989 bp, Candida glabrata; identical to SEQ ID NO: 2509
  CDS (1)..(1989)

SEQ ID NO: 8417 - protein, 662 aa, Candida glabrata; identical to SEQ ID NO: 2510

SEQ ID NO: 8418 - DNA, 2856 bp, Candida glabrata; identical to SEQ ID NO: 2511
  CDS (1)..(2856)

SEQ ID NO: 8419 - protein, 951 aa, Candida glabrata; identical to SEQ ID NO: 2512

SEQ ID NO: 8420 - DNA, 2052 bp, Ashbya gossypii; identical to SEQ ID NO: 2513
  CDS (1)..(2052)

SEQ ID NO: 8421 - protein, 683 aa, Ashbya gossypii; identical to SEQ ID NO: 2514

SEQ ID NO: 8422 - DNA, 2535 bp, Ashbya gossypii; identical to SEQ ID NO: 2515
  CDS (1)..(2535)

SEQ ID NO: 8423 - protein, 844 aa, Ashbya gossypii; identical to SEQ ID NO: 2516

SEQ ID NO: 8424 - DNA, 1830 bp, Neurospora crassa; identical to SEQ ID NO: 2517
  CDS (1)..(1830)

SEQ ID NO: 8425 - protein, 609 aa, Neurospora crassa; identical to SEQ ID NO: 2518

SEQ ID NO: 8426 - DNA, 2388 bp, Candida albicans; identical to SEQ ID NO: 2519
  CDS (1)..(2388)

SEQ ID NO: 8427 - protein, 795 aa, Candida albicans; identical to SEQ ID NO: 2520

SEQ ID NO: 8428 - DNA, 2418 bp, Aspergillus fumigatus; identical to SEQ ID NO: 2521
  CDS (1)..(2418)

SEQ ID NO: 8429 - protein, 805 aa, Aspergillus fumigatus; identical to SEQ ID NO: 2522

SEQ ID NO: 8430 - DNA, 2757 bp, Neurospora crassa; identical to SEQ ID NO: 2523
  CDS (1)..(2757)

SEQ ID NO: 8431 - protein, 918 aa, Neurospora crassa; identical to SEQ ID NO: 2524

SEQ ID NO: 8432 - DNA, 2239 bp, Drosophila melanogaster; identical to SEQ ID NO: 2525
  CDS (76)..(2079)

SEQ ID NO: 8433 - protein, 667 aa, Drosophila melanogaster; identical to SEQ ID NO: 2526

SEQ ID NO: 8434 - DNA, 3100 bp, Saccharomyces cerevisiae; identical to SEQ ID NO: 2527
  CDS (821)..(2887)

SEQ ID NO: 8435 - protein, 688 aa, Saccharomyces cerevisiae; identical to SEQ ID NO: 2528

SEQ ID NO: 8436 - DNA, 2266 bp, Xenopus tropicalis; identical to SEQ ID NO: 2529
  CDS (36)..(2012)

SEQ ID NO: 8437 - protein, 658 aa, Xenopus tropicalis; identical to SEQ ID NO: 2530

SEQ ID NO: 8438 - DNA, 25 bp, artificial sequence
  primer
atgtcaagcggcagtactattgttt

SEQ ID NO: 8439 - DNA, 25 bp, artificial sequence
  primer
ttattgatctaaggtcgccaccttt

SEQ ID NO: 8440 - DNA, 1390 bp, Saccharomyces cerevisiae; identical to SEQ ID NO: 531
  CDS (303)..(1118)

SEQ ID NO: 8441 - protein, 271 aa, Saccharomyces cerevisiae; identical to SEQ ID NO: 532

SEQ ID NO: 8442 - DNA, 714 bp, Deinococcus radiodurans; identical to SEQ ID NO: 533
  CDS (1)..(714)

SEQ ID NO: 8443 - protein, 237 aa, Deinococcus radiodurans; identical to SEQ ID NO: 534

SEQ ID NO: 8444 - DNA, 1350 bp, Nostoc sp. PCC 7120; identical to SEQ ID NO: 535
  CDS (1)..(1350)

SEQ ID NO: 8445 - protein, 449 aa, Nostoc sp. PCC 7120; identical to SEQ ID NO: 536

SEQ ID NO: 8446 - DNA, 636 bp, Listeria monocytogenes; identical to SEQ ID NO: 537
  CDS (1)..(636)

SEQ ID NO: 8447 - protein, 211 aa, Listeria monocytogenes; identical to SEQ ID NO: 538

SEQ ID NO: 8448 - DNA, 636 bp, Listeria innocua; identical to SEQ ID NO: 539
  CDS (1)..(636)

SEQ ID NO: 8449 - protein, 211 aa, Listeria innocua; identical to SEQ ID NO: 540

SEQ ID NO: 8450 - DNA, 654 bp, Brucella melitensis; identical to SEQ ID NO: 541
  CDS (1)..(654)

SEQ ID NO: 8451 - protein, 217 aa, Brucella melitensis; identical to SEQ ID NO: 542

SEQ ID NO: 8452 - DNA, 813 bp, Nostoc sp. PCC 7120; identical to SEQ ID NO: 543
  CDS (1)..(813)

SEQ ID NO: 8453 - protein, 270 aa, Nostoc sp. PCC 7120; identical to SEQ ID NO: 544

SEQ ID NO: 8454 - DNA, 615 bp, Deinococcus radiodurans; identical to SEQ ID NO: 545
  CDS (1)..(615)

SEQ ID NO: 8455 - protein, 204 aa, Deinococcus radiodurans; identical to SEQ ID NO: 546

SEQ ID NO: 8456 - DNA, 714 bp, Caulobacter crescentus; identical to SEQ ID NO: 547
  CDS (1)..(714)

SEQ ID NO: 8457 - protein, 237 aa, Caulobacter crescentus; identical to SEQ ID NO: 548

SEQ ID NO: 8458 - DNA, 756 bp, Treponema pallidum subsp. pallidum (syphilis spirochete); identical to SEQ ID NO: 549
  CDS (1)..(756)

SEQ ID NO: 8459 - protein, 251 aa, Treponema pallidum subsp. pallidum (syphilis spirochete); identical to SEQ ID NO: 550

SEQ ID NO: 8460 - DNA, 645 bp, Xylella fastidiosa; identical to SEQ ID NO: 551
  CDS (1)..(645)

SEQ ID NO: 8461 - protein, 214 aa, Xylella fastidiosa; identical to SEQ ID NO: 552

SEQ ID NO: 8462 - DNA, 2034 bp, Arabidopsis thaliana (mouse-ear cress); identical to SEQ ID NO: 553
  CDS (1)..(2034)

SEQ ID NO: 8463 - protein, 677 aa, Arabidopsis thaliana (mouse-ear cress); identical to SEQ ID NO: 554

SEQ ID NO: 8464 - DNA, 582 bp, Bacillus subtilis; identical to SEQ ID NO: 555
  CDS (1)..(582)

SEQ ID NO: 8465 - protein, 193 aa, Bacillus subtilis; identical to SEQ ID NO: 556

SEQ ID NO: 8466 - DNA, 606 bp, Thermotoga maritima; identical to SEQ ID NO: 557
  CDS (1)..(606)

SEQ ID NO: 8467 - protein, 201 aa, Thermotoga maritima; identical to SEQ ID NO: 558

SEQ ID NO: 8468 - DNA, 660 bp, Clostridium acetobutylicum; identical to SEQ ID NO: 559
  CDS (1)..(660)

SEQ ID NO: 8469 - protein, 219 aa, Clostridium acetobutylicum; identical to SEQ ID NO: 560

SEQ ID NO: 8470 - DNA, 744 bp, Saccharomyces cerevisiae; identical to SEQ ID NO: 561
  CDS (1)..(744)

SEQ ID NO: 8471 - protein, 247 aa, Saccharomyces cerevisiae; identical to SEQ ID NO: 562

SEQ ID NO: 8472 - DNA, 1050 bp, Synechocystis sp; identical to SEQ ID NO: 563
  CDS (1)..(1050)

SEQ ID NO: 8473 - protein, 349 aa, Synechocystis sp; identical to SEQ ID NO: 564

SEQ ID NO: 8474 - DNA, 875 bp, Arabidopsis thaliana (mouse-ear cress); identical to SEQ ID NO: 565
  CDS (30)..(722)

SEQ ID NO: 8475 - protein, 230 aa, Arabidopsis thaliana (mouse-ear cress); identical to SEQ ID NO: 566

SEQ ID NO: 8476 - DNA, 741 bp, Debaryomyces hansenii; identical to SEQ ID NO: 567
  CDS (1)..(741)

SEQ ID NO: 8477 - protein, 246 aa, Debaryomyces hansenii; identical to SEQ ID NO: 568

SEQ ID NO: 8478 - DNA, 741 bp, Yarrowia lipolytica; identical to SEQ ID NO: 569
  CDS (1)..(741)

SEQ ID NO: 8479 - protein, 246 aa, Yarrowia lipolytica; identical to SEQ ID NO: 570

SEQ ID NO: 8480 - DNA, 816 bp, Kluyveromyces lactis; identical to SEQ ID NO: 571
  CDS (1)..(816)

SEQ ID NO: 8481 - protein, 271 aa, Kluyveromyces lactis; identical to SEQ ID NO: 572

SEQ ID NO: 8482 - DNA, 687 bp, Kluyveromyces lactis; identical to SEQ ID NO: 573
  CDS (1)..(687)

SEQ ID NO: 8483 - protein, 228 aa, Kluyveromyces lactis; identical to SEQ ID NO: 574

SEQ ID NO: 8484 - DNA, 651 bp, Erwinia carotovora subsp; identical to SEQ ID NO: 575
  CDS (1)..(651)

SEQ ID NO: 8485 - protein, 216 aa, Erwinia carotovora subsp; identical to SEQ ID NO: 576

SEQ ID NO: 8486 - DNA, 840 bp, Candida glabrata; identical to SEQ ID NO: 577
  CDS (1)..(840)

SEQ ID NO: 8487 - protein, 279 aa, Candida glabrata; identical to SEQ ID NO: 578

SEQ ID NO: 8488 - DNA, 744 bp, Candida glabrata; identical to SEQ ID NO: 579
  CDS (1)..(744)

SEQ ID NO: 8489 - protein, 247 aa, Candida glabrata; identical to SEQ ID NO: 580

SEQ ID NO: 8490 - DNA, 621 bp, Bartonella quintana; identical to SEQ ID NO: 581
  CDS (1)..(621)

SEQ ID NO: 8491 - protein, 206 aa, Bartonella quintana; identical to SEQ ID NO: 582

SEQ ID NO: 8492 - DNA, 648 bp, Parachlamydia sp; identical to SEQ ID NO: 583
  CDS (1)..(648)

SEQ ID NO: 8493 - protein, 215 aa, Parachlamydia sp; identical to SEQ ID NO: 584

SEQ ID NO: 8494 - DNA, 636 bp, Listeria monocytogenes; identical to SEQ ID NO: 585
  CDS (1)..(636)

SEQ ID NO: 8495 - protein, 211 aa, Listeria monocytogenes; identical to SEQ ID NO: 586

SEQ ID NO: 8496 - DNA, 633 bp, Thermus thermophilus; identical to SEQ ID NO: 587
  CDS (1)..(633)

SEQ ID NO: 8497 - protein, 210 aa, Thermus thermophilus; identical to SEQ ID NO: 588

SEQ ID NO: 8498 - DNA, 654 bp, Mycobacterium paratuberculosis; identical to SEQ ID NO: 589
  CDS (1)..(654)

SEQ ID NO: 8499 - protein, 217 aa, Mycobacterium paratuberculosis; identical to SEQ ID NO: 590

SEQ ID NO: 8500 - DNA, 1134 bp, Mycobacterium paratuberculosis; identical to SEQ ID NO: 591
  CDS (1)..(1134)

SEQ ID NO: 8501 - protein, 377 aa, Mycobacterium paratuberculosis; identical to SEQ ID NO: 592

SEQ ID NO: 8502 - DNA, 627 bp, Lactobacillus johnsonii; identical to SEQ ID NO: 593
  CDS (1)..(627)

SEQ ID NO: 8503 - protein, 208 aa, Lactobacillus johnsonii; identical to SEQ ID NO: 594

SEQ ID NO: 8504 - DNA, 807 bp, Ashbya gossypii; identical to SEQ ID NO: 595
  CDS (1)..(807)

SEQ ID NO: 8505 - protein, 268 aa, Ashbya gossypii; identical to SEQ ID NO: 596

SEQ ID NO: 8506 - DNA, 687 bp, Mycobacterium tuberculosis; identical to SEQ ID NO: 597
  CDS (1)..(687)

SEQ ID NO: 8507 - protein, 228 aa, Mycobacterium tuberculosis; identical to SEQ ID NO: 598

SEQ ID NO: 8508 - DNA, 618 bp, Photorhabdus luminescens; identical to SEQ ID NO: 599
  CDS (1)..(618)

SEQ ID NO: 8509 - protein, 205 aa, Photorhabdus luminescens; identical to SEQ ID NO: 600

SEQ ID NO: 8510 - DNA, 588 bp, Anopheles gambiae str; identical to SEQ ID NO: 601
  CDS (1)..(588)

SEQ ID NO: 8511 - protein, 195 aa, Anopheles gambiae str; identical to SEQ ID NO: 602

SEQ ID NO: 8512 - DNA, 3762 bp, Neurospora crassa; identical to SEQ ID NO: 603
  CDS (1)..(3762)

SEQ ID NO: 8513 - protein, 1253 aa, Neurospora crassa; identical to SEQ ID NO: 604

SEQ ID NO: 8514 - DNA, 567 bp, Synechococcus sp; identical to SEQ ID NO: 605
  CDS (1)..(567)

SEQ ID NO: 8515 - protein, 188 aa, Synechococcus sp; identical to SEQ ID NO: 606

SEQ ID NO: 8516 - DNA, 612 bp, Rhodopirellula baltica; identical to SEQ ID NO: 607
  CDS (1)..(612)

SEQ ID NO: 8517 - protein, 203 aa, Rhodopirellula baltica; identical to SEQ ID NO: 608

SEQ ID NO: 8518 - DNA, 1329 bp, Prochlorococcus marinus subsp; identical to SEQ ID NO: 609
  CDS (1)..(1329)

SEQ ID NO: 8519 - protein, 442 aa, Prochlorococcus marinus subsp; identical to SEQ ID NO: 610

SEQ ID NO: 8520 - DNA, 1332 bp, Prochlorococcus marinus; identical to SEQ ID NO: 611
  CDS (1)..(1332)

SEQ ID NO: 8521 - protein, 443 aa, Prochlorococcus marinus; identical to SEQ ID NO: 612

SEQ ID NO: 8522 - DNA, 591 bp, Prochlorococcus marinus; identical to SEQ ID NO: 613
  CDS (1)..(591)

SEQ ID NO: 8523 - protein, 196 aa, Prochlorococcus marinus; identical to SEQ ID NO: 614

SEQ ID NO: 8524 - DNA, 618 bp, Streptomyces avermitilis; identical to SEQ ID NO: 615
  CDS (1)..(618)

SEQ ID NO: 8525 - protein, 205 aa, Streptomyces avermitilis; identical to SEQ ID NO: 616

SEQ ID NO: 8526 - DNA, 600 bp, Streptomyces avermitilis; identical to SEQ ID NO: 617
  CDS (1)..(600)

SEQ ID NO: 8527 - protein, 199 aa, Streptomyces avermitilis; identical to SEQ ID NO: 618

SEQ ID NO: 8528 - DNA, 612 bp, Streptomyces avermitilis; identical to SEQ ID NO: 619
  CDS (1)..(612)

SEQ ID NO: 8529 - protein, 203 aa, Streptomyces avermitilis; identical to SEQ ID NO: 620

SEQ ID NO: 8530 - DNA, 645 bp, Enterococcus faecalis; identical to SEQ ID NO: 621
  CDS (1)..(645)

SEQ ID NO: 8531 - protein, 214 aa, Enterococcus faecalis; identical to SEQ ID NO: 622

SEQ ID NO: 8532 - DNA, 666 bp, Lactobacillus plantarum; identical to SEQ ID NO: 623
  CDS (1)..(666)

SEQ ID NO: 8533 - protein, 221 aa, Lactobacillus plantarum; identical to SEQ ID NO: 624

SEQ ID NO: 8534 - DNA, 642 bp, Clostridium tetani; identical to SEQ ID NO: 625
  CDS (1)..(642)

SEQ ID NO: 8535 - protein, 213 aa, Clostridium tetani; identical to SEQ ID NO: 626

SEQ ID NO: 8536 - DNA, 600 bp, Bradyrhizobium japonicum; identical to SEQ ID NO: 627
  CDS (1)..(600)

SEQ ID NO: 8537 - protein, 199 aa, Bradyrhizobium japonicum; identical to SEQ ID NO: 628

SEQ ID NO: 8538 - DNA, 1407 bp, Synechococcus elongatus; identical to SEQ ID NO: 629
  CDS (1)..(1407)

SEQ ID NO: 8539 - protein, 468 aa, Synechococcus elongatus; identical to SEQ ID NO: 630

SEQ ID NO: 8540 - DNA, 582 bp, Oceanobacillus iheyensis; identical to SEQ ID NO: 631
  CDS (1)..(582)

SEQ ID NO: 8541 - protein, 193 aa, Oceanobacillus iheyensis; identical to SEQ ID NO: 632

SEQ ID NO: 8542 - DNA, 648 bp, Bifidobacterium longum; identical to SEQ ID NO: 633
  CDS (1)..(648)

SEQ ID NO: 8543 - protein, 215 aa, Bifidobacterium longum; identical to SEQ ID NO: 634

SEQ ID NO: 8544 - DNA, 1005 bp, Arabidopsis thaliana; identical to SEQ ID NO: 635
  CDS (1)..(1005)

SEQ ID NO: 8545 - protein, 334 aa, Arabidopsis thaliana; identical to SEQ ID NO: 636

SEQ ID NO: 8546 - DNA, 645 bp, Xanthomonas campestris; identical to SEQ ID NO: 637
  CDS (1)..(645)

SEQ ID NO: 8547 - protein, 214 aa, Xanthomonas campestris; identical to SEQ ID NO: 638

SEQ ID NO: 8548 - DNA, 645 bp, Xanthomonas axonopodis; identical to SEQ ID NO: 639
  CDS (1)..(645)

SEQ ID NO: 8549 - protein, 214 aa, Xanthomonas axonopodis; identical to SEQ ID NO: 640

SEQ ID NO: 8550 - DNA, 621 bp, Thermoanaerobacter tengcongensis; identical to SEQ ID NO: 641
  CDS (1)..(621)

SEQ ID NO: 8551 - protein, 206 aa, Thermoanaerobacter tengcongensis; identical to SEQ ID NO: 642

SEQ ID NO: 8552 - DNA, 582 bp, Rhizobium loti; identical to SEQ ID NO: 643
  CDS (1)..(582)

SEQ ID NO: 8553 - protein, 193 aa, Rhizobium loti; identical to SEQ ID NO: 644

SEQ ID NO: 8554 - DNA, 651 bp, Pasteurella multocida; identical to SEQ ID NO: 645
  CDS (1)..(651)

SEQ ID NO: 8555 - protein, 216 aa, Pasteurella multocida; identical to SEQ ID NO: 646

SEQ ID NO: 8556 - DNA, 597 bp, Streptomyces coelicolor; identical to SEQ ID NO: 647
  CDS (1)..(597)

SEQ ID NO: 8557 - protein, 198 aa, Streptomyces coelicolor; identical to SEQ ID NO: 648

SEQ ID NO: 8558 - DNA, 600 bp, Streptomyces coelicolor; identical to SEQ ID NO: 649
  CDS (1)..(600)

SEQ ID NO: 8559 - protein, 199 aa, Streptomyces coelicolor; identical to SEQ ID NO: 650

SEQ ID NO: 8560 - DNA, 660 bp, Gloeobacter violaceus; identical to SEQ ID NO: 651
  CDS (1)..(660)

SEQ ID NO: 8561 - protein, 219 aa, Gloeobacter violaceus; identical to SEQ ID NO: 652

SEQ ID NO: 8562 - DNA, 621 bp, Bartonella henselae; identical to SEQ ID NO: 653
  CDS (1)..(621)

SEQ ID NO: 8563 - protein, 206 aa, Bartonella henselae; identical to SEQ ID NO: 654

SEQ ID NO: 8564 - DNA, 681 bp, Parachlamydia sp; identical to SEQ ID NO: 655
  CDS (1)..(681)

SEQ ID NO: 8565 - protein, 226 aa, Parachlamydia sp; identical to SEQ ID NO: 656

SEQ ID NO: 8566 - DNA, 636 bp, Rhizobium meliloti; identical to SEQ ID NO: 657
  CDS (1)..(636)

SEQ ID NO: 8567 - protein, 211 aa, Rhizobium meliloti; identical to SEQ ID NO: 658

SEQ ID NO: 8568 - DNA, 648 bp, Escherichia coli O6; identical to SEQ ID NO: 659
  CDS (1)..(648)

SEQ ID NO: 8569 - protein, 215 aa, Escherichia coli O6; identical to SEQ ID NO: 660

SEQ ID NO: 8570 - DNA, 648 bp, Photorhabdus luminescens; identical to SEQ ID NO: 661
  CDS (1)..(648)

SEQ ID NO: 8571 - protein, 215 aa, Photorhabdus luminescens; identical to SEQ ID NO: 662

SEQ ID NO: 8572 - DNA, 648 bp, Salmonella typhimurium; identical to SEQ ID NO: 663
  CDS (1)..(648)

SEQ ID NO: 8573 - protein, 215 aa, Salmonella typhimurium; identical to SEQ ID NO: 664

SEQ ID NO: 8574 - DNA, 22 bp, artificial sequence
  primer
atgccttcgctaacccccagat

SEQ ID NO: 8575 - DNA, 23 bp, artificial sequence
  primer
ttacacatcgccatgctgggatt

SEQ ID NO: 8576 - DNA, 1239 bp, Saccharomyces cerevisiae; identical to SEQ ID NO: 5653
  CDS (1)..(1239)

SEQ ID NO: 8577 - protein, 412 aa, Saccharomyces cerevisiae; identical to SEQ ID NO: 5654

SEQ ID NO: 8578 - DNA, 1719 bp, Rattus norvegicus (Norway rat); identical to SEQ ID NO: 5655
  CDS (30)..(1274)

SEQ ID NO: 8579 - protein, 414 aa, Rattus norvegicus (Norway rat); identical to SEQ ID NO: 5656

SEQ ID NO: 8580 - DNA, 1212 bp, Caulobacter crescentus; identical to SEQ ID NO: 5657
  CDS (1)..(1212)

SEQ ID NO: 8581 - protein, 403 aa, Caulobacter crescentus; identical to SEQ ID NO: 5658

SEQ ID NO: 8582 - DNA, 1551 bp, Arabidopsis thaliana (mouse-ear cress); identical to SEQ ID NO: 5659
  CDS (21)..(1271)

SEQ ID NO: 8583 - protein, 416 aa, Arabidopsis thaliana (mouse-ear cress); identical to SEQ ID NO: 5660

SEQ ID NO: 8584 - DNA, 1368 bp, Agrobacterium tumefaciens; identical to SEQ ID NO: 5661
  CDS (1)..(1368)

SEQ ID NO: 8585 - protein, 455 aa, Agrobacterium tumefaciens; identical to SEQ ID NO: 5662

SEQ ID NO: 8586 - DNA, 1230 bp, Mycobacterium tuberculosis; identical to SEQ ID NO: 5663
  CDS (1)..(1230)

SEQ ID NO: 8587 - protein, 409 aa, Mycobacterium tuberculosis; identical to SEQ ID NO: 5664

SEQ ID NO: 8588 - DNA, 1608 bp, Saccharomyces cerevisiae; identical to SEQ ID NO: 5665
  CDS (111)..(1397)

SEQ ID NO: 8589 - protein, 428 aa, Saccharomyces cerevisiae; identical to SEQ ID NO: 5666

SEQ ID NO: 8590 - DNA, 1242 bp, Sulfolobus solfataricus; identical to SEQ ID NO: 5667
  CDS (1)..(1242)

SEQ ID NO: 8591 - protein, 413 aa, Sulfolobus solfataricus; identical to SEQ ID NO: 5668

SEQ ID NO: 8592 - DNA, 1200 bp, Thermotoga maritima; identical to SEQ ID NO: 5669
  CDS (1)..(1200)

SEQ ID NO: 8593 - protein, 399 aa, Thermotoga maritima; identical to SEQ ID NO: 5670

SEQ ID NO: 8594 - DNA, 1221 bp, Sphingomonas yanoikuyae; identical to SEQ ID NO: 5671
  CDS (1)..(1221)

SEQ ID NO: 8595 - protein, 406 aa, Sphingomonas yanoikuyae; identical to SEQ ID NO: 5672

SEQ ID NO: 8596 - DNA, 1740 bp, Bos primigenius taurus (cattle); identical to SEQ ID NO: 5673
  CDS (67)..(1425)

SEQ ID NO: 8597 - protein, 452 aa, Bos primigenius taurus (cattle); identical to SEQ ID NO: 5674

SEQ ID NO: 8598 - DNA, 1569 bp, Solanum tuberosum (potato); identical to SEQ ID NO: 5675
  CDS (69)..(1319)

SEQ ID NO: 8599 - protein, 416 aa, Solanum tuberosum (potato); identical to SEQ ID NO: 5676

SEQ ID NO: 8600 - DNA, 1850 bp, Saccharomyces cerevisiae; identical to SEQ ID NO: 5677
  CDS (461)..(1723)

SEQ ID NO: 8601 - protein, 420 aa, Saccharomyces cerevisiae; identical to SEQ ID NO: 5678

SEQ ID NO: 8602 - DNA, 1584 bp, Nicotiana tabacum (common tobacco); identical to SEQ ID NO: 5679
  CDS (85)..(1332)

SEQ ID NO: 8603 - protein, 415 aa, Nicotiana tabacum (common tobacco); identical to SEQ ID NO: 5680

SEQ ID NO: 8604 - DNA, 1722 bp, Nicotiana tabacum (common tobacco); identical to SEQ ID NO: 5681
  CDS (76)..(1524)

SEQ ID NO: 8605 - protein, 482 aa, Nicotiana tabacum (common tobacco); identical to SEQ ID NO: 5682

SEQ ID NO: 8606 - DNA, 1308 bp, Caenorhabditis elegans; identical to SEQ ID NO: 5683
  CDS (1)..(1308)

SEQ ID NO: 8607 - protein, 435 aa, Caenorhabditis elegans; identical to SEQ ID NO: 5684

SEQ ID NO: 8608 - DNA, 1239 bp, Caenorhabditis elegans; identical to SEQ ID NO: 5685
  CDS (1)..(1239)

SEQ ID NO: 8609 - protein, 412 aa, Caenorhabditis elegans; identical to SEQ ID NO: 5686

SEQ ID NO: 8610 - DNA, 1257 bp, Schizosaccharomyces pombe; identical to SEQ ID NO: 5687
  CDS (1)..(1257)

SEQ ID NO: 8611 - protein, 418 aa, Schizosaccharomyces pombe; identical to SEQ ID NO: 5688

SEQ ID NO: 8612 - DNA, 1827 bp, Glycine max; identical to SEQ ID NO: 5689
  CDS (289)..(1539)

SEQ ID NO: 8613 - protein, 416 aa, Glycine max; identical to SEQ ID NO: 5690

SEQ ID NO: 8614 - DNA, 1645 bp, Eucalyptus globulus; identical to SEQ ID NO: 5691
  CDS (161)..(1411)

SEQ ID NO: 8615 - protein, 416 aa, Eucalyptus globulus; identical to SEQ ID NO: 5692

SEQ ID NO: 8616 - DNA, 1596 bp, Homo sapiens; identical to SEQ ID NO: 5693
  CDS (44)..(1303)

SEQ ID NO: 8617 - protein, 419 aa, Homo sapiens [sequence omitted]

SEQ ID NO: 8618 - DNA, 1233 bp, Debaryomyces hansenii; identical to SEQ ID NO: 5695
  CDS (1)..(1233)

SEQ ID NO: 8619 - protein, 410 aa, Debaryomyces hansenii; identical to SEQ ID NO: 5696

SEQ ID NO: 8620 - DNA, 1296 bp, Debaryomyces hansenii; identical to SEQ ID NO: 5697
  CDS (1)..(1296)

SEQ ID NO: 8621 - protein, 431 aa, Debaryomyces hansenii; identical to SEQ ID NO: 5698

SEQ ID NO: 8622 - DNA, 1326 bp, Yarrowia lipolytica; identical to SEQ ID NO: 5699
  CDS (1)..(1326)

SEQ ID NO: 8623 - protein, 441 aa, Yarrowia lipolytica; identical to SEQ ID NO: 5700

SEQ ID NO: 8624 - DNA, 1248 bp, Kluyveromyces lactis; identical to SEQ ID NO: 5701
  CDS (1)..(1248)

SEQ ID NO: 8625 - protein, 415 aa, Kluyveromyces lactis; identical to SEQ ID NO: 5702

SEQ ID NO: 8626 - DNA, 1290 bp, Kluyveromyces lactis; identical to SEQ ID NO: 5703
  CDS (1)..(1290)

SEQ ID NO: 8627 - protein, 429 aa, Kluyveromyces lactis; identical to SEQ ID NO: 5704

SEQ ID NO: 8628 - DNA, 1257 bp, Candida glabrata; identical to SEQ ID NO: 5705
  CDS (1)..(1257)

SEQ ID NO: 8629 - protein, 418 aa, Candida glabrata; identical to SEQ ID NO: 5706

SEQ ID NO: 8630 - DNA, 1272 bp, Candida glabrata; identical to SEQ ID NO: 5707
  CDS (1)..(1272)

SEQ ID NO: 8631 - protein, 423 aa, Candida glabrata; identical to SEQ ID NO: 5708

SEQ ID NO: 8632 - DNA, 1236 bp, Candida glabrata; identical to SEQ ID NO: 5709
  CDS (1)..(1236)

SEQ ID NO: 8633 - protein, 411 aa, Candida glabrata; identical to SEQ ID NO: 5710

SEQ ID NO: 8634 - DNA, 1215 bp, Bartonella quintana; identical to SEQ ID NO: 5711
  CDS (1)..(1215)

SEQ ID NO: 8635 - protein, 404 aa, Bartonella quintana; identical to SEQ ID NO: 5712

SEQ ID NO: 8636 - DNA, 1215 bp, Bartonella henselae; identical to SEQ ID NO: 5713
  CDS (1)..(1215)

SEQ ID NO: 8637 - protein, 404 aa, Bartonella henselae; identical to SEQ ID NO: 5714

SEQ ID NO: 8638 - DNA, 1212 bp, Rhizobium leguminosarum; identical to SEQ ID NO: 5715
  CDS (1)..(1212)

SEQ ID NO: 8639 - protein, 403 aa, Rhizobium leguminosarum; identical to SEQ ID NO: 5716

SEQ ID NO: 8640 - DNA, 1230 bp, Bdellovibrio bacteriovorus; identical to SEQ ID NO: 5717
  CDS (1)..(1230)

SEQ ID NO: 8641 - protein, 409 aa, Bdellovibrio bacteriovorus; identical to SEQ ID NO: 5718

SEQ ID NO: 8642 - DNA, 1227 bp, Rhodopseudomonas palustris; identical to SEQ ID NO: 5719
  CDS (1)..(1227)

SEQ ID NO: 8643 - protein, 408 aa, Rhodopseudomonas palustris; identical to SEQ ID NO: 5720

SEQ ID NO: 8644 - DNA, 1564 bp, Pisum sativum; identical to SEQ ID NO: 5721
  CDS (79)..(1317)

SEQ ID NO: 8645 - protein, 412 aa, Pisum sativum; identical to SEQ ID NO: 5722

SEQ ID NO: 8646 - DNA, 2254 bp, Ovis aries; identical to SEQ ID NO: 5723
  CDS (167)..(1411)

SEQ ID NO: 8647 - protein, 414 aa, Ovis aries; identical to SEQ ID NO: 5724

SEQ ID NO: 8648 - DNA, 1197 bp, Leptospira interrogans; identical to SEQ ID NO: 5725
  CDS (1)..(1197)

SEQ ID NO: 8649 - protein, 398 aa, Leptospira interrogans; identical to SEQ ID NO: 5726

SEQ ID NO: 8650 - DNA, 1239 bp, Mycobacterium paratuberculosis; identical to SEQ ID NO: 5727
  CDS (1)..(1239)

SEQ ID NO: 8651 - protein, 412 aa, Mycobacterium paratuberculosis; identical to SEQ ID NO: 5728

SEQ ID NO: 8652 - DNA, 1278 bp, Ashbya gossypii; identical to SEQ ID NO: 5729
  CDS (1)..(1278)

SEQ ID NO: 8653 - protein, 425 aa, Ashbya gossypii; identical to SEQ ID NO: 5730

SEQ ID NO: 8654 - DNA, 1248 bp, Ashbya gossypii; identical to SEQ ID NO: 5731
  CDS (1)..(1248)

SEQ ID NO: 8655 - protein, 415 aa, Ashbya gossypii; identical to SEQ ID NO: 5732

SEQ ID NO: 8656 - DNA, 1287 bp, Dictyostelium discoideum; identical to SEQ ID NO: 5733
  CDS (1)..(1287)

SEQ ID NO: 8657 - protein, 428 aa, Dictyostelium discoideum; identical to SEQ ID NO: 5734

SEQ ID NO: 8658 - DNA, 1594 bp, Oryza sativa; identical to SEQ ID NO: 5735
  CDS (66)..(1304)

SEQ ID NO: 8659 - protein, 412 aa, Oryza sativa; identical to SEQ ID NO: 5736

SEQ ID NO: 8660 - DNA, 1230 bp, Gloeobacter violaceus; identical to SEQ ID NO: 5737
  CDS (1)..(1230)

SEQ ID NO: 8661 - protein, 409 aa, Gloeobacter violaceus; identical to SEQ ID NO: 5738

SEQ ID NO: 8662 - DNA, 1410 bp, Plasmodium yoelii yoelii; identical to SEQ ID NO: 5739
  CDS (1)..(1410)

SEQ ID NO: 8663 - protein, 469 aa, Plasmodium yoelii yoelii; identical to SEQ ID NO: 5740

SEQ ID NO: 8664 - DNA, 1389 bp, Neurospora crassa; identical to SEQ ID NO: 5741
  CDS (1)..(1389)

SEQ ID NO: 8665 - protein, 462 aa, Neurospora crassa; identical to SEQ ID NO: 5742

SEQ ID NO: 8666 - DNA, 1765 bp, Oryza sativa; identical to SEQ ID NO: 5743
  CDS (83)..(1489)

SEQ ID NO: 8667 - protein, 468 aa, Oryza sativa; identical to SEQ ID NO: 5744

SEQ ID NO: 8668 - DNA, 1794 bp, Lupinus albus; identical to SEQ ID NO: 5745
  CDS (58)..(1515)

SEQ ID NO: 8669 - protein, 485 aa, Lupinus albus; identical to SEQ ID NO: 5746

SEQ ID NO: 8670 - DNA, 1583 bp, Lupinus albus; identical to SEQ ID NO: 5747
  CDS (43)..(1281)

SEQ ID NO: 8671 - protein, 412 aa, Lupinus albus; identical to SEQ ID NO: 5748

SEQ ID NO: 8672 - DNA, 1627 bp, Lupinus albus; identical to SEQ ID NO: 5749
  CDS (79)..(1317)

SEQ ID NO: 8673 - protein, 412 aa, Lupinus albus; identical to SEQ ID NO: 5750

SEQ ID NO: 8674 - DNA, 2305 bp, Homo sapiens; identical to SEQ ID NO: 5751
  CDS (196)..(1440)

SEQ ID NO: 8675 - protein, 414 aa, Homo sapiens [sequence omitted]

SEQ ID NO: 8676 - DNA, 1215 bp, Bradyrhizobium japonicum; identical to SEQ ID NO: 5753
  CDS (1)..(1215)

SEQ ID NO: 8677 - protein, 404 aa, Bradyrhizobium japonicum; identical to SEQ ID NO: 5754

SEQ ID NO: 8678 - DNA, 1215 bp, Brucella suis; identical to SEQ ID NO: 5755
  CDS (1)..(1215)

SEQ ID NO: 8679 - protein, 404 aa, Brucella suis; identical to SEQ ID NO: 5756

SEQ ID NO: 8680 - DNA, 1221 bp, Bifidobacterium longum; identical to SEQ ID NO: 5757
  CDS (1)..(1221)

SEQ ID NO: 8681 - protein, 406 aa, Bifidobacterium longum; identical to SEQ ID NO: 5758

SEQ ID NO: 8682 - DNA, 1407 bp, Plasmodium falciparum; identical to SEQ ID NO: 5759
  CDS (1)..(1407)

SEQ ID NO: 8683 - protein, 468 aa, Plasmodium falciparum; identical to SEQ ID NO: 5760

SEQ ID NO: 8684 - DNA, 1514 bp, Arabidopsis thaliana; identical to SEQ ID NO: 5761
  CDS (1)..(1458)

SEQ ID NO: 8685 - protein, 485 aa, Arabidopsis thaliana; identical to SEQ ID NO: 5762

SEQ ID NO: 8686 - DNA, 1212 bp, Thermoanaerobacter tengcongensis; identical to SEQ ID NO: 5763
  CDS (1)..(1212)

SEQ ID NO: 8687 - protein, 403 aa, Thermoanaerobacter tengcongensis; identical to SEQ ID NO: 5764

SEQ ID NO: 8688 - DNA, 1551 bp, Cucumis sativus; identical to SEQ ID NO: 5765
  CDS (62)..(1294)

SEQ ID NO: 8689 - protein, 410 aa, Cucumis sativus; identical to SEQ ID NO: 5766

SEQ ID NO: 8690 - DNA, 1610 bp, Arabidopsis thaliana; identical to SEQ ID NO: 5767
  CDS (165)..(1397)

SEQ ID NO: 8691 - protein, 410 aa, Arabidopsis thaliana; identical to SEQ ID NO: 5768

SEQ ID NO: 8692 - DNA, 1215 bp, Rhizobium meliloti; identical to SEQ ID NO: 5769
  CDS (1)..(1215)

SEQ ID NO: 8693 - protein, 404 aa, Rhizobium meliloti; identical to SEQ ID NO: 5770

SEQ ID NO: 8694 - DNA, 1561 bp, Prunus persica; identical to SEQ ID NO: 5771
  CDS (1)..(1245)

SEQ ID NO: 8695 - protein, 414 aa, Prunus persica; identical to SEQ ID NO: 5772

SEQ ID NO: 8696 - DNA, 1242 bp, Emericella nidulans; identical to SEQ ID NO: 5773
  CDS (1)..(1242)

SEQ ID NO: 8697 - protein, 413 aa, Emericella nidulans; identical to SEQ ID NO: 5774

SEQ ID NO: 8698 - DNA, 1212 bp, Rhizobium loti; identical to SEQ ID NO: 5775
  CDS (1)..(1212)

SEQ ID NO: 8699 - protein, 403 aa, Rhizobium loti; identical to SEQ ID NO: 5776

SEQ ID NO: 8700 - DNA, 1679 bp, Mus musculus; identical to SEQ ID NO: 5777
  CDS (46)..(1404)

SEQ ID NO: 8701 - protein, 452 aa, Mus musculus; identical to SEQ ID NO: 5778

SEQ ID NO: 8702 - DNA, 1227 bp, Oryza sativa; identical to SEQ ID NO: 5779
  CDS (1)..(1227)

SEQ ID NO: 8703 - protein, 408 aa, Oryza sativa; identical to SEQ ID NO: 5780

SEQ ID NO: 8704 - DNA, 1554 bp, Solanum tuberosum; identical to SEQ ID NO: 5781
  CDS (61)..(1473)

SEQ ID NO: 8705 - protein, 470 aa, Solanum tuberosum; identical to SEQ ID NO: 5782

SEQ ID NO: 8706 - DNA, 1708 bp, Citrus limon; identical to SEQ ID NO: 5783
  CDS (155)..(1399): n means a or g or c or t/u, s means g or c

SEQ ID NO: 8707 - protein, 414 aa, Citrus limon; identical to SEQ ID NO: 5784

SEQ ID NO: 8708 - DNA, 1782 bp, Drosophila melanogaster; identical to SEQ ID NO: 5785
  CDS (430)..(1782)

SEQ ID NO: 8709 - protein, 450 aa, Drosophila melanogaster; identical to SEQ ID NO: 5786

SEQ ID NO: 8710 - DNA, 1503 bp, Oryza sativa; identical to SEQ ID NO: 5787
  CDS (84)..(1322)

SEQ ID NO: 8711 - protein, 412 aa, Oryza sativa; identical to SEQ ID NO: 5788

SEQ ID NO: 8712 - DNA, 1859 bp, Oryza sativa; identical to SEQ ID NO: 5789
  CDS (201)..(1445)

SEQ ID NO: 8713 - protein, 414 aa, Oryza sativa; identical to SEQ ID NO: 5790

SEQ ID NO: 8714 - DNA, 1488 bp, Daucus carota; identical to SEQ ID NO: 5791
  CDS (91)..(1341)

SEQ ID NO: 8715 - protein, 416 aa, Daucus carota; identical to SEQ ID NO: 5792

SEQ ID NO: 8716 - DNA, 1512 bp, Daucus carota; identical to SEQ ID NO: 5793
  CDS (93)..(1331)

SEQ ID NO: 8717 - protein, 412 aa, Daucus carota; identical to SEQ ID NO: 5794

SEQ ID NO: 8718 - DNA, 1600 bp, Candida tropicalis; identical to SEQ ID NO: 5795
  CDS (201)..(1493)

SEQ ID NO: 8719 - protein, 430 aa, Candida tropicalis; identical to SEQ ID NO: 5796

SEQ ID NO: 8720 - DNA, 1560 bp, Glycine max; identical to SEQ ID NO: 5797
  CDS (87)..(1328)

SEQ ID NO: 8721 - protein, 413 aa, Glycine max; identical to SEQ ID NO: 5798

SEQ ID NO: 8722 - DNA, 1985 bp, Aspergillus niger; identical to SEQ ID NO: 5799
  CDS (288)..(1784)

SEQ ID NO: 8723 - protein, 498 aa, Aspergillus niger; identical to SEQ ID NO: 5800

SEQ ID NO: 8724 - DNA, 1727 bp, Homo sapiens; identical to SEQ ID NO: 5801
  CDS (67)..(1425)

SEQ ID NO: 8725 - protein, 452 aa, Homo sapiens; identical to SEQ ID NO: 5802

SEQ ID NO: 8726 - DNA, 1863 bp, Mus musculus; identical to SEQ ID NO: 5803
  CDS (24)..(1595)

SEQ ID NO: 8727 - protein, 523 aa, Mus musculus; identical to SEQ ID NO: 5804

SEQ ID NO: 8728 - DNA, 1740 bp, Brachydanio rerio; identical to SEQ ID NO: 5805
  CDS (80)..(1429)

SEQ ID NO: 8729 - protein, 449 aa, Brachydanio rerio; identical to SEQ ID NO: 5806

SEQ ID NO: 8730 - DNA, 25 bp, artificial sequence
  primer
atgacaaagattaaggtagctaacc

SEQ ID NO: 8731 - DNA, 23 bp, artificial sequence
  primer
ttacaatgcagctgcctcgaact

SEQ ID NO: 8732 - DNA, 1518 bp, Saccharomyces cerevisiae; identical to SEQ ID NO: 2533
  CDS (1)..(1518)

SEQ ID NO: 8733 - protein, 505 aa, Saccharomyces cerevisiae; identical to SEQ ID NO: 2534

SEQ ID NO: 8734 - DNA, 1548 bp, Mus musculus (house mouse); identical to SEQ ID NO: 2535
  CDS (1)..(1548)

SEQ ID NO: 8735 - protein, 515 aa, Mus musculus (house mouse); identical to SEQ ID NO: 2536

SEQ ID NO: 8736 - DNA, 1593 bp, Fugu rubripes (Japanese pufferfish); identical to SEQ ID NO: 2537
  CDS (1)..(1593)

SEQ ID NO: 8737 - protein, 530 aa, Fugu rubripes (Japanese pufferfish); identical to SEQ ID NO: 2538

SEQ ID NO: 8738 - DNA, 1506 bp, Vibrio cholerae; identical to SEQ ID NO: 2539
  CDS (1)..(1506)

SEQ ID NO: 8739 - protein, 501 aa, Vibrio cholerae; identical to SEQ ID NO: 2540

SEQ ID NO: 8740 - DNA, 1470 bp, Pseudomonas aeruginosa; identical to SEQ ID NO: 2541
  CDS (1)..(1470)

SEQ ID NO: 8741 - protein, 489 aa, Pseudomonas aeruginosa; identical to SEQ ID NO: 2542

SEQ ID NO: 8742 - DNA, 1485 bp, Staphylococcus aureus; identical to SEQ ID NO: 2543
  CDS (1)..(1485)

SEQ ID NO: 8743 - protein, 494 aa, Staphylococcus aureus; identical to SEQ ID NO: 2544

SEQ ID NO: 8744 - DNA, 1488 bp, Streptococcus pneumoniae; identical to SEQ ID NO: 2545
  CDS (1)..(1488)

SEQ ID NO: 8745 - protein, 495 aa, Streptococcus pneumoniae; identical to SEQ ID NO: 2546

SEQ ID NO: 8746 - DNA, 1476 bp, Salmonella enterica subsp. enterica serovar Typhi; identical to SEQ ID NO: 2547
  CDS (1)..(1476)

SEQ ID NO: 8747 - protein, 491 aa, Salmonella enterica subsp. enterica serovar Typhi; identical to SEQ ID NO: 2548

SEQ ID NO: 8748 - DNA, 1476 bp, Agrobacterium tumefaciens; identical to SEQ ID NO: 2549
  CDS (1)..(1476)

SEQ ID NO: 8749 - protein, 491 aa, Agrobacterium tumefaciens; identical to SEQ ID NO: 2550

SEQ ID NO: 8750 - DNA, 1530 bp, Nostoc sp. PCC 7120; identical to SEQ ID NO: 2551
  CDS (1)..(1530)

SEQ ID NO: 8751 - protein, 509 aa, Nostoc sp. PCC 7120; identical to SEQ ID NO: 2552

SEQ ID NO: 8752 - DNA, 1386 bp, Agrobacterium tumefaciens; identical to SEQ ID NO: 2553
  CDS (1)..(1386)

SEQ ID NO: 8753 - protein, 461 aa, Agrobacterium tumefaciens; identical to SEQ ID NO: 2554

SEQ ID NO: 8754 - DNA, 1476 bp, Brucella melitensis; identical to SEQ ID NO: 2555
  CDS (1)..(1476)

SEQ ID NO: 8755 - protein, 491 aa, Brucella melitensis; identical to SEQ ID NO: 2556

SEQ ID NO: 8756 - DNA, 1458 bp, Zymomonas mobilis; identical to SEQ ID NO: 2557
  CDS (1)..(1458)

SEQ ID NO: 8757 - protein, 485 aa, Zymomonas mobilis; identical to SEQ ID NO: 2558

SEQ ID NO: 8758 - DNA, 1470 bp, Bacillus subtilis; identical to SEQ ID NO: 2559
  CDS (1)..(1470)

SEQ ID NO: 8759 - protein, 489 aa, Bacillus subtilis; identical to SEQ ID NO: 2560

SEQ ID NO: 8760 - DNA, 1401 bp, Mycobacterium tuberculosis; identical to SEQ ID NO: 2561
  CDS (1)..(1401)

SEQ ID NO: 8761 - protein, 466 aa, Mycobacterium tuberculosis; identical to SEQ ID NO: 2562

SEQ ID NO: 8762 - DNA, 1545 bp, Mycobacterium tuberculosis; identical to SEQ ID NO: 2563
  CDS (1)..(1545)

SEQ ID NO: 8763 - protein, 514 aa, Mycobacterium tuberculosis; identical to SEQ ID NO: 2564

SEQ ID NO: 8764 - DNA, 1320 bp, Chlamydia trachomatis; identical to SEQ ID NO: 2565
  CDS (1)..(1320)

SEQ ID NO: 8765 - protein, 439 aa, Chlamydia trachomatis; identical to SEQ ID NO: 2566

SEQ ID NO: 8766 - DNA, 1773 bp, Deinococcus radiodurans; identical to SEQ ID NO: 2567
  CDS (1)..(1773)

SEQ ID NO: 8767 - protein, 590 aa, Deinococcus radiodurans; identical to SEQ ID NO: 2568

SEQ ID NO: 8768 - DNA, 1467 bp, Pseudomonas aeruginosa; identical to SEQ ID NO: 2569
  CDS (1)..(1467)

SEQ ID NO: 8769 - protein, 488 aa, Pseudomonas aeruginosa; identical to SEQ ID NO: 2570

SEQ ID NO: 8770 - DNA, 1422 bp, Caulobacter crescentus; identical to SEQ ID NO: 2571
  CDS (1)..(1422)

SEQ ID NO: 8771 - protein, 473 aa, Caulobacter crescentus; identical to SEQ ID NO: 2572

SEQ ID NO: 8772 - DNA, 1437 bp, Borrelia burgdorferi (Lyme disease spirochete); identical to SEQ ID NO: 2573
  CDS (1)..(1437)

SEQ ID NO: 8773 - protein, 478 aa, Borrelia burgdorferi (Lyme disease spirochete); identical to SEQ ID NO: 2574

SEQ ID NO: 8774 - DNA, 1539 bp, Chlamydophila pneumoniae, Chlamydia pneumoniae; identical to SEQ ID NO: 2575
  CDS (1)..(1539)

SEQ ID NO: 8775 - protein, 512 aa, Chlamydophila pneumoniae, Chlamydia pneumoniae; identical to SEQ ID NO: 2576

SEQ ID NO: 8776 - DNA, 1476 bp, Escherichia coli; identical to SEQ ID NO: 2577
  CDS (1)..(1476)

SEQ ID NO: 8777 - protein, 491 aa, Escherichia coli; identical to SEQ ID NO: 2578

SEQ ID NO: 8778 - DNA, 1548 bp, Treponema pallidum subsp. pallidum (syphilis spirochete); identical to SEQ ID NO: 2579
  CDS (1)..(1548)

SEQ ID NO: 8779 - protein, 515 aa, Treponema pallidum subsp. pallidum (syphilis spirochete); identical to SEQ ID NO: 2580

SEQ ID NO: 8780 - DNA, 1476 bp, Buchnera sp; identical to SEQ ID NO: 2581
  CDS (1)..(1476)

SEQ ID NO: 8781 - protein, 491 aa, Buchnera sp; identical to SEQ ID NO: 2582

SEQ ID NO: 8782 - DNA, 1512 bp, Lactococcus lactis subsp. lactis; identical to SEQ ID NO: 2583
  CDS (1)..(1512)

SEQ ID NO: 8783 - protein, 503 aa, Lactococcus lactis subsp. lactis; identical to SEQ ID NO: 2584

SEQ ID NO: 8784 - DNA, 1572 bp, Drosophila melanogaster; identical to SEQ ID NO: 2585
  CDS (1)..(1572)

SEQ ID NO: 8785 - protein, 523 aa, Drosophila melanogaster; identical to SEQ ID NO: 2586

SEQ ID NO: 8786 - DNA, 1575 bp, Synechococcus sp; identical to SEQ ID NO: 2587
  CDS (1)..(1575)

SEQ ID NO: 8787 - protein, 524 aa, Synechococcus sp; identical to SEQ ID NO: 2588

SEQ ID NO: 8788 - DNA, 1485 bp, Haemophilus influenzae; identical to SEQ ID NO: 2589
  CDS (1)..(1485)

SEQ ID NO: 8789 - protein, 494 aa, Haemophilus influenzae; identical to SEQ ID NO: 2590

SEQ ID NO: 8790 - DNA, 1446 bp, Neisseria meningitidis; identical to SEQ ID NO: 2591
  CDS (1)..(1446)

SEQ ID NO: 8791 - protein, 481 aa, Neisseria meningitidis; identical to SEQ ID NO: 2592

SEQ ID NO: 8792 - DNA, 1278 bp, Helicobacter pylori; identical to SEQ ID NO: 2593
  CDS (1)..(1278)

SEQ ID NO: 8793 - protein, 425 aa, Helicobacter pylori; identical to SEQ ID NO: 2594

SEQ ID NO: 8794 - DNA, 1434 bp, Xylella fastidiosa; identical to SEQ ID NO: 2595
  CDS (1)..(1434)

SEQ ID NO: 8795 - protein, 477 aa, Xylella fastidiosa; identical to SEQ ID NO: 2596

SEQ ID NO: 8796 - DNA, 1296 bp, Aquifex aeolicus; identical to SEQ ID NO: 2597
  CDS (1)..(1296)

SEQ ID NO: 8797 - protein, 431 aa, Aquifex aeolicus; identical to SEQ ID NO: 2598

SEQ ID NO: 8798 - DNA, 1491 bp, Thermotoga maritima; identical to SEQ ID NO: 2599
  CDS (1)..(1491)

SEQ ID NO: 8799 - protein, 496 aa, Thermotoga maritima; identical to SEQ ID NO: 2600

SEQ ID NO: 8800 - DNA, 1494 bp, Kluyveromyces marxianus var. lactis, Candida sphaerica; identical to SEQ ID NO: 2601
  CDS (1)..(1494)

SEQ ID NO: 8801 - protein, 497 aa, Kluyveromyces marxianus var. lactis, Candida sphaerica; identical to SEQ ID NO: 2602

SEQ ID NO: 8802 - DNA, 2813 bp, Erwinia chrysanthemi; identical to SEQ ID NO: 2603
  CDS (322)..(1797)

SEQ ID NO: 8803 - protein, 491 aa, Erwinia chrysanthemi; identical to SEQ ID NO: 2604

SEQ ID NO: 8804 - DNA, 3244 bp, Plasmodium falciparum; identical to SEQ ID NO: 2605
  CDS (184)..(2916)

SEQ ID NO: 8805 - protein, 910 aa, Plasmodium falciparum; identical to SEQ ID NO: 2606

SEQ ID NO: 8806 - DNA, 1785 bp, Medicago sativa (alfalfa); identical to SEQ ID NO: 2607
  CDS (38)..(1585)

SEQ ID NO: 8807 - protein, 515 aa, Medicago sativa (alfalfa); identical to SEQ ID NO: 2608

SEQ ID NO: 8808 - DNA, 1689 bp, Solanum tuberosum (potato); identical to SEQ ID NO: 2609
  CDS (46)..(1581)

SEQ ID NO: 8809 - protein, 511 aa, Solanum tuberosum (potato); identical to SEQ ID NO: 2610

SEQ ID NO: 8810 - DNA, 1530 bp, Synechocystis sp; identical to SEQ ID NO: 2611
  CDS (1)..(1530)

SEQ ID NO: 8811 - protein, 509 aa, Synechocystis sp; identical to SEQ ID NO: 2612

SEQ ID NO: 8812 - DNA, 1953 bp, Nicotiana tabacum (common tobacco); identical to SEQ ID NO: 2613
  CDS (43)..(1824)

SEQ ID NO: 8813 - protein, 593 aa, Nicotiana tabacum (common tobacco); identical to SEQ ID NO: 2614

SEQ ID NO: 8814 - DNA, 1869 bp, Nicotiana tabacum (common tobacco); identical to SEQ ID NO: 2615
  CDS (22)..(1788)

SEQ ID NO: 8815 - protein, 588 aa, Nicotiana tabacum (common tobacco); identical to SEQ ID NO: 2616

SEQ ID NO: 8816 - DNA, 2058 bp, Solanum tuberosum (potato); identical to SEQ ID NO: 2617
  CDS (41)..(1774)

SEQ ID NO: 8817 - protein, 577 aa, Solanum tuberosum (potato); identical to SEQ ID NO: 2618

SEQ ID NO: 8818 - DNA, 2049 bp, Spinacia oleracea (spinach); identical to SEQ ID NO: 2619
  CDS (147)..(1871)

SEQ ID NO: 8819 - protein, 574 aa, Spinacia oleracea (spinach); identical to SEQ ID NO: 2620

SEQ ID NO: 8820 - DNA, 2359 bp, Petroselinum crispum (parsley); identical to SEQ ID NO: 2621
  CDS (172)..(1986)

SEQ ID NO: 8821 - protein, 604 aa, Petroselinum crispum (parsley); identical to SEQ ID NO: 2622

SEQ ID NO: 8822 - DNA, 1848 bp, Petroselinum crispum (parsley); identical to SEQ ID NO: 2623
  CDS (41)..(1528)

SEQ ID NO: 8823 - protein, 495 aa, Petroselinum crispum (parsley); identical to SEQ ID NO: 2624

SEQ ID NO: 8824 - DNA, 1957 bp, Petroselinum crispum (parsley); identical to SEQ ID NO: 2625
  CDS (74)..(1678)

SEQ ID NO: 8825 - protein, 534 aa, Petroselinum crispum (parsley); identical to SEQ ID NO: 2626

SEQ ID NO: 8826 - DNA, 1569 bp, Caenorhabditis elegans; identical to SEQ ID NO: 2627
  CDS (1)..(1569)

SEQ ID NO: 8827 - protein, 522 aa, Caenorhabditis elegans; identical to SEQ ID NO: 2628

SEQ ID NO: 8828 - DNA, 1779 bp, Streptomyces coelicolor; identical to SEQ ID NO: 2629
  CDS (1)..(1779)

SEQ ID NO: 8829 - protein, 592 aa, Streptomyces coelicolor; identical to SEQ ID NO: 2630

SEQ ID NO: 8830 - DNA, 1524 bp, Streptomyces coelicolor; identical to SEQ ID NO: 2631
  CDS (1)..(1524)

SEQ ID NO: 8831 - protein, 507 aa, Streptomyces coelicolor; identical to SEQ ID NO: 2632

SEQ ID NO: 8832 - DNA, 1422 bp, Schizosaccharomyces pombe; identical to SEQ ID NO: 2633
  CDS (1)..(1422)

SEQ ID NO: 8833 - protein, 473 aa, Schizosaccharomyces pombe; identical to SEQ ID NO: 2634

SEQ ID NO: 8834 - DNA, 1503 bp, Schizosaccharomyces pombe; identical to SEQ ID NO: 2635
  CDS (1)..(1503)

SEQ ID NO: 8835 - protein, 500 aa, Schizosaccharomyces pombe; identical to SEQ ID NO: 2636

SEQ ID NO: 8836 - DNA, 1428 bp, Schizosaccharomyces pombe; identical to SEQ ID NO: 2637
  CDS (1)..(1428)

SEQ ID NO: 8837 - protein, 475 aa, Schizosaccharomyces pombe; identical to SEQ ID NO: 2638

SEQ ID NO: 8838 - DNA, 1461 bp, Leuconostoc mesenteroides; identical to SEQ ID NO: 2639
  CDS (1)..(1461)

SEQ ID NO: 8839 - protein, 486 aa, Leuconostoc mesenteroides; identical to SEQ ID NO: 2640

SEQ ID NO: 8840 - DNA, 3038 bp, Corynebacterium glutamicum; identical to SEQ ID NO: 2641
  CDS (115)..(1659)

SEQ ID NO: 8841 - protein, 514 aa, Corynebacterium glutamicum; identical to SEQ ID NO: 2642

SEQ ID NO: 8842 - DNA, 1852 bp, Nicotiana tabacum; identical to SEQ ID NO: 2643
  CDS (102)..(1634)

SEQ ID NO: 8843 - protein, 510 aa, Nicotiana tabacum; identical to SEQ ID NO: 2644

SEQ ID NO: 8844 - DNA, 1821 bp, Nicotiana tabacum; identical to SEQ ID NO: 2645
  CDS (88)..(1623)

SEQ ID NO: 8845 - protein, 511 aa, Nicotiana tabacum; identical to SEQ ID NO: 2646

SEQ ID NO: 8846 - DNA, 1808 bp, Chlamydia trachomatis; identical to SEQ ID NO: 2647
  CDS (105)..(1643)

SEQ ID NO: 8847 - protein, 512 aa, Chlamydia trachomatis; identical to SEQ ID NO: 2648

SEQ ID NO: 8848 - DNA, 2750 bp, Plasmodium falciparum; identical to SEQ ID NO: 2649
  CDS (48)..(2258)

SEQ ID NO: 8849 - protein, 736 aa, Plasmodium falciparum; identical to SEQ ID NO: 2650

SEQ ID NO: 8850 - DNA, 1509 bp, Debaryomyces hansenii; identical to SEQ ID NO: 2651
  CDS (1)..(1509)

SEQ ID NO: 8851 - protein, 502 aa, Debaryomyces hansenii; identical to SEQ ID NO: 2652

SEQ ID NO: 8852 - DNA, 1503 bp, Candida glabrata; identical to SEQ ID NO: 2653
  CDS (1)..(1503)

SEQ ID NO: 8853 - protein, 500 aa, Candida glabrata; identical to SEQ ID NO: 2654

SEQ ID NO: 8854 - DNA, 1485 bp, Bacillus thuringiensis serovar konkukian str; identical to SEQ ID NO: 2655
  CDS (1)..(1485)

SEQ ID NO: 8855 - protein, 494 aa, Bacillus thuringiensis serovar konkukian str; identical to SEQ ID NO: 2656

SEQ ID NO: 8856 - DNA, 1554 bp, Oryza sativa; identical to SEQ ID NO: 2657
  CDS (1)..(1554)

SEQ ID NO: 8857 - protein, 517 aa, Oryza sativa; identical to SEQ ID NO: 2658

SEQ ID NO: 8858 - DNA, 1500 bp, Photobacterium profundum; identical to SEQ ID NO: 2659
  CDS (1)..(1500)

SEQ ID NO: 8859 - protein, 499 aa, Photobacterium profundum; identical to SEQ ID NO: 2660

SEQ ID NO: 8860 - DNA, 1551 bp, Parachlamydia sp; identical to SEQ ID NO: 2661
  CDS (1)..(1551)

SEQ ID NO: 8861 - protein, 516 aa, Parachlamydia sp; identical to SEQ ID NO: 2662

SEQ ID NO: 8862 - DNA, 1515 bp, Rhodopseudomonas palustris; identical to SEQ ID NO: 2663
  CDS (1)..(1515)

SEQ ID NO: 8863 - protein, 504 aa, Rhodopseudomonas palustris; identical to SEQ ID NO: 2664

SEQ ID NO: 8864 - DNA, 1650 bp, Corynebacterium diphtheriae; identical to SEQ ID NO: 2665
  CDS (1)..(1650)

SEQ ID NO: 8865 - protein, 549 aa, Corynebacterium diphtheriae; identical to SEQ ID NO: 2666

SEQ ID NO: 8866 - DNA, 1446 bp, uncultured bacterium 581; identical to SEQ ID NO: 2667
  CDS (1)..(1446)

SEQ ID NO: 8867 - protein, 481 aa, uncultured bacterium 581; identical to SEQ ID NO: 2668

SEQ ID NO: 8868 - DNA, 1602 bp, Nonomuraea sp; identical to SEQ ID NO: 2669
  CDS (1)..(1602)

SEQ ID NO: 8869 - protein, 533 aa, Nonomuraea sp; identical to SEQ ID NO: 2670

SEQ ID NO: 8870 - DNA, 1476 bp, Listeria monocytogenes; identical to SEQ ID NO: 2671
  CDS (1)..(1476)

SEQ ID NO: 8871 - protein, 491 aa, Listeria monocytogenes; identical to SEQ ID NO: 2672

SEQ ID NO: 8872 - DNA, 1485 bp, Bacillus cereus; identical to SEQ ID NO: 2673
  CDS (1)..(1485)

SEQ ID NO: 8873 - protein, 494 aa, Bacillus cereus; identical to SEQ ID NO: 2674

SEQ ID NO: 8874 - DNA, 1410 bp, Mycobacterium paratuberculosis; identical to SEQ ID NO: 2675
  CDS (1)..(1410)

SEQ ID NO: 8875 - protein, 469 aa, Mycobacterium paratuberculosis; identical to SEQ ID NO: 2676

SEQ ID NO: 8876 - DNA, 2454 bp, Mycobacterium paratuberculosis; identical to SEQ ID NO: 2677
  CDS (1)..(2454)

SEQ ID NO: 8877 - protein, 817 aa, Mycobacterium paratuberculosis; identical to SEQ ID NO: 2678

SEQ ID NO: 8878 - DNA, 1545 bp, Mycobacterium paratuberculosis; identical to SEQ ID NO: 2679
  CDS (1)..(1545)

SEQ ID NO: 8879 - protein, 514 aa, Mycobacterium paratuberculosis; identical to SEQ ID NO: 2680

SEQ ID NO: 8880 - DNA, 1449 bp, Lactobacillus johnsonii; identical to SEQ ID NO: 2681
  CDS (1)..(1449)

SEQ ID NO: 8881 - protein, 482 aa, Lactobacillus johnsonii; identical to SEQ ID NO: 2682

SEQ ID NO: 8882 - DNA, 1539 bp, Ashbya gossypii; identical to SEQ ID NO: 2683
  CDS (1)..(1539)

SEQ ID NO: 8883 - protein, 512 aa, Ashbya gossypii; identical to SEQ ID NO: 2684

SEQ ID NO: 8884 - DNA, 1734 bp, Oryza sativa; identical to SEQ ID NO: 2685
  CDS (1)..(1734)

SEQ ID NO: 8885 - protein, 577 aa, Oryza sativa; identical to SEQ ID NO: 2686

SEQ ID NO: 8886 - DNA, 1467 bp, Gluconobacter oxydans; identical to SEQ ID NO: 2687
  CDS (1)..(1467)

SEQ ID NO: 8887 - protein, 488 aa, Gluconobacter oxydans; identical to SEQ ID NO: 2688

SEQ ID NO: 8888 - DNA, 1581 bp, Vibrio vulnificus; identical to SEQ ID NO: 2689
  CDS (1)..(1581)

SEQ ID NO: 8889 - protein, 526 aa, Vibrio vulnificus; identical to SEQ ID NO: 2690

SEQ ID NO: 8890 - DNA, 1476 bp, Photorhabdus luminescens; identical to SEQ ID NO: 2691
  CDS (1)..(1476)

SEQ ID NO: 8891 - protein, 491 aa, Photorhabdus luminescens; identical to SEQ ID NO: 2692

SEQ ID NO: 8892 - DNA, 1539 bp, Gloeobacter violaceus; identical to SEQ ID NO: 2693
  CDS (1)..(1539)

SEQ ID NO: 8893 - protein, 512 aa, Gloeobacter violaceus; identical to SEQ ID NO: 2694

SEQ ID NO: 8894 - DNA, 1539 bp, Gloeobacter violaceus; identical to SEQ ID NO: 2695
  CDS (1)..(1539)

SEQ ID NO: 8895 - protein, 512 aa, Gloeobacter violaceus; identical to SEQ ID NO: 2696

SEQ ID NO: 8896 - DNA, 1479 bp, Chromobacterium violaceum; identical to SEQ ID NO: 2697
  CDS (1)..(1479)

SEQ ID NO: 8897 - protein, 492 aa, Chromobacterium violaceum; identical to SEQ ID NO: 2698

SEQ ID NO: 8898 - DNA, 2229 bp, Giardia lamblia ATCC 50803; identical to SEQ ID NO: 2699
  CDS (1)..(2229)

SEQ ID NO: 8899 - protein, 742 aa, Giardia lamblia ATCC 50803; identical to SEQ ID NO: 2700

SEQ ID NO: 8900 - DNA, 2850 bp, Plasmodium yoelii yoelii; identical to SEQ ID NO: 2701
  CDS (1)..(2850)

SEQ ID NO: 8901 - protein, 949 aa, Plasmodium yoelii yoelii; identical to SEQ ID NO: 2702

SEQ ID NO: 8902 - DNA, 1476 bp, Neurospora crassa; identical to SEQ ID NO: 2703
  CDS (1)..(1476)

SEQ ID NO: 8903 - protein, 491 aa, Neurospora crassa; identical to SEQ ID NO: 2704

SEQ ID NO: 8904 - DNA, 1524 bp, Synechococcus sp; identical to SEQ ID NO: 2705
  CDS (1)..(1524)

SEQ ID NO: 8905 - protein, 507 aa, Synechococcus sp; identical to SEQ ID NO: 2706

SEQ ID NO: 8906 - DNA, 1455 bp, Rhodopirellula baltica; identical to SEQ ID NO: 2707
  CDS (1)..(1455)

SEQ ID NO: 8907 - protein, 484 aa, Rhodopirellula baltica; identical to SEQ ID NO: 2708

SEQ ID NO: 8908 - DNA, 1524 bp, Prochlorococcus marinus subsp; identical to SEQ ID NO: 2709
  CDS (1)..(1524)

SEQ ID NO: 8909 - protein, 507 aa, Prochlorococcus marinus subsp; identical to SEQ ID NO: 2710

SEQ ID NO: 8910 - DNA, 1524 bp, Prochlorococcus marinus; identical to SEQ ID NO: 2711
  CDS (1)..(1524)

SEQ ID NO: 8911 - protein, 507 aa, Prochlorococcus marinus; identical to SEQ ID NO: 2712

SEQ ID NO: 8912 - DNA, 1521 bp, Prochlorococcus marinus; identical to SEQ ID NO: 2713
  CDS (1)..(1521)

SEQ ID NO: 8913 - protein, 506 aa, Prochlorococcus marinus; identical to SEQ ID NO: 2714

SEQ ID NO: 8914 - DNA, 1488 bp, Haemophilus ducreyi; identical to SEQ ID NO: 2715
  CDS (1)..(1488)

SEQ ID NO: 8915 - protein, 495 aa, Haemophilus ducreyi; identical to SEQ ID NO: 2716

SEQ ID NO: 8916 - DNA, 1497 bp, Candidatus Blochmannia floridanus; identical to SEQ ID NO: 2717
  CDS (1)..(1497)

SEQ ID NO: 8917 - protein, 498 aa, Candidatus Blochmannia floridanus; identical to SEQ ID NO: 2718

SEQ ID NO: 8918 - DNA, 1768 bp, Oryza sativa; identical to SEQ ID NO: 2719
  CDS (2)..(1768)

SEQ ID NO: 8919 - protein, 588 aa, Oryza sativa; identical to SEQ ID NO: 2720

SEQ ID NO: 8920 - DNA, 1548 bp, Bos indicus; identical to SEQ ID NO: 2721
  CDS (1)..(1548)

SEQ ID NO: 8921 - protein, 515 aa, Bos indicus; identical to SEQ ID NO: 2722

SEQ ID NO: 8922 - DNA, 1536 bp, Chlamydophila caviae; identical to SEQ ID NO: 2723
  CDS (1)..(1536)

SEQ ID NO: 8923 - protein, 511 aa, Chlamydophila caviae; identical to SEQ ID NO: 2724

SEQ ID NO: 8924 - DNA, 1524 bp, Streptomyces avermitilis; identical to SEQ ID NO: 2725
  CDS (1)..(1524)

SEQ ID NO: 8925 - protein, 507 aa, Streptomyces avermitilis; identical to SEQ ID NO: 2726

SEQ ID NO: 8926 - DNA, 1647 bp, Streptomyces avermitilis; identical to SEQ ID NO: 2727
  CDS (1)..(1647)

SEQ ID NO: 8927 - protein, 548 aa, Streptomyces avermitilis; identical to SEQ ID NO: 2728

SEQ ID NO: 8928 - DNA, 1491 bp, Nitrosomonas europaea; identical to SEQ ID NO: 2729
  CDS (1)..(1491)

SEQ ID NO: 8929 - protein, 496 aa, Nitrosomonas europaea; identical to SEQ ID NO: 2730

SEQ ID NO: 8930 - DNA, 1524 bp, Enterococcus faecalis; identical to SEQ ID NO: 2731
  CDS (1)..(1524)

SEQ ID NO: 8931 - protein, 507 aa, Enterococcus faecalis; identical to SEQ ID NO: 2732

SEQ ID NO: 8932 - DNA, 1464 bp, Tropheryma whipplei; identical to SEQ ID NO: 2733
  CDS (1)..(1464)

SEQ ID NO: 8933 - protein, 487 aa, Tropheryma whipplei; identical to SEQ ID NO: 2734

SEQ ID NO: 8934 - DNA, 2145 bp, Leishmania mexicana; identical to SEQ ID NO: 2735
  CDS (298)..(1986)

SEQ ID NO: 8935 - protein, 562 aa, Leishmania mexicana; identical to SEQ ID NO: 2736

SEQ ID NO: 8936 - DNA, 1494 bp, Dictyostelium discoideum; identical to SEQ ID NO: 2737
  CDS (1)..(1494)

SEQ ID NO: 8937 - protein, 497 aa, Dictyostelium discoideum; identical to SEQ ID NO: 2738

SEQ ID NO: 8938 - DNA, 1503 bp, Xylella fastidiosa; identical to SEQ ID NO: 2739
  CDS (1)..(1503)

SEQ ID NO: 8939 - protein, 500 aa, Xylella fastidiosa; identical to SEQ ID NO: 2740

SEQ ID NO: 8940 - DNA, 1506 bp, Vibrio parahaemolyticus; identical to SEQ ID NO: 2741
  CDS (1)..(1506)

SEQ ID NO: 8941 - protein, 501 aa, Vibrio parahaemolyticus; identical to SEQ ID NO: 2742

SEQ ID NO: 8942 - DNA, 1533 bp, Pseudomonas syringae; identical to SEQ ID NO: 2743
  CDS (1)..(1533)

SEQ ID NO: 8943 - protein, 510 aa, Pseudomonas syringae; identical to SEQ ID NO: 2744

SEQ ID NO: 8944 - DNA, 1470 bp, Pseudomonas syringae; identical to SEQ ID NO: 2745
  CDS (1)..(1470)

SEQ ID NO: 8945 - protein, 489 aa, Pseudomonas syringae; identical to SEQ ID NO: 2746

SEQ ID NO: 8946 - DNA, 1458 bp, Pseudomonas putida; identical to SEQ ID NO: 2747
  CDS (1)..(1458)

SEQ ID NO: 8947 - protein, 485 aa, Pseudomonas putida; identical to SEQ ID NO: 2748

SEQ ID NO: 8948 - DNA, 1506 bp, Pseudomonas putida; identical to SEQ ID NO: 2749
  CDS (1)..(1506)

SEQ ID NO: 8949 - protein, 501 aa, Pseudomonas putida; identical to SEQ ID NO: 2750

SEQ ID NO: 8950 - DNA, 1470 bp, Pseudomonas putida; identical to SEQ ID NO: 2751
  CDS (1)..(1470)

SEQ ID NO: 8951 - protein, 489 aa, Pseudomonas putida; identical to SEQ ID NO: 2752

SEQ ID NO: 8952 - DNA, 1485 bp, Lactobacillus plantarum; identical to SEQ ID NO: 2753
  CDS (1)..(1485)

SEQ ID NO: 8953 - protein, 494 aa, Lactobacillus plantarum; identical to SEQ ID NO: 2754

SEQ ID NO: 8954 - DNA, 1440 bp, Clostridium tetani; identical to SEQ ID NO: 2755
  CDS (1)..(1440)

SEQ ID NO: 8955 - protein, 479 aa, Clostridium tetani; identical to SEQ ID NO: 2756

SEQ ID NO: 8956 - DNA, 1512 bp, Bradyrhizobium japonicum; identical to SEQ ID NO: 2757
  CDS (1)..(1512)

SEQ ID NO: 8957 - protein, 503 aa, Bradyrhizobium japonicum; identical to SEQ ID NO: 2758

SEQ ID NO: 8958 - DNA, 1497 bp, Bacteroides thetaiotaomicron; identical to SEQ ID NO: 2759
  CDS (1)..(1497)

SEQ ID NO: 8959 - protein, 498 aa, Bacteroides thetaiotaomicron; identical to SEQ ID NO: 2760

SEQ ID NO: 8960 - DNA, 4583 bp, Mus musculus; identical to SEQ ID NO: 2761
  CDS (119)..(2488)

SEQ ID NO: 8961 - protein, 789 aa, Mus musculus; identical to SEQ ID NO: 2762

SEQ ID NO: 8962 - DNA, 1485 bp, Staphylococcus epidermidis; identical to SEQ ID NO: 2763
  CDS (1)..(1485)

SEQ ID NO: 8963 - protein, 494 aa, Staphylococcus epidermidis; identical to SEQ ID NO: 2764

SEQ ID NO: 8964 - DNA, 1590 bp, Yersinia pestis; identical to SEQ ID NO: 2765
  CDS (1)..(1590)

SEQ ID NO: 8965 - protein, 529 aa, Yersinia pestis; identical to SEQ ID NO: 2766

SEQ ID NO: 8966 - DNA, 1530 bp, Synechococcus elongatus; identical to SEQ ID NO: 2767
  CDS (1)..(1530)

SEQ ID NO: 8967 - protein, 509 aa, Synechococcus elongatus; identical to SEQ ID NO: 2768

SEQ ID NO: 8968 - DNA, 1473 bp, Shewanella oneidensis; identical to SEQ ID NO: 2769
  CDS (1)..(1473)

SEQ ID NO: 8969 - protein, 490 aa, Shewanella oneidensis; identical to SEQ ID NO: 2770

SEQ ID NO: 8970 - DNA, 1476 bp, Oceanobacillus iheyensis; identical to SEQ ID NO: 2771
  CDS (1)..(1476)

SEQ ID NO: 8971 - protein, 491 aa, Oceanobacillus iheyensis; identical to SEQ ID NO: 2772

SEQ ID NO: 8972 - DNA, 1344 bp, Corynebacterium efficiens; identical to SEQ ID NO: 2773
  CDS (1)..(1344)

SEQ ID NO: 8973 - protein, 447 aa, Corynebacterium efficiens; identical to SEQ ID NO: 2774

SEQ ID NO: 8974 - DNA, 1545 bp, Corynebacterium efficiens; identical to SEQ ID NO: 2775
  CDS (1)..(1545)

SEQ ID NO: 8975 - protein, 514 aa, Corynebacterium efficiens; identical to SEQ ID NO: 2776

SEQ ID NO: 8976 - DNA, 1668 bp, Bifidobacterium longum; identical to SEQ ID NO: 2777
  CDS (1)..(1668)

SEQ ID NO: 8977 - protein, 555 aa, Bifidobacterium longum; identical to SEQ ID NO: 2778

SEQ ID NO: 8978 - DNA, 1284 bp, Rhodococcus opacus; identical to SEQ ID NO: 2779
  CDS (1)..(1284)

SEQ ID NO: 8979 - protein, 427 aa, Rhodococcus opacus; identical to SEQ ID NO: 2780

SEQ ID NO: 8980 - DNA, 2879 bp, Leishmania guyanensis; identical to SEQ ID NO: 2781
  CDS (205)..(1893): n means a or g or c or t/u, s means g or c

SEQ ID NO: 8981 - protein, 562 aa, Leishmania guyanensis; identical to SEQ ID NO: 2782

SEQ ID NO: 8982 - DNA, 1689 bp, Leishmania mexicana; identical to SEQ ID NO: 2783
  CDS (1)..(1689): n means a or g or c or t/u, s means g or c

SEQ ID NO: 8983 - protein, 562 aa, Leishmania mexicana; identical to SEQ ID NO: 2784
  Xaa in position 76-148 and 492-510 is unknown

SEQ ID NO: 8984 - DNA, 2916 bp, Leishmania amazonensis; identical to SEQ ID NO: 2785
  CDS (207)..(1895): n means a or g or c or t/u, y means t/u or c

SEQ ID NO: 8985 - protein, 562 aa, Leishmania amazonensis; identical to SEQ ID NO: 2786
  Xaa in position 463 and 481 is unknown

SEQ ID NO: 8986 - DNA, 1440 bp, Chlorobium tepidum; identical to SEQ ID NO: 2787
  CDS (1)..(1440)

SEQ ID NO: 8987 - protein, 479 aa, Chlorobium tepidum; identical to SEQ ID NO: 2788

SEQ ID NO: 8988 - DNA, 2187 bp, Methylobacterium extorquens; identical to SEQ ID NO: 2789
  CDS (640)..(2187)

SEQ ID NO: 8989 - protein, 515 aa, Methylobacterium extorquens; identical to SEQ ID NO: 2790

SEQ ID NO: 8990 - DNA, 1476 bp, Bartonella henselae; identical to SEQ ID NO: 2791
  CDS (1)..(1476)

SEQ ID NO: 8991 - protein, 491 aa, Bartonella henselae; identical to SEQ ID NO: 2792

SEQ ID NO: 8992 - DNA, 2266 bp, Toxoplasma gondii; identical to SEQ ID NO: 2793
  CDS (169)..(1851)

SEQ ID NO: 8993 - protein, 560 aa, Toxoplasma gondii; identical to SEQ ID NO: 2794

SEQ ID NO: 8994 - DNA, 1923 bp, Xanthomonas campestris; identical to SEQ ID NO: 2795
  CDS (1)..(1923)

SEQ ID NO: 8995 - protein, 640 aa, Xanthomonas campestris; identical to SEQ ID NO: 2796

SEQ ID NO: 8996 - DNA, 1431 bp, Xanthomonas campestris; identical to SEQ ID NO: 2797
  CDS (1)..(1431)

SEQ ID NO: 8997 - protein, 476 aa, Xanthomonas campestris; identical to SEQ ID NO: 2798

SEQ ID NO: 8998 - DNA, 1839 bp, Xanthomonas axonopodis; identical to SEQ ID NO: 2799
  CDS (1)..(1839)

SEQ ID NO: 8999 - protein, 612 aa, Xanthomonas axonopodis; identical to SEQ ID NO: 2800

SEQ ID NO: 9000 - DNA, 1431 bp, Xanthomonas axonopodis; identical to SEQ ID NO: 2801
  CDS (1)..(1431)

SEQ ID NO: 9001 - protein, 476 aa, Xanthomonas axonopodis; identical to SEQ ID NO: 2802

SEQ ID NO: 9002 - DNA, 1458 bp, Thermoanaerobacter tengcongensis; identical to SEQ ID NO: 2803
  CDS (1)..(1458)

SEQ ID NO: 9003 - protein, 485 aa, Thermoanaerobacter tengcongensis; identical to SEQ ID NO: 2804

SEQ ID NO: 9004 - DNA, 1762 bp, Oryza sativa; identical to SEQ ID NO: 2805
  CDS (41)..(1558)

SEQ ID NO: 9005 - protein, 505 aa, Oryza sativa; identical to SEQ ID NO: 2806

SEQ ID NO: 9006 - DNA, 1305 bp, Encephalitozoon cuniculi; identical to SEQ ID NO: 2807
  CDS (1)..(1305)

SEQ ID NO: 9007 - protein, 434 aa, Encephalitozoon cuniculi; identical to SEQ ID NO: 2808

SEQ ID NO: 9008 - DNA, 2125 bp, Drosophila melanogaster; identical to SEQ ID NO: 2809
  CDS (158)..(1738)

SEQ ID NO: 9009 - protein, 526 aa, Drosophila melanogaster; identical to SEQ ID NO: 2810

SEQ ID NO: 9010 - DNA, 1470 bp, Ralstonia solanacearum; identical to SEQ ID NO: 2811
  CDS (1)..(1470)

SEQ ID NO: 9011 - protein, 489 aa, Ralstonia solanacearum; identical to SEQ ID NO: 2812

SEQ ID NO: 9012 - DNA, 1521 bp, Enterococcus mundtii; identical to SEQ ID NO: 2813
  CDS (1)..(1521)

SEQ ID NO: 9013 - protein, 506 aa, Enterococcus mundtii; identical to SEQ ID NO: 2814

SEQ ID NO: 9014 - DNA, 2230 bp, Homo sapiens; identical to SEQ ID NO: 2815
  CDS (54)..(1601)

SEQ ID NO: 9015 - protein, 515 aa, Homo sapiens [sequence omitted]

SEQ ID NO: 9016 - DNA, 1470 bp, Rhizobium loti; identical to SEQ ID NO: 2817
  CDS (1)..(1470)

SEQ ID NO: 9017 - protein, 489 aa, Rhizobium loti; identical to SEQ ID NO: 2818

SEQ ID NO: 9018 - DNA, 1428 bp, Rhizobium loti; identical to SEQ ID NO: 2819
  CDS (1)..(1428)

SEQ ID NO: 9019 - protein, 475 aa, Rhizobium loti; identical to SEQ ID NO: 2820

SEQ ID NO: 9020 - DNA, 3584 bp, Plasmodium berghei; identical to SEQ ID NO: 2821
  CDS (370)..(3222)

SEQ ID NO: 9021 - protein, 950 aa, Plasmodium berghei; identical to SEQ ID NO: 2822

SEQ ID NO: 9022 - DNA, 1491 bp, Pasteurella multocida; identical to SEQ ID NO: 2823
  CDS (1)..(1491)

SEQ ID NO: 9023 - protein, 496 aa, Pasteurella multocida; identical to SEQ ID NO: 2824

SEQ ID NO: 9024 - DNA, 1470 bp, Pseudomonas putida; identical to SEQ ID NO: 2825
  CDS (1)..(1470)

SEQ ID NO: 9025 - protein, 489 aa, Pseudomonas putida; identical to SEQ ID NO: 2826

SEQ ID NO: 9026 - DNA, 1566 bp, Trypanosoma brucei; identical to SEQ ID NO: 2827
  CDS (1)..(1566)

SEQ ID NO: 9027 - protein, 521 aa, Trypanosoma brucei; identical to SEQ ID NO: 2828

SEQ ID NO: 9028 - DNA, 1904 bp, Triticum aestivum; identical to SEQ ID NO: 2829
  CDS (153)..(1682)

SEQ ID NO: 9029 - protein, 509 aa, Triticum aestivum; identical to SEQ ID NO: 2830

SEQ ID NO: 9030 - DNA, 2098 bp, Solanum tuberosum; identical to SEQ ID NO: 2831
  CDS (27)..(1775)

SEQ ID NO: 9031 - protein, 582 aa, Solanum tuberosum; identical to SEQ ID NO: 2832

SEQ ID NO: 9032 - DNA, 1924 bp, Dunaliella bioculata; identical to SEQ ID NO: 2833
  CDS (68)..(1840)

SEQ ID NO: 9033 - protein, 590 aa, Dunaliella bioculata; identical to SEQ ID NO: 2834

SEQ ID NO: 9034 - DNA, 1976 bp, Cyanidium caldarium; identical to SEQ ID NO: 2835
  CDS (46)..(1848)

SEQ ID NO: 9035 - protein, 600 aa, Cyanidium caldarium; identical to SEQ ID NO: 2836

SEQ ID NO: 9036 - DNA, 2106 bp, Drosophila melanogaster; identical to SEQ ID NO: 2837
  CDS (28)..(1746)

SEQ ID NO: 9037 - protein, 572 aa, Drosophila melanogaster; identical to SEQ ID NO: 2838

SEQ ID NO: 9038 - DNA, 1777 bp, Mesembryanthemum crystallinum; identical to SEQ ID NO: 2839
  CDS (39)..(1589)

SEQ ID NO: 9039 - protein, 516 aa, Mesembryanthemum crystallinum; identical to SEQ ID NO: 2840

SEQ ID NO: 9040 - DNA, 1542 bp, Mus musculus; identical to SEQ ID NO: 2841
  CDS (1)..(1542)

SEQ ID NO: 9041 - protein, 513 aa, Mus musculus; identical to SEQ ID NO: 2842

SEQ ID NO: 9042 - DNA, 1485 bp, Actinobacillus actinomycetemcomitans; identical to SEQ ID NO: 2843
  CDS (1)..(1485)

SEQ ID NO: 9043 - protein, 494 aa, Actinobacillus actinomycetemcomitans; identical to SEQ ID NO: 2844

SEQ ID NO: 9044 - DNA, 1473 bp, Buchnera aphidicola; identical to SEQ ID NO: 2845
  CDS (1)..(1473)

SEQ ID NO: 9045 - protein, 490 aa, Buchnera aphidicola; identical to SEQ ID NO: 2846

SEQ ID NO: 9046 - DNA, 1473 bp, Buchnera aphidicola; identical to SEQ ID NO: 2847
  CDS (1)..(1473)

SEQ ID NO: 9047 - protein, 490 aa, Buchnera aphidicola; identical to SEQ ID NO: 2848

SEQ ID NO: 9048 - DNA, 2049 bp, Ceratitis capitata; identical to SEQ ID NO: 2849
  CDS (60)..(1640)

SEQ ID NO: 9049 - protein, 526 aa, Ceratitis capitata; identical to SEQ ID NO: 2850

SEQ ID NO: 9050 - DNA, 1524 bp, Chlamydia muridarum; identical to SEQ ID NO: 2851
  CDS (1)..(1524)

SEQ ID NO: 9051 - protein, 507 aa, Chlamydia muridarum; identical to SEQ ID NO: 2852

SEQ ID NO: 9052 - DNA, 2062 bp, Drosophila melanogaster; identical to SEQ ID NO: 2853
  CDS (303)..(1877)

SEQ ID NO: 9053 - protein, 524 aa, Drosophila melanogaster; identical to SEQ ID NO: 2854

SEQ ID NO: 9054 - DNA, 1536 bp, Emericella nidulans; identical to SEQ ID NO: 2855
  CDS (1)..(1536)

SEQ ID NO: 9055 - protein, 511 aa, Emericella nidulans; identical to SEQ ID NO: 2856

SEQ ID NO: 9056 - DNA, 1957 bp, Leuconostoc mesenteroides; identical to SEQ ID NO: 2857
  CDS (206)..(1666)

SEQ ID NO: 9057 - protein, 486 aa, Leuconostoc mesenteroides; identical to SEQ ID NO: 2858

SEQ ID NO: 9058 - DNA, 2055 bp, Macropus robustus; identical to SEQ ID NO: 2859
  CDS (94)..(1641)

SEQ ID NO: 9059 - protein, 515 aa, Macropus robustus; identical to SEQ ID NO: 2860

SEQ ID NO: 9060 - DNA, 1530 bp, Nostoc punctiforme; identical to SEQ ID NO: 2861
  CDS (1)..(1530)

SEQ ID NO: 9061 - protein, 509 aa, Nostoc punctiforme; identical to SEQ ID NO: 2862

SEQ ID NO: 9062 - DNA, 1476 bp, Rhizobium meliloti; identical to SEQ ID NO: 2863
  CDS (1)..(1476)

SEQ ID NO: 9063 - protein, 491 aa, Rhizobium meliloti; identical to SEQ ID NO: 2864

SEQ ID NO: 9064 - DNA, 2853 bp, Homo sapiens; identical to SEQ ID NO: 2865
  CDS (273)..(2648)

SEQ ID NO: 9065 - protein, 791 aa, Homo sapiens; identical to SEQ ID NO: 2866

SEQ ID NO: 9066 - DNA, 1970 bp, Arabidopsis thaliana; identical to SEQ ID NO: 2867
  CDS (60)..(1790)

SEQ ID NO: 9067 - protein, 576 aa, Arabidopsis thaliana; identical to SEQ ID NO: 2868

SEQ ID NO: 9068 - DNA, 2112 bp, Arabidopsis thaliana; identical to SEQ ID NO: 2869
  CDS (142)..(1932)

SEQ ID NO: 9069 - protein, 596 aa, Arabidopsis thaliana; identical to SEQ ID NO: 2870

SEQ ID NO: 9070 - DNA, 2161 bp, Arabidopsis thaliana; identical to SEQ ID NO: 2871
  CDS (90)..(1967)

SEQ ID NO: 9071 - protein, 625 aa, Arabidopsis thaliana; identical to SEQ ID NO: 2872

SEQ ID NO: 9072 - DNA, 1936 bp, Arabidopsis thaliana; identical to SEQ ID NO: 2873
  CDS (136)..(1686)

SEQ ID NO: 9073 - protein, 516 aa, Arabidopsis thaliana; identical to SEQ ID NO: 2874

SEQ ID NO: 9074 - DNA, 1959 bp, Arabidopsis thaliana; identical to SEQ ID NO: 2875
  CDS (194)..(1741)

SEQ ID NO: 9075 - protein, 515 aa, Arabidopsis thaliana [sequence omitted]

SEQ ID NO: 9076 - DNA, 1503 bp, Xenopus laevis; identical to SEQ ID NO: 2877
  CDS (1)..(1503)

SEQ ID NO: 9077 - protein, 500 aa, Xenopus laevis; identical to SEQ ID NO: 2878

SEQ ID NO: 9078 - DNA, 2004 bp, Arabidopsis thaliana; identical to SEQ ID NO: 2879
  CDS (51)..(1850)

SEQ ID NO: 9079 - protein, 599 aa, Arabidopsis thaliana; identical to SEQ ID NO: 2880

SEQ ID NO: 9080 - DNA, 23 bp, artificial sequence
  primer
atgagtgaaggccccgtcaaatt

SEQ ID NO: 9081 - DNA, 25 bp, artificial sequence
  primer
ctaattatccttcgtatcttctggc

SEQ ID NO: 9082 - protein, 24 aa, consensus
  MISC_FEATURE (1)..(24): consensus for the disclosure of Xaa see table VIII
RXXXXXGPCSXXXXXXXXXYXXXX

SEQ ID NO: 9083 - protein, 42 aa, consensus; identical to SEQ ID NO: 2884
  MISC_FEATURE (1)..(42): consensus for the disclosure of Xaa see table VIII

SEQ ID NO: 9084 - protein, 65 aa, consensus; identical to SEQ ID NO: 2885
  MISC_FEATURE (1)..(65): consensus for the disclosure of Xaa see table VIII

SEQ ID NO: 9085 - protein, 71 aa, consensus; identical to SEQ ID NO: 2886
  MISC_FEATURE (1)..(71): consensus for the disclosure of Xaa see table VIII

SEQ ID NO: 9086 - protein, 41 aa, consensus; identical to SEQ ID NO: 2887
  MISC_FEATURE (1)..(41): consensus for the disclosure of Xaa see table VIII

SEQ ID NO: 9087 - protein, 455 aa, consensus; identical to SEQ ID NO: 2888
  MISC_FEATURE (1)..(455): Xaa in all positions is any amino acid

SEQ ID NO: 9088 - protein, 58 aa, consensus; identical to SEQ ID NO: 6166
  MISC_FEATURE (1)..(58): consensus for the disclosure of Xaa see table VIII

SEQ ID NO: 9089 - protein, 74 aa, consensus; identical to SEQ ID NO: 6167
  MISC_FEATURE (1)..(74): consensus for the disclosure of Xaa see table VIII

SEQ ID NO: 9090 - protein, 44 aa, consensus; identical to SEQ ID NO: 6168
  MISC_FEATURE (1)..(44): consensus for the disclosure of Xaa see table VIII

SEQ ID NO: 9091 - protein, 76 aa, consensus; identical to SEQ ID NO: 2897
  MISC_FEATURE (1)..(76): consensus for the disclosure of Xaa see table VIII

SEQ ID NO: 9092 - protein, 39 aa, consensus; identical to SEQ ID NO: 2898
  MISC_FEATURE (1)..(39): consensus for the disclosure of Xaa see table VIII

SEQ ID NO: 9093 - protein, 84 aa, consensus; identical to SEQ ID NO: 2899
  MISC_FEATURE (1)..(84): consensus for the disclosure of Xaa see table VIII

SEQ ID NO: 9094 - protein, 31 aa, consensus; identical to SEQ ID NO: 2900
  MISC_FEATURE (1)..(31): consensus for the disclosure of Xaa see table VIII

SEQ ID NO: 9095 - protein, 101 aa, consensus; identical to SEQ ID NO: 1322
  MISC_FEATURE (1)..(101): consensus for the disclosure of Xaa see table VIII

SEQ ID NO: 9096 - protein, 642 aa, consensus; identical to SEQ ID NO: 2902
  MISC_FEATURE (1)..(642): Xaa in all positions is any amino acid

SEQ ID NO: 9097 - protein, 64 aa, consensus
  MISC_FEATURE (1)..(64): consensus for the disclosure of Xaa see table VIII
XXXXXXXXXXXXXXXXXXXXXXXXXXXXXXXXXXXXXXXXXXXXXXXXXXXXXRXXXXXXXXXX

SEQ ID NO: 9098 - protein, 61 aa, consensus
  MISC_FEATURE (1)..(61): consensus for the disclosure of Xaa see table VIII
LXXXXXXXXXXXXXXXXXXXXXXXXXXXXXXXXXXXXXXXXXXXXXXXXXXXXXXXXXXXX

SEQ ID NO: 9099 - protein, 55 aa, consensus
  MISC_FEATURE (1)..(55): consensus for the disclosure of Xaa see table VIII
XXXXXXXXXXXAXXXXXXXXXXXXXXXXXXXXXXXXXXXXXXXXXXXXXXHXXRX

SEQ ID NO: 9100 - protein, 64 aa, consensus
  MISC_FEATURE (1)..(64): consensus for the disclosure of Xaa see table VIII
XXXXXXXXXXXXXXXXXXXXXXXXXXXXXXXXXXEXXXXXXXXXXXXXXXXPXXXXXXLXXXTX

SEQ ID NO: 9101 - protein, 20 aa, consensus
  MISC_FEATURE (1)..(20): consensus for the disclosure of Xaa see table VIII
XXXXXXXXXXXXXXXXXXXX

SEQ ID NO: 9102 - protein, 278 aa, consensus
  MISC_FEATURE (1)..(278): Xaa in all positions is any amino acid
GXXVXXXXAXXXVXXHXXXYGXXXFEGXRXYXXXXXXXXXXXFXXXXHXXRLXXSAXXXXXXXXXXXXXXXXXXXXXXXXXXXXXXXYXRXXXXXGXXXXXXXXXXXXXXXXXXXXXXXXXXXXXXXXXXXXGXXXXXXXXXRXXXXXXXXXXKXXXXYXXXXXXXXEAXXXGXXXXXXLXXXGXXXEXXXXNXFXVXXGXXXTPXXXXXXLXGITRXXXXXXXXXXGXXXXEXXXXXXXXXXXADEXFXXGTAXEXXPXXXXDXXXXXXXXXXGXXT

SEQ ID NO: 9103 - protein, 37 aa, consensus
  MISC_FEATURE (1)..(37): consensus for the disclosure of Xaa see table VIII
EXXXXNXXXXXXXXXXXXXXXXTXXXXXXXXXXXXXX

SEQ ID NO: 9104 - protein, 48 aa, consensus
  MISC_FEATURE (1)..(48): consensus for the disclosure of Xaa see table VIII
KXEXXXXXXXXXXXXXXXXXXXXXXXXRGDXXXXXXXXXXXXXXXXXX

SEQ ID NO: 9105 - protein, 63 aa, consensus
  MISC_FEATURE (1)..(63): consensus for the disclosure of Xaa see table VIII
XXXAXXXXXXXXXXXXXTRXEXXDXXXXXXXXXXXXXLXXEXXXGXXPXXXXXXXXXXXXXXX

SEQ ID NO: 9106 - protein, 346 aa, consensus
  MISC_FEATURE (1)..(346): Xaa in all positions is any amino acid
GXXXXXRXNFSHGXXXXHXXXXXXXXXXXXXXXXXXXXXXXXXXXXDXXGPXIRXXXXXXXXXXXXXXXXXXGXXXXXXXXXXXXXXXXXXXXXXXXXXXXXXXXXXXXXGXXXXXXDGXXXXXVXXXXXXXXXXXXXXXXXXXXXXXXGXXXXXKXXNXXXXXXXXXXXXXKDXXDXXXXXXXXXXXDXXXXSFXXXXXDXXXXXXXXXXXXXXXXXXXXXXXXXKXEXXXXXXXXXXXXXIXXXXDXXMVARGDLGXEXXXXXXXXXQKXXIXXXXXXXXXVIXATQMLXSMXXXPXPTRAEXXDVXNAXXDGXDXXMLSXEXAXGXXPXXXVXXMXXXXXXXE

SEQ ID NO: 9107 - protein, 20 aa, consensus
  MISC_FEATURE (1)..(20): consensus for the disclosure of Xaa see table VIII
XXXXXXXXGXXXXXXXXXXX

SEQ ID NO: 9108 - protein, 94 aa, consensus; identical to SEQ ID NO: 1313
  MISC_FEATURE (1)..(94): consensus for the disclosure of Xaa see table VIII

SEQ ID NO: 9109 - protein, 89 aa, consensus; identical to SEQ ID NO: 1314
  MISC_FEATURE (1)..(89): consensus for the disclosure of Xaa see table VIII

SEQ ID NO: 9110 - protein, 464 aa, consensus; identical to SEQ ID NO: 1315
  MISC_FEATURE (1)..(464): Xaa in all Positions is any amino acid

SEQ ID NO: 9111 - protein, 122 aa, consensus; identical to SEQ ID NO: 1316
  MISC_FEATURE (1)..(122): consensus for the disclosure of Xaa see table VIII

SEQ ID NO: 9112 - protein, 50 aa, consensus; identical to SEQ ID NO: 1317
  MISC_FEATURE (1)..(50): consensus for the disclosure of Xaa see table VIII

SEQ ID NO: 9113 - protein, 62 aa, consensus; identical to SEQ ID NO: 1318
  MISC_FEATURE (1)..(62): consensus for the disclosure of Xaa see table VIII

SEQ ID NO: 9114 - protein, 65 aa, consensus; identical to SEQ ID NO: 1319
  MISC_FEATURE (1)..(65): consensus for the disclosure of Xaa see table VIII

SEQ ID NO: 9115 - protein, 432 aa, consensus; identical to SEQ ID NO: 1320
  MISC_FEATURE (1)..(432): Xaa on all Positions is any amino acid

SEQ ID NO: 9116 - protein, 432 aa, consensus; identical to SEQ ID NO: 1321
  MISC_FEATURE (1)..(432): Xaa in all Positions is any amino acid

SEQ ID NO: 9117 - protein, 101 aa, consensus; identical to SEQ ID NO: 1322
  MISC_FEATURE (1)..(101): consensus for the disclosure of Xaa see table VIII

SEQ ID NO: 9118 - protein, 23 aa, consensus
  MISC_FEATURE (1)..(23): consensus for the disclosure of Xaa see table VIII
XXXLPXPXXXXXXXXXXXXXXXX

SEQ ID NO: 9119 - protein, 27 aa, consensus
  MISC_FEATURE (1)..(27): consensus for the disclosure of Xaa see table VIII
XXXXXXXXXXXXXXXXXXXXXXXLXXX

SEQ ID NO: 9120 - protein, 16 aa, consensus
  MISC_FEATURE (1)..(16): consensus for the disclosure of Xaa see table VIII
XXXXXXXXXFXXXRXX

SEQ ID NO: 9121 - protein, 45 aa, consensus; identical to SEQ ID NO: 2913
  MISC_FEATURE (1)..(45): consensus for the disclosure of Xaa see table VIII

SEQ ID NO: 9122 - protein, 31 aa, consensus; identical to SEQ ID NO: 2914
  MISC_FEATURE (1)..(31): consensus for the disclosure of Xaa see table VIII

SEQ ID NO: 9123 - protein, 43 aa, consensus; identical to SEQ ID NO: 2915
  MISC_FEATURE (1)..(43): consensus for the disclosure of Xaa see table VIII

SEQ ID NO: 9124 - protein, 24 aa, consensus
  MISC_FEATURE (1)..(24): consensus for the disclosure of Xaa see table VIII
HXXXXXXXXXXXXXXXXXXXXXXX

SEQ ID NO: 9125 - protein, 65 aa, consensus; identical to SEQ ID NO: 1307
  MISC_FEATURE (1)..(65): consensus for the disclosure of Xaa see table VIII

SEQ ID NO: 9126 - protein, 137 aa, consensus; identical to SEQ ID NO: 6194
  MISC_FEATURE (1)..(137): consensus for the disclosure of Xaa see table VIII

SEQ ID NO: 9127 - protein, 166 aa, consensus; identical to SEQ ID NO: 6195
  MISC_FEATURE (1)..(166): consensus for the disclosure of Xaa see table VIII

SEQ ID NO: 9128 - protein, 447 aa, consensus; identical to SEQ ID NO: 6196
  MISC_FEATURE (1)..(447): Xaa in all positions is any amino acid

SEQ ID NO: 9129 - protein, 447 aa, consensus; identical to SEQ ID NO: 6197
  MISC_FEATURE (1)..(447): Xaa in all positions is any amino acid

SEQ ID NO: 9130 - protein, 150 aa, consensus; identical to SEQ ID NO: 2917
  MISC_FEATURE (1)..(150): consensus for the disclosure of Xaa see table VIII

SEQ ID NO: 9131 - protein, 44 aa, consensus; identical to SEQ ID NO: 2918
  MISC_FEATURE (1)..(44): consensus for the disclosure of Xaa see table VIII

SEQ ID NO: 9132 - protein, 97 aa, consensus; identical to SEQ ID NO: 2919
  MISC_FEATURE (1)..(97): consensus for the disclosure of Xaa see table VIII

SEQ ID NO: 9133 - protein, 1277 aa, consensus; identical to SEQ ID NO: 2920
  MISC_FEATURE (1)..(1277): Xaa in all Positions is any amino acid

SEQ ID NO: 9134 - DNA, 1563 bp, Escherichia coli K12; identical to SEQ ID NO: 3241
  CDS (1)..(1563)

SEQ ID NO: 9135 - protein, 520 aa, Escherichia coli K12; identical to SEQ ID NO: 3242

SEQ ID NO: 9136 - DNA, 2984 bp, Rhizobium meliloti; identical to SEQ ID NO: 3243
  CDS (638)..(2827)

SEQ ID NO: 9137 - protein, 729 aa, Rhizobium meliloti; identical to SEQ ID NO: 3244

SEQ ID NO: 9138 - DNA, 1365 bp, Salmonella typhimurium; identical to SEQ ID NO: 3245
  CDS (1)..(1365)

SEQ ID NO: 9139 - protein, 454 aa, Salmonella typhimurium; identical to SEQ ID NO: 3246

SEQ ID NO: 9140 - DNA, 1413 bp, Bacillus subtilis; identical to SEQ ID NO: 3247
  CDS (1)..(1413)

SEQ ID NO: 9141 - protein, 470 aa, Bacillus subtilis; identical to SEQ ID NO: 3248

SEQ ID NO: 9142 - DNA, 1449 bp, Spirochaeta aurantia; identical to SEQ ID NO: 3249
  CDS (1)..(1449)

SEQ ID NO: 9143 - protein, 482 aa, Spirochaeta aurantia; identical to SEQ ID NO: 3250

SEQ ID NO: 9144 - DNA, 1389 bp, Methanobacterium thermoautotrophicum; identical to SEQ ID NO: 3251
  CDS (1)..(1389)

SEQ ID NO: 9145 - protein, 462 aa, Methanobacterium thermoautotrophicum; identical to SEQ ID NO: 3252

SEQ ID NO: 9146 - DNA, 1572 bp, Haloferax volcanii; identical to SEQ ID NO: 3253
  CDS (1)..(1572)

SEQ ID NO: 9147 - protein, 523 aa, Haloferax volcanii; identical to SEQ ID NO: 3254

SEQ ID NO: 9148 - DNA, 1305 bp, Pyrococcus abyssi; identical to SEQ ID NO: 3255
  CDS (1)..(1305)

SEQ ID NO: 9149 - protein, 434 aa, Pyrococcus abyssi; identical to SEQ ID NO: 3256

SEQ ID NO: 9150 - DNA, 1572 bp, Vibrio cholerae; identical to SEQ ID NO: 3257
  CDS (1)..(1572)

SEQ ID NO: 9151 - protein, 523 aa, Vibrio cholerae; identical to SEQ ID NO: 3258

SEQ ID NO: 9152 - DNA, 1359 bp, Xylella fastidiosa; identical to SEQ ID NO: 3259
  CDS (1)..(1359)

SEQ ID NO: 9153 - protein, 452 aa, Xylella fastidiosa; identical to SEQ ID NO: 3260

SEQ ID NO: 9154 - DNA, 1464 bp, Xylella fastidiosa; identical to SEQ ID NO: 3261
  CDS (1)..(1464)

SEQ ID NO: 9155 - protein, 487 aa, Xylella fastidiosa; identical to SEQ ID NO: 3262

SEQ ID NO: 9156 - DNA, 2760 bp, Arabidopsis thaliana (mouse-ear cress); identical to SEQ ID NO: 3263
  CDS (7)..(2760)

SEQ ID NO: 9157 - protein, 917 aa, Arabidopsis thaliana (mouse-ear cress); identical to SEQ ID NO: 3264

SEQ ID NO: 9158 - DNA, 1722 bp, Streptococcus pneumoniae; identical to SEQ ID NO: 3265
  CDS (1)..(1722)

SEQ ID NO: 9159 - protein, 573 aa, Streptococcus pneumoniae; identical to SEQ ID NO: 3266

SEQ ID NO: 9160 - DNA, 1362 bp, Streptococcus pneumoniae; identical to SEQ ID NO: 3267
  CDS (1)..(1362)

SEQ ID NO: 9161 - protein, 453 aa, Streptococcus pneumoniae; identical to SEQ ID NO: 3268

SEQ ID NO: 9162 - DNA, 1428 bp, Clostridium acetobutylicum; identical to SEQ ID NO: 3269
  CDS (1)..(1428)

SEQ ID NO: 9163 - protein, 475 aa, Clostridium acetobutylicum; identical to SEQ ID NO: 3270

SEQ ID NO: 9164 - DNA, 1566 bp, Yersinia pestis; identical to SEQ ID NO: 3271
  CDS (1)..(1566)

SEQ ID NO: 9165 - protein, 521 aa, Yersinia pestis; identical to SEQ ID NO: 3272

SEQ ID NO: 9166 - DNA, 2148 bp, Nostoc sp. PCC 7120; identical to SEQ ID NO: 3273
  CDS (1)..(2148)

SEQ ID NO: 9167 - protein, 715 aa, Nostoc sp. PCC 7120; identical to SEQ ID NO: 3274

SEQ ID NO: 9168 - DNA, 1377 bp, Yersinia pestis; identical to SEQ ID NO: 3275
  CDS (1)..(1377)

SEQ ID NO: 9169 - protein, 458 aa, Yersinia pestis; identical to SEQ ID NO: 3276

SEQ ID NO: 9170 - DNA, 2145 bp, Nostoc sp. PCC 7120; identical to SEQ ID NO: 3277
  CDS (1)..(2145)

SEQ ID NO: 9171 - protein, 714 aa, Nostoc sp. PCC 7120; identical to SEQ ID NO: 3278

SEQ ID NO: 9172 - DNA, 2208 bp, Nostoc sp. PCC 7120; identical to SEQ ID NO: 3279
  CDS (1)..(2208)

SEQ ID NO: 9173 - protein, 735 aa, Nostoc sp. PCC 7120; identical to SEQ ID NO: 3280

SEQ ID NO: 9174 - DNA, 1515 bp, Nostoc sp. PCC 7120; identical to SEQ ID NO: 3281
  CDS (1)..(1515)

SEQ ID NO: 9175 - protein, 504 aa, Nostoc sp. PCC 7120; identical to SEQ ID NO: 3282

SEQ ID NO: 9176 - DNA, 1362 bp, Escherichia coli; identical to SEQ ID NO: 3283
  CDS (1)..(1362)

SEQ ID NO: 9177 - protein, 453 aa, Escherichia coli; identical to SEQ ID NO: 3284

SEQ ID NO: 9178 - DNA, 2190 bp, Agrobacterium tumefaciens; identical to SEQ ID NO: 3285
  CDS (1)..(2190)

SEQ ID NO: 9179 - protein, 729 aa, Agrobacterium tumefaciens; identical to SEQ ID NO: 3286

SEQ ID NO: 9180 - DNA, 1365 bp, Listeria monocytogenes; identical to SEQ ID NO: 3287
  CDS (1)..(1365)

SEQ ID NO: 9181 - protein, 454 aa, Listeria monocytogenes; identical to SEQ ID NO: 3288

SEQ ID NO: 9182 - DNA, 1365 bp, Listeria innocua; identical to SEQ ID NO: 3289
  CDS (1)..(1365)

SEQ ID NO: 9183 - protein, 454 aa, Listeria innocua; identical to SEQ ID NO: 3290

SEQ ID NO: 9184 - DNA, 1869 bp, Klebsiella pneumoniae; identical to SEQ ID NO: 3291
  CDS (151)..(1506)

SEQ ID NO: 9185 - protein, 451 aa, Klebsiella pneumoniae; identical to SEQ ID NO: 3292

SEQ ID NO: 9186 - DNA, 1389 bp, Leptospira biflexa; identical to SEQ ID NO: 3293
  CDS (1)..(1389)

SEQ ID NO: 9187 - protein, 462 aa, Leptospira biflexa; identical to SEQ ID NO: 3294

SEQ ID NO: 9188 - DNA, 1425 bp, Methanococcus jannaschii; identical to SEQ ID NO: 3295
  CDS (1)..(1425)

SEQ ID NO: 9189 - protein, 474 aa, Methanococcus jannaschii; identical to SEQ ID NO: 3296

SEQ ID NO: 9190 - DNA, 1503 bp, Helicobacter pylori; identical to SEQ ID NO: 3297
  CDS (1)..(1503)

SEQ ID NO: 9191 - protein, 500 aa, Helicobacter pylori; identical to SEQ ID NO: 3298

SEQ ID NO: 9192 - DNA, 1236 bp, Archaeoglobus fulgidus; identical to SEQ ID NO: 3299
  CDS (1)..(1236)

SEQ ID NO: 9193 - protein, 411 aa, Archaeoglobus fulgidus; identical to SEQ ID NO: 3300

SEQ ID NO: 9194 - DNA, 954 bp, Aeropyrum pernix; identical to SEQ ID NO: 3301
  CDS (1)..(954)

SEQ ID NO: 9195 - protein, 317 aa, Aeropyrum pernix; identical to SEQ ID NO: 3302

SEQ ID NO: 9196 - DNA, 1377 bp, Vibrio cholerae; identical to SEQ ID NO: 3303
  CDS (1)..(1377)

SEQ ID NO: 9197 - protein, 458 aa, Vibrio cholerae; identical to SEQ ID NO: 3304

SEQ ID NO: 9198 - DNA, 1497 bp, Xylella fastidiosa; identical to SEQ ID NO: 3305
  CDS (1)..(1497)

SEQ ID NO: 9199 - protein, 498 aa, Xylella fastidiosa; identical to SEQ ID NO: 3306

SEQ ID NO: 9200 - DNA, 1362 bp, Pseudomonas aeruginosa; identical to SEQ ID NO: 3307
  CDS (1)..(1362)

SEQ ID NO: 9201 - protein, 453 aa, Pseudomonas aeruginosa; identical to SEQ ID NO: 3308

SEQ ID NO: 9202 - DNA, 1461 bp, Bacillus halodurans; identical to SEQ ID NO: 3309
  CDS (1)..(1461)

SEQ ID NO: 9203 - protein, 486 aa, Bacillus halodurans; identical to SEQ ID NO: 3310

SEQ ID NO: 9204 - DNA, 1467 bp, Halobacterium sp. NRC-1; identical to SEQ ID NO: 3311
  CDS (1)..(1467)

SEQ ID NO: 9205 - protein, 488 aa, Halobacterium sp. NRC-1; identical to SEQ ID NO: 3312

SEQ ID NO: 9206 - DNA, 1584 bp, Halobacterium sp. NRC-1; identical to SEQ ID NO: 3313
  CDS (1)..(1584)

SEQ ID NO: 9207 - protein, 527 aa, Halobacterium sp. NRC-1; identical to SEQ ID NO: 3314

SEQ ID NO: 9208 - DNA, 1542 bp, Caulobacter crescentus; identical to SEQ ID NO: 3315
  CDS (1)..(1542)

SEQ ID NO: 9209 - protein, 513 aa, Caulobacter crescentus; identical to SEQ ID NO: 3316

SEQ ID NO: 9210 - DNA, 1557 bp, Haemophilus influenzae; identical to SEQ ID NO: 3317
  CDS (1)..(1557)

SEQ ID NO: 9211 - protein, 518 aa, Haemophilus influenzae; identical to SEQ ID NO: 3318

SEQ ID NO: 9212 - DNA, 1395 bp, Methanobacterium thermoautotrophicum; identical to SEQ ID NO: 3319
  CDS (1)..(1395)

SEQ ID NO: 9213 - protein, 464 aa, Methanobacterium thermoautotrophicum; identical to SEQ ID NO: 3320

SEQ ID NO: 9214 - DNA, 1509 bp, Bacillus halodurans; identical to SEQ ID NO: 3321
  CDS (1)..(1509)

SEQ ID NO: 9215 - protein, 502 aa, Bacillus halodurans; identical to SEQ ID NO: 3322

SEQ ID NO: 9216 - DNA, 1464 bp, Streptococcus pneumoniae; identical to SEQ ID NO: 3323
  CDS (1)..(1464)

SEQ ID NO: 9217 - protein, 487 aa, Streptococcus pneumoniae; identical to SEQ ID NO: 3324

SEQ ID NO: 9218 - DNA, 1479 bp, Pseudomonas aeruginosa; identical to SEQ ID NO: 3325
  CDS (1)..(1479)

SEQ ID NO: 9219 - protein, 492 aa, Pseudomonas aeruginosa; identical to SEQ ID NO: 3326

SEQ ID NO: 9220 - DNA, 1386 bp, Thermotoga maritima; identical to SEQ ID NO: 3327
  CDS (1)..(1386)

SEQ ID NO: 9221 - protein, 461 aa, Thermotoga maritima; identical to SEQ ID NO: 3328

SEQ ID NO: 9222 - DNA, 1482 bp, Pseudomonas putida; identical to SEQ ID NO: 3329
  CDS (1)..(1482)

SEQ ID NO: 9223 - protein, 493 aa, Pseudomonas putida; identical to SEQ ID NO: 3330

SEQ ID NO: 9224 - DNA, 3065 bp, Pseudomonas aeruginosa; identical to SEQ ID NO: 3331
  CDS (401)..(1993)

SEQ ID NO: 9225 - protein, 530 aa, Pseudomonas aeruginosa; identical to SEQ ID NO: 3332

SEQ ID NO: 9226 - DNA, 1485 bp, Aquifex aeolicus; identical to SEQ ID NO: 3333
  CDS (1)..(1485)

SEQ ID NO: 9227 - protein, 494 aa, Aquifex aeolicus; identical to SEQ ID NO: 3334

SEQ ID NO: 9228 - DNA, 1422 bp, Deinococcus radiodurans; identical to SEQ ID NO: 3335
  CDS (1)..(1422)

SEQ ID NO: 9229 - protein, 473 aa, Deinococcus radiodurans; identical to SEQ ID NO: 3336

SEQ ID NO: 9230 - DNA, 1917 bp, Deinococcus radiodurans; identical to SEQ ID NO: 3337
  CDS (1)..(1917)

SEQ ID NO: 9231 - protein, 638 aa, Deinococcus radiodurans; identical to SEQ ID NO: 3338

SEQ ID NO: 9232 - DNA, 1551 bp, Mycobacterium tuberculosis; identical to SEQ ID NO: 3339
  CDS (1)..(1551)

SEQ ID NO: 9233 - protein, 516 aa, Mycobacterium tuberculosis; identical to SEQ ID NO: 3340

SEQ ID NO: 9234 - DNA, 1503 bp, Helicobacter pylori; identical to SEQ ID NO: 3341
  CDS (1)..(1503)

SEQ ID NO: 9235 - protein, 500 aa, Helicobacter pylori; identical to SEQ ID NO: 3342

SEQ ID NO: 9236 - DNA, 1476 bp, Neisseria meningitidis; identical to SEQ ID NO: 3343
  CDS (1)..(1476)

SEQ ID NO: 9237 - protein, 491 aa, Neisseria meningitidis; identical to SEQ ID NO: 3344

SEQ ID NO: 9238 - DNA, 1575 bp, Caulobacter crescentus; identical to SEQ ID NO: 3345
  CDS (1)..(1575)

SEQ ID NO: 9239 - protein, 524 aa, Caulobacter crescentus; identical to SEQ ID NO: 3346

SEQ ID NO: 9240 - DNA, 1251 bp, Campylobacter jejuni; identical to SEQ ID NO: 3347
  CDS (1)..(1251)

SEQ ID NO: 9241 - protein, 416 aa, Campylobacter jejuni; identical to SEQ ID NO: 3348

SEQ ID NO: 9242 - DNA, 1266 bp, Sulfolobus solfataricus; identical to SEQ ID NO: 3349
  CDS (1)..(1266)

SEQ ID NO: 9243 - protein, 421 aa, Sulfolobus solfataricus; identical to SEQ ID NO: 3350

SEQ ID NO: 9244 - DNA, 1548 bp, Buchnera aphidicola; identical to SEQ ID NO: 3351
  CDS (1)..(1548)

SEQ ID NO: 9245 - protein, 515 aa, Buchnera aphidicola; identical to SEQ ID NO: 3352

SEQ ID NO: 9246 - DNA, 2172 bp, Streptomyces griseus; identical to SEQ ID NO: 3353
  CDS (1)..(2172)

SEQ ID NO: 9247 - protein, 723 aa, Streptomyces griseus; identical to SEQ ID NO: 3354

SEQ ID NO: 9248 - DNA, 2712 bp, Streptomyces lividans; identical to SEQ ID NO: 3355
  CDS (119)..(1546)

SEQ ID NO: 9249 - protein, 475 aa, Streptomyces lividans; identical to SEQ ID NO: 3356

SEQ ID NO: 9250 - DNA, 2115 bp, Clostridium thermocellum; identical to SEQ ID NO: 3357
  CDS (361)..(1845)

SEQ ID NO: 9251 - protein, 494 aa, Clostridium thermocellum; identical to SEQ ID NO: 3358

SEQ ID NO: 9252 - DNA, 1548 bp, Bacillus subtilis; identical to SEQ ID NO: 3359
  CDS (1)..(1548)

SEQ ID NO: 9253 - protein, 515 aa, Bacillus subtilis; identical to SEQ ID NO: 3360

SEQ ID NO: 9254 - DNA, 1524 bp, Saccharomyces cerevisiae; identical to SEQ ID NO: 3361
  CDS (1)..(1524)

SEQ ID NO: 9255 - protein, 507 aa, Saccharomyces cerevisiae; identical to SEQ ID NO: 3362

SEQ ID NO: 9256 - DNA, 2340 bp, Thermus aquaticus; identical to SEQ ID NO: 3363
  CDS (169)..(1557)

SEQ ID NO: 9257 - protein, 462 aa, Thermus aquaticus; identical to SEQ ID NO: 3364

SEQ ID NO: 9258 - DNA, 2558 bp, Bacillus caldotenax; identical to SEQ ID NO: 3365
  CDS (312)..(1838)

SEQ ID NO: 9259 - protein, 508 aa, Bacillus caldotenax; identical to SEQ ID NO: 3366

SEQ ID NO: 9260 - DNA, 2068 bp, Arabidopsis thaliana (mouse-ear cress); identical to SEQ ID NO: 3367
  CDS (29)..(1894)

SEQ ID NO: 9261 - protein, 621 aa, Arabidopsis thaliana (mouse-ear cress); identical to SEQ ID NO: 3368

SEQ ID NO: 9262 - DNA, 1371 bp, Lactococcus lactis subsp. lactis; identical to SEQ ID NO: 3369
  CDS (1)..(1371)

SEQ ID NO: 9263 - protein, 456 aa, Lactococcus lactis subsp. lactis; identical to SEQ ID NO: 3370

SEQ ID NO: 9264 - DNA, 1527 bp, Synechocystis sp; identical to SEQ ID NO: 3371
  CDS (1)..(1527)

SEQ ID NO: 9265 - protein, 508 aa, Synechocystis sp; identical to SEQ ID NO: 3372

SEQ ID NO: 9266 - DNA, 1458 bp, Synechocystis sp; identical to SEQ ID NO: 3373
  CDS (1)..(1458)

SEQ ID NO: 9267 - protein, 485 aa, Synechocystis sp; identical to SEQ ID NO: 3374

SEQ ID NO: 9268 - DNA, 2144 bp, Nicotiana tabacum (common tobacco); identical to SEQ ID NO: 3375
  CDS (90)..(1940)

SEQ ID NO: 9269 - protein, 616 aa, Nicotiana tabacum (common tobacco); identical to SEQ ID NO: 3376

SEQ ID NO: 9270 - DNA, 1509 bp, Streptomyces coelicolor; identical to SEQ ID NO: 3377
  CDS (1)..(1509)

SEQ ID NO: 9271 - protein, 502 aa, Streptomyces coelicolor; identical to SEQ ID NO: 3378

SEQ ID NO: 9272 - DNA, 1470 bp, Schizosaccharomyces pombe; identical to SEQ ID NO: 3379
  CDS (1)..(1470)

SEQ ID NO: 9273 - protein, 489 aa, Schizosaccharomyces pombe; identical to SEQ ID NO: 3380

SEQ ID NO: 9274 - DNA, 1302 bp, Pyrococcus kodakaraensis; identical to SEQ ID NO: 3381
  CDS (1)..(1302)

SEQ ID NO: 9275 - protein, 433 aa, Pyrococcus kodakaraensis; identical to SEQ ID NO: 3382

SEQ ID NO: 9276 - DNA, 1590 bp, Mycobacterium leprae; identical to SEQ ID NO: 3383
  CDS (1)..(1590)

SEQ ID NO: 9277 - protein, 529 aa, Mycobacterium leprae; identical to SEQ ID NO: 3384

SEQ ID NO: 9278 - DNA, 1512 bp, Rhodobacter sphaeroides; identical to SEQ ID NO: 3385
  CDS (1)..(1512)

SEQ ID NO: 9279 - protein, 503 aa, Rhodobacter sphaeroides; identical to SEQ ID NO: 3386

SEQ ID NO: 9280 - DNA, 1993 bp, Ruta graveolens; identical to SEQ ID NO: 3387
  CDS (94)..(1935)

SEQ ID NO: 9281 - protein, 613 aa, Ruta graveolens; identical to SEQ ID NO: 3388

SEQ ID NO: 9282 - DNA, 1983 bp, Corynebacterium glutamicum; identical to SEQ ID NO: 3389
  CDS (86)..(1963)

SEQ ID NO: 9283 - protein, 625 aa, Corynebacterium glutamicum; identical to SEQ ID NO: 3390

SEQ ID NO: 9284 - DNA, 2220 bp, Streptomyces pristinaespiralis; identical to SEQ ID NO: 3391
  CDS (61)..(2220)

SEQ ID NO: 9285 - protein, 719 aa, Streptomyces pristinaespiralis; identical to SEQ ID NO: 3392

SEQ ID NO: 9286 - DNA, 2051 bp, Ruta graveolens; identical to SEQ ID NO: 3393
  CDS (43)..(1869)

SEQ ID NO: 9287 - protein, 608 aa, Ruta graveolens; identical to SEQ ID NO: 3394

SEQ ID NO: 9288 - DNA, 2660 bp, Streptomyces venezuelae; identical to SEQ ID NO: 3395
  CDS (651)..(2660)

SEQ ID NO: 9289 - protein, 669 aa, Streptomyces venezuelae; identical to SEQ ID NO: 3396

SEQ ID NO: 9290 - DNA, 1518 bp, Symbiobacterium thermophilum; identical to SEQ ID NO: 3397
  CDS (1)..(1518)

SEQ ID NO: 9291 - protein, 505 aa, Symbiobacterium thermophilum; identical to SEQ ID NO: 3398

SEQ ID NO: 9292 - DNA, 1476 bp, Symbiobacterium thermophilum; identical to SEQ ID NO: 3399
  CDS (1)..(1476)

SEQ ID NO: 9293 - protein, 491 aa, Symbiobacterium thermophilum; identical to SEQ ID NO: 3400

SEQ ID NO: 9294 - DNA, 2088 bp, Propionibacterium acnes; identical to SEQ ID NO: 3401
  CDS (1)..(2088)

SEQ ID NO: 9295 - protein, 695 aa, Propionibacterium acnes; identical to SEQ ID NO: 3402

SEQ ID NO: 9296 - DNA, 1458 bp, Leifsonia xyli; identical to SEQ ID NO: 3403
  CDS (1)..(1458)

SEQ ID NO: 9297 - protein, 485 aa, Leifsonia xyli; identical to SEQ ID NO: 3404

SEQ ID NO: 9298 - DNA, 1560 bp, Leifsonia xyli; identical to SEQ ID NO: 3405
  CDS (1)..(1560)

SEQ ID NO: 9299 - protein, 519 aa, Leifsonia xyli; identical to SEQ ID NO: 3406

SEQ ID NO: 9300 - DNA, 1545 bp, Debaryomyces hansenii CBS767; identical to SEQ ID NO: 3407
  CDS (1)..(1545)

SEQ ID NO: 9301 - protein, 514 aa, Debaryomyces hansenii CBS767; identical to SEQ ID NO: 3408

SEQ ID NO: 9302 - DNA, 1524 bp, Yarrowia lipolytica CLIB99; identical to SEQ ID NO: 3409
  CDS (1)..(1524)

SEQ ID NO: 9303 - protein, 507 aa, Yarrowia lipolytica CLIB99; identical to SEQ ID NO: 3410

SEQ ID NO: 9304 - DNA, 1527 bp, Kluyveromyces lactis NRRL Y; identical to SEQ ID NO: 3411
  CDS (1)..(1527)

SEQ ID NO: 9305 - protein, 508 aa, Kluyveromyces lactis NRRL Y; identical to SEQ ID NO: 3412

SEQ ID NO: 9306 - DNA, 1455 bp, Erwinia carotovora; identical to SEQ ID NO: 3413
  CDS (1)..(1455)

SEQ ID NO: 9307 - protein, 484 aa, Erwinia carotovora; identical to SEQ ID NO: 3414

SEQ ID NO: 9308 - DNA, 1563 bp, Erwinia carotovora; identical to SEQ ID NO: 3415
  CDS (1)..(1563)

SEQ ID NO: 9309 - protein, 520 aa, Erwinia carotovora; identical to SEQ ID NO: 3416

SEQ ID NO: 9310 - DNA, 1311 bp, Acinetobacter sp; identical to SEQ ID NO: 3417
  CDS (1)..(1311)

SEQ ID NO: 9311 - protein, 436 aa, Acinetobacter sp; identical to SEQ ID NO: 3418

SEQ ID NO: 9312 - DNA, 1521 bp, Candida glabrata CBS138; identical to SEQ ID NO: 3419
  CDS (1)..(1521)

SEQ ID NO: 9313 - protein, 506 aa, Candida glabrata CBS138; identical to SEQ ID NO: 3420

SEQ ID NO: 9314 - DNA, 1407 bp, Staphylococcus aureus; identical to SEQ ID NO: 3421
  CDS (1)..(1407)

SEQ ID NO: 9315 - protein, 468 aa, Staphylococcus aureus; identical to SEQ ID NO: 3422

SEQ ID NO: 9316 - DNA, 1407 bp, Staphylococcus aureus; identical to SEQ ID NO: 3423
  CDS (1)..(1407)

SEQ ID NO: 9317 - protein, 468 aa, Staphylococcus aureus; identical to SEQ ID NO: 3424

SEQ ID NO: 9318 - DNA, 1428 bp, Bacillus thuringiensis; identical to SEQ ID NO: 3425
  CDS (1)..(1428)

SEQ ID NO: 9319 - protein, 475 aa, Bacillus thuringiensis; identical to SEQ ID NO: 3426

SEQ ID NO: 9320 - DNA, 1443 bp, Bacillus thuringiensis; identical to SEQ ID NO: 3427
  CDS (46)..(1443)

SEQ ID NO: 9321 - protein, 465 aa, Bacillus thuringiensis; identical to SEQ ID NO: 3428

SEQ ID NO: 9322 - DNA, 2061 bp, Streptomyces venezuelae; identical to SEQ ID NO: 3429
  CDS (1)..(2061)

SEQ ID NO: 9323 - protein, 686 aa, Streptomyces venezuelae; identical to SEQ ID NO: 3430

SEQ ID NO: 9324 - DNA, 1593 bp, Photobacterium profundum; identical to SEQ ID NO: 3431
  CDS (1)..(1593)

SEQ ID NO: 9325 - protein, 530 aa, Photobacterium profundum; identical to SEQ ID NO: 3432

SEQ ID NO: 9326 - DNA, 1404 bp, Photobacterium profundum; identical to SEQ ID NO: 3433
  CDS (1)..(1404)

SEQ ID NO: 9327 - protein, 467 aa, Photobacterium profundum; identical to SEQ ID NO: 3434

SEQ ID NO: 9328 - DNA, 1404 bp, Photobacterium profundum; identical to SEQ ID NO: 3435
  CDS (1)..(1404)

SEQ ID NO: 9329 - protein, 467 aa, Photobacterium profundum; identical to SEQ ID NO: 3436

SEQ ID NO: 9330 - DNA, 1320 bp, Methanococcus maripaludis; identical to SEQ ID NO: 3437
  CDS (1)..(1320)

SEQ ID NO: 9331 - protein, 439 aa, Methanococcus maripaludis; identical to SEQ ID NO: 3438

SEQ ID NO: 9332 - DNA, 1305 bp, Parachlamydia sp; identical to SEQ ID NO: 3439
  CDS (1)..(1305)

SEQ ID NO: 9333 - protein, 434 aa, Parachlamydia sp; identical to SEQ ID NO: 3440

SEQ ID NO: 9334 - DNA, 2160 bp, Rhodopseudomonas palustris; identical to SEQ ID NO: 3441
  CDS (1)..(2160)

SEQ ID NO: 9335 - protein, 719 aa, Rhodopseudomonas palustris; identical to SEQ ID NO: 3442

SEQ ID NO: 9336 - DNA, 1554 bp, Corynebacterium diphtheriae; identical to SEQ ID NO: 3443
  CDS (1)..(1554)

SEQ ID NO: 9337 - protein, 517 aa, Corynebacterium diphtheriae; identical to SEQ ID NO: 3444

SEQ ID NO: 9338 - DNA, 3174 bp, Lycopersicon esculentum; identical to SEQ ID NO: 3445
  CDS (121)..(2829)

SEQ ID NO: 9339 - protein, 902 aa, Lycopersicon esculentum; identical to SEQ ID NO: 3446

SEQ ID NO: 9340 - DNA, 1848 bp, uncultured bacterium; identical to SEQ ID NO: 3447
  CDS (1)..(1848)

SEQ ID NO: 9341 - protein, 615 aa, uncultured bacterium; identical to SEQ ID NO: 3448

SEQ ID NO: 9342 - DNA, 2151 bp, Xanthomonas albilineans; identical to SEQ ID NO: 3449
  CDS (1)..(2151)

SEQ ID NO: 9343 - protein, 716 aa, Xanthomonas albilineans; identical to SEQ ID NO: 3450

SEQ ID NO: 9344 - DNA, 2088 bp, Streptomyces thioluteus; identical to SEQ ID NO: 3451
  CDS (1)..(2088): n means a or g or c or t/u, s means g or c, w means a or t/u

SEQ ID NO: 9345 - protein, 695 aa, Streptomyces thioluteus; identical to SEQ ID NO: 3452
  Xaa in position 11 and 12 is unknown

SEQ ID NO: 9346 - DNA, 1707 bp, Listeria monocytogenes; identical to SEQ ID NO: 3453
  CDS (1)..(1707)

SEQ ID NO: 9347 - protein, 568 aa, Listeria monocytogenes; identical to SEQ ID NO: 3454

SEQ ID NO: 9348 - DNA, 1374 bp, Listeria monocytogenes; identical to SEQ ID NO: 3455
  CDS (1)..(1374)

SEQ ID NO: 9349 - protein, 457 aa, Listeria monocytogenes; identical to SEQ ID NO: 3456

SEQ ID NO: 9350 - DNA, 1599 bp, Desulfovibrio vulgaris; identical to SEQ ID NO: 3457
  CDS (1)..(1599)

SEQ ID NO: 9351 - protein, 532 aa, Desulfovibrio vulgaris; identical to SEQ ID NO: 3458

SEQ ID NO: 9352 - DNA, 1899 bp, Thermus thermophilus; identical to SEQ ID NO: 3459
  CDS (1)..(1899)

SEQ ID NO: 9353 - protein, 632 aa, Thermus thermophilus; identical to SEQ ID NO: 3460

SEQ ID NO: 9354 - DNA, 1422 bp, Leptospira interrogans; identical to SEQ ID NO: 3461
  CDS (1)..(1422)

SEQ ID NO: 9355 - protein, 473 aa, Leptospira interrogans; identical to SEQ ID NO: 3462

SEQ ID NO: 9356 - DNA, 1413 bp, Bacillus cereus; identical to SEQ ID NO: 3463
  CDS (1)..(1413)

SEQ ID NO: 9357 - protein, 470 aa, Bacillus cereus; identical to SEQ ID NO: 3464

SEQ ID NO: 9358 - DNA, 1443 bp, Bacillus cereus; identical to SEQ ID NO: 3465
  CDS (1)..(1443)

SEQ ID NO: 9359 - protein, 480 aa, Bacillus cereus; identical to SEQ ID NO: 3466

SEQ ID NO: 9360 - DNA, 1476 bp, Geobacter sulfurreducens; identical to SEQ ID NO: 3467
  CDS (1)..(1476)

SEQ ID NO: 9361 - protein, 491 aa, Geobacter sulfurreducens; identical to SEQ ID NO: 3468

SEQ ID NO: 9362 - DNA, 1506 bp, Ashbya gossypii; identical to SEQ ID NO: 3469
  CDS (1)..(1506)

SEQ ID NO: 9363 - protein, 501 aa, Ashbya gossypii; identical to SEQ ID NO: 3470

SEQ ID NO: 9364 - DNA, 1362 bp, Shigella flexneri; identical to SEQ ID NO: 3471
  CDS (1)..(1362)

SEQ ID NO: 9365 - protein, 453 aa, Shigella flexneri; identical to SEQ ID NO: 3472

SEQ ID NO: 9366 - DNA, 1419 bp, Wolinella succinogenes; identical to SEQ ID NO: 3473
  CDS (1)..(1419)

SEQ ID NO: 9367 - protein, 472 aa, Wolinella succinogenes; identical to SEQ ID NO: 3474

SEQ ID NO: 9368 - DNA, 1401 bp, Vibrio vulnificus; identical to SEQ ID NO: 3475
  CDS (1)..(1401)

SEQ ID NO: 9369 - protein, 466 aa, Vibrio vulnificus; identical to SEQ ID NO: 3476

SEQ ID NO: 9370 - DNA, 2076 bp, Photorhabdus luminescens; identical to SEQ ID NO: 3477
  CDS (1)..(2076)

SEQ ID NO: 9371 - protein, 691 aa, Photorhabdus luminescens; identical to SEQ ID NO: 3478

SEQ ID NO: 9372 - DNA, 1371 bp, Photorhabdus luminescens; identical to SEQ ID NO: 3479
  CDS (1)..(1371)

SEQ ID NO: 9373 - protein, 456 aa, Photorhabdus luminescens; identical to SEQ ID NO: 3480

SEQ ID NO: 9374 - DNA, 1575 bp, Photorhabdus luminescens; identical to SEQ ID NO: 3481
  CDS (1)..(1575)

SEQ ID NO: 9375 - protein, 524 aa, Photorhabdus luminescens; identical to SEQ ID NO: 3482

SEQ ID NO: 9376 - DNA, 2934 bp, Photorhabdus luminescens; identical to SEQ ID NO: 3483
  CDS (1)..(2934)

SEQ ID NO: 9377 - protein, 977 aa, Photorhabdus luminescens; identical to SEQ ID NO: 3484

SEQ ID NO: 9378 - DNA, 1527 bp, Gloeobacter violaceus; identical to SEQ ID NO: 3485
  CDS (1)..(1527)

SEQ ID NO: 9379 - protein, 508 aa, Gloeobacter violaceus; identical to SEQ ID NO: 3486

SEQ ID NO: 9380 - DNA, 1359 bp, Gloeobacter violaceus; identical to SEQ ID NO: 3487
  CDS (1)..(1359)

SEQ ID NO: 9381 - protein, 452 aa, Gloeobacter violaceus; identical to SEQ ID NO: 3488

SEQ ID NO: 9382 - DNA, 1293 bp, Chromobacterium violaceum; identical to SEQ ID NO: 3489
  CDS (1)..(1293)

SEQ ID NO: 9383 - protein, 430 aa, Chromobacterium violaceum; identical to SEQ ID NO: 3490

SEQ ID NO: 9384 - DNA, 1467 bp, Chromobacterium violaceum; identical to SEQ ID NO: 3491
  CDS (1)..(1467)

SEQ ID NO: 9385 - protein, 488 aa, Chromobacterium violaceum; identical to SEQ ID NO: 3492

SEQ ID NO: 9386 - DNA, 1287 bp, Synechococcus sp; identical to SEQ ID NO: 3493
  CDS (1)..(1287)

SEQ ID NO: 9387 - protein, 428 aa, Synechococcus sp; identical to SEQ ID NO: 3494

SEQ ID NO: 9388 - DNA, 1521 bp, Synechococcus sp; identical to SEQ ID NO: 3495
  CDS (1)..(1521)

SEQ ID NO: 9389 - protein, 506 aa, Synechococcus sp; identical to SEQ ID NO: 3496

SEQ ID NO: 9390 - DNA, 1644 bp, Rhodopirellula baltica; identical to SEQ ID NO: 3497
  CDS (1)..(1644)

SEQ ID NO: 9391 - protein, 547 aa, Rhodopirellula baltica; identical to SEQ ID NO: 3498

SEQ ID NO: 9392 - DNA, 1554 bp, Rhodopirellula baltica; identical to SEQ ID NO: 3499
  CDS (1)..(1554)

SEQ ID NO: 9393 - protein, 517 aa, Rhodopirellula baltica; identical to SEQ ID NO: 3500

SEQ ID NO: 9394 - DNA, 1521 bp, Prochlorococcus marinus subsp; identical to SEQ ID NO: 3501
  CDS (1)..(1521)

SEQ ID NO: 9395 - protein, 506 aa, Prochlorococcus marinus subsp; identical to SEQ ID NO: 3502

SEQ ID NO: 9396 - DNA, 1341 bp, Prochlorococcus marinus; identical to SEQ ID NO: 3503
  CDS (1)..(1341)

SEQ ID NO: 9397 - protein, 446 aa, Prochlorococcus marinus; identical to SEQ ID NO: 3504

SEQ ID NO: 9398 - DNA, 1521 bp, Prochlorococcus marinus; identical to SEQ ID NO: 3505
  CDS (1)..(1521)

SEQ ID NO: 9399 - protein, 506 aa, Prochlorococcus marinus; identical to SEQ ID NO: 3506

SEQ ID NO: 9400 - DNA, 1518 bp, Prochlorococcus marinus; identical to SEQ ID NO: 3507
  CDS (1)..(1518)

SEQ ID NO: 9401 - protein, 505 aa, Prochlorococcus marinus; identical to SEQ ID NO: 3508

SEQ ID NO: 9402 - DNA, 1497 bp, Helicobacter hepaticus; identical to SEQ ID NO: 3509
  CDS (1)..(1497)

SEQ ID NO: 9403 - protein, 498 aa, Helicobacter hepaticus; identical to SEQ ID NO: 3510

SEQ ID NO: 9404 - DNA, 1386 bp, Candidatus Blochmannia floridanus; identical to SEQ ID NO: 3511
  CDS (1)..(1386)

SEQ ID NO: 9405 - protein, 461 aa, Candidatus Blochmannia floridanus; identical to SEQ ID NO: 3512

SEQ ID NO: 9406 - DNA, 1566 bp, Candidatus Blochmannia floridanus; identical to SEQ ID NO: 3513
  CDS (1)..(1566)

SEQ ID NO: 9407 - protein, 521 aa, Candidatus Blochmannia floridanus; identical to SEQ ID NO: 3514

SEQ ID NO: 9408 - DNA, 1428 bp, Bacillus cereus; identical to SEQ ID NO: 3515
  CDS (1)..(1428)

SEQ ID NO: 9409 - protein, 475 aa, Bacillus cereus; identical to SEQ ID NO: 3516

SEQ ID NO: 9410 - DNA, 1398 bp, Bacillus cereus; identical to SEQ ID NO: 3517
  CDS (1)..(1398)

SEQ ID NO: 9411 - protein, 465 aa, Bacillus cereus; identical to SEQ ID NO: 3518

SEQ ID NO: 9412 - DNA, 1416 bp, Bacillus anthracis; identical to SEQ ID NO: 3519
  CDS (1)..(1416)

SEQ ID NO: 9413 - protein, 471 aa, Bacillus anthracis; identical to SEQ ID NO: 3520

SEQ ID NO: 9414 - DNA, 1482 bp, Streptomyces avermitilis; identical to SEQ ID NO: 3521
  CDS (1)..(1482)

SEQ ID NO: 9415 - protein, 493 aa, Streptomyces avermitilis; identical to SEQ ID NO: 3522

SEQ ID NO: 9416 - DNA, 2199 bp, Streptomyces avermitilis; identical to SEQ ID NO: 3523
  CDS (1)..(2199)

SEQ ID NO: 9417 - protein, 732 aa, Streptomyces avermitilis; identical to SEQ ID NO: 3524

SEQ ID NO: 9418 - DNA, 1488 bp, Nitrosomonas europaea; identical to SEQ ID NO: 3525
  CDS (1)..(1488)

SEQ ID NO: 9419 - protein, 495 aa, Nitrosomonas europaea; identical to SEQ ID NO: 3526

SEQ ID NO: 9420 - DNA, 1293 bp, Coxiella burnetii; identical to SEQ ID NO: 3527
  CDS (1)..(1293)

SEQ ID NO: 9421 - protein, 430 aa, Coxiella burnetii; identical to SEQ ID NO: 3528

SEQ ID NO: 9422 - DNA, 1392 bp, Coxiella burnetii; identical to SEQ ID NO: 3529
  CDS (1)..(1392)

SEQ ID NO: 9423 - protein, 463 aa, Coxiella burnetii; identical to SEQ ID NO: 3530

SEQ ID NO: 9424 - DNA, 1443 bp, Tropheryma whipplei; identical to SEQ ID NO: 3531
  CDS (1)..(1443)

SEQ ID NO: 9425 - protein, 480 aa, Tropheryma whipplei; identical to SEQ ID NO: 3532

SEQ ID NO: 9426 - DNA, 1494 bp, Burkholderia multivorans; identical to SEQ ID NO: 3533
  CDS (1)..(1494)

SEQ ID NO: 9427 - protein, 497 aa, Burkholderia multivorans; identical to SEQ ID NO: 3534

SEQ ID NO: 9428 - DNA, 1851 bp, Oryza sativa; identical to SEQ ID NO: 3535
  CDS (1)..(1851)

SEQ ID NO: 9429 - protein, 616 aa, Oryza sativa; identical to SEQ ID NO: 3536

SEQ ID NO: 9430 - DNA, 2241 bp, Neurospora crassa; identical to SEQ ID NO: 3537
  CDS (493)..(2241)

SEQ ID NO: 9431 - protein, 582 aa, Neurospora crassa; identical to SEQ ID NO: 3538

SEQ ID NO: 9432 - DNA, 1359 bp, Xylella fastidiosa; identical to SEQ ID NO: 3539
  CDS (1)..(1359)

SEQ ID NO: 9433 - protein, 452 aa, Xylella fastidiosa; identical to SEQ ID NO: 3540

SEQ ID NO: 9434 - DNA, 1476 bp, Xylella fastidiosa; identical to SEQ ID NO: 3541
  CDS (1)..(1476)

SEQ ID NO: 9435 - protein, 491 aa, Xylella fastidiosa; identical to SEQ ID NO: 3542

SEQ ID NO: 9436 - DNA, 1365 bp, Vibrio parahaemolyticus; identical to SEQ ID NO: 3543
  CDS (1)..(1365)

SEQ ID NO: 9437 - protein, 454 aa, Vibrio parahaemolyticus; identical to SEQ ID NO: 3544

SEQ ID NO: 9438 - DNA, 1344 bp, Pseudomonas syringae; identical to SEQ ID NO: 3545
  CDS (1)..(1344)

SEQ ID NO: 9439 - protein, 447 aa, Pseudomonas syringae; identical to SEQ ID NO: 3546

SEQ ID NO: 9440 - DNA, 1482 bp, Pseudomonas syringae; identical to SEQ ID NO: 3547
  CDS (1)..(1482)

SEQ ID NO: 9441 - protein, 493 aa, Pseudomonas syringae; identical to SEQ ID NO: 3548

SEQ ID NO: 9442 - DNA, 1341 bp, Pseudomonas putida; identical to SEQ ID NO: 3549
  CDS (1)..(1341)

SEQ ID NO: 9443 - protein, 446 aa, Pseudomonas putida; identical to SEQ ID NO: 3550

SEQ ID NO: 9444 - DNA, 1482 bp, Pseudomonas putida; identical to SEQ ID NO: 3551
  CDS (1)..(1482)

SEQ ID NO: 9445 - protein, 493 aa, Pseudomonas putida; identical to SEQ ID NO: 3552

SEQ ID NO: 9446 - DNA, 1437 bp, Lactobacillus plantarum; identical to SEQ ID NO: 3553
  CDS (1)..(1437)

SEQ ID NO: 9447 - protein, 478 aa, Lactobacillus plantarum; identical to SEQ ID NO: 3554

SEQ ID NO: 9448 - DNA, 2166 bp, Bradyrhizobium japonicum; identical to SEQ ID NO: 3555
  CDS (1)..(2166)

SEQ ID NO: 9449 - protein, 721 aa, Bradyrhizobium japonicum; identical to SEQ ID NO: 3556

SEQ ID NO: 9450 - DNA, 1407 bp, Bacteroides thetaiotaomicron; identical to SEQ ID NO: 3557
  CDS (1)..(1407)

SEQ ID NO: 9451 - protein, 468 aa, Bacteroides thetaiotaomicron; identical to SEQ ID NO: 3558

SEQ ID NO: 9452 - DNA, 1407 bp, Staphylococcus epidermidis; identical to SEQ ID NO: 3559
  CDS (1)..(1407)

SEQ ID NO: 9453 - protein, 468 aa, Staphylococcus epidermidis; identical to SEQ ID NO: 3560

SEQ ID NO: 9454 - DNA, 1161 bp, Staphylococcus epidermidis; identical to SEQ ID NO: 3561
  CDS (10)..(1161)

SEQ ID NO: 9455 - protein, 383 aa, Staphylococcus epidermidis; identical to SEQ ID NO: 3562

SEQ ID NO: 9456 - DNA, 1401 bp, Vibrio vulnificus; identical to SEQ ID NO: 3563
  CDS (1)..(1401)

SEQ ID NO: 9457 - protein, 466 aa, Vibrio vulnificus; identical to SEQ ID NO: 3564

SEQ ID NO: 9458 - DNA, 1566 bp, Vibrio vulnificus; identical to SEQ ID NO: 3565
  CDS (1)..(1566)

SEQ ID NO: 9459 - protein, 521 aa, Vibrio vulnificus; identical to SEQ ID NO: 3566

SEQ ID NO: 9460 - DNA, 1521 bp, Synechococcus elongatus; identical to SEQ ID NO: 3567
  CDS (1)..(1521)

SEQ ID NO: 9461 - protein, 506 aa, Synechococcus elongatus; identical to SEQ ID NO: 3568

SEQ ID NO: 9462 - DNA, 1377 bp, Synechococcus elongatus; identical to SEQ ID NO: 3569
  CDS (1)..(1377)

SEQ ID NO: 9463 - protein, 458 aa, Synechococcus elongatus; identical to SEQ ID NO: 3570

SEQ ID NO: 9464 - DNA, 1362 bp, Streptococcus mutans; identical to SEQ ID NO: 3571
  CDS (1)..(1362)

SEQ ID NO: 9465 - protein, 453 aa, Streptococcus mutans; identical to SEQ ID NO: 3572

SEQ ID NO: 9466 - DNA, 1725 bp, Shewanella oneidensis; identical to SEQ ID NO: 3573
  CDS (1)..(1725)

SEQ ID NO: 9467 - protein, 574 aa, Shewanella oneidensis; identical to SEQ ID NO: 3574

SEQ ID NO: 9468 - DNA, 1404 bp, Shewanella oneidensis; identical to SEQ ID NO: 3575
  CDS (1)..(1404)

SEQ ID NO: 9469 - protein, 467 aa, Shewanella oneidensis; identical to SEQ ID NO: 3576

SEQ ID NO: 9470 - DNA, 1407 bp, Oceanobacillus iheyensis; identical to SEQ ID NO: 3577
  CDS (1)..(1407)

SEQ ID NO: 9471 - protein, 468 aa, Oceanobacillus iheyensis; identical to SEQ ID NO: 3578

SEQ ID NO: 9472 - DNA, 1362 bp, Escherichia coli O6; identical to SEQ ID NO: 3579
  CDS (1)..(1362)

SEQ ID NO: 9473 - protein, 453 aa, Escherichia coli O6; identical to SEQ ID NO: 3580

SEQ ID NO: 9474 - DNA, 1668 bp, Corynebacterium efficiens; identical to SEQ ID NO: 3581
  CDS (1)..(1668)

SEQ ID NO: 9475 - protein, 555 aa, Corynebacterium efficiens; identical to SEQ ID NO: 3582

SEQ ID NO: 9476 - DNA, 1869 bp, Corynebacterium efficiens; identical to SEQ ID NO: 3583
  CDS (1)..(1869)

SEQ ID NO: 9477 - protein, 622 aa, Corynebacterium efficiens; identical to SEQ ID NO: 3584

SEQ ID NO: 9478 - DNA, 1557 bp, Bifidobacterium longum; identical to SEQ ID NO: 3585
  CDS (1)..(1557)

SEQ ID NO: 9479 - protein, 518 aa, Bifidobacterium longum; identical to SEQ ID NO: 3586

SEQ ID NO: 9480 - DNA, 1482 bp, Streptomyces globisporus; identical to SEQ ID NO: 3587
  CDS (1)..(1482)

SEQ ID NO: 9481 - protein, 493 aa, Streptomyces globisporus; identical to SEQ ID NO: 3588

SEQ ID NO: 9482 - DNA, 1686 bp, Streptococcus pyogenes; identical to SEQ ID NO: 3589
  CDS (1)..(1686)

SEQ ID NO: 9483 - protein, 561 aa, Streptococcus pyogenes; identical to SEQ ID NO: 3590

SEQ ID NO: 9484 - DNA, 1887 bp, Chlorobium tepidum; identical to SEQ ID NO: 3591
  CDS (1)..(1887)

SEQ ID NO: 9485 - protein, 628 aa, Chlorobium tepidum; identical to SEQ ID NO: 3592

SEQ ID NO: 9486 - DNA, 1515 bp, Chlorobium tepidum; identical to SEQ ID NO: 3593
  CDS (1)..(1515)

SEQ ID NO: 9487 - protein, 504 aa, Chlorobium tepidum; identical to SEQ ID NO: 3594

SEQ ID NO: 9488 - DNA, 1832 bp, Acinetobacter baumannii; identical to SEQ ID NO: 3595
  CDS (321)..(1637)

SEQ ID NO: 9489 - protein, 438 aa, Acinetobacter baumannii; identical to SEQ ID NO: 3596

SEQ ID NO: 9490 - DNA, 1356 bp, Xanthomonas campestris; identical to SEQ ID NO: 3597
  CDS (1)..(1356)

SEQ ID NO: 9491 - protein, 451 aa, Xanthomonas campestris; identical to SEQ ID NO: 3598

SEQ ID NO: 9492 - DNA, 1356 bp, Xanthomonas axonopodis; identical to SEQ ID NO: 3599
  CDS (1)..(1356)

SEQ ID NO: 9493 - protein, 451 aa, Xanthomonas axonopodis; identical to SEQ ID NO: 3600

SEQ ID NO: 9494 - DNA, 1476 bp, Xanthomonas axonopodis; identical to SEQ ID NO: 3601
  CDS (1)..(1476)

SEQ ID NO: 9495 - protein, 491 aa, Xanthomonas axonopodis; identical to SEQ ID NO: 3602

SEQ ID NO: 9496 - DNA, 1839 bp, Methanosarcina mazei; identical to SEQ ID NO: 3603
  CDS (1)..(1839)

SEQ ID NO: 9497 - protein, 612 aa, Methanosarcina mazei; identical to SEQ ID NO: 3604

SEQ ID NO: 9498 - DNA, 1362 bp, Fusobacterium nucleatum; identical to SEQ ID NO: 3605
  CDS (1)..(1362)

SEQ ID NO: 9499 - protein, 453 aa, Fusobacterium nucleatum; identical to SEQ ID NO: 3606

SEQ ID NO: 9500 - DNA, 1431 bp, Thermoanaerobacter tengcongensis; identical to SEQ ID NO: 3607
  CDS (1)..(1431)

SEQ ID NO: 9501 - protein, 476 aa, Thermoanaerobacter tengcongensis; identical to SEQ ID NO: 3608

SEQ ID NO: 9502 - DNA, 1683 bp, Methanosarcina acetivorans; identical to SEQ ID NO: 3609
  CDS (1)..(1683)

SEQ ID NO: 9503 - protein, 560 aa, Methanosarcina acetivorans; identical to SEQ ID NO: 3610

SEQ ID NO: 9504 - DNA, 1407 bp, Methanopyrus kandleri; identical to SEQ ID NO: 3611
  CDS (1)..(1407)

SEQ ID NO: 9505 - protein, 468 aa, Methanopyrus kandleri; identical to SEQ ID NO: 3612

SEQ ID NO: 9506 - DNA, 1299 bp, Pyrococcus furiosus; identical to SEQ ID NO: 3613
  CDS (1)..(1299)

SEQ ID NO: 9507 - protein, 432 aa, Pyrococcus furiosus; identical to SEQ ID NO: 3614

SEQ ID NO: 9508 - DNA, 1347 bp, Clostridium perfringens; identical to SEQ ID NO: 3615
  CDS (1)..(1347)

SEQ ID NO: 9509 - protein, 448 aa, Clostridium perfringens; identical to SEQ ID NO: 3616

SEQ ID NO: 9510 - DNA, 1530 bp, Ralstonia solanacearum; identical to SEQ ID NO: 3617
  CDS (1)..(1530)

SEQ ID NO: 9511 - protein, 509 aa, Ralstonia solanacearum; identical to SEQ ID NO: 3618

SEQ ID NO: 9512 - DNA, 1269 bp, Pyrobaculum aerophilum; identical to SEQ ID NO: 3619
  CDS (1)..(1269)

SEQ ID NO: 9513 - protein, 422 aa, Pyrobaculum aerophilum; identical to SEQ ID NO: 3620

SEQ ID NO: 9514 - DNA, 1479 bp, Arabidopsis thaliana; identical to SEQ ID NO: 3621
  CDS (1)..(1479)

SEQ ID NO: 9515 - protein, 492 aa, Arabidopsis thaliana; identical to SEQ ID NO: 3622

SEQ ID NO: 9516 - DNA, 1302 bp, Sulfolobus tokodaii; identical to SEQ ID NO: 3623
  CDS (1)..(1302)

SEQ ID NO: 9517 - protein, 433 aa, Sulfolobus tokodaii; identical to SEQ ID NO: 3624

SEQ ID NO: 9518 - DNA, 1056 bp, Thermoplasma volcanium; identical to SEQ ID NO: 3625
  CDS (1)..(1056)

SEQ ID NO: 9519 - protein, 351 aa, Thermoplasma volcanium; identical to SEQ ID NO: 3626

SEQ ID NO: 9520 - DNA, 2202 bp, Rhizobium loti; identical to SEQ ID NO: 3627
  CDS (1)..(2202)

SEQ ID NO: 9521 - protein, 733 aa, Rhizobium loti; identical to SEQ ID NO: 3628

SEQ ID NO: 9522 - DNA, 3859 bp, Brucella abortus; identical to SEQ ID NO: 3629
  CDS (341)..(2536): n means a or g or c or t/u, y means t/u or c

SEQ ID NO: 9523 - protein, 731 aa, Brucella abortus; identical to SEQ ID NO: 3630
  Xaa in position 602 is unknown

SEQ ID NO: 9524 - DNA, 1410 bp, Bradyrhizobium japonicum; identical to SEQ ID NO: 3631
  CDS (1)..(1410)

SEQ ID NO: 9525 - protein, 469 aa, Bradyrhizobium japonicum; identical to SEQ ID NO: 3632

SEQ ID NO: 9526 - DNA, 2145 bp, Catharanthus roseus; identical to SEQ ID NO: 3633
  CDS (53)..(1879)

SEQ ID NO: 9527 - protein, 608 aa, Catharanthus roseus; identical to SEQ ID NO: 3634

SEQ ID NO: 9528 - DNA, 1551 bp, Pasteurella multocida; identical to SEQ ID NO: 3635
  CDS (1)..(1551)

SEQ ID NO: 9529 - protein, 516 aa, Pasteurella multocida; identical to SEQ ID NO: 3636

SEQ ID NO: 9530 - DNA, 1416 bp, Streptomyces coelicolor; identical to SEQ ID NO: 3637
  CDS (1)..(1416)

SEQ ID NO: 9531 - protein, 471 aa, Streptomyces coelicolor; identical to SEQ ID NO: 3638

SEQ ID NO: 9532 - DNA, 1350 bp, Xanthomonas albilineans; identical to SEQ ID NO: 3639
  CDS (1)..(1350)

SEQ ID NO: 9533 - protein, 449 aa, Xanthomonas albilineans; identical to SEQ ID NO: 3640

SEQ ID NO: 9534 - DNA, 1071 bp, Thermoplasma acidophilum; identical to SEQ ID NO: 3641
  CDS (1)..(1071)

SEQ ID NO: 9535 - protein, 356 aa, Thermoplasma acidophilum; identical to SEQ ID NO: 3642

SEQ ID NO: 9536 - DNA, 2986 bp, Buchnera aphidicola; identical to SEQ ID NO: 3643
  CDS (1)..(1566)

SEQ ID NO: 9537 - protein, 521 aa, Buchnera aphidicola; identical to SEQ ID NO: 3644

SEQ ID NO: 9538 - DNA, 2630 bp, Buchnera aphidicola; identical to SEQ ID NO: 3645
  CDS (1)..(1566)

SEQ ID NO: 9539 - protein, 521 aa, Buchnera aphidicola; identical to SEQ ID NO: 3646

SEQ ID NO: 9540 - DNA, 2591 bp, Buchnera aphidicola; identical to SEQ ID NO: 3647
  CDS (1)..(1560)

SEQ ID NO: 9541 - protein, 519 aa, Buchnera aphidicola; identical to SEQ ID NO: 3648

SEQ ID NO: 9542 - DNA, 1706 bp, Bordetella bronchiseptica; identical to SEQ ID NO: 3649
  CDS (75)..(1595)

SEQ ID NO: 9543 - protein, 506 aa, Bordetella bronchiseptica; identical to SEQ ID NO: 3650

SEQ ID NO: 9544 - DNA, 2027 bp, Buchnera aphidicola; identical to SEQ ID NO: 3651
  CDS (1)..(1587)

SEQ ID NO: 9545 - protein, 528 aa, Buchnera aphidicola; identical to SEQ ID NO: 3652

SEQ ID NO: 9546 - DNA, 1569 bp, Buchnera aphidicola; identical to SEQ ID NO: 3653
  CDS (1)..(1569)

SEQ ID NO: 9547 - protein, 522 aa, Buchnera aphidicola; identical to SEQ ID NO: 3654

SEQ ID NO: 9548 - DNA, 2124 bp, Oryza sativa; identical to SEQ ID NO: 3655
  CDS (19)..(1839)

SEQ ID NO: 9549 - protein, 606 aa, Oryza sativa; identical to SEQ ID NO: 3656

SEQ ID NO: 9550 - DNA, 1734 bp, Oryza sativa; identical to SEQ ID NO: 3657
  CDS (1)..(1734)

SEQ ID NO: 9551 - protein, 577 aa, Oryza sativa; identical to SEQ ID NO: 3658

SEQ ID NO: 9552 - DNA, 1888 bp, Lactococcus lactis; identical to SEQ ID NO: 3659
  CDS (147)..(1559)

SEQ ID NO: 9553 - protein, 470 aa, Lactococcus lactis; identical to SEQ ID NO: 3660

SEQ ID NO: 9554 - DNA, 1317 bp, Aeropyrum pernix; identical to SEQ ID NO: 3661
  CDS (1)..(1317)

SEQ ID NO: 9555 - protein, 438 aa, Aeropyrum pernix; identical to SEQ ID NO: 3662

SEQ ID NO: 9556 - DNA, 1788 bp, Arabidopsis thaliana; identical to SEQ ID NO: 3663
  CDS (1)..(1788)

SEQ ID NO: 9557 - protein, 595 aa, Arabidopsis thaliana; identical to SEQ ID NO: 3664

SEQ ID NO: 9558 - DNA, 2017 bp, Arthrobacter globiformis; identical to SEQ ID NO: 3665
  CDS (402)..(1997): n means a or g or c or t/u, s means g or c

SEQ ID NO: 9559 - protein, 531 aa, Arthrobacter globiformis; identical to SEQ ID NO: 3666

SEQ ID NO: 9560 - DNA, 2199 bp, Azospirillum brasilense; identical to SEQ ID NO: 3667
  CDS (1)..(2199)

SEQ ID NO: 9561 - protein, 732 aa, Azospirillum brasilense; identical to SEQ ID NO: 3668

SEQ ID NO: 9562 - DNA, 1542 bp, Bacillus pumilus; identical to SEQ ID NO: 3669
  CDS (1)..(1542)

SEQ ID NO: 9563 - protein, 513 aa, Bacillus pumilus; identical to SEQ ID NO: 3670

SEQ ID NO: 9564 - DNA, 1527 bp, Bacillus stearothermophilus; identical to SEQ ID NO: 3671
  CDS (1)..(1527)

SEQ ID NO: 9565 - protein, 508 aa, Bacillus stearothermophilus; identical to SEQ ID NO: 3672

SEQ ID NO: 9566 - DNA, 1545 bp, Buchnera aphidicola; identical to SEQ ID NO: 3673
  CDS (1)..(1545)

SEQ ID NO: 9567 - protein, 514 aa, Buchnera aphidicola; identical to SEQ ID NO: 3674

SEQ ID NO: 9568 - DNA, 1593 bp, Buchnera aphidicola; identical to SEQ ID NO: 3675
  CDS (1)..(1593)

SEQ ID NO: 9569 - protein, 530 aa, Buchnera aphidicola; identical to SEQ ID NO: 3676

SEQ ID NO: 9570 - DNA, 3037 bp, Buchnera aphidicola; identical to SEQ ID NO: 3677
  CDS (1)..(1581)

SEQ ID NO: 9571 - protein, 526 aa, Buchnera aphidicola; identical to SEQ ID NO: 3678

SEQ ID NO: 9572 - DNA, 1557 bp, Corynebacterium glutamicum; identical to SEQ ID NO: 3679
  CDS (1)..(1557)

SEQ ID NO: 9573 - protein, 518 aa, Corynebacterium glutamicum; identical to SEQ ID NO: 3680

SEQ ID NO: 9574 - DNA, 1476 bp, Neisseria gonorrhoeae; identical to SEQ ID NO: 3681
  CDS (1)..(1476)

SEQ ID NO: 9575 - protein, 491 aa, Neisseria gonorrhoeae; identical to SEQ ID NO: 3682

SEQ ID NO: 9576 - DNA, 1476 bp, Neisseria meningitidis; identical to SEQ ID NO: 3683
  CDS (1)..(1476)

SEQ ID NO: 9577 - protein, 491 aa, Neisseria meningitidis; identical to SEQ ID NO: 3684

SEQ ID NO: 9578 - DNA, 1563 bp, Salmonella typhimurium; identical to SEQ ID NO: 3685
  CDS (1)..(1563)

SEQ ID NO: 9579 - protein, 520 aa, Salmonella typhimurium; identical to SEQ ID NO: 3686

SEQ ID NO: 9580 - DNA, 2502 bp, Serratia marcescens; identical to SEQ ID NO: 3687
  CDS (280)..(1839)

SEQ ID NO: 9581 - protein, 519 aa, Serratia marcescens; identical to SEQ ID NO: 3688

SEQ ID NO: 9582 - DNA, 1626 bp, Vibrio parahaemolyticus; identical to SEQ ID NO: 3689
  CDS (1)..(1626)

SEQ ID NO: 9583 - protein, 541 aa, Vibrio parahaemolyticus; identical to SEQ ID NO: 3690

SEQ ID NO: 9584 - DNA, 24 bp, artificial sequence
  primer
atgcaaacacaaaaaccgactctc

SEQ ID NO: 9585 - DNA, 25 bp, artificial sequence
  primer
ttagaaagtctcctgtgcatgatgc

SEQ ID NO: 9586 - DNA, 1476 bp, Escherichia coli K12; identical to SEQ ID NO: 2577
  CDS (1)..(1476)

SEQ ID NO: 9587 - protein, 491 aa, Escherichia coli K12; identical to SEQ ID NO: 2578

SEQ ID NO: 9588 - DNA, 1957 bp, Leuconostoc mesenteroides; identical to SEQ ID NO: 2857
  CDS (206)..(1666)

SEQ ID NO: 9589 - protein, 486 aa, Leuconostoc mesenteroides; identical to SEQ ID NO: 2858

SEQ ID NO: 9590 - DNA, 2110 bp, Drosophila melanogaster
  CDS (370)..(1944)
cattggcagtgcttgcttgggcgtttgtttgctgcggcggttcgcgccgcgcttcagtcagtcagggaacgatcgtgcttatcttcattactactaccgcttccaccgaggcttcgcgactccgtacccgtactcgctttgttttacgtttgcgctactagttagtgaatccgacgacgacgacctgcgcgtgcgattaaagcgccgcaactctttgtaattacacagccagagccgcagaggttgctcaaaatccagcgactggagaaatcgtatatcgagttggaaatccgaatcgaaaggcttgcgtatacatagttgtcacacttttgcttttaaacagaaaaatccattcacattcgggtcaagatggcaacgcaaaaggaagatcacaccgccctggatctcataatcaagtcactcaagtcgcctacaatggtctgcgagggaacccactttgacggcaagattccgcacacgttcgtcatctttggggcgtcgggcgatctggccaagaagaagatctaccccacgctctggtggctctaccgcgatgacctgctgcccaagccgaccaagttctgcggctatgcccgttccatgctgaccgtcgatagcatcaaggagcagtgtctgccgtacatgaaggtccagccgcacgagcagaagaagtacgaggagttctgggccctcaatgagtacgtgtccggcagatatgacggacgcactggcttcgagctgcttaaccagcagctggagattatggagaacaagaacaaggccaaccgcatcttctatctggccctgccgcccagcgtcttcgaggaggtgactgtcaacatcaagcagatctgcatgtcggtctgcggttggaaccgcgtgattatcgagaagcctttcggccgggatgacgcctcctcgcaggcgctgagcgaccatctggccggtctgttccaggaggatcagctgtaccgcatcgatcactacctgggcaaggagatggtgcagaacctgatgaccatacgcttcggcaacaagatcctcagctcgacgtggaaccgcgagaacatcgcctccgtgctgatcacgttcaaggagcccttcggcacgcagggtcgtggcggctacttcgacgagttcggcatcatacgcgacgtgatgcagaaccatctgctgcagatcctctcgctggtggccatggagaagccggtgagctgccacccggacgacattcgtgacgagaaggtcaaggtgctgaagagcatcgaggccctgacgctggatgacatggtgctgggccagtacctgggcaatccgcagggtacaaacgatgatgcgcgcacgggctacgtggaggaccccaccgttagcaacgattcgaacacgcccacctacgccctcggcgtgctcaagatcaacaacgagcgctggcagggagtgcccttcatcctgcgctgcggcaaggcgctgaacgagcgcaaggcggaggtgcgtatccagtaccaggacgtgcccggcgacatcttcgagggcaatacgaagcgcaacgagctggtcatccgcgtccagccgggcgaggccctgtactttaagatgatgaccaagagccccggcatcacgttcgacatcgaggagacggagctggacctcacctacgagcaccgctacaaggactcctacctgccggacgcgtacgagcgtctcatcctcgacgtcttctgcggctcccagatgcacttcgtccgctcggacgagctgcgcgaggcgtggcgcatatttacgcccattctgcaccagatcgagaaggagcacattcggccaatcacctaccagtacggatcgcgcggtcccaaggaggcggaccgcaagtgcgaggagaacaatttcaagtactccggctcctacaagtggcacggcggcaaggcggccacgtccaatcactgagcgtttggagcacaccaatccccgggctgggttcgcaggatactcctctctgtccgcacgtacatgtacatacatacatatatatgtatatatacatatatgcattctttggttatttgtaattcggtctgtacaagatttttttttattaaatatacaaaatagt

SEQ ID NO: 9591 - protein, 524 aa, Drosophila melanogaster
MATQKEDHTALDLIIKSLKSPTMVCEGTHFDGKIPHTFVIFGASGDLAKKKIYPTLWWLYRDDLLPKPTKFCGYARSMLTVDSIKEQCLPYMKVQPHEQKKYEEFWALNEYVSGRYDGRTGFELLNQQLEIMENKNKANRIFYLALPPSVFEEVTVNIKQICMSVCGWNRVIIEKPFGRDDASSQALSDHLAGLFQEDQLYRIDHYLGKEMVQNLMTIRFGNKILSSTWNRENIASVLITFKEPFGTQGRGGYFDEFGIIRDVMQNHLLQILSLVAMEKPVSCHPDDIRDEKVKVLKSIEALTLDDMVLGQYLGNPQGTNDDARTGYVEDPTVSNDSNTPTYALGVLKINNERWQGVPFILRCGKALNERKAEVRIQYQDVPGDIFEGNTKRNELVIRVQPGEALYFKMMTKSPGITFDIEETELDLTYEHRYKDSYLPDAYERLILDVFCGSQMHFVRSDELREAWRIFTPILHQIEKEHIRPITYQYGSRGPKEADRKCEENNFKYSGSYKWHGGKAATSNH

SEQ ID NO: 9592 - DNA, 1593 bp, Fugu rubripes (Japanese pufferfish); identical to SEQ ID NO: 2537
  CDS (1)..(1593)

SEQ ID NO: 9593 - protein, 530 aa, Fugu rubripes (Japanese pufferfish); identical to SEQ ID NO: 2538

SEQ ID NO: 9594 - DNA, 1506 bp, Vibrio cholerae; identical to SEQ ID NO: 2539
  CDS (1)..(1506)

SEQ ID NO: 9595 - protein, 501 aa, Vibrio cholerae; identical to SEQ ID NO: 2540

SEQ ID NO: 9596 - DNA, 1476 bp, Pseudomonas aeruginosa
  CDS (7)..(1476)
caacaaatgcctgatgtccgcgttctgccttgcacgttagcgctgttcggtgcgctgggcgatctcgccttgcgcaagctgttcccggcgctctaccaactcgatcgtgagaacctgctgcaccgcgatacccgcgtcctggccctggcccgtgacgaaggcgctcccgccgaacacctggcgacgctggagcagcgcctgcgcctggcagtgccggcgaaggagtgggacgacgtggtctggcagcgtttccgcgaacgcctcgactacctgagcatggacttcctcgacccgcaggcctatgtcggcttgcgcgaggcggtggatgacgaactgccgctggtcgcctacttcgccacgccggcctcggtgttcggcggcatctgcgagaacctcgccgccgccggtctcgccgagcgcacccgggtggtgctggagaagcccatcggtcatgacctggagtcgtcccgcgaggtcaacgaggcagtcgcccggttcttcccggaaagccgcatctaccggatcgaccattacctgggcaaggagacggtgcagaacctgatcgccctgcgcttcgccaacagcctcttcgagacccagtggaaccagaaccacatctcccacgtggagatcaccgtggccgagaaggtcggcatcgaaggccgctggggctacttcgaccaggccgggcaactgcgcgacatggtgcagaaccacctgctgcaactgctctgcctgatcgccatggatccgcccagcgacctttcggcggacagcattcgcgacgagaaggtcaaggtcctccgcgccctcgagccgattcccgcagaacaactggcttcgcgcgtggtgcgtgggcagtacaccgccggtttcagcgacggcaaggcagtgccgggctacctggaggaggaacatgcgaatcgcgacagcgacgcggaaaccttcgtcgccctgcgcgtggacatccgcaactggcgctggtcgggcgtgccgttctacctgcgcaccggcaagcgcatgccgcagaagctgtcgcagatcgtcatccacttcaaggagccgccgcactacatcttcgctcccgagcagcgttcgctgatcagcaaccggctgatcatccgcctgcagccggacgaaggtatctccctgcaagtgatgaccaaggaccagggcctgggcaagggcatgcaattgcgtaccggcccgctgcaactgagtttttccgagacctaccacgcggcgcggattcccgatgcctacgagcgtctgctgctggaggtcacccagggcaaccagtacctgttcgtgcgcaaggacgaggtggagttcgcctggaagtggtgcgaccagctgatcgctggctgggaacgcctgagcgaagcgcccaagccgtatccggctgggagttgggggccggtggcctcggtggccctggtggcccgcgatgggaggagttggtatggcgatttctga

SEQ ID NO: 9597 - protein, 489 aa, Pseudomonas aeruginosa; identical to SEQ ID NO: 2542

SEQ ID NO: 9598 - DNA, 1485 bp, Staphylococcus aureus
  CDS (1)..(1485)
atgagtactaaaaacaaacacatcccatgtttaatcacaatctttggtgcaactggtgacttaagccatcgtaagttgtttccatcaatattccatctctaccaacaagacaatttagatgaacatattgccatcatcggtattggacgtcgtgacattactaatgatgatttccgtaatcaagtaaaatcatcaattcaaaagcacgtaaaagatacaaacaaaattgacgcgtttatggaacatgtcttctatcatagacatgatgttagtaatgaagaaagctatcaagaattactagattttagtaatgaattagatagccaatttgaattaaaaggtaatcgactattctatttagcaatggcaccacaattctttggcgttatttctgattatctaaaatcttctggtcttactgatacaaaaggatttaaacgccttgttatcgaaaaaccattcggtagtgatttaaaatcagccgaagcattaaacaatcaaattcgtaaatcatttaaagaagaagaaatttatcgtattgaccactatttaggaaaagacatggttcaaaatatcgaggtattacgttttgcgaatgcgatgtttgaaccattatggaataacaaatatatttcaaacatccaagttacatcttctgaaatactaggtgttgaagatcgtggtggttattatgaatcaagtggcgcgctaaaagatatggtgcaaaaccacatgttacaaatggttgcattattagctatggaagcacctattagtttaaatagtgaagatatccgtgctgagaaagtaaaagtacttaaatcactgcgtcatttccaatctgaagatgttaaaaagaactttgttcgtggtcaatatggcgaaggctatatcgatggtaaacaagttaaagcataccgtgatgaagatcgcgttgcagatgactctaacacacctacctttgtttcaggtaaattaacaattgataactttagatgggctggtgtaccattctatattcgtactggtaaacgtatgaaatctaaaacaattcaagttgtcgttgaatttaaagaagtaccaatgaacttatactatgaaactgataaactgttagattcaaacctattagtaatcaatatccaacctaatgaaggtgtatctttacatctaaatgctaagaaaaatacacaaggtatcgaaacagaacctgtccaattgtcttactcaatgagcgctcaagataaaatgaatactgtagatgcatatgaaaatctattatttgattgtcttaaaggtgatgccactaacttcacgcactgggaagaattaaaatcaacatggaaatttgttgatgcaattcaagatgaatggaatatggttgatccagaattccctaactatgaatcaggtactaatggtccattagaaagtgatttactacttgctcgtgatggtaaccattggtgggacgatattcaatga

SEQ ID NO: 9599 - protein, 494 aa, Staphylococcus aureus; identical to SEQ ID NO: 2544

SEQ ID NO: 9600 - DNA, 1488 bp, Streptococcus pneumoniae; identical to SEQ ID NO: 2545
  CDS (1)..(1488)

SEQ ID NO: 9601 - protein, 495 aa, Streptococcus pneumoniae; identical to SEQ ID NO: 2546

SEQ ID NO: 9602 - DNA, 1476 bp, Salmonella enterica subsp. enterica serovar Typhi; identical to SEQ ID NO: 2547
  CDS (1)..(1476)

SEQ ID NO: 9603 - protein, 491 aa, Salmonella enterica subsp. enterica serovar Typhi; identical to SEQ ID NO: 2548

SEQ ID NO: 9604 - DNA, 1476 bp, Listeria monocytogenes
  CDS (1)..(1476)
atgacagatgagttagaacaaaaagcactgattactatttttggcggtacgggagatttggcaaatcgcaaactttacccttcgctatatcatttgtacagtaagggatctcttggcgacaattttgctgttattggaacggctcgtcgtgaatggagtaacgatttcttccgtgataaagtaaaagagtctatcaaagacattgacggttctgaaaaagacgcagatgcatttgcttctcacttctactatcaatctcatgatgtgacaaataaagaatcttatctaactttaaaagatttgtctgatgaattagatgcaaaatacgaattagatggcaatcgccttttctatcttgcaatggcgccaaatttctttggaactatcgcaagtcgcattaaatctgaaggctttgttgatacagacggtttccatcgtttaattatcgaaaaaccattcggccatgatttagctagtgcggaagaattaaacaattcacttcgtcaagctttcaaggaagatgaaatttatcgtattgaccattatttaggaaaagaaatgatccaaaatatttcggttattcgttttgcaaattctattattgaatcgctttggaataatcgttacatcgataatattcaagttactttaacagaggtacttggagtcgaagatcgtggacgctattacgatgaaagtggcgcacttcgagacatggttcaaaatcatatcttacaaatcgtttctttacttgcaatggagccaccgattaacttatctactcgcgagattcgtcatgaaaaagttcgcgcgcttcgttctttacgcgtttttgaaggaaaagaagtgcatcaaagctttatccgtggtcaatatggtcccggtgaagtggatggtaaagagttaaaaggttatcgtcaagaagataatgtggatccccattccaatacggaaacatttgttgcagccaaacttgaaatcgataatttccgctgggctggcgtaccattttacattcgcactggtaaacgtcttgcgaagaaaacaacgcaaattgcgattcagtttaaagatgtcccactaaacttattcgggcaacaacaatcacttggtggtaatgtgcttgttattcatatccaaccggacgaaggtattacacttcatttgaacgtaaaagaacctggtcaaggtatggttacgatgccagtcaacttgaattatattcattcctctccagacggcatgaacacacctgaggcttacgaaaaattgattctagactgtcttcgcggtgacgcgacttacttctctcactgggatgaagtatcgctatcatggaactttatcgaccatatagcagatgtttggacaaatacgaaagatcatttcccgaactacaaatccggttcaatggggccaaaagaagcagacgacctcattcaacgtgacggattccagtggttcccgatcgattaa

SEQ ID NO: 9605 - protein, 491 aa, Listeria monocytogenes
MTDELEQKALITIFGGTGDLANRKLYPSLYHLYSKGSLGDNFAVIGTARREWSNDFFRDKVKESIKDIDGSEKDADAFASHFYYQSHDVTNKESYLTLKDLSDELDAKYELDGNRLFYLAMAPNFFGTIASRIKSEGFVDTDGFHRLIIEKPFGHDLASAEELNNSLRQAFKEDEIYRIDHYLGKEMIQNISVIRFANSIIESLWNNRYIDNIQVTLTEVLGVEDRGRYYDESGALRDMVQNHILQIVSLLAMEPPINLSTREIRHEKVRALRSLRVFEGKEVHQSFIRGQYGPGEVDGKELKGYRQEDNVDPHSNTETFVAAKLEIDNFRWAGVPFYIRTGKRLAKKTTQIAIQFKDVPLNLFGQQQSLGGNVLVIHIQPDEGITLHLNVKEPGQGMVTMPVNLNYIHSSPDGMNTPEAYEKLILDCLRGDATYFSHWDEVSLSWNFIDHIADVWTNTKDHFPNYKSGSMGPKEADDLIQRDGFQWFPID

SEQ ID NO: 9606 - DNA, 1530 bp, Nostoc sp. PCC 7120; identical to SEQ ID NO: 2551
  CDS (1)..(1530)

SEQ ID NO: 9607 - protein, 509 aa, Nostoc sp. PCC 7120; identical to SEQ ID NO: 2552

SEQ ID NO: 9608 - DNA, 1386 bp, Agrobacterium tumefaciens; identical to SEQ ID NO: 2553
  CDS (1)..(1386)

SEQ ID NO: 9609 - protein, 461 aa, Agrobacterium tumefaciens; identical to SEQ ID NO: 2554

SEQ ID NO: 9610 - DNA, 1476 bp, Brucella melitensis; identical to SEQ ID NO: 2555
  CDS (1)..(1476)

SEQ ID NO: 9611 - protein, 491 aa, Brucella melitensis; identical to SEQ ID NO: 2556

SEQ ID NO: 9612 - DNA, 1458 bp, Zymomonas mobilis; identical to SEQ ID NO: 2557
  CDS (1)..(1458)

SEQ ID NO: 9613 - protein, 485 aa, Zymomonas mobilis; identical to SEQ ID NO: 2558

SEQ ID NO: 9614 - DNA, 1470 bp, Bacillus subtilis; identical to SEQ ID NO: 2559
  CDS (1)..(1470)

SEQ ID NO: 9615 - protein, 489 aa, Bacillus subtilis; identical to SEQ ID NO: 2560

SEQ ID NO: 9616 - DNA, 1401 bp, Mycobacterium tuberculosis
  CDS (1)..(1401)
atggttgacggcggaggtggcgcgtcagatctgttggtgatcttcggaattaccggtgacctggcccgcaagatgaccttccgcgcgttgtatcggctcgagcgccaccagttgctggactgccccatcctgggtgtggccagtgacgacatgtccgtcgggcagttggtcaagtgggctcgcgagtccatcggtcgtaccgaaaagatcgacgatgcggtgttcgaccggttggcgggccggttgtcctacctgcacggtgacgtcaccgacagccagctctacgattcgctggccgaactgattggctcggcctgtcggccgctgtattacctggaaatgccgccggcgctgttcgcgccgattgtcgaaaatctcgcgaacgtgcggctgttggagcgcgcacgcgttgccgtggaaaagccgttcggccacgacctggcctccgcgctcgaactcaacgcccggctgcgagcggtgttgggcgaagaccaaatcctgcgtgtggaccactttctgggcaagcagcccgtcgtcgagctggagtacctgaggttcgccaatcaggcgttagccgagctctgggatcgcaacagcatctccgagatccacatcaccatggccgaggacttcggggtggaggaccgcggcaagttttacgacgccgtcggtgccctgcgtgacgtggtgcaaaaccatctgctgcaggtgctggcgctggtgacgatggaaccgccggtcggttccagcgccgatgacctcaacgacaagaaggccgaggtcttccgggcgatggcgccgctggatcccgatcggtgcgtgcgtgggcagtacctcggctacaccgaagttgcgggcgtagcaagcgattcggcgaccgaaacgtatgtcgcgctgcgaaccgagatcgacaactggcgctgggccggggtgccgatcttcgtgcgggccggaaaagagctgcccgcgaaggtcaccgaagtacggctatttctacgccgagttccggcattggcctttctgcccaaccgccgaccggccgagcccaaccagattgtgctgcgtatcgaccccgatccgggtatgcgactgcagatttcggcccacaccgacgactcgtggcgagatatccacctggactcctcgttcgcggtggacctcggtgaaccgatacgaccctatgagcggctgctgtatgccggattggtcggcgatcaccagttgttcgcccgcgaggacagcatcgagcagacgtggcggatcgtgcagccgctgctcgacaacccgggtgaaatccatcggtacgatcgcggttcctggggtccggaagccgcgcagtcgttgctgcgcggtcaccgcggttggcagtcgccgtggctgccccgcggcacggacgcatga

SEQ ID NO: 9617 - protein, 466 aa, Mycobacterium tuberculosis; identical to SEQ ID NO: 2562

SEQ ID NO: 9618 - DNA, 1545 bp, Mycobacterium tuberculosis
  CDS (1)..(1545)
atgaaaccggcccacgccgcggcgtcgtggcgcaacccgctacgagacaagcgggacaagcgattacccagaatcgccggcccgtgcggcatggtgattttcggcgtcaccggcgacctggcccgcaagaaggtgatgccggccgtctacgatttggccaaccgcggcctgctgccgcccacattctcgctggtggggtttgcccgccgagactggagcacccaggatttcggtcaagtggtgtacaacgccgtccaagagcactgccgaacaccgtttcggcaacagaactgggaccggctggccgagggattccgttttgtgccaggcactttcgacgacgacgacgcgttcgcccaactcgccgagacgctggagaagctcgacgccgagcgcggcaccggcggcaaccacgccttctacctggcgatcccgcccaaatccttcccggtggtgtgtgagcagctgcacaagtccggcctggcccgcccgcaaggcgaccggtggagccgagtcgtgatagagaagccgttcggccacgacctggccagcgcacgcgagctgaacaaggcggtcaacgcggtcttcccggaggaagcggtcttccgcatcgaccactacctgggcaaagagacggtgcagaacatcctggcgctgcggttcgccaaccagctgttcgacccgatctggaatgcgcactacgtcgaccacgtacagatcaccatggccgaagacatcggcctgggcgggcgcgcgggctattacgacggcatcggcgcggcccgcgatgtcatccagaaccatctcatgcagctgctggcgctgaccgcgatggaggagccggtcagcttccacccggcagcgttgcaggccgagaagatcaaggtgctctcggccacccgccttgccgagccactcgaccagaccaccagccgcggccagtacgccgccggctggcaaggcggggagaaggtggttgggctgctcgacgaggaggggttcgccgaggactccaccaccgaaaccttcgccgctatcaccctggaagtcgatacgcgccggtgggccggcgtgccgttctatctgcgaacgggaaaacgattgggccgccgggtgaccgagatcgctctggtcttcaggcgggcgccgcatctgccgttcgacgccaccatgaccgacgagctgggcaccaacgcgatggtcatccgcgtgcagcccgacgaaggtgtcacattgcggttcggctccaaggtgccgggcaccgccatggaagtccgcgacgtcaacatggacttctcctacggctcggcattcgccgaagattcaccggaggcctacgagcggctcatcctcgacgtcctgctcggcgagccctcgctgtttccggtcaacgcggaggtcgaactggcgtgggagatcctcgatccagcgttggaacattgggcggcacacgggacgcccgacgcctacgaggcaggtacctggggtccggaatcatccttggagatgctgcgccgcaccggccgggaatggcggcggccatga

SEQ ID NO: 9619 - protein, 514 aa, Mycobacterium tuberculosis; identical to SEQ ID NO: 2564

SEQ ID NO: 9620 - DNA, 1320 bp, Chlamydia trachomatis; identical to SEQ ID NO: 2565
  CDS (1)..(1320)

SEQ ID NO: 9621 - protein, 439 aa, Chlamydia trachomatis; identical to SEQ ID NO: 2566

SEQ ID NO: 9622 - DNA, 1773 bp, Deinococcus radiodurans; identical to SEQ ID NO: 2567
  CDS (1)..(1773)

SEQ ID NO: 9623 - protein, 590 aa, Deinococcus radiodurans; identical to SEQ ID NO: 2568

SEQ ID NO: 9624 - DNA, 1467 bp, Pseudomonas aeruginosa; identical to SEQ ID NO: 2569
  CDS (1)..(1467)

SEQ ID NO: 9625 - protein, 488 aa, Pseudomonas aeruginosa; identical to SEQ ID NO: 2570

SEQ ID NO: 9626 - DNA, 1422 bp, Caulobacter crescentus; identical to SEQ ID NO: 2571
  CDS (1)..(1422)

SEQ ID NO: 9627 - protein, 473 aa, Caulobacter crescentus; identical to SEQ ID NO: 2572

SEQ ID NO: 9628 - DNA, 1512 bp, Agrobacterium tumefaciens
  CDS (1)..(1512)
atgatgccccaacctttgaagatcgagagaatcgatatgagcagtcagatcattcctgttgaaccttttgattgtgtcgttttcggcggcacgggcgatcttgccgagcgcaagcttctgccggccctttatcaccggcaggtcgaaggccagttcacggagccgacccgcatcatcggcgcgtcgcgttcggtcatgacccatgaggaatatcgcaaattcgcgcaggacgccctgaaggaacacctgaaggccggcgaatatgacgatgcgcaggtgaccctgttcctcaaccggcttttctacgtgcccgtcgatgccaagtccggcaatggctgggacgtgctgaagaaactgctcgatgagggcaaggaacgcatccgcgcgttttatctggccgtcgcacccggcattttcggcgacatcgccgacaagatccgtgagcacaagctgatcacccgctcgacccgcatcgtcgttgaaaagccgatcggccgggatctcgcatccgcgcaggaactgaacgacaccatcggtcacgtcttcaaggaagagcagatcttccgcatcgaccactatctcggcaaggagacggtgcagaacctgatggcgctgcgtttcgccaatgcgctttacgagccgctgtggaattccgcccatatcgaccacgttcagatcaccgttgccgaagcggtgggtcttgaaggtcgcgccggttattacgacaaggccggtgcgctgcgcgacatggtgcagaaccacattctccagctgctttgcctcgttgccatggagccgcccgcttccatgaaatcggaggcagtgcgcgacgaaaagctcaaggtactgcgctcgctgaagccaatcgataccagcaatgtcgaaaagctgacggtacgcggccagtaccgcgccggcgcttccgcaggcggccccgtcaagggttatctggaagagctggaaggcggcgtttccaacaccgaaaccttcgtcgccatcaaggctgaaatcgccaactggcgctgggccggcgttcccttctacatccgcaccggcaaacgcctcgcgacccgtgtttcggaaatcgtcgtcaccttcaagcagatcccgcactcgatcttcgacgatgcggctggcaagatcgaagccaacaagctggtcattcgcctgcagccggatgaaggcgtcaagcagtcgctcctcatcaaggatcccggtccaggcggcatgcgcctgcgtcaggtctcgctggacatgagctttgccgaagccttcaacgtgcgcagccccgatgcctatgagcggctgttgatggacaccattcgttccaaccagacattgttcatgcgccgcgacgaggtcgaggccgcgtgggactggatcgaccccatcttgaagagctgggaagagctgggacagagcgtacagggttacactgccggcacctggggcccgagcggttcgatcgcactgatcgagcgcgacggccgcacctggcacgatgccgactga

SEQ ID NO: 9629 - protein, 503 aa, Agrobacterium tumefaciens
MMPQPLKIERIDMSSQIIPVEPFDCVVFGGTGDLAERKLLPALYHRQVEGQFTEPTRIIGASRSVMTHEEYRKFAQDALKEHLKAGEYDDAQVTLFLNRLFYVPVDAKSGNGWDVLKKLLDEGKERIRAFYLAVAPGIFGDIADKIREHKLITRSTRIVVEKPIGRDLASAQELNDTIGHVFKEEQIFRIDHYLGKETVQNLMALRFANALYEPLWNSAHIDHVQITVAEAVGLEGRAGYYDKAGALRDMVQNHILQLLCLVAMEPPASMKSEAVRDEKLKVLRSLKPIDTSNVEKLTVRGQYRAGASAGGPVKGYLEELEGGVSNTETFVAIKAEIANWRWAGVPFYIRTGKRLATRVSEIVVTFKQIPHSIFDDAAGKIEANKLVIRLQPDEGVKQSLLIKDPGPGGMRLRQVSLDMSFAEAFNVRSPDAYERLLMDTIRSNQTLFMRRDEVEAAWDWIDPILKSWEELGQSVQGYTAGTWGPSGSIALIERDGRTWHDAD

SEQ ID NO: 9630 - DNA, 1437 bp, Borrelia burgdorferi (Lyme disease spirochete); identical to SEQ ID NO: 2573
  CDS (1)..(1437)

SEQ ID NO: 9631 - protein, 478 aa, Borrelia burgdorferi (Lyme disease spirochete); identical to SEQ ID NO: 2574

SEQ ID NO: 9632 - DNA, 1548 bp, Treponema pallidum subsp. pallidum (syphilis spirochete); identical to SEQ ID NO: 2579
  CDS (1)..(1548)

SEQ ID NO: 9633 - protein, 515 aa, Treponema pallidum subsp. pallidum (syphilis spirochete); identical to SEQ ID NO: 2580

SEQ ID NO: 9634 - DNA, 1278 bp, Helicobacter pylori
  CDS (1)..(1278)
atgttagattttgatttggttctttttggcgcgactggggatttagccatgcgaaagctctttgtttcgctctatgaaatttatactcattatggttttaaaaacgattctaggattatcgcatcggggcgtaaggagctatccaatgaagaatttttaacactcctttgtgagaaaacacaactgcattcaagagaaaagggtagggaatttttagcccatatcagttatttgtgcgttcgtttggataaccctaaagactttgaagaattgagtaaaatcgctacaaaaaataaacccttgattttctacttttctatctcgcctagtttttttgcaacgaccgcccaacatttggccaaaaacgcgctcaatcacgccaacacacgcttgattttagaaaagcctttagggcatgatttaaagacatgtaaagagattttccaaagcattagcgttttttttaaagaagaacaaatctttagaatcgatcattatttagggaaaaagggcgttcaaaatatccttgaattgcgcctgaataaccctattttaaatattttatgggatcaaatcagcgcagttgaaatctgcgtgtatgagactttgggggtggaagaaagaggcgaattttacgataaaatcggggctttaagggatatggttcaaaaccatctcttgcaagttttatcccttatcgctacagatttacccaacaatttaaaggatttgaggaaagaaaaaatcaaagttttaaaaaccttacaaccccctaaagattttaaaaaacaggttattcgggcccaatatcaaggctatagagatgaaaataaggtccataaagagagccagacagagacttttgttgctattaaagcctttttggatacgcccaaatttaaaggcgtgcctttctaccttaagcacgctaaaaaaatgccccacaaccaagcgagcgtgaaaatccattttaacgcggtcaatacgctagaatttttcctctctcaagataaaatcaccctcaccctaaaagatcatcaaaacccccttattttagaaacccataacaaacaagaatttttacggccctacgctaaattgctctatgatgcgatacaaaataaccacaataatttcgcccaccagttggaattagaagcgtcatgggtttttattgacacgctcatagagggttttatgaataacgccacgcccttatattcctatgaaagccaccatctaaacgaatcagaatttttaaaaccactctatcaataa

SEQ ID NO: 9635 - protein, 425 aa, Helicobacter pylori
MLDFDLVLFGATGDLAMRKLFVSLYEIYTHYGFKNDSRIIASGRKELSNEEFLTLLCEKTQLHSREKGREFLAHISYLCVRLDNPKDFEELSKIATKNKPLIFYFSISPSFFATTAQHLAKNALNHANTRLILEKPLGHDLKTCKEIFQSISVFFKEEQIFRIDHYLGKKGVQNILELRLNNPILNILWDQISAVEICVYETLGVEERGEFYDKIGALRDMVQNHLLQVLSLIATDLPNNLKDLRKEKIKVLKTLQPPKDFKKQVIRAQYQGYRDENKVHKESQTETFVAIKAFLDTPKFKGVPFYLKHAKKMPHNQASVKIHFNAVNTLEFFLSQDKITLTLKDHQNPLILETHNKQEFLRPYAKLLYDAIQNNHNNFAHQLELEASWVFIDTLIEGFMNNATPLYSYESHHLNESEFLKPLYQ

SEQ ID NO: 9636 - DNA, 1446 bp, Neisseria meningitidis; identical to SEQ ID NO: 2591
  CDS (1)..(1446)

SEQ ID NO: 9637 - protein, 481 aa, Neisseria meningitidis; identical to SEQ ID NO: 2592

SEQ ID NO: 9638 - DNA, 1296 bp, Aquifex aeolicus; identical to SEQ ID NO: 2597
  CDS (1)..(1296)

SEQ ID NO: 9639 - protein, 431 aa, Aquifex aeolicus; identical to SEQ ID NO: 2598

SEQ ID NO: 9640 - DNA, 1491 bp, Thermotoga maritima; identical to SEQ ID NO: 2599
  CDS (1)..(1491)

SEQ ID NO: 9641 - protein, 496 aa, Thermotoga maritima; identical to SEQ ID NO: 2600

SEQ ID NO: 9642 - DNA, 1518 bp, Saccharomyces cerevisiae; identical to SEQ ID NO: 2533
  CDS (1)..(1518)

SEQ ID NO: 9643 - protein, 505 aa, Saccharomyces cerevisiae; identical to SEQ ID NO: 2534

SEQ ID NO: 9644 - DNA, 1494 bp, Kluyveromyces marxianus var. lactis, Candida sphaerica; identical to SEQ ID NO: 2601
  CDS (1)..(1494)

SEQ ID NO: 9645 - protein, 497 aa, Kluyveromyces marxianus var. lactis, Candida sphaerica; identical to SEQ ID NO: 2602

SEQ ID NO: 9646 - DNA, 2813 bp, Erwinia chrysanthemi; identical to SEQ ID NO: 2603
  CDS (322)..(1797)

SEQ ID NO: 9647 - protein, 491 aa, Erwinia chrysanthemi; identical to SEQ ID NO: 2604

SEQ ID NO: 9648 - DNA, 1645 bp, Aspergillus niger
  CDS (68)..(1600)
cttccctcctccaccgaatctctcacctttccttcccatctcgtggttgttcacacatcagtaaaacatggccagcacaatagcacgcactgaggaacgccagaatgctggcaccatggagctcaaagatgacactgtcatcatagtactgggtgcctccggagatcttgcaaagaagaagaccttcccggcccttttcggcctttatcgcaacaagttcctccccaagggaatcaagatcgtcggatatgcccggacaaacatggaccatgaggagtacctgaggcgtgtgcgctcatacatcaagacccctaccaaggaaatcgaagagcagctggacagcttctgccagttctgcacctacatttccggtcaatatgacaaggatgactcgttcatcaacctcaacaagcacctcgaggagattgagaagggccagaaggagcagaacagaatctactacatggccctcccccccagcgttttcaccaccgtttccgaccaacttaagcgcaactgctaccccaagaacggcgttgcccgtatcatcgtagagaagcctttcggcaaggaccttcagagctcgcgcgatctccaaaaagccctggagcctaactggaaggaagaggagatcttccgtatcgaccactacctgggtaaggagatggtcaagaacatccttatcatgcgcttcggaaacgaattcttcaacgccacctggaaccgtcaccacatcgataacgttcagatcacattcaaggagcccttcggcactgagggacgtggtggttacttcgatgaattcggcatcatccgtgatgtcatgcagaaccaccttctccaggtgttgacgctgctcgctatggagcgccccatttccttctccgccgaggacatccgtgacgagaaggttcgtgtcctccgtgcgatggacgccattgagcccaagaacgtcattattggccagtacggaaagtctctggatggcagcaagcccgcctacaaggaggacgagaccgttccccaggattcccgctgccccaccttctgcgctatggtcgcctacatcaagaacgagaggtgggacggtgttcctttcatcatgaaggctggcaaggccttgaacgagcagaagaccgagatccgtatccagttccgtgacgttacctccggaattttcaaggacatccctcgcaacgagctcgttatccgcgtccagcccaacgagtccgtgtacatcaagatgaactccaagctgcctggcctgtccatgcagacggttgtgactgagctcgacctcacctaccgccgccgcttctccgacctcaagatccccgaagcctacgagtctctgatcctggatgctctgaagggcgaccactccaacttcgtccgtgacgatgagctggatgccagctggaggatcttcacccctctcctgcactacctggatgacaacaaggagatcatccccatggaatacccctacggctcccgcggacccgccgtccttgatgacttcaccgcgtccttcggctacaagttcagcgatgctgctggctaccagtggcccttgacttccacccccaaccgtctgtaaataagggcggtcggcaggttatgacggatgaggatgaaaaaaaaa

SEQ ID NO: 9649 - protein, 510 aa, Aspergillus niger
MASTIARTEERQNAGTMELKDDTVIIVLGASGDLAKKKTFPALFGLYRNKFLPKGIKIVGYARTNMDHEEYLRRVRSYIKTPTKEIEEQLDSFCQFCTYISGQYDKDDSFINLNKHLEEIEKGQKEQNRIYYMALPPSVFTTVSDQLKRNCYPKNGVARIIVEKPFGKDLQSSRDLQKALEPNWKEEEIFRIDHYLGKEMVKNILIMRFGNEFFNATWNRHHIDNVQITFKEPFGTEGRGGYFDEFGIIRDVMQNHLLQVLTLLAMERPISFSAEDIRDEKVRVLRAMDAIEPKNVIIGQYGKSLDGSKPAYKEDETVPQDSRCPTFCAMVAYIKNERWDGVPFIMKAGKALNEQKTEIRIQFRDVTSGIFKDIPRNELVIRVQPNESVYIKMNSKLPGLSMQTVVTELDLTYRRRFSDLKIPEAYESLILDALKGDHSNFVRDDELDASWRIFTPLLHYLDDNKEIIPMEYPYGSRGPAVLDDFTASFGYKFSDAAGYQWPLTSTPNRL

SEQ ID NO: 9650 - DNA, 1785 bp, Medicago sativa (alfalfa); identical to SEQ ID NO: 2607
  CDS (38)..(1585)

SEQ ID NO: 9651 - protein, 515 aa, Medicago sativa (alfalfa); identical to SEQ ID NO: 2608

SEQ ID NO: 9652 - DNA, 1689 bp, Solanum tuberosum (potato); identical to SEQ ID NO: 2609
  CDS (46)..(1581)

SEQ ID NO: 9653 - protein, 511 aa, Solanum tuberosum (potato); identical to SEQ ID NO: 2610

SEQ ID NO: 9654 - DNA, 1530 bp, Synechocystis sp; identical to SEQ ID NO: 2611
  CDS (1)..(1530)

SEQ ID NO: 9655 - protein, 509 aa, Synechocystis sp; identical to SEQ ID NO: 2612

SEQ ID NO: 9656 - DNA, 2047 bp, Arabidopsis thaliana (mouse-ear cress)
  CDS (51)..(1850)
gtttgcatccaaatccaattcataactcacactcgtctcaaattcgaaaaatgtcgtctctctcctgccctacctaccgctcccgcacttcgtcttcgtctcctttcttgtcgaatcatcatcattcttcgctgatcaatgttgttgacccacgccgctcactctccttccactacgcttctcctcaggggcttaatctagctgagctctgtgttgttagatcgcagaggaggtccgttcagagttctgttgtcgtgcaagatggatcagtagccaccgagtcaagctcgtccgaggaggcgaaagatgtaggggtgttaacgattccttcacttgaagctgacaaggttgtagcagagtctgatggcggtgaacaactttcaacagttagtatcacggtggtgggagcttctggtgatcttgccaagaagaaaatattcccagctcttttcgcactttactatgaaggctgtcttcctgagcattttaccatttttggctatgcaaggagtaagatgacagatgctgaacttagagttatggtcagcaaaacattgacatgtagaattgataagagggcaaactgcggtgaaaagatggaagagtttctcaagagatgtttttaccattcgggtcagtatgattctcaggaacattttgttgcattggacgagaagctcaaggagcatgagggtggaagactttcgaaccgtcttttctatctttcaatccctccaaatatctttgttgacgcggtgaaatgtgcaagctcatctgcttcatctgtcaatggatggactagggtcattgtcgagaaaccttttggccgggactccaaaacctcggctgcattaacaaagtctcttaagcagtacctggaggaagaccaaatatttaggatagaccattacttagggaaggagctggttgagaacttgtcggttcttcgattctcaaatcttatatttgaaccgctatggtcaaggcagtatataaggaacgtgcaattcattttttctgaggatttcggcactgaaggacgcggagggtacttcgacaattacggaataataagagatataatgcagaatcatctgcttcagatattagctcttttcgccatggaaacacctgtgagtttggatgcagaggatatcagaaatgaaaaggtaaaggtactacgttcaatgagaccaataaaacttgaagatgtggtgataggacagtacaagagccacagcataggaggagtcacttatccaagctatactgatgataaaactgtgccaaaaggtagtctgaccccgacatttgcagctgctgcactcttcatcgacaatgcaagatgggatggtgtaccttttctaatgaaagctgggaaagcactaaacacccgaagtgcggagataagagtccagttcaggcatgtgcctggaaatttatataaccggaattctggtactgatcgtgatcagaccacaaatgagcttgtcatccgcgtccaacctgatgaagctatctatttgaaaatcaacaacaaggtccctggtttaggaatgagattagatcagagtaacttaaatcttctctattcagcaaggtattcaaaggagattccagatgcatatgagaggcttttgttagatgcgatcgaaggtgaacgcagattgttcataagaagcgatgaacttgacgctgcttgggcgcttttcactccattgctcaaagagatagaagaaaagaagacaaccccagaattctatccttacggcagtcgtggtccagtcggtgcccattatctagccgcaaaacacaaggtccaatggggagacctaagtcttgatcagtgaaagagtggaagaacattttttgttcatagattcacgtcttagaattttcattatttgtgtggtttatggaaactttctttcgctttcagagataggagtgagttttgttcgattttgtatctggaataataagtaagaactaccctattcttgccaccctttttgctttcaataaaggaaacacaaatttaagtgta

SEQ ID NO: 9657 - protein, 599 aa, Arabidopsis thaliana (mouse-ear cress)
MSSLSCPTYRSRTSSSSPFLSNHHHSSLINVVDPRRSLSFHYASPQGLNLAELCVVRSQRRSVQSSVVVQDGSVATESSSSEEAKDVGVLTIPSLEADKVVAESDGGEQLSTVSITVVGASGDLAKKKIFPALFALYYEGCLPEHFTIFGYARSKMTDAELRVMVSKTLTCRIDKRANCGEKMEEFLKRCFYHSGQYDSQEHFVALDEKLKEHEGGRLSNRLFYLSIPPNIFVDAVKCASSSASSVNGWTRVIVEKPFGRDSKTSAALTKSLKQYLEEDQIFRIDHYLGKELVENLSVLRFSNLIFEPLWSRQYIRNVQFIFSEDFGTEGRGGYFDNYGIIRDIMQNHLLQILALFAMETPVSLDAEDIRNEKVKVLRSMRPIKLEDVVIGQYKSHSIGGVTYPSYTDDKTVPKGSLTPTFAAAALFIDNARWDGVPFLMKAGKALNTRSAEIRVQFRHVPGNLYNRNSGTDRDQTTNELVIRVQPDEAIYLKINNKVPGLGMRLDQSNLNLLYSARYSKEIPDAYERLLLDAIEGERRLFIRSDELDAAWALFTPLLKEIEEKKTTPEFYPYGSRGPVGAHYLAAKHKVQWGDLSLDQ

SEQ ID NO: 9658 - DNA, 1953 bp, Nicotiana tabacum (common tobacco); identical to SEQ ID NO: 2613
  CDS (43)..(1824)

SEQ ID NO: 9659 - protein, 593 aa, Nicotiana tabacum (common tobacco); identical to SEQ ID NO: 2614

SEQ ID NO: 9660 - DNA, 1869 bp, Nicotiana tabacum (common tobacco); identical to SEQ ID NO: 2615
  CDS (22)..(1788)

SEQ ID NO: 9661 - protein, 588 aa, Nicotiana tabacum (common tobacco); identical to SEQ ID NO: 2616

SEQ ID NO: 9662 - DNA, 2058 bp, Solanum tuberosum (potato); identical to SEQ ID NO: 2617
  CDS (41)..(1774)

SEQ ID NO: 9663 - protein, 577 aa, Solanum tuberosum (potato); identical to SEQ ID NO: 2618

SEQ ID NO: 9664 - DNA, 2049 bp, Spinacia oleracea (spinach); identical to SEQ ID NO: 2619
  CDS (147)..(1871)

SEQ ID NO: 9665 - protein, 574 aa, Spinacia oleracea (spinach); identical to SEQ ID NO: 2620

SEQ ID NO: 9666 - DNA, 2359 bp, Petroselinum crispum (parsley); identical to SEQ ID NO: 2621
  CDS (172)..(1986)

SEQ ID NO: 9667 - protein, 604 aa, Petroselinum crispum (parsley); identical to SEQ ID NO: 2622

SEQ ID NO: 9668 - DNA, 1848 bp, Petroselinum crispum (parsley); identical to SEQ ID NO: 2623
  CDS (41)..(1528)

SEQ ID NO: 9669 - protein, 495 aa, Petroselinum crispum (parsley); identical to SEQ ID NO: 2624

SEQ ID NO: 9670 - DNA, 1957 bp, Petroselinum crispum (parsley); identical to SEQ ID NO: 2625
  CDS (74)..(1678)

SEQ ID NO: 9671 - protein, 534 aa, Petroselinum crispum (parsley); identical to SEQ ID NO: 2626

SEQ ID NO: 9672 - DNA, 1569 bp, Caenorhabditis elegans; identical to SEQ ID NO: 2627
  CDS (1)..(1569)

SEQ ID NO: 9673 - protein, 522 aa, Caenorhabditis elegans; identical to SEQ ID NO: 2628

SEQ ID NO: 9674 - DNA, 1779 bp, Streptomyces coelicolor; identical to SEQ ID NO: 2629
  CDS (1)..(1779)

SEQ ID NO: 9675 - protein, 592 aa, Streptomyces coelicolor; identical to SEQ ID NO: 2630

SEQ ID NO: 9676 - DNA, 1524 bp, Streptomyces coelicolor; identical to SEQ ID NO: 2631
  CDS (1)..(1524)

SEQ ID NO: 9677 - protein, 507 aa, Streptomyces coelicolor; identical to SEQ ID NO: 2632

SEQ ID NO: 9678 - DNA, 1422 bp, Schizosaccharomyces pombe; identical to SEQ ID NO: 2633
  CDS (1)..(1422)

SEQ ID NO: 9679 - protein, 473 aa, Schizosaccharomyces pombe; identical to SEQ ID NO: 2634

SEQ ID NO: 9680 - DNA, 1503 bp, Schizosaccharomyces pombe; identical to SEQ ID NO: 2635
  CDS (1)..(1503)

SEQ ID NO: 9681 - protein, 500 aa, Schizosaccharomyces pombe; identical to SEQ ID NO: 2636

SEQ ID NO: 9682 - DNA, 1428 bp, Schizosaccharomyces pombe; identical to SEQ ID NO: 2637
  CDS (1)..(1428)

SEQ ID NO: 9683 - protein, 475 aa, Schizosaccharomyces pombe; identical to SEQ ID NO: 2638

SEQ ID NO: 9684 - DNA, 1862 bp, Arabidopsis thaliana (mouse-ear cress)
  CDS (43)..(1593)
ctacgtcagggtttggttagagtgttaaaaaactattggaagatgggttctggtcaatggcatatggagaagaggtctactttaaagaatgattcgtttgtaaaagaatacaatccaatcacggaaactgggagtctctctatcattgttcttggtgcttctggtgatcttgctaagaagaagacttttcctgcacttttcaatctatttcatcagggatttcttaatccagatgaagttcatatatttggatatgcaaggagtaagattactgatgaggagcttagagataaaatccgcggatatcttgttgatgagaagaatgcatctaagaaaacagaagctttgtccaagtttctaaagctgattaagtatgtgagtggaccttatgattctgaggaagggtttaagagattagacaaggcgattttggagcacgagatatctaaaaagactgctgaaggatcttcgaggagattgttttatcttgcacttcctccgtctgtataccctcctgtaagcaagatgatcaaggcatggtgcactaacaaatctgatcttggtggatggactaggattgttgttgagaaaccatttggaaaggatttggaatctgcagagcagctgagttctcagattggagccttgtttgaagaaccacagatttatcgtattgatcactatctgggaaaagagttagttcaaaacatgttggttcttcggtttgccaatcgcttgtttttgccactatggaaccgcgacaatattgcaaacgtacagatcgttttcagagaagattttggaactgaaggtcgcggtggatattttgatgaatacggaatcattcgtgatattattcaaaaccacttgctccaggttctttgccttgtcgccatggagaaaccaatctctcttaaacccgagcacatccgggatgagaaagtgaaggttcttcaatctgtgattcccataaaagatgaagaggtggttcttggacaatatgaaggatatagagatgatccaactgttccaaatgactcaaacactccaacgtttgccacaacaattcttcgcattaacaatgaaagatgggaaggtgttccttttatactgaaggccggaaaggcaatgagttcaaagaaggcagatattcgcattcagtttaaagatgttcctggcgacatattcaaatgtcaaaaccaagggaggaacgagtttgttatacgcttgcagccttcagaggccatgtacatgaagctaactgtgaagcaaccgggtctggagatgcaaaccgtgcagagtgaactagacctatcgtacaagcagcgttaccaagatgtctcaattccagaggcttacgaacgccttattcttgacacaatcagaggcgaccaacaacactttgttcgcagagacgaattaaaggcagcttgggaaatcttcactccactgcttcacaggatcgacaagggagaagtgaaatcggtcccatacaaacaaggtagccgtggcccagcggaagcagatcagctacttaagaaagctggttatatgcagactcatggctacatttggatccctcctacattgtaaatggtataatcatagagatgatgatgatgagtacacacaaaataagagggttttttttcttttttttccttgcttgctgaataaaaactcttcaccagtttggagtttgtttaagtgaatcttatgtatactagtgatcttcactaggacattgtttgtttatgccttgtagtttttgttgtactagtcccttgttttctttttttacataatgcaaaacagctttgtggaaaagctaattaaattaagaaaaaaaaaccctgacgtag

SEQ ID NO: 9685 - protein, 516 aa, Arabidopsis thaliana (mouse-ear cress)
MGSGQWHMEKRSTLKNDSFVKEYNPITETGSLSIIVLGASGDLAKKKTFPALFNLFHQGFLNPDEVHIFGYARSKITDEELRDKIRGYLVDEKNASKKTEALSKFLKLIKYVSGPYDSEEGFKRLDKAILEHEISKKTAEGSSRRLFYLALPPSVYPPVSKMIKAWCTNKSDLGGWTRIVVEKPFGKDLESAEQLSSQIGALFEEPQIYRIDHYLGKELVQNMLVLRFANRLFLPLWNRDNIANVQIVFREDFGTEGRGGYFDEYGIIRDIIQNHLLQVLCLVAMEKPISLKPEHIRDEKVKVLQSVIPIKDEEVVLGQYEGYRDDPTVPNDSNTPTFATTILRINNERWEGVPFILKAGKAMSSKKADIRIQFKDVPGDIFKCQNQGRNEFVIRLQPSEAMYMKLTVKQPGLEMQTVQSELDLSYKQRYQDVSIPEAYERLILDTIRGDQQHFVRRDELKAAWEIFTPLLHRIDKGEVKSVPYKQGSRGPAEADQLLKKAGYMQTHGYIWIPPTL

SEQ ID NO: 9686 - DNA, 1696 bp, Leuconostoc mesenteroides
  CDS (123)..(1583)
tctagtcatttaatcaatttttgacttgttcaacgcttaatatgtttgtgaatcccgtacttttccagacctttttgcgttataatggagagtgaatttaattataatataaggggaacatcatggtttcagaaatcaaaacgttggtaactttctttggcggaactggtgatttagcaaagcgtaagctttacccatcagttttcaacctctacaaaaaaggatacttacaagaacactttgccattgttgggacagcacgtcaacaattaagtgatgacgagtttaagcaattggttcgtgattcaattaaagactttactgaagatcaagcacaagccgaagcgtttattgcgcatttttcttaccgtgcgcacgatgtcacagatgccgcttcttatggtatcttgaagtcagcgatcgaagaagcagcaaccaaatttgacattgatggcaatcgtattttctatatgtcagttgcccctcgtttcttcggtacaatcgctaaatatttgaaatcagaaggtttgctagctgagactggctacaatcgtttgatgattgaaaagccttttggtacatcatacgccaccgcagaagaattgcaaagtgatttggaaaatgcatttgatgatgaccaactgttccgtattgaccactatcttggaaaagaaatggtacaaaatattgcagcattacgttttggtaacccaatctttgatgccgcttggaataaggactatatcaaaaacgtacaagtaactttggctgaagttctaggtgttgaagagcgtgctggttactacgataccactggcgcccttttggatatgattcaaaaccacacaatgcaaattgttggttggttagcaatggaaaaacctgaatcattcaatgataaggatatccgtgcagctaaaaacgccgccttcaatgcattaaagatttataacgaagaagaagtgaataagtacttcgttcgtgcacaatatggtgctggtgatacagctgattacaagccatatttggaagaagcagatgtccctgctgactcaaagaacaacacattcattgctggtgaattgcagttcgatttgccacgttgggaaggtgttcctttctatgttcgttcaggtaagcgtttggctgccaagcaaacacgtgttgatattgtatttaaggctggcacattcaactttggttcagaacaagaagcacaagaatcagtactctcaatcatcattgatccaaagggtgctattgaattgaagcttaacgctaagtcagttgaagatgccttcaacacccgcacaatcaacttggattgggcagtatctgatgaagacaagaagaacacaccagaaccatacgaacgtatgattcacgatacaatgaatggtgacggatcaaactttgctgattggaacggtgtatcaattgcttggaagtttgttgacgcaattactgccgtttacgatgcagataaagcaccattggagacatataagtcaggttcaatgggtcctgaagcatcagacaagctattagctgaaaatggcgatgcttgggtatttaaaggataagcacatttaaaaagaccatcaaacaaatctttgtttgacggtctttttatattgtctgatttaagatgcgtttggtttcacggaaaacggctgacaaattggtgtattgatcc

SEQ ID NO: 9687 - protein, 486 aa, Leuconostoc mesenteroides; identical to SEQ ID NO: 2640

SEQ ID NO: 9688 - DNA, 1545 bp, Corynebacterium glutamicum
  CDS (1)..(1545)
atgagcacaaacacgaccccctccagctggacaaacccactgcgcgacccgcaggataaacgactcccccgcatcgctggcccttccggcatggtgatcttcggtgtcactggcgacttggctcgaaagaagctgctccccgccatttatgatctagcaaaccgcggattgctgcccccaggattctcgttggtaggttacggccgccgcgaatggtccaaagaagactttgaaaaatacgtacgcgatgccgcaagtgctggtgctcgtacggaattccgtgaaaatgtttgggagcgcctcgccgagggtatggaatttgttcgcggcaactttgatgatgatgcagctttcgacaacctcgctgcaacactcaagcgcatcgacaaaacccgcggcaccgccggcaactgggcttactacctgtccattccaccagattccttcacagcggtctgccaccagctggagcgttccggcatggctgaatccaccgaagaagcatggcgccgcgtgatcatcgagaagcctttcggccacaacctcgaatccgcacacgagctcaaccagctggtcaacgcagtcttcccagaatcttctgtgttccgcatcgaccactatttgggcaaggaaacagttcaaaacatcctggctctgcgttttgctaaccagctgtttgagccactgtggaactccaactacgttgaccacgtccagatcaccatggctgaagatattggcttgggtggacgtgctggttactacgacggcatcggcgcagcccgcgacgtcatccagaaccacctgatccagctcttggctctggttgccatggaagaaccaatttctttcgtgccagcgcagctgcaggcagaaaagatcaaggtgctctctgcgacaaagccgtgctacccattggataaaacctccgctcgtggtcagtacgctgccggttggcagggctctgagttagtcaagggacttcgcgaagaagatggcttcaaccctgagtccaccactgagacttttgcggcttgtaccttagagatcacgtctcgtcgctgggctggtgtgccgttctacctgcgcaccggtaagcgtcttggtcgccgtgttactgagattgccgtggtgtttaaagacgcaccacaccagcctttcgacggcgacatgactgtatcccttggccaaaacgccatcgtgattcgcgtgcagcctgatgaaggtgtgctcatccgcttcggttccaaggttccaggttctgccatggaagtccgtgacgtcaacatggacttctcctactcagaatccttcactgaagaatcacctgaagcatacgagcgcctcattttggatgcgctgttagatgaatccagcctcttccctaccaacgaggaagtggaactgagctggaagattctggatccaattcttgaagcatgggatgccgatggagaaccagaggattacccagcgggtacgtggggtccaaagagcgctgatgaaatgctttcccgcaacggtcacacctggcgcaggccataa

SEQ ID NO: 9689 - protein, 514 aa, Corynebacterium glutamicum
MSTNTTPSSWTNPLRDPQDKRLPRIAGPSGMVIFGVTGDLARKKLLPAIYDLANRGLLPPGFSLVGYGRREWSKEDFEKYVRDAASAGARTEFRENVWERLAEGMEFVRGNFDDDAAFDNLAATLKRIDKTRGTAGNWAYYLSIPPDSFTAVCHQLERSGMAESTEEAWRRVIIEKPFGHNLESAHELNQLVNAVFPESSVFRIDHYLGKETVQNILALRFANQLFEPLWNSNYVDHVQITMAEDIGLGGRAGYYDGIGAARDVIQNHLIQLLALVAMEEPISFVPAQLQAEKIKVLSATKPCYPLDKTSARGQYAAGWQGSELVKGLREEDGFNPESTTETFAACTLEITSRRWAGVPFYLRTGKRLGRRVTEIAVVFKDAPHQPFDGDMTVSLGQNAIVIRVQPDEGVLIRFGSKVPGSAMEVRDVNMDFSYSESFTEESPEAYERLILDALLDESSLFPTNEEVELSWKILDPILEAWDADGEPEDYPAGTWGPKSADEMLSRNGHTWRRP

SEQ ID NO: 9690 - DNA, 2491 bp, Cricetulus griseus
  CDS (136)..(1683)
tgaggcgggtcagctcagtcaaagcacccgccctcctgcgttaaacgagccagctaagcgcacgccccggaaacgagctgtgcactccagaactgtaaacctgtttggcagcagcaactaaacacagaaaacaccatggcagagcaggtggccctgagccggacccaggtgtgtggcatcctgagggaagagttgtaccagggtgatgccttccaccaagctgatacacatatatttatcatcatgggtgcatcgggtgacctggccaagaagaagatctatcccactatctggtggctgttccgggatggccttctacccgaagacaccttcattgtgggctatgcccgctcccgactcacagtggatgacatccgcaagcagagtgagcccttctttaaagccaccccagaggaaagacccaagctggaggagttctttgcccgtaactcctatgtggctggccagtatgatgatccagcctcctacaagcacctcaacagccacatgaatgccctgcatcaggggatgcaggccaaccgcctattctacctggccttgccccccacagtctatgaagctgtcaccaagaacattcaagagacctgcatgagtcagacaggctggaaccgcatcatagtggagaagcccttcgggagagacctgcagagctccaaccagctgtcgaaccacatctcctctctgttccgtgaggaccagatctaccgcattgaccactacctgggcaaggagatggtccagaacctcatggtgctgagatttgccaacaggatctttggccccatctggaaccgagacaacattgcctgtgtgatcctcacatttaaagagccctttggtactgagggtcgtgggggctactttgatgaatttgggatcatcagggatgttatgcagaaccacctcctgcagatgttgtgtctggtggccatggaaaaacctgcctccacagattcagatgatgtccgtgatgagaaggtcaaagtgttgaaatgtatctcagaggtggaaaccagcaatgtggtccttggccagtatgtggggaaccccaatggagaaggagaagctaccaatgggtacttggatgaccccacagtgccccgtgggtccaccactgccacctttgcagcagctgtcctctatgtggagaatgagcggtgggatggggtacccttcatcctgcgctgtggcaaagccctgaatgaacgcaaggctgaggtgagactacagttccgagatgtggcaggcgacatcttccaccagcagtgcaagcgtaatgagctggtgattcgtgtgcagcccaatgaggctgtatacaccaagatgatgaccaagaagcctggcatgttcttcaaccctgaggagtcagagctggacttgacctatggcaacagatacaagaatgtgaagctccctgatgcctatgaacgcctcatcctggatgtcttctgtgggagccagatgcactttgtccgcagtgatgaactcagggaagcctggcgtatcttcacaccactgctgcacaagattgatcaagagaagccccagcctatcccctatgtttatggcagccgcggccccacagaggcagatgagctgatgaagagagtgggcttccagtatgagggcacctacaaatgggtgaaccctcacaagctctgagccttgggaacttataccatctgcactctgccccttttggacaccctttctgtgtctatccttcttaccacctaacctcatatttggactattagccccacattggaacgactttgggaccataggctttagccacacattccagtccctgggctcgtgccaccactctataccctatgctgctgctgctgctgctaccactgccaccaccaccatcactgctgctgctgctgttaccaccaccactgaccccagctacattcctcaactatcaaattctccaagttctcaaaactcactgtaatgctttcagggccaccattgaccctatctgagccacccatctctccacaagaagcaaatcacctcctcccctcactccagcccctgcaaagggaagaagaacagcctatcagtctgtccctagactcctcaagacaggagttaggaacaatggggaggaaccttgagcctcagagggataaagaccaaaccacactccctagtgtctatgggcaagctcctcaaaattcaaatgaaatggtcaaggacacccatgtgagaagacctgcccatggccacaccagcttcagtgccacttgacattcctcctcaccagctggaagagaccacatactgcctaacaatattgtggcactagagatgtcccctaaccaactccatactccatggtcatcatcccacccacaggcagccttctcaccaaaggaaggcagaagtagcagctatgatttccctaccccaaccttgcaattaaatcctccaacagttaaaaaaaaaaaaaaaa

SEQ ID NO: 9691 - protein, 515 aa, Cricetulus griseus
MAEQVALSRTQVCGILREELYQGDAFHQADTHIFIIMGASGDLAKKKIYPTIWWLFRDGLLPEDTFIVGYARSRLTVDDIRKQSEPFFKATPEERPKLEEFFARNSYVAGQYDDPASYKHLNSHMNALHQGMQANRLFYLALPPTVYEAVTKNIQETCMSQTGWNRIIVEKPFGRDLQSSNQLSNHISSLFREDQIYRIDHYLGKEMVQNLMVLRFANRIFGPIWNRDNIACVILTFKEPFGTEGRGGYFDEFGIIRDVMQNHLLQMLCLVAMEKPASTDSDDVRDEKVKVLKCISEVETSNVVLGQYVGNPNGEGEATNGYLDDPTVPRGSTTATFAAAVLYVENERWDGVPFILRCGKALNERKAEVRLQFRDVAGDIFHQQCKRNELVIRVQPNEAVYTKMMTKKPGMFFNPEESELDLTYGNRYKNVKLPDAYERLILDVFCGSQMHFVRSDELREAWRIFTPLLHKIDQEKPQPIPYVYGSRGPTEADELMKRVGFQYEGTYKWVNPHKL

SEQ ID NO: 9692 - DNA, 1852 bp, Nicotiana tabacum; identical to SEQ ID NO: 2643
  CDS (102)..(1634)

SEQ ID NO: 9693 - protein, 510 aa, Nicotiana tabacum; identical to SEQ ID NO: 2644

SEQ ID NO: 9694 - DNA, 1821 bp, Nicotiana tabacum; identical to SEQ ID NO: 2645
  CDS (88)..(1623)

SEQ ID NO: 9695 - protein, 511 aa, Nicotiana tabacum; identical to SEQ ID NO: 2646

SEQ ID NO: 9696 - DNA, 1539 bp, Chlamydia trachomatis
  CDS (1)..(1539)
atgctaggttgtaccttggaagaaattaaagactttggccccacattaccagcctgccctccctgtatcgtggttatttttggtgctacaggagacttgacctctaggaagctctttcctgctttatacaatttaacaaaggaaggacgtctatccgaaaactttgtttgtgttgggtttgctaggcgacctaagtctcatgagcaatttctcgaagaaatgaagcttgccgttcagcatttctctcactcatcggaaatagatattcgagtttgggaaagtctggaaaatagaatcttttaccaccaagctaatttttctgatgccgaaggctactctgctctgaaagcttatttggagcaactagatcaacaatatggaacacaagggaatcgtcttttttatttatcaacaccaccagattatttccaggaaatcatccgcaatttaaatcggcatcagctattctatcatgaacaaggagcacaacagccttggtctcggctaattatagaaaagccttttggagttaatttagaaacagctcgagagcttcaacaatgcattgatgccaatattgatgaagagtcggtttatcgaatagaccattatttaggaaaagaaacggttcaaaacattctgactattcgttttgctaatactctctttgagtcttgctggaattctcagtacatagatcatgtgcaaatcagcgttagcgaatcaattggtataggatctcgagggaatttcttcgaaaagtcgggcatgctacgagacatggtacagaatcatttgacgcagctgctatgtctactgactatggaacctccttctgaattttcttcagaagaaataaaaaaagaaaaaattaaaattctaaagaaaattcttcctatccgcgaagaagatgctgttcgtggccaatatggtgaagggattgtgcaagatgtttcagttctgggctatcgggaggaagaaaatgtcgatccgaattcttcagtagaaacctacgttgcattaaaattatttatcgacaatcctcgctggaaaggggttcccttttacttacaagcagggaaacgtcttactaaaagaacaacagatatcgctgtgatctttaaaaaatccagctacaatttattcaatgcagagaattgtcctttgtgtccgttagaaaatgatttacttattattcgtattcaaccggatgaaggtgttgcgctacaatttaactgcaaggttccaggaacaaataagctcgtacgtcctgtaaaaatggacttccgttacgacagctattttaatactgttactcccgaagcttatgaacggttactgtgcgactgtatccttggggacagaacgctattcactagcaatgaagaagtcttagcatcttgggaactattttctcctctattagaaaaatggtctcaagtacaccctatattccctaactatatggccggatctttacgtcctcaagaagctgatgaactattatctagagatggaaaagcttggcggccctattaa

SEQ ID NO: 9697 - protein, 512 aa, Chlamydia trachomatis; identical to SEQ ID NO: 2648

SEQ ID NO: 9698 - DNA, 1581 bp, Vibrio vulnificus; identical to SEQ ID NO: 2689
  CDS (1)..(1581)

SEQ ID NO: 9699 - protein, 526 aa, Vibrio vulnificus; identical to SEQ ID NO: 2690

SEQ ID NO: 9700 - DNA, 1476 bp, Photorhabdus luminescens; identical to SEQ ID NO: 2691
  CDS (1)..(1476)

SEQ ID NO: 9701 - protein, 491 aa, Photorhabdus luminescens; identical to SEQ ID NO: 2692

SEQ ID NO: 9702 - DNA, 1539 bp, Gloeobacter violaceus; identical to SEQ ID NO: 2693
  CDS (1)..(1539)

SEQ ID NO: 9703 - protein, 512 aa, Gloeobacter violaceus; identical to SEQ ID NO: 2694

SEQ ID NO: 9704 - DNA, 1539 bp, Gloeobacter violaceus; identical to SEQ ID NO: 2695
  CDS (1)..(1539)

SEQ ID NO: 9705 - protein, 512 aa, Gloeobacter violaceus; identical to SEQ ID NO: 2696

SEQ ID NO: 9706 - DNA, 1479 bp, Chromobacterium violaceum; identical to SEQ ID NO: 2697
  CDS (1)..(1479)

SEQ ID NO: 9707 - protein, 492 aa, Chromobacterium violaceum; identical to SEQ ID NO: 2698

SEQ ID NO: 9708 - DNA, 1476 bp, Neurospora crassa; identical to SEQ ID NO: 2703
  CDS (1)..(1476)

SEQ ID NO: 9709 - protein, 491 aa, Neurospora crassa; identical to SEQ ID NO: 2704

SEQ ID NO: 9710 - DNA, 1524 bp, Synechococcus sp; identical to SEQ ID NO: 2705
  CDS (1)..(1524)

SEQ ID NO: 9711 - protein, 507 aa, Synechococcus sp; identical to SEQ ID NO: 2706

SEQ ID NO: 9712 - DNA, 1455 bp, Rhodopirellula baltica; identical to SEQ ID NO: 2707
  CDS (1)..(1455)

SEQ ID NO: 9713 - protein, 484 aa, Rhodopirellula baltica; identical to SEQ ID NO: 2708

SEQ ID NO: 9714 - DNA, 1524 bp, Prochlorococcus marinus subsp; identical to SEQ ID NO: 2709
  CDS (1)..(1524)

SEQ ID NO: 9715 - protein, 507 aa, Prochlorococcus marinus subsp; identical to SEQ ID NO: 2710

SEQ ID NO: 9716 - DNA, 1524 bp, Prochlorococcus marinus; identical to SEQ ID NO: 2711
  CDS (1)..(1524)

SEQ ID NO: 9717 - protein, 507 aa, Prochlorococcus marinus; identical to SEQ ID NO: 2712

SEQ ID NO: 9718 - DNA, 1521 bp, Prochlorococcus marinus; identical to SEQ ID NO: 2713
  CDS (1)..(1521)

SEQ ID NO: 9719 - protein, 506 aa, Prochlorococcus marinus; identical to SEQ ID NO: 2714

SEQ ID NO: 9720 - DNA, 1488 bp, Haemophilus ducreyi; identical to SEQ ID NO: 2715
  CDS (1)..(1488)

SEQ ID NO: 9721 - protein, 495 aa, Haemophilus ducreyi; identical to SEQ ID NO: 2716

SEQ ID NO: 9722 - DNA, 1497 bp, Candidatus Blochmannia floridanus; identical to SEQ ID NO: 2717
  CDS (1)..(1497)

SEQ ID NO: 9723 - protein, 498 aa, Candidatus Blochmannia floridanus; identical to SEQ ID NO: 2718

SEQ ID NO: 9724 - DNA, 1548 bp, Bos indicus; identical to SEQ ID NO: 2721
  CDS (1)..(1548)

SEQ ID NO: 9725 - protein, 515 aa, Bos indicus; identical to SEQ ID NO: 2722

SEQ ID NO: 9726 - DNA, 1485 bp, Bacillus anthracis
  CDS (10)..(1485)
ttggaatcaatgacctttgttttatttggagcgacaggggacttagcgaaacgcaaaatttaccccgcactatataacttatatagagatcaaaagcttccaaagcaaatatccgttatcgggcttgggagacgtgaagtatctcatgtagattttcaaaaaagaataaaagaatcaatagagacgttttctcgtcatagagaagaaggtactccagaactcgaaggttttttagataattttcgctattgtccattagatgtgagtaagccggaagactatgagagattattacaagtcgttcgtgaaagggaagaagagctacatataaaagggaatagaatgttctatctttccggtgctcctgaattttttgagacaatcgctttaaatattaaggaaagcggacttgataaaacggatggatggaaacgcctaatgattgagaaaccgttcgggcacgaccttacatctgctcgtgagctgaatgataagcttagtcgcacgtttgaagaagacgagatataccgtattgatcattatttaggtaagccgatgattcaaaaccttgaagcactagagtttgcaaatcctgttttacaatcgatttggaataaagaacatatagcgaatgtacaaatcacagcgagtgaaacagttggtgttgaagaaagggcaggatattatgatcaggcaggagccattcgagatatggttcaaaatcatatgttacaaatattaatgatgactgctatgaatttgccggaaaaggttaatgcatgtgaaattcgagaggaaaagcgaaaggtaatggaggcgcttcgtaaagtgaaaaaagaagacgttcaaaaccatatcattcgcggacaatatggtgcaggtgagataaatggcgggcaagttgtagcatataaagaggagccaggagtaaatccctcttctaatatagacacatttattgctgctcgcttgtggatcgataatccattttggactggcgttcccttttatatacgaacaggcaaacgaatgaaagaaaagtctactcgtattgtaatcgaatttaaaaatacgttaaaacagcaatatcaagatagtaatccaaatgcagcacctaacttgttaataattgaaattagcccaggtgagaacgtttcattacagttaaatagtaaaaatccattgaaaaatggagaaattgaaccgatccgtattaactttacttgtgagcaagcggatgtgggagtacctgaagcgtatgaaagactcattcatgatgctgtgagtggagacgctacattctttgcacattggagagaagttgaattgtcatgggaatgggtacaaccaattcttgaagcattcgaggaaaacttattaccacttcatgaatatgagtctggttcatatggtccagaggcatctaatgaattattgcaagaaagtggatttaaatggtggttagatcaagaaacgaaaaaatga

SEQ ID NO: 9727 - protein, 491 aa, Bacillus anthracis
MTFVLFGATGDLAKRKIYPALYNLYRDQKLPKQISVIGLGRREVSHVDFQKRIKESIETFSRHREEGTPELEGFLDNFRYCPLDVSKPEDYERLLQVVREREEELHIKGNRMFYLSGAPEFFETIALNIKESGLDKTDGWKRLMIEKPFGHDLTSARELNDKLSRTFEEDEIYRIDHYLGKPMIQNLEALEFANPVLQSIWNKEHIANVQITASETVGVEERAGYYDQAGAIRDMVQNHMLQILMMTAMNLPEKVNACEIREEKRKVMEALRKVKKEDVQNHIIRGQYGAGEINGGQVVAYKEEPGVNPSSNIDTFIAARLWIDNPFWTGVPFYIRTGKRMKEKSTRIVIEFKNTLKQQYQDSNPNAAPNLLIIEISPGENVSLQLNSKNPLKNGEIEPIRINFTCEQADVGVPEAYERLIHDAVSGDATFFAHWREVELSWEWVQPILEAFEENLLPLHEYESGSYGPEASNELLQESGFKWWLDQETKK

SEQ ID NO: 9728 - DNA, 1536 bp, Chlamydophila caviae; identical to SEQ ID NO: 2723
  CDS (1)..(1536)

SEQ ID NO: 9729 - protein, 511 aa, Chlamydophila caviae; identical to SEQ ID NO: 2724

SEQ ID NO: 9730 - DNA, 1524 bp, Streptomyces avermitilis; identical to SEQ ID NO: 2725
  CDS (1)..(1524)

SEQ ID NO: 9731 - protein, 507 aa, Streptomyces avermitilis; identical to SEQ ID NO: 2726

SEQ ID NO: 9732 - DNA, 1647 bp, Streptomyces avermitilis; identical to SEQ ID NO: 2727
  CDS (1)..(1647)

SEQ ID NO: 9733 - protein, 548 aa, Streptomyces avermitilis; identical to SEQ ID NO: 2728

SEQ ID NO: 9734 - DNA, 1491 bp, Nitrosomonas europaea; identical to SEQ ID NO: 2729
  CDS (1)..(1491)

SEQ ID NO: 9735 - protein, 496 aa, Nitrosomonas europaea; identical to SEQ ID NO: 2730

SEQ ID NO: 9736 - DNA, 1524 bp, Enterococcus faecalis
  CDS (1)..(1524)
atgaatgaaaaagtagcattatttactattttcggggggacaggtgatcttgccaaacgtaaattgtatccttccctgttccgcttatataaaaaaggattattagctgagcgttttgcggtgattggtaccgcacgtcgggaatggacagacgaatactatcgtgaaatcgtccgtgaaaccattcaagacttaaatcccacggccgaagaggcaactgaattttctagtcatttctattaccaatcacataatgtgaatgatacggaacattataataccttaaaagaattatctgatcgcctaaatgaacaataccacttagaaggcaatcatgtttactatttagctatggcccctcaattctttggaaccattgttaatcacttgaaatcacaacatattatttcggaagaaggctttgatcgtctaattatcgaaaagccatttggttctgattatgaatctgcctacgaattaaatgaagaaattcgtgctgcatttcctgaacaagatattttccgaattgaccattacttaggcaaagaaatgatccaaaatatttcagccattcgttttgccaataatatttttgaatcacaatggaacaatcgttacattgataatgtccaaatcaccttcgctgaaagcttaggtgtcgaggatcgtggcggctattatgaccacagtggcgcactaaaagatatggttcaaaatcatattttacaagtcgttgcattgctttctatggagcctcctgttgccttttctgaaaaagaaattcggactgaaaaagtaaaagctttacgtgccatccgcctttattctgaagaagaagcccttcaaaatttcgtgcgtggacaatacggcgaaggtcagctagctgatcaaacatttgcagcctatcgtgatgaaccaaatgtggcagaaacttcatccactgaaacttttgttgctggtaaatttttaattgataatttccgttggtctggcgtccctttctatgttcgcacaggtaaacgattaactgaaaaaggcacacgcattaacatcgtctttaaacaagtacctattaatgtcttcaaagatgatacgtgtgaagaatgcgataaaaccgatttaccaccgaatgttttaactatctatatccaaccaactgaaggattttcattaaccttaaatggaaaagaaatcggtcaagggttcaatacaactccagtgaaacttgatttccgtcaaagtgctgaaatgactgaaaatagtccagaagcatacgaaaaacttctattagactgcctaaatggcgatagtacaaacttctctcattgggacgaagttgcccaatcttggcgcattgttgacattattcgacatgcttgggataaaacagacgtttctttccctaattatgccgctggcacaatgggcccgcaagctgccttcgacttattagaaaaagatggctttacttgggaatggcaaccagataactggtaccgtgaccgcggtcaacttgatcaatga

SEQ ID NO: 9737 - protein, 507 aa, Enterococcus faecalis; identical to SEQ ID NO: 2732

SEQ ID NO: 9738 - DNA, 1464 bp, Tropheryma whipplei; identical to SEQ ID NO: 2733
  CDS (1)..(1464)

SEQ ID NO: 9739 - protein, 487 aa, Tropheryma whipplei; identical to SEQ ID NO: 2734

SEQ ID NO: 9740 - DNA, 2145 bp, Leishmania mexicana; identical to SEQ ID NO: 2735
  CDS (298)..(1986)

SEQ ID NO: 9741 - protein, 562 aa, Leishmania mexicana; identical to SEQ ID NO: 2736

SEQ ID NO: 9742 - DNA, 1494 bp, Dictyostelium discoideum; identical to SEQ ID NO: 2737
  CDS (1)..(1494)

SEQ ID NO: 9743 - protein, 497 aa, Dictyostelium discoideum; identical to SEQ ID NO: 2738

SEQ ID NO: 9744 - DNA, 1503 bp, Xylella fastidiosa; identical to SEQ ID NO: 2739
  CDS (1)..(1503)

SEQ ID NO: 9745 - protein, 500 aa, Xylella fastidiosa; identical to SEQ ID NO: 2740

SEQ ID NO: 9746 - DNA, 1506 bp, Vibrio parahaemolyticus; identical to SEQ ID NO: 2741
  CDS (1)..(1506)

SEQ ID NO: 9747 - protein, 501 aa, Vibrio parahaemolyticus; identical to SEQ ID NO: 2742

SEQ ID NO: 9748 - DNA, 1533 bp, Pseudomonas syringae; identical to SEQ ID NO: 2743
  CDS (1)..(1533)

SEQ ID NO: 9749 - protein, 510 aa, Pseudomonas syringae; identical to SEQ ID NO: 2744

SEQ ID NO: 9750 - DNA, 1470 bp, Pseudomonas syringae; identical to SEQ ID NO: 2745
  CDS (1)..(1470)

SEQ ID NO: 9751 - protein, 489 aa, Pseudomonas syringae; identical to SEQ ID NO: 2746

SEQ ID NO: 9752 - DNA, 1458 bp, Pseudomonas putida; identical to SEQ ID NO: 2747
  CDS (1)..(1458)

SEQ ID NO: 9753 - protein, 485 aa, Pseudomonas putida; identical to SEQ ID NO: 2748

SEQ ID NO: 9754 - DNA, 1506 bp, Pseudomonas putida; identical to SEQ ID NO: 2749
  CDS (1)..(1506)

SEQ ID NO: 9755 - protein, 501 aa, Pseudomonas putida; identical to SEQ ID NO: 2750

SEQ ID NO: 9756 - DNA, 1470 bp, Pseudomonas putida; identical to SEQ ID NO: 2751
  CDS (1)..(1470)

SEQ ID NO: 9757 - protein, 489 aa, Pseudomonas putida; identical to SEQ ID NO: 2752

SEQ ID NO: 9758 - DNA, 1485 bp, Lactobacillus plantarum; identical to SEQ ID NO: 2753
  CDS (1)..(1485)

SEQ ID NO: 9759 - protein, 494 aa, Lactobacillus plantarum; identical to SEQ ID NO: 2754

SEQ ID NO: 9760 - DNA, 1440 bp, Clostridium tetani; identical to SEQ ID NO: 2755
  CDS (1)..(1440)

SEQ ID NO: 9761 - protein, 479 aa, Clostridium tetani; identical to SEQ ID NO: 2756

SEQ ID NO: 9762 - DNA, 1512 bp, Bradyrhizobium japonicum; identical to SEQ ID NO: 2757
  CDS (1)..(1512)

SEQ ID NO: 9763 - protein, 503 aa, Bradyrhizobium japonicum; identical to SEQ ID NO: 2758

SEQ ID NO: 9764 - DNA, 1497 bp, Bacteroides thetaiotaomicron; identical to SEQ ID NO: 2759
  CDS (1)..(1497)

SEQ ID NO: 9765 - protein, 498 aa, Bacteroides thetaiotaomicron; identical to SEQ ID NO: 2760

SEQ ID NO: 9766 - DNA, 1485 bp, Staphylococcus epidermidis; identical to SEQ ID NO: 2763
  CDS (1)..(1485)

SEQ ID NO: 9767 - protein, 494 aa, Staphylococcus epidermidis; identical to SEQ ID NO: 2764

SEQ ID NO: 9768 - DNA, 1590 bp, Yersinia pestis; identical to SEQ ID NO: 2765
  CDS (1)..(1590)

SEQ ID NO: 9769 - protein, 529 aa, Yersinia pestis; identical to SEQ ID NO: 2766

SEQ ID NO: 9770 - DNA, 1506 bp, Vibrio vulnificus
  CDS (1)..(1506)
atgatggtaataccagaaaacagcagcatcgtaatttttggtgcttcaggtgatttaacatatcgcaagttgatccctgctttataccacctctacgcaagtaagcagctaccagaaaactttgctattttaggtgtcagccgcactgaatacagcgatgaatcttatcgcgaaaagttaaagcgctctcttcaggaaatggagaaaacggaaccagctattctggattcatttatcgaccatcttcactatcaagccatcaacacgtcagacacaaaagactacgcgaagttggttgtacgtttagatgaattggccgctcaataccagttcgaacaacgtaatacactgttttatctggccacaccgccaagcctttacagtgttattcctgcaagccttgctcatcacggtctcaatagtgaagaggatggttggaagcgcctgatcattgaaaaaccgtttggttatgatttggcttcggcacgtcagctcgacaaagaaatacacgattgcttccaagagcatcagatctatcgcatcgaccactaccttggaaaagagaccgtacaaaacttacttgttttccgtttctctaacgccatgtttgaacctctgtggaaccgcaacttcattgattatgtggaaatcacaggtgccgaattccttggtgtggaagagcgcggtggttattacgacggctccggcgctgtgcgcgatatgttccaaaaccacctactgcaagtgttggcgatggtgggcatggagccgccagcacaaattaacgccgattccatgcgtgatgaagtagtgaaagttctgcagtgtttaaaaccgcttgaggaagatgatctgcgtaacaacctagttttgggtcaatacaccgcatcagacgtgcgcggacaacatctgcttggctaccgtgaagaaaacggcgtagcggacgattctcgtaccgagacttacattggtcttaaagcgtacatcaataactggcgttggaatggcgtaccattctacgtgcgcacgggtaagcgtcttccaactcgcgtgacagaagtggttatccacttcaaacaaacaccgcatccggtatttggccaaaacgctccagaaaacaaactgatcattcgtattcagcctgatgaaggcattcaaatgagcttcggtttgaaagaacccggtgcaggctttaaagccaaagaagtgaagatgaacttccattatgcttcgttgcaagagacgcaaatgctgaccgcctatgagcgtctgcttcttgatgcgttaaacggcgacgcaacgctgtttgctcgcagcgatgcggtcgaagcgtgttggaaatacgttcaacctatcctcgatttcaaacaagatccacaagcactctttggttatgcttgcggtacttgggggccaaaagagtcggacgatttgctgcagcgtgatgatcgcgcgtggcgtttcccatgcaaaaacctaacagatacggactactgcgaactatga

SEQ ID NO: 9771 - protein, 501 aa, Vibrio vulnificus
MMVIPENSSIVIFGASGDLTYRKLIPALYHLYASKQLPENFAILGVSRTEYSDESYREKLKRSLQEMEKTEPAILDSFIDHLHYQAINTSDTKDYAKLVVRLDELAAQYQFEQRNTLFYLATPPSLYSVIPASLAHHGLNSEEDGWKRLIIEKPFGYDLASARQLDKEIHDCFQEHQIYRIDHYLGKETVQNLLVFRFSNAMFEPLWNRNFIDYVEITGAEFLGVEERGGYYDGSGAVRDMFQNHLLQVLAMVGMEPPAQINADSMRDEVVKVLQCLKPLEEDDLRNNLVLGQYTASDVRGQHLLGYREENGVADDSRTETYIGLKAYINNWRWNGVPFYVRTGKRLPTRVTEVVIHFKQTPHPVFGQNAPENKLIIRIQPDEGIQMSFGLKEPGAGFKAKEVKMNFHYASLQETQMLTAYERLLLDALNGDATLFARSDAVEACWKYVQPILDFKQDPQALFGYACGTWGPKESDDLLQRDDRAWRFPCKNLTDTDYCEL

SEQ ID NO: 9772 - DNA, 1530 bp, Synechococcus elongatus; identical to SEQ ID NO: 2767
  CDS (1)..(1530)

SEQ ID NO: 9773 - protein, 509 aa, Synechococcus elongatus; identical to SEQ ID NO: 2768

SEQ ID NO: 9774 - DNA, 1473 bp, Shewanella oneidensis; identical to SEQ ID NO: 2769
  CDS (1)..(1473)

SEQ ID NO: 9775 - protein, 490 aa, Shewanella oneidensis; identical to SEQ ID NO: 2770

SEQ ID NO: 9776 - DNA, 1476 bp, Oceanobacillus iheyensis; identical to SEQ ID NO: 2771
  CDS (1)..(1476)

SEQ ID NO: 9777 - protein, 491 aa, Oceanobacillus iheyensis; identical to SEQ ID NO: 2772

SEQ ID NO: 9778 - DNA, 1344 bp, Corynebacterium efficiens; identical to SEQ ID NO: 2773
  CDS (1)..(1344)

SEQ ID NO: 9779 - protein, 447 aa, Corynebacterium efficiens; identical to SEQ ID NO: 2774

SEQ ID NO: 9780 - DNA, 1545 bp, Corynebacterium efficiens; identical to SEQ ID NO: 2775
  CDS (1)..(1545)

SEQ ID NO: 9781 - protein, 514 aa, Corynebacterium efficiens; identical to SEQ ID NO: 2776

SEQ ID NO: 9782 - DNA, 1668 bp, Bifidobacterium longum; identical to SEQ ID NO: 2777
  CDS (1)..(1668)

SEQ ID NO: 9783 - protein, 555 aa, Bifidobacterium longum; identical to SEQ ID NO: 2778

SEQ ID NO: 9784 - DNA, 1284 bp, Rhodococcus opacus; identical to SEQ ID NO: 2779
  CDS (1)..(1284)

SEQ ID NO: 9785 - protein, 427 aa, Rhodococcus opacus; identical to SEQ ID NO: 2780

SEQ ID NO: 9786 - DNA, 2358 bp, Solanum tuberosum
  CDS (160)..(1905)
ctccacttggcggaagaaactaatgtttatttagcaaaggcgaaacaccctttcggagatctcaagagactaatcccaactccttttacgccataaccccccattcatatttcattcccctcacttctatcgaacccatcttctctgatttatcaagatatggtaaccctttattcttccccttccactaactgttctggggctttttcatcttactccaattcttctattggcttctacaattatcacaacaacttccctatttcatccagaaagtttggttctcacaagatttctttgcaaattaatgccattcgcatgcaagatggtgctgttgtggctcaacctagcaaaacccaagatgaaactcctttgaagaaattaaaagatggaattttgtcaaaggagcagaaacatacatttgattttgatagcaacaaagataaatcaactgtcagtattactgttgttggtgcttcaggagatcttgccaaaaaaaagatatttcctgcactttttgcactttattatgagggttgcttaccggagcatttcactatttttggttatgcccggagtaagatgactgatgatgaactcaggaacatggtcagcaagacacttacttgcaggattgataagagggaaaattgtggtgaaaagatggaacagtttctagaaaggtgtttctaccatagtggacaatatgattcccaagaaaactttgcagagcttgataaaaaactgaaagaacatgaggctggaaggttttccaatcgtctgttttacttgtccattccaccaaatatttttataaatgctgtacgatgtgcaagccttgcgtcatctgctcatggatggactagagtcattgtagagaaaccctttggtcgggattctgaatcctctgctgcattaacaggagcacttaagcagtacttgaaggaagatcaaattttcaggattgatcactatttagggaaggagcttgtggaaaacctttctgtccttcgtttctccaacttgatatttgaacccttatggtcaaggcagtatataaggaacgtgcaatttattttctctgaagattttggcactgaaggaaggggaggttattttgatcattatgggataattagagacattatgcaaaaccatttgcttcaaattcttgccctctttgccatggaaacacctgtcagtttggatgcagaagatatcaggaatgaaaaggtaaaagttctgcgttctatgagacctttacaactagatgatgttattgtcgggcagtacaaaagtcacacaaaagggggtgttaactatcctggttataccgacgacaagactgtacccaaggacagtctaaccccaacttttgctgcagctgctcttttcatagataatgcaagatgggatggtgtgcctttccttatgaaggctggaaaagctttacataccaggagtgcggaaataagagtacaattcaggcacgtgccaggaaacttatacaataagaactttggctcggatctagatcaggcaacaaacgagcttgttatccgtgttcaacctgacgaagctatatacctaaagatcaataacaaagttcccggtttaggaatgagattggatcgcagtaatcttaatctgctttactcagcaagatactcaaaggagatccctgatgcatatgagcggctacttcttgatgccatagaaggtgaacgtaggctttttatccgtagtgatgaactggatgctgcttggtctcttttcacaccagtgttgaaagaccttgagcataagaaaatagtaccggaaagctacccctatggaagtcgaggacctattggagcacattaccttgcagcacgatataaagtaagatggggtgatcttgcttagacaaagtaatttgctattgctatgagaaaccatatgtagccttacaagttcttctgcttagtatggtgcaaccaaatttgttgttgggattccagtatcaagactaacaaagcttgaagttgcttactgtcaaggcagatgacaatagagaacacaagttagtgaaacaaaagaagaggagaatctgggtttattttgttattcaaataaatcttttctattgcaccaatgcatatccagtggtagcatcttttttcatgtagcatttagtataccttgttagaatctaataattcgaaaagtcatcgtcttcttatcaagtattcatacatgcagctttctggttccgaactatattaaattttattgcatgaaatgtactatgaaatagaaggtttgttgccttcaatatttcttcaaaaaaaaaaaaaaaaaaaaaaaaaaaaaaaaaaa

SEQ ID NO: 9787 - protein, 581 aa, Solanum tuberosum
MVTLYSSPSTNCSGAFSSYSNSSIGFYNYHNNFPISSRKFGSHKISLQINAIRMQDGAVVAQPSKTQDETPLKKLKDGILSKEQKHTFDFDSNKDKSTVSITVVGASGDLAKKKIFPALFALYYEGCLPEHFTIFGYARSKMTDDELRNMVSKTLTCRIDKRENCGEKMEQFLERCFYHSGQYDSQENFAELDKKLKEHEAGRFSNRLFYLSIPPNIFINAVRCASLASSAHGWTRVIVEKPFGRDSESSAALTGALKQYLKEDQIFRIDHYLGKELVENLSVLRFSNLIFEPLWSRQYIRNVQFIFSEDFGTEGRGGYFDHYGIIRDIMQNHLLQILALFAMETPVSLDAEDIRNEKVKVLRSMRPLQLDDVIVGQYKSHTKGGVNYPGYTDDKTVPKDSLTPTFAAAALFIDNARWDGVPFLMKAGKALHTRSAEIRVQFRHVPGNLYNKNFGSDLDQATNELVIRVQPDEAIYLKINNKVPGLGMRLDRSNLNLLYSARYSKEIPDAYERLLLDAIEGERRLFIRSDELDAAWSLFTPVLKDLEHKKIVPESYPYGSRGPIGAHYLAARYKVRWGDLA

SEQ ID NO: 9788 - DNA, 2879 bp, Leishmania guyanensis; identical to SEQ ID NO: 2781
  CDS (205)..(1893): n means a or g or c or t/u, s means g or c

SEQ ID NO: 9789 - protein, 562 aa, Leishmania guyanensis; identical to SEQ ID NO: 2782

SEQ ID NO: 9790 - DNA, 2916 bp, Leishmania amazonensis; identical to SEQ ID NO: 2785
  CDS (207)..(1895): n means a or g or c or t/u, y means t/u or c

SEQ ID NO: 9791 - protein, 562 aa, Leishmania amazonensis; identical to SEQ ID NO: 2786
  Xaa in position 463 and 481 is unknown

SEQ ID NO: 9792 - DNA, 1440 bp, Chlorobium tepidum; identical to SEQ ID NO: 2787
  CDS (1)..(1440)

SEQ ID NO: 9793 - protein, 479 aa, Chlorobium tepidum; identical to SEQ ID NO: 2788

SEQ ID NO: 9794 - DNA, 2187 bp, Methylobacterium extorquens; identical to SEQ ID NO: 2789
  CDS (640)..(2187)

SEQ ID NO: 9795 - protein, 515 aa, Methylobacterium extorquens; identical to SEQ ID NO: 2790

SEQ ID NO: 9796 - DNA, 1476 bp, Bartonella henselae; identical to SEQ ID NO: 2791
  CDS (1)..(1476)

SEQ ID NO: 9797 - protein, 491 aa, Bartonella henselae; identical to SEQ ID NO: 2792

SEQ ID NO: 9798 - DNA, 2266 bp, Toxoplasma gondii; identical to SEQ ID NO: 2793
  CDS (169)..(1851)

SEQ ID NO: 9799 - protein, 560 aa, Toxoplasma gondii; identical to SEQ ID NO: 2794

SEQ ID NO: 9800 - DNA, 1455 bp, Corynebacterium glutamicum
  CDS (1)..(1455)
atggtgatcttcggtgtcactggcgacttggctcgaaagaagctgctccccgccatttatgatctagcaaaccgcggattgctgcccccaggattctcgttggtaggttacggccgccgcgaatggtccaaagaagactttgaaaaatacgtacgcgatgccgcaagtgctggtgctcgtacggaattccgtgaaaatgtttgggagcgcctcgccgagggtatggaatttgttcgcggcaactttgatgatgatgcagctttcgacaacctcgctgcaacactcaagcgcatcgacaaaacccgcggcaccgccggcaactgggcttactacctgtccattccaccagattccttcacagcggtctgccaccagctggagcgttccggcatggctgaatccaccgaagaagcatggcgccgcgtgatcatcgagaagcctttcggccacaacctcgaatccgcacacgagctcaaccagctggtcaacgcagtcttcccagaatcttctgtgttccgcatcgaccactatttgggcaaggaaacagttcaaaacatcctggctctgcgttttgctaaccagctgtttgagccactgtggaactccaactacgttgaccacgtccagatcaccatggctgaagatattggcttgggtggacgtgctggttactacgacggcatcggcgcagcccgcgacgtcatccagaaccacctgatccagctcttggctctggttgccatggaagaaccaatttctttcgtgccagcgcagctgcaggcagaaaagatcaaggtgctctctgcgacaaagccgtgctacccattggataaaacctccgctcgtggtcagtacgctgccggttggcagggctctgagttagtcaagggacttcgcgaagaagatggcttcaaccctgagtccaccactgagacttttgcggcttgtaccttagagatcacgtctcgtcgctgggctggtgtgccgttctacctgcgcaccggtaagcgtcttggtcgccgtgttactgagattgccgtggtgtttaaagacgcaccacaccagcctttcgacggcgacatgactgtatcccttggccaaaacgccatcgtgattcgcgtgcagcctgatgaaggtgtgctcatccgcttcggttccaaggttccaggttctgccatggaagtccgtgacgtcaacatggacttctcctactcagaatccttcactgaagaatcacctgaagcatacgagcgcctcattttggatgcgctgttagatgaatccagcctcttccctaccaacgaggaagtggaactgagctggaagattctggatccaattcttgaagcatgggatgccgatggagaaccagaggattacccagcgggtacgtggggtccaaagagcgctgatgaaatgctttcccgcaacggtcacacctggcgcaggccatga

SEQ ID NO: 9801 - protein, 484 aa, Corynebacterium glutamicum
MVIFGVTGDLARKKLLPAIYDLANRGLLPPGFSLVGYGRREWSKEDFEKYVRDAASAGARTEFRENVWERLAEGMEFVRGNFDDDAAFDNLAATLKRIDKTRGTAGNWAYYLSIPPDSFTAVCHQLERSGMAESTEEAWRRVIIEKPFGHNLESAHELNQLVNAVFPESSVFRIDHYLGKETVQNILALRFANQLFEPLWNSNYVDHVQITMAEDIGLGGRAGYYDGIGAARDVIQNHLIQLLALVAMEEPISFVPAQLQAEKIKVLSATKPCYPLDKTSARGQYAAGWQGSELVKGLREEDGFNPESTTETFAACTLEITSRRWAGVPFYLRTGKRLGRRVTEIAVVFKDAPHQPFDGDMTVSLGQNAIVIRVQPDEGVLIRFGSKVPGSAMEVRDVNMDFSYSESFTEESPEAYERLILDALLDESSLFPTNEEVELSWKILDPILEAWDADGEPEDYPAGTWGPKSADEMLSRNGHTWRRP

SEQ ID NO: 9802 - DNA, 1923 bp, Xanthomonas campestris; identical to SEQ ID NO: 2795
  CDS (1)..(1923)

SEQ ID NO: 9803 - protein, 640 aa, Xanthomonas campestris; identical to SEQ ID NO: 2796

SEQ ID NO: 9804 - DNA, 1431 bp, Xanthomonas campestris; identical to SEQ ID NO: 2797
  CDS (1)..(1431)

SEQ ID NO: 9805 - protein, 476 aa, Xanthomonas campestris; identical to SEQ ID NO: 2798

SEQ ID NO: 9806 - DNA, 1839 bp, Xanthomonas axonopodis; identical to SEQ ID NO: 2799
  CDS (1)..(1839)

SEQ ID NO: 9807 - protein, 612 aa, Xanthomonas axonopodis; identical to SEQ ID NO: 2800

SEQ ID NO: 9808 - DNA, 1431 bp, Xanthomonas axonopodis; identical to SEQ ID NO: 2801
  CDS (1)..(1431)

SEQ ID NO: 9809 - protein, 476 aa, Xanthomonas axonopodis; identical to SEQ ID NO: 2802

SEQ ID NO: 9810 - DNA, 1458 bp, Thermoanaerobacter tengcongensis; identical to SEQ ID NO: 2803
  CDS (1)..(1458)

SEQ ID NO: 9811 - protein, 485 aa, Thermoanaerobacter tengcongensis; identical to SEQ ID NO: 2804

SEQ ID NO: 9812 - DNA, 1446 bp, uncultured proteobacterium
  CDS (1)..(1446)
atgaccggagtcgacctaattatttttggcgcttccggagacctttcagcaagaaagctctttcccgcactgtttcaactcgaccgcgccgaattactgcccagcgacctgcgcatcacagcaattgctagagatcaggtcgacgtaaatacttttttggaaggcctaagacagcgaatgcatgcctacatgggctctgagtcgccttccgatgccgagtggcagcactactcacgacattttcaatatgtgggcgccgacttcgccaacgctgacagctattccagtatcagggcaactctagatgatacccgtatcagcttattttacttggctacaccacccagcatcttcgccctaatttgcaacaatctggccactaataattgcctcaccggcgactgccgaatcgtactcgaaaaacccattggcgaatgtctagcctcgtcaaaggaagtcaatgaaacgctggctcgctactttgacgaaggatctatttatcgcatagatcactacctgggaaaggagaccgttcagaacttactcgcgctgcgctttgcaaaccgatttattaatagtcagtgggatgccaactgtatcgaccatgttcaaatcaccgtcggcgaaatcgtcggtattgagggtcgctggtcttactatgaccgcgttggccagctccgcgacatggttcaaaaccaccttatgcagttactctgtctcgtcgctatggagccccccaatagcctagaagccgatagcatccgcgacgaaaaagtcaaaatcgtcaaggccttgagacgcatcgactctgatcaggtctctgagcacgtgattaaagggcaatacagccagggttggtcttcaggtgcggccgtgcctgggtaccttgaggagcccggttgtgagcgcccggacagcgataccgagacgtttatcgcgatcaaagctcatgtagacaactggcgctgggccggcgttccattttacctgcgaacaggaaaacgcgttcctgaaaaattaactgaaatcatcattcagtacaaagaccttccccacaacatttttagcggcggcaccagcgcgaacaagttaatcattcggttacagcccagggaaggcatcgagctaacaatggcatcgaaacgccagacgctgcgagaaaaactgtccttacagaaccataccttggatttagattttcgggaaaccaccggcatgaatcgaattcccgacgcctacgaacgattatttcttgatgcaattaatggcgatcagtcgctgtttgtaggtcgagaggagatcgaagaaagctggcgctggtgtgatgaactgattgacgcctgcaaccaaaagaacatagagaccaagccctatcacgctggatcttggggcccacctaaagccgagcttttaattgaaaaggatgggcgtagctggcatgtctga

SEQ ID NO: 9813 - protein, 481 aa, uncultured proteobacterium; identical to SEQ ID NO: 2668

SEQ ID NO: 9814 - DNA, 1762 bp, Oryza sativa; identical to SEQ ID NO: 2805
  CDS (41)..(1558)

SEQ ID NO: 9815 - protein, 505 aa, Oryza sativa; identical to SEQ ID NO: 2806

SEQ ID NO: 9816 - DNA, 1305 bp, Encephalitozoon cuniculi; identical to SEQ ID NO: 2807
  CDS (1)..(1305)

SEQ ID NO: 9817 - protein, 434 aa, Encephalitozoon cuniculi; identical to SEQ ID NO: 2808

SEQ ID NO: 9818 - DNA, 2125 bp, Drosophila melanogaster; identical to SEQ ID NO: 2809
  CDS (158)..(1738)

SEQ ID NO: 9819 - protein, 526 aa, Drosophila melanogaster; identical to SEQ ID NO: 2810

SEQ ID NO: 9820 - DNA, 1470 bp, Ralstonia solanacearum; identical to SEQ ID NO: 2811
  CDS (1)..(1470)

SEQ ID NO: 9821 - protein, 489 aa, Ralstonia solanacearum; identical to SEQ ID NO: 2812

SEQ ID NO: 9822 - DNA, 1521 bp, Enterococcus mundtii; identical to SEQ ID NO: 2813
  CDS (1)..(1521)

SEQ ID NO: 9823 - protein, 506 aa, Enterococcus mundtii; identical to SEQ ID NO: 2814

SEQ ID NO: 9824 - DNA, 2630 bp, Homo sapiens
  CDS (474)..(2021)
agggacagcccagaggaggcgtggccacgctgccggcggaagtggagcctaccgcgagcgcgcgaggccgccggggcaggcggggaaaccggacataggggcggggccgggccggcgatggggatgcgggagcactacgcggagctgcacccgtgcccgccggaattggggatgcagagcagcggcagcgggtatggcaggcagccggcgggccggcctccagcgcaggtgcccgagaggcaggggctggcctgggatgcgcgcgcacctgccctcgccccgccccgcccgcacgaggggtggtggccgaggccccgccccgcacgcctcgcctgaggcgggtccgctcagcccaggcgcccgcccccgcccccgccgattaaatgggccggcggggctcagcccccggaaacggtcgtacacttcggggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgcacattcctggccccgggctctggccaccctggcccgcccctcgctgctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacaagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagcc

SEQ ID NO: 9825 - protein, 515 aa, Homo sapiens [sequence omitted]

SEQ ID NO: 9826 - DNA, 1491 bp, Pasteurella multocida; identical to SEQ ID NO: 2823
  CDS (1)..(1491)

SEQ ID NO: 9827 - protein, 496 aa, Pasteurella multocida; identical to SEQ ID NO: 2824

SEQ ID NO: 9828 - DNA, 1470 bp, Pseudomonas putida; identical to SEQ ID NO: 2825
  CDS (1)..(1470)

SEQ ID NO: 9829 - protein, 489 aa, Pseudomonas putida; identical to SEQ ID NO: 2826

SEQ ID NO: 9830 - DNA, 1566 bp, Trypanosoma brucei; identical to SEQ ID NO: 2827
  CDS (1)..(1566)

SEQ ID NO: 9831 - protein, 521 aa, Trypanosoma brucei; identical to SEQ ID NO: 2828

SEQ ID NO: 9832 - DNA, 1904 bp, Triticum aestivum; identical to SEQ ID NO: 2829
  CDS (153)..(1682)

SEQ ID NO: 9833 - protein, 509 aa, Triticum aestivum; identical to SEQ ID NO: 2830

SEQ ID NO: 9834 - DNA, 1924 bp, Triticum aestivum
  CDS (161)..(1702)
cgattgggcaaggaaggggccacccccctccccattcctacccacccagcatctcggcagtaactctcctccctcccaccggcgcgcccgctcgccgcgcgcgcgaatctcggtcgcaactggtgtactgttgaaggaaggaaaaatcatcctatttgtcatggcgggaactgactcctcggcgtcatcgagacaaagcagtttcaactcattagcaaaggacctagaacttcctttggagcaagggtgcctcaccatcgttgtacttggggcttctggagatcttgccaagaagaaaacgttcccggcactctaccacctttttgagcaggggttcttacaatctggtgaagtgcatatagtggggtatgcgagaacaaatctttctgatgatgggttgagagggcgcatccgtgcataccttaaaggagcctcagaggaacatgtttcagaattcttgcaattgataaaatatgtcagtggttcctatgacagtggagaaggttttgaaaaactgaacaaggaaatatcagattatgagatgtcaaacaactcaggaagctcccgtaggctcttttatttggcattgcctccatctgtctacccttcagtgtgcaaaatgatccgaacatattgcatgagtccaacttctcgcgctggatggactagagtaattgttgagaagccctttggaagggacctggactctgcagaagaattgagttcccaacttggggagctattcgaggaagatcaactctacaggattgaccactacttgggaaaagagttggtccaaaacttgcttgtgcttcgttttgcgaaccgtttgttcttaccactttggaaccgtgacaatgttgataatatacagattgtattcagggaggacttcggaactgatggacgtggaggatattttgatcaatatggaatcatccgtgatatcattcagaaccatttgttgcaggttttctgtttggttgcaatggaaaagcctgtatctcttaagcctgagcacatcagagatgagaaagtcaaggttctgcaatccgtgaacccgataaaggacgaagaggtagtccttggacaatatcagggctacaaggatgaccctacagtgccagatgactctaataccccaacgtttgcatctattgtacttagggtacacaatgaaagatgggaaggtgttcctttcattcttaaagctggtaaagcattaaactcaagaaaagcagaaattcgtgtgcagttcaaggatgttcccggtgacatttttaaatgtaagaagcagggaagaaatgagtttgtcatacgcctccagccatcagaagccatgtacatgaaactaactgaattcgtgcaggtgaagaaacctggattggaaatggctactgaacagagtgaacttgatctgtcatatgggatgcgttaccaagatgtcaaaattccagaggcatacgagcgcctcattttggatacaataagaggggaccagcaacactttgtgcgccgagatgagctgaaggctgcctggcagatcttcactcccttgttgcacgacatcgacgctggcaagctgaaggctgtttcatacaagcctggcagccgaggccccaaggaagctgatgaactgagtgagaaggttgggtacatgcagacccacggttacatctggataccacccacccttgcatagagtgcctccctcgatccttgtaggtttgtttagctaggaagagtgaaagtatcacggataaaaatcttacgaattttagctgtactgcggtttacctggcgttgtaataacggatctgttcgacggagtatacctcaccacggtgtgaaataaaaaatggagtgtttcaaaaaaaaaaaaaaaaaagggtcgcgcgatcgatgccgaatcactagtgaattc

SEQ ID NO: 9835 - protein, 513 aa, Triticum aestivum
MAGTDSSASSRQSSFNSLAKDLELPLEQGCLTIVVLGASGDLAKKKTFPALYHLFEQGFLQSGEVHIVGYARTNLSDDGLRGRIRAYLKGASEEHVSEFLQLIKYVSGSYDSGEGFEKLNKEISDYEMSNNSGSSRRLFYLALPPSVYPSVCKMIRTYCMSPTSRAGWTRVIVEKPFGRDLDSAEELSSQLGELFEEDQLYRIDHYLGKELVQNLLVLRFANRLFLPLWNRDNVDNIQIVFREDFGTDGRGGYFDQYGIIRDIIQNHLLQVFCLVAMEKPVSLKPEHIRDEKVKVLQSVNPIKDEEVVLGQYQGYKDDPTVPDDSNTPTFASIVLRVHNERWEGVPFILKAGKALNSRKAEIRVQFKDVPGDIFKCKKQGRNEFVIRLQPSEAMYMKLTEFVQVKKPGLEMATEQSELDLSYGMRYQDVKIPEAYERLILDTIRGDQQHFVRRDELKAAWQIFTPLLHDIDAGKLKAVSYKPGSRGPKEADELSEKVGYMQTHGYIWIPPTLA

SEQ ID NO: 9836 - DNA, 2098 bp, Solanum tuberosum; identical to SEQ ID NO: 2831
  CDS (27)..(1775)

SEQ ID NO: 9837 - protein, 582 aa, Solanum tuberosum; identical to SEQ ID NO: 2832

SEQ ID NO: 9838 - DNA, 1924 bp, Dunaliella bioculata; identical to SEQ ID NO: 2833
  CDS (68)..(1840)

SEQ ID NO: 9839 - protein, 590 aa, Dunaliella bioculata; identical to SEQ ID NO: 2834

SEQ ID NO: 9840 - DNA, 1976 bp, Cyanidium caldarium; identical to SEQ ID NO: 2835
  CDS (46)..(1848)

SEQ ID NO: 9841 - protein, 600 aa, Cyanidium caldarium; identical to SEQ ID NO: 2836

SEQ ID NO: 9842 - DNA, 1777 bp, Mesembryanthemum crystallinum; identical to SEQ ID NO: 2839
  CDS (39)..(1589)

SEQ ID NO: 9843 - protein, 516 aa, Mesembryanthemum crystallinum; identical to SEQ ID NO: 2840

SEQ ID NO: 9844 - DNA, 1587 bp, Mus musculus
  CDS (31)..(1572)
atgcagtggcaactaaactaggaaaacatcatggcagagcaggtgaccctaagccggacccaagtgtgtgggatcctgagggaagagttgtaccaaaatgatgccttccaccaagctgatacacacatatttatcatcatgggtgcatcgggtgacctggccaagaagaagatctatcccaccatctggtggctgttccgggatggtcttctacccaaagaaaccttcattgtgggctatgcccgctcacaactcacagtggatgacatccaaaagcagagtgagcccttctttaaggccactccagaagaaagacccaagctggaggagttcttcacgcgtaactcctatgtagttggccagtatgatgatccagcctcctataagcacctcaacagctacattaatgccctgcaccaggggatgcaggccaaccatctattctacctggccttgccccccacagtctatgaagcagtcaccaagaacattcaagagacctgcatgagtcagacaggctttaaccgcatcatagtggagaaacccttcgggagagacctgcagagctccaatcaattgtctaaccacatctcctctcttttccgtgaagaccagatctaccgcattgaccactacctggacaaagagatggtccagaacctcatggtgctgaggtttgctaacaggatctttggccctatctggaatggagacaacattgtttgtgtgatcctcacatttaaagagccctttggtactgagggtcgtgggggctattttgatgaatttgggatcatcagggatgttatgcagagccacctcctgcagatgttgtgtctggtggccatggaaaagcctgctaccacagattcagatgatgtccgtaatgagaaggtcaaagtgttgaaatgtatctcagaggtggaaactgacaatgtgatccttggccagtatgtggggaaccccaatggagaaggagaagctgccaatggatacttagatgaccccacagtaccccgtgggtccacaactgccacctttgctgcagctgtcctctatgtgaagaatgaacggtgggatggggtacccttcatactgcgctgtggcaaagccctgaatgaacgcaaagctgaagtgagactgcaattccgagatataccaggcgacatcttccaccagaagtgcaagcgtaatgagctggtcatccgtatgcagcccaatgaggcagtatacaccacgatgatgaccaagaagcctggcatgttctttaaccctgaggagtcggagctggacctaacttatggcaacaaatacaagaatgtgaagctccctggtgcctatgaacgcctcatcctggatgtcttctgtgggtgccagatgcactttgtccgtactgatgaactcagggaaggctggcgtatcttcacaccactgctgcacaagattgaacgagaaaagccccagcccttcccctatgtatatggcagccgtggccccacagaggcagatgagctgatgaggagagtgggcttccagtacaagggtacctacaagggtactcacaagcactgagccctggaacttctg

SEQ ID NO: 9845 - protein, 513 aa, Mus musculus; identical to SEQ ID NO: 2842

SEQ ID NO: 9846 - DNA, 1485 bp, Actinobacillus actinomycetemcomitans; identical to SEQ ID NO: 2843
  CDS (1)..(1485)

SEQ ID NO: 9847 - protein, 494 aa, Actinobacillus actinomycetemcomitans; identical to SEQ ID NO: 2844

SEQ ID NO: 9848 - DNA, 1473 bp, Buchnera aphidicola; identical to SEQ ID NO: 2845
  CDS (1)..(1473)

SEQ ID NO: 9849 - protein, 490 aa, Buchnera aphidicola; identical to SEQ ID NO: 2846

SEQ ID NO: 9850 - DNA, 1473 bp, Buchnera aphidicola; identical to SEQ ID NO: 2847
  CDS (1)..(1473)

SEQ ID NO: 9851 - protein, 490 aa, Buchnera aphidicola; identical to SEQ ID NO: 2848

SEQ ID NO: 9852 - DNA, 2049 bp, Ceratitis capitata; identical to SEQ ID NO: 2849
  CDS (60)..(1640)

SEQ ID NO: 9853 - protein, 526 aa, Ceratitis capitata; identical to SEQ ID NO: 2850

SEQ ID NO: 9854 - DNA, 1524 bp, Chlamydia muridarum; identical to SEQ ID NO: 2851
  CDS (1)..(1524)

SEQ ID NO: 9855 - protein, 507 aa, Chlamydia muridarum; identical to SEQ ID NO: 2852

SEQ ID NO: 9856 - DNA, 1536 bp, Emericella nidulans; identical to SEQ ID NO: 2855
  CDS (1)..(1536)

SEQ ID NO: 9857 - protein, 511 aa, Emericella nidulans; identical to SEQ ID NO: 2856

SEQ ID NO: 9858 - DNA, 1962 bp, Macropus robustus
  CDS (1)..(1548)
atggcagagcaggtggcactgagccggacccaagtgtgtggaattctccgggaagaattgtaccagggtgatgccttccaccagtcagacacacacatattcatcatcatgggagcctcgggtgacttagcaaagaagaaaatctaccctacaatctggtggctgttccgtgatgggcttctccccgaagacaccttcattgtgggctatgctcgctcaaacctcactgtggatgacatccgaaagcaaagcgagccctattttaaggccaccccggaagagaacctgaagctggaggagttcttctctcgaaattcctacgtggcaggccaatacgatgagccagcttcctttcagcgtctcaatgcccacatgaactccctgcatcatgggtcacaggccaaccgcctcttctacctggccttgccacccaccgtctatgaagctgtcactaagaacatcaaagagacttgcatgagccagataggttggaaccgggtcattgtggagaagccttttggaaaagatcttcagagctctgacaaactgtcaaaccacatttcctcactcttccatgaggaccagatctaccggatcgatcactacctgggcaaggaaatggtacagaacctcatggtgctaagatttggtaacaggatctttggaccgatctggaaccgagacaacattgcctgtgtcatcttcaccttcaaggagccctttggcactcttggccgagggggctattttgatgagtttgggatcattcgagacgtgatgcagaaccacctcttgcagatgctttgcctagtggccatggaaaaacctgcctccaccaactctgatgatgtccgggatgaaaaggtgaaggtcctgaagtgtatctcagaggtgagagcaactgatgtggtcttgggccagtatgtggggaacccagatggagaaggggaagccaccaaaggctatttggatgatcccacagtgccccggggctccaccactgccacctttgctgctgtggtcctctatgtggaaaatgaaagatgggacggagtcccctttatcctccgctgtggaaaggccctgaatgaacgcaaagcagaagtgaggttacagttccgggatgtggctggtgatatcttccagcgccagtgtaagcggaatgagctggtgatccgcgtgcagcccaacgaggctgtctacaccaagatgatgaccaagaagccagggatgttcttcaaccccgaagagtcagagctggacctgacctatggcaacagatacaaagatgtgaagctgcccgatgcttatgagcgccttatcctggatgtcttctgtggaagccagatgcactttgtgcgcagtgatgagcttcgggaagcctggaggatctttacgcccctgctgcaccacattgagaaggagaagacccagcccattgcctacgtctatggcagccgaggccctcctgaagcagacgaactgatgaagagagtgggcttccagtatgagggcacctacaagtgggtaaacccccacaagctctgaggcagcctggcagcccactagcttcctcccccttgtttcccatccccagcctccatgctcatccttttagccctttggcctcacttagggtctgtctctctgcccatcccctgttcatgttctactcaggcagaaactcttgggaccacaagaccaggagcccgtccctgggggagatggagggccccattgagagattccctgggccctttccactcccagaaggcccggggacccggccaccaacttctcagccctgtttacagctgcattaggtctgccattcagcagctaccagatacttcctcctgctttgagctcccagagccagctacattccaatagcagtcgctggaggtgtcctctgtttcccttcaggacagcagctttataaatacagagaattaccagtca

SEQ ID NO: 9859 - protein, 515 aa, Macropus robustus; identical to SEQ ID NO: 2860

SEQ ID NO: 9860 - DNA, 1530 bp, Nostoc punctiforme; identical to SEQ ID NO: 2861
  CDS (1)..(1530)

SEQ ID NO: 9861 - protein, 509 aa, Nostoc punctiforme; identical to SEQ ID NO: 2862

SEQ ID NO: 9862 - DNA, 1476 bp, Rhizobium meliloti; identical to SEQ ID NO: 2863
  CDS (1)..(1476)

SEQ ID NO: 9863 - protein, 491 aa, Rhizobium meliloti; identical to SEQ ID NO: 2864

SEQ ID NO: 9864 - DNA, 1731 bp, Arabidopsis thaliana
  CDS (1)..(1731)
atggcgacacattctatgatcattccttctccttcttcttcttcctcgtctctcgctactgctgcgtctccgtttaaagagactctaccactctttagtagatctctcacattcccgagaaaatccttgttttctcaggttcgcttgagattcttcgccgagaaacattctcagcttgatacttcaaatgggtgtgccactaatttcgcttctttacaagattctggagatcaacttacagaggaacatgttacaaaaggagagtctactcttagtattacagttgttggagcgtcaggggacttagccaagaagaagatatttcctgcattgtttgctctcttttatgagggttgtcttcctcaggacttttctgtttttggttatgctcggactaaactcactcatgaagagcttcgtgacatgattagtagtactttaacttgccggattgatcagagggaaaaatgtggggataagatggagcagttcttgaaaagatgcttttaccattcgggtcagtataactcggaagaggattttgcggaactaaacaagaagctcaaagagaaagaggcaggaaagatatcaaacaggctgtactatttgtcgatacccccaaacatattcgttgatgtggttaggtgtgcaagtcttagagcctcctcagagaatggctggacaagggtcattgtggaaaagccatttggtcgtgactctgaatcatccggagagttaactagatgtctgaaacagtatcttacagaggagcaaatcttcaggattgatcactatttgggaaaggagcttgttgagaacctttcagtgctccgattctcaaatcttgttttcgagcctctgtggtcaagaaattacatacgcaacgttcagctgattttttctgaggatttcggaacagaagggcgtggaggttactttgatcaatatggaatcatacgagacatcatgcaaaaccatctcttgcaaatacttgcactttttgcaatggagacgccagtgagcttagatgctgaggacataagaagtgaaaaggtgaaagttttgagatcaatgaaaccgttgcggcttgaagatgtggttgttggtcaatacaaaggccataacaagggaggaaaaacttatccaggttatacagacgatccaacggttccaaatcacagtctcactcctacatttgctgcagcagccatgttcatcaacaatgcgagatgggacggtgttccttttcttatgaaagctggaaaagctctccataccagaggagcagagatcagagttcagttcagacatgtcccaggaaacttgtacaagaaaagttttgctactaatttagacaatgcaacaaatgaactagtgattagagttcagcctgatgaagggatatacctgaggatcaacaacaaagttcctggtcttggaatgagactagatcgcagcgaccttaaccttctatatcgatccaggtatccaagagagataccagatgcatatgaaagactgcttctcgatgcaatcgaaggagagaggaggttgtttatcagaagtgatgagctagatgcagcatgggatctattcacaccggctttgaaggaactagaggagaagaaaatcattcctgagctctatccatatggaagcagaggtcctgttggtgcacattaccttgcatctaagtacaatgtgagatggggagatcttggagaagcttaa

SEQ ID NO: 9865 - protein, 576 aa, Arabidopsis thaliana; identical to SEQ ID NO: 2868

SEQ ID NO: 9866 - DNA, 2112 bp, Arabidopsis thaliana; identical to SEQ ID NO: 2869
  CDS (142)..(1932)

SEQ ID NO: 9867 - protein, 596 aa, Arabidopsis thaliana; identical to SEQ ID NO: 2870

SEQ ID NO: 9868 - DNA, 1909 bp, Arabidopsis thaliana
  CDS (1)..(1878)
atgtctctctccagttgcttgcttcccttttctcaatcagcgacggctccgtcttcctccgtctgctcttgccatctcgccgcctctttttctaattttccggtttcgtcaagagactatagtttctccagaagtggaagccttgttctcaacggaggaggctcgaatctctgccggagattctgtggtttgaaactgtggatacttaagagcttgaatcgtagacaaggcaacaacagaaaacatcagcctgtaaacgagcttacaacacactcaaagcacactttcctcagcgatgatgaacgaggttttgctgaagaaactagagctgaagatttacgaccagaagagaatattctgggaacggatttgaatgatgggtttcacaatgttggagacttaccacctgtgtcaaaacaactctcggatgatctttcagatgttcgaagaagggcctcactttgcattgctgttgtaggagccactggtgagctagcaagagggaagattttcccggcattgtttgcgttgtattatagcggctaccttcctgaggatgttgctatatttggggtttcaagaaagaatctgacagatgaagacctcagatccatcattgcatcaacgctgacttgccgtgttgatcatcaggagaattgtgggggcaagatggatgcatttcagagtagaacatactatatcaatggaggttataataacagggatgggatgtcccgacttgccgagagaatgaaacagattgagggagaatcagaagcaaatagaatcttttacctctcagtacctcaagaagctctggtggatgtggcatgcaccattggagataacgctcaggcaccacgaggctggactcgaataatagttgagaaaccttttggttttaactcacattcgtctcatcagttaacaaagtcacttctctctaagtttgaagagaagcaaatctacaggatagatcacatgttaggaagaaacctcattgaaaatctgacagtgttaaggttttcaaatctagtttttgaaccactatggaacagaacatacatacgcaatatacaggttattatatcagaatcaattgcgcaaacagaaaagttttctgatggatatggaataatacgggacatagtgcacagccatatacttcagacaatcgcattacttgccatggaacctccgataagtctcgatggtgaagatatccgaaatgaaaaggtgaaggttttaagatcaattcgcaagatagacccgcgtgatgtcatccttggccagtataaatccagttcccgagacaagaacggtgtgatcttgaacggtgtagaccctacatattgtgcagcagccttgtatattgataatgcacgttgggatggtgtacctttccttgtaagagttggcactggcctcattaaacacagagtggagattcatgtgcaattccggcatgttcctggaaacctataccgagaaaatattggaataaacatagatttggggacaaatgagcttattctacgtgacgaacctgatgaggccatcctggtgaaaatcaacaacaaggttcctggtttaggtcttcagctagacgcttctgaacttaacttgctctataaagacaggtataaaaccgaagtaccagactcatatgaacacctaattcatgatgtaattgacggagacaatcatctgttcatgagaagcgatgaggttgcagcagcatggaacattcttagtccggttctagaagagatagacaagcatcacacagctccggagttgtatgaatttggtggacgaggaccagttgcggcatactatctttgggccaagcacggtgtcccatgggcagatgactgaagaagaaacatagatgcagcaacaaacaaat

SEQ ID NO: 9869 - protein, 625 aa, Arabidopsis thaliana; identical to SEQ ID NO: 2872

SEQ ID NO: 9870 - DNA, 1548 bp, Arabidopsis thaliana
  CDS (1)..(1548)
atgggatctggtcaatggcacgttgagaaaaggtctacgtttaggaatgattcgtttgtgagagaatatggtatagttccagaaactggttgtctttcaatcatagttcttggtgcttctggtgatcttgctaagaagaagacttttcctgctctttttaacttataccgtcagggatttctcaatccagatgaagttcatattttcgggtatgcgaggactaagatttctgatgaagagctgagagataggattcgtggatatcttgttgatgagaagaatgctgagcaagctgaagctttgtcaaagtttctgcagctgattaagtatgtgagtggcccttatgatgctgaggaggggttccagagattagacaaggcaatttcagagcacgaaatctccaaaaatagtactgaagggtcttccagaagactgttttatcttgcacttccaccgtctgtttatccttctgtatgcaagatgatcaagacgtgctgcatgaacaaatctgatcttggtggatggacacggattgttgtggagaagccatttggcaaggaccttgaatctgcagagcaactgagttctcagattggagagttatttgatgaatcacagatctatcgtatagaccattatcttgggaaggaattagttcaaaacatgttggtcctccggtttgcaaatcgctttttcttgccactttggaaccgtgacaatatcgagaacgtgcagattgttttcagggaagattttggaactgaagggcgtggcggatattttgacgaatatggaataatccgtgatattattcaaaaccatctgctacaggttctttgccttgttgccatggagaaaccaatatctcttaaacctgagcatatccgggatgagaaagtgaaggtgcttcaatctgtggttccgataagcgatgacgaggtagttcttggacaatacgaaggatatagggatgatgatactgttccaaacgactcaaacactccaacatttgccacaacaatccttcgcatacacaacgaaagatgggaaggtgttccatttatattaaaggccggaaaagcgttgaattcaaggaaggcagaaattcgcattcaattcaaggatgtcccaggcgacatattcagatgtcaaaagcaaggaaggaacgagtttgtgatacgcttgcaaccttcagaggcaatgtacatgaaactaactgttaagcaaccaggtctagatatgaatactgtgcaaagtgaactagacttgtcgtatgggcaacggtatcaaggtgtcgctatccctgaggcatacgagcgcttaattcttgacacaatcaaaggcgatcaacaacatttcgttcgtagagacgaattaaaggttgcgtgggagatcttcacgccgctactccacaggatcgacaaaggagaagtaaagtcaatcccatacaaaccaggaagccgaggaccgaaagaagctgatcagctactagagaaagctggttatcttcagactcacggctatatctggatccctcctacactataa

SEQ ID NO: 9871 - protein, 515 aa, Arabidopsis thaliana [sequence omitted]

SEQ ID NO: 9872 - DNA, 1719 bp, Drosophila melanogaster
  CDS (1)..(1719)
atgcaatatctatcactaatcttttttaaattacaactatttattcttggccaaaatttgacgttaccttgctttcttttattctctcaaaattatacttcaattaaattacccgaaatgatttccatggacccccacaatgaggaggcgtattccatcgtggtcttcggagcctcaggcggattggccaaaaagaaggtgtttccggcgctttgggctctcttccgggagaatcggctgccccagggcaccaaaatatttactttcacccggtccccgctgcagacgaagacgtaccggttgcagattcttccctatatggagctggacaagcatcgggaccccaagaagtacaacctcttttggacgaccgtgcactgtgtgcagggcgagtacgacaagccggagaactacgtggcactcacggaggcgatggtacaccaggagacaaagcacaatcaggtgcgcgcgaatcgaatcttctacctggcgctgccaccgatcgttttcgatcaggtgaccctcaatgtcagtcgaaaatgcagctcgaccacgggatggaaccgcataatagtggagaagcccttcgcgcgggacgacatctcctacaaggcctttcaaacctcgctgtgcaactgcttccgggagtcgcagatttacctgatggaccacctcctcagccggcaggtgatgcagaacttctttgcgctgcgctactcaaaccacttgtgggccgagaccctgaaccaccgccacgtggcggcggtgatgatatccataaagtgtgagctgccggtgtcggtgaatcgggcagactactttaatcagtttggcattattcgcgacctgatgaccaaccacatgatccagatgctggccatgctggctatggatcagccgtacgccaacactgctgacgacctgcgtgccgaacggctgaaggttcttcgccaggtgctaactcccaacataggcgacgtcgtcttggctcaataccgcaacaaccggcgggagactgaccccgcgaagtgcggctacacggagcacacctacatcccgaaggactcctttacgcccacattcgctctggtggtgctgcacatcaacaaccgccgttggaccggggtacccttcattctcagagcgggaaaagccttgaacgacaccaagtcggaggtgcgtatccagtacaagccggtggactgcgacaccttccacagcgacagtactgacattcgtaacgagctagtcctgagatccttccccacggaagaggtctttatgcgcatgcgcctcaagcggcagggcgaggatatctgccttcgggagagcgagatcaacctgcgagtggatgatcggggaccgaagggactccaaggactgcccggctacctgctcaacgtgtttcaaggcgaccagacgctcttcatgcgctccgatgagcagtgcgagatttggcgcatattctcccccgttctcgccaccatcgattcggatcgtccccgcccgttgcactatgactttggatcacggggtcctttgctggcctatcgcaaggccgagcgcgctggcttcgtattcttcgccacggacgagtggcatcagagcgaagagacgttagaatacacggtcaagaatagcaagcagctaatcggaccccataccgccctcaagccagtaagagatcctcggtccaagaggtcgaattccaatccttag

SEQ ID NO: 9873 - protein, 572 aa, Drosophila melanogaster; identical to SEQ ID NO: 2838

SEQ ID NO: 9874 - DNA, 1503 bp, Xenopus laevis; identical to SEQ ID NO: 2877
  CDS (1)..(1503)

SEQ ID NO: 9875 - protein, 500 aa, Xenopus laevis; identical to SEQ ID NO: 2878

SEQ ID NO: 9876 - DNA, 1545 bp, Mycobacterium paratuberculosis; identical to SEQ ID NO: 2679
  CDS (1)..(1545)

SEQ ID NO: 9877 - protein, 514 aa, Mycobacterium paratuberculosis; identical to SEQ ID NO: 2680

SEQ ID NO: 9878 - DNA, 1410 bp, Mycobacterium paratuberculosis; identical to SEQ ID NO: 2675
  CDS (1)..(1410)

SEQ ID NO: 9879 - protein, 469 aa, Mycobacterium paratuberculosis; identical to SEQ ID NO: 2676

SEQ ID NO: 9880 - DNA, 1874 bp, Oryza sativa
  CDS (9)..(1742)
ggctccaaatggccggcaccggcttacgattccggcagggcgccatcttcttctcaggagctcatgctgctgctcatccaagaacaaggactcctcaccaccattgctcacctcagaggacgcacgatgcgagaggaaggtgccgcctcacggctaagtccgcaaatggacgcccacagatcagtgcctccttcagagatgtggcgatagatggggcacagtctgaagatggggcgccagagcagggaggatccaccgtcagcatcaccgtcgtcggcgcctccggcgatctcgccaagaagaagatctttcccgcgcttttcgccctgtactacgaggactgcctcccggagcattttacagtttttggttatgctcgtagcaagatgagcgatgaagagctcaggaacatgattagcttgactctgacatgccggattgatcagagggagaactgcagtgacaagatggaacagtttctgaagagatgcttttatcaatctgggcagtacaattcagaggaagggttttctgaactggacagaaagctaaaagaaaaggaggctggcaaggtaccaaacaggctcttttacctgtcgattccaccgaacatatttgtcgatgtggtgagatctgctagtcgcacagcatcatctcaagacggatggacaaggttcatagtggagaagccattcggccgcgattccgagtcgtcaggggagctcactcgaaacttgaagaagtacttggccgaggagcagatattcaggattgaccattatttggggaaggagctggttgagaacctctcggtgctccgtttctccaatctcgtcttcgagccactgtggtcgaggaactacatcaggaatgtgcagctcatattttctgaagatttcggcacggagggtcgaggcggccacttcgacaactacgggatcatcagggacataatgcagaaccacctgctgcagatcctggccctgttcgccatggagactccggtcagcctcgacgccgaggacatccgcaacgagaaggtgaaagtgctgaggtcgatgaggcagctgaggctggaggacgtggtggtgggtcagtacaaggggcacagcaagggcgggaagacgtacccggcgtacgtggacgacccgacggtgccgagcggcagcatcacgccgacgttcgccgccgccgccctcttcatcgacaacgcccgctgggacggcgtccccttcctcatgaaggccggcaaggccctgcacacgcgacgggcggagatcagggtgcagttccggcgggtgccggggaacctgtacgggcggcggagccggagcgtgggcggcggcgggacgacagcgacgagggagctggagaaggcgacgaacgagctggtgctgcgggtgcagcccgacgaggcgatctacctcaagatcaacagcaaggtgcccgggctggggatgaggctggacagcagcgacctcaacctgctctactccgagcgctaccccgccgagatccccgacgcctacgagcgcctgctgctcgacgccatcgagggcgagcgccgcctcttcatccgcagcgacgagctcgacgccgcctgggccatcttcacccccgtcctcgccgacctcgaggccaacaaggtggcacccgagctctacccgtacggcagccggggacccgtcggagcgcactacctcgccgccaaccacaacgtccgctggggtgacattagctagctcagaaaatgaaaagatcgatcggagtcgctgttaccgtgcttgctataatcttcatttaccatttgcattgatgaattctttattggactgctcagggacgaaattaataaaacaaagctctagtcattc

SEQ ID NO: 9881 - protein, 577 aa, Oryza sativa
MAGTGLRFRQGAIFFSGAHAAAHPRTRTPHHHCSPQRTHDARGRCRLTAKSANGRPQISASFRDVAIDGAQSEDGAPEQGGSTVSITVVGASGDLAKKKIFPALFALYYEDCLPEHFTVFGYARSKMSDEELRNMISLTLTCRIDQRENCSDKMEQFLKRCFYQSGQYNSEEGFSELDRKLKEKEAGKVPNRLFYLSIPPNIFVDVVRSASRTASSQDGWTRFIVEKPFGRDSESSGELTRNLKKYLAEEQIFRIDHYLGKELVENLSVLRFSNLVFEPLWSRNYIRNVQLIFSEDFGTEGRGGHFDNYGIIRDIMQNHLLQILALFAMETPVSLDAEDIRNEKVKVLRSMRQLRLEDVVVGQYKGHSKGGKTYPAYVDDPTVPSGSITPTFAAAALFIDNARWDGVPFLMKAGKALHTRRAEIRVQFRRVPGNLYGRRSRSVGGGGTTATRELEKATNELVLRVQPDEAIYLKINSKVPGLGMRLDSSDLNLLYSERYPAEIPDAYERLLLDAIEGERRLFIRSDELDAAWAIFTPVLADLEANKVAPELYPYGSRGPVGAHYLAANHNVRWGDIS

SEQ ID NO: 9882 - DNA, 1449 bp, Lactobacillus johnsonii; identical to SEQ ID NO: 2681
  CDS (1)..(1449)

SEQ ID NO: 9883 - protein, 482 aa, Lactobacillus johnsonii; identical to SEQ ID NO: 2682

SEQ ID NO: 9884 - DNA, 1485 bp, Bacillus cereus; identical to SEQ ID NO: 2673
  CDS (1)..(1485)

SEQ ID NO: 9885 - protein, 494 aa, Bacillus cereus; identical to SEQ ID NO: 2674

SEQ ID NO: 9886 - DNA, 1539 bp, Ashbya gossypii; identical to SEQ ID NO: 2683
  CDS (1)..(1539)

SEQ ID NO: 9887 - protein, 512 aa, Ashbya gossypii; identical to SEQ ID NO: 2684

SEQ ID NO: 9888 - DNA, 2074 bp, Oryza sativa
  CDS (138)..(1904)
gcggctagactttcgtcgatatccccgataaaatccacccgtctcccctcctccccactcgccttcgcctccatcctcctcctcctcctgccggcttgcatccgctcttccttcctccaggaggaaggcatacaggcatggcgctctcctgcatgaggtgctccccggccgccggcgccgtacgacgaggattggcatcggcggctccgccggcggcgctctccttcgccagatgcggcctccgtagagcggccgcgctcgggtggcgcgtcgccgccgtcaccactacgggagtgcagggtgccaaggatgctggtctggagaaggctgccagaagtgcttcccaatcaaaggtggaaaatggctcaccttcagaaatcattttagatgattttgaagacttgagccctctatcagaaaatgatgactccactgttagtatcactgtagtcggagcatctggtgaccttgccaagaagaagatatttcctgcactttttgctctatactatgaagattgtcttccaaagcatttcactatcttcggatatgcacgcagcaagatgacagatgctgaattgagaaacatggtcagcaaaacactgacatgcagaatagataaaagggaaaactgtaatgagaagatggaagagtttttaaagagatgcttctatcattcaggccaatatgattcagaggagcatttcatggaccttgacaagaagctgaaacaacatgagggttccagagtttctaaccgtcttttctacttgtcaataccaccaaatatattccttgatgttgtaaaatgtgcaagcaaatcagcatcatctgggaatggttggacaagggtaattgttgagaaaccttttggtcgtgactcagattcatcttctgcattaacaaggggtctgaagcagtacctggtagaggaccaaatcttcaggattgaccactacttgggaaaggaactagtggagaacctgtctgtccttcgcttctcaaatcttgtttttgaacctctatggtcaaggcagtatataaggaatgtgcagctgatattctcagaggatttcggcactgaaggacgaggagggtactttgataggtatggtattatccgtgacataatgcagaatcatcttcttcagatactagccctatttgcaatggaaactcctgttagcttggaggcagaggacataagaaacgaaaaggttaaagttctgcgttccatgaagcccctgcaactggaagatgtggtgataggacagtacaaaagtcatacaaagggtggtaccacataccctggatacactgaagataagacggtgcccaaggatagtgtaaccccaacatttgctgcagctgcacttttcataaataatgctagatgggatggagttccttttcttatgaaagctgggaaggctttacatacaaagggggctgagattagagtacagttccgacatgttcctggtaatctttataagaggagttttgggactgatcttgatacagccactaatgaacttgtcatacgtgtgcaacctgatgaagctatctacttgaagattaacaacaaaattcctggtcttggtatgagactagatagaagtaatttgaatcttcactatgcagcaaggtactccaaggagataccagatgcttatgagaggctcttacttgatgccattgaaggagagcgaaggctttttatccgttctgatgagttggatgccgcatgggagctcttcactcccttactcaaggagctggaagagaagcggatagcccctgagctatacccttatggaagccgcggtcctgtaggggctcactaccttgcagcaaagtacaacgtcagatggggtgatttgaccacagaacagaaggcatgagacagatgatatctattttcgctccttttttttcttttgccattgcatttctgtaagattgcatgctcagttagtgggacagatggaaaataaggcaatcagttagcttaggttgcaaggcctgtaaccattagactataaatagctttgtggtatattcactattgggt

SEQ ID NO: 9889 - protein, 588 aa, Oryza sativa
MALSCMRCSPAAGAVRRGLASAAPPAALSFARCGLRRAAALGWRVAAVTTTGVQGAKDAGLEKAARSASQSKVENGSPSEIILDDFEDLSPLSENDDSTVSITVVGASGDLAKKKIFPALFALYYEDCLPKHFTIFGYARSKMTDAELRNMVSKTLTCRIDKRENCNEKMEEFLKRCFYHSGQYDSEEHFMDLDKKLKQHEGSRVSNRLFYLSIPPNIFLDVVKCASKSASSGNGWTRVIVEKPFGRDSDSSSALTRGLKQYLVEDQIFRIDHYLGKELVENLSVLRFSNLVFEPLWSRQYIRNVQLIFSEDFGTEGRGGYFDRYGIIRDIMQNHLLQILALFAMETPVSLEAEDIRNEKVKVLRSMKPLQLEDVVIGQYKSHTKGGTTYPGYTEDKTVPKDSVTPTFAAAALFINNARWDGVPFLMKAGKALHTKGAEIRVQFRHVPGNLYKRSFGTDLDTATNELVIRVQPDEAIYLKINNKIPGLGMRLDRSNLNLHYAARYSKEIPDAYERLLLDAIEGERRLFIRSDELDAAWELFTPLLKELEEKRIAPELYPYGSRGPVGAHYLAAKYNVRWGDLTTEQKA

SEQ ID NO: 9890 - DNA, 1900 bp, Gluconobacter oxydans
  CDS (301)..(1767)
ttttgctttctgcatccatgtccggtttccttcctgaggcgtaagtcttggctgtattttccggcgctgcacgaacacagcatccgccgcgcggcttatcgtgatgagggccagacggtcaacggaattatgtgcacgtttcatgaacgcgtgaagatgacgaagcttttctcccgaggtcgtgcagggcccgtcccttgacaggaagggccctgacagggaactagacggtgcctgaaaaggcctgaaccctaacccttttttcccggtctgcgggttcgagaggtcagagagtcttccatggaacatttccagcaggtcgagcctttcgactatgtcatcttcggtgccactggcgatctcacgatgcgcaagctgctgcccgcgctctacaaccgccttcggatgggccagattccggatgatgcgtgcatcatcggagccgcccgtacggagctggaccgggaggcctatgtcgcgcgggcccgagacgcccttgagcggtttcttccctcagacatcctgggcccggggctggtcgagcgtttcctcgcccgtctcgattacgtgacgctggacagcagccgcgagggcccgcagtgggacgccctgaagtccctgctggccaaggcacagcctgaccgggtgcgcgtctatatttcgcaaccgcaccgcagcttacggcagcatctgcgagacctgaaccgctacgagctgatcacccccacgtcgcgggttgttctcgaaaagccgatcggtacgaacatggccaccgccaccgccatcaatgacggggtcggccagtattttccggaaaagcagatctaccggatcgatcattatctcgggaaagagacggtccagaacgttctcgccctgcgttttgcaaacccgctcatgaacgctgcctggtccggcgagcatatcgagagcgtgcagatcacggcggtcgagaccgtgggcgtcgaaggtcgtgcggcctattacgacacgtctggcgcgcttcgcgacatgatccagaaccacctgctccaggtactgtgtctggttgcgatggaagcccccgattcccttgaggccgatgccgtccgcaacgccaaactggccgtcctgaacgccctgcgccccatcacggatgccacagccgccaccgagacggtgcgcgcgcagtacacggcaggcgtggtcgatggcgagaatgttccgggttatcttgaagagctcggcaagcccagcgcgacggaaacctatgccgcaatccgcgcctgggtggacacgccgcgctggaagaacgtgccgttctacatccgcacggccaagcggtccggcaagaaggtcagcgagatcgtcgtgacgttccgcccggctgcgaccaccatgttcggcgccaccccggccagcaacaggctggtcctgcgcatccagcccaacgaaggcgtggacctgcgtctgaacgtcaagaaccctgcgctggatgtcttcaacctgcggacggcggatcttgatacctccatccgcatggaaggcggcctgcccttcccggattcctatgagcggcttcttctggatgccgtgcggggtgatccggtactgttcatccgccgcgacgaggtcgaggccgcatggcgctgggtcgagcccatccttgaggcctggaaacatgacaaggcgcccatgcagacctacagtgcgggttcctatgggccggaacaggcaacacaactgctcgccagccatggcgacacctggcatgaagcgtcggagtaaccgcatttgagcgacgataaaagcgcaacgccccgcctgggtcgcactccgggccggggcacgcgccggcagccccgcagcttcaaacagctccttctgcggcggcttctggtcgtcatcccggcttttctgc

SEQ ID NO: 9891 - protein, 488 aa, Gluconobacter oxydans; identical to SEQ ID NO: 2688

SEQ ID NO: 9892 - DNA, 1515 bp, Rhodopseudomonas palustris; identical to SEQ ID NO: 2663
  CDS (1)..(1515)

SEQ ID NO: 9893 - protein, 504 aa, Rhodopseudomonas palustris; identical to SEQ ID NO: 2664

SEQ ID NO: 9894 - DNA, 1650 bp, Corynebacterium diphtheriae; identical to SEQ ID NO: 2665
  CDS (1)..(1650)

SEQ ID NO: 9895 - protein, 549 aa, Corynebacterium diphtheriae; identical to SEQ ID NO: 2666

SEQ ID NO: 9896 - DNA, 1602 bp, Nonomuraea sp; identical to SEQ ID NO: 2669
  CDS (1)..(1602)

SEQ ID NO: 9897 - protein, 533 aa, Nonomuraea sp; identical to SEQ ID NO: 2670

SEQ ID NO: 9898 - DNA, 1551 bp, Parachlamydia sp; identical to SEQ ID NO: 2661
  CDS (1)..(1551)

SEQ ID NO: 9899 - protein, 516 aa, Parachlamydia sp; identical to SEQ ID NO: 2662

SEQ ID NO: 9900 - DNA, 1500 bp, Photobacterium profundum; identical to SEQ ID NO: 2659
  CDS (1)..(1500)

SEQ ID NO: 9901 - protein, 499 aa, Photobacterium profundum; identical to SEQ ID NO: 2660

SEQ ID NO: 9902 - DNA, 26 bp, artificial sequence
  primer
atgaaggataaagtgtataagcgtcc

SEQ ID NO: 9903 - DNA, 27 bp, artificial sequence
  primer
ttaggcagcgttaattacaaactgttc

SEQ ID NO: 9904 - DNA, 1212 bp, Escherichia coli K12
  CDS (1)..(1212)
atgaaaaacagaaccctgggaagtgtttttatcgtggcgggaaccacaattggcgcaggcatgctggcaatgccgctggctgcggccggtgttggttttagcgttacgttaatcttgttgattgggctttgggcgttgatgtgctacacggcgctattactgctggaggtgtaccagcatgttccggcagataccggtctgggcacgctggcaaaacgctatctgggacgctacggtcaatggctgacgggcttcagtatgatgttcttaatgtatgctctgactgcggcatacatcagcggtgccggtgaattgttggcctccagcatcagcgactggacaggtatttctatgtcggcaaccgctggcgtgctgttgttcacttttgttgccggtggcgtggtttgtgtcggaacttcactggtcgatttatttaaccgttttctgttcagcgccaagattatttttctggtggtaatgctggtactactgctgccgcatattcacaaagtgaatcttttaaccctgccgttgcaacaggggctggctctgtctgcaatcccggtgatttttacgtcgtttggttttcacggtagcgtgccgagtattgtcagctatatggatggcaacattcgtaagctacgctgggtgtttataatcggtagtgcgatccccctggtggcatatattttctggcaggtggcgacgcttggcagcattgattcaacaacctttatgggattgctggctaatcatgctggattaaacgggctgttacaggcgttacgcgaaatggtggcctctccgcatgttgagctggcagtgcatttatttgctgatttagccctcgccacgtcatttctcggcgttgcgttaggcttatttgattatctggctgatttatttcagcgttcaaataccgttggtggacggttgcaaactggtgcaattacgtttctgccgccgttggcgtttgcactgttttatccacgaggatttgtgatggcgctgggttacgccggtgtggcgctggcggtactggcattgattatcccttcgctgttgacctggcaaagcagaaagcacaatcctcaggcgggttaccgggtcaaaggtggtcgtccggcgctggtggtggtgtttctctgtggtattgctgtgattggcgtgcaatttttgattgcggcagggttgttaccagaagtggggtga

SEQ ID NO: 9905 - protein, 403 aa, Escherichia coli K12
MKNRTLGSVFIVAGTTIGAGMLAMPLAAAGVGFSVTLILLIGLWALMCYTALLLLEVYQHVPADTGLGTLAKRYLGRYGQWLTGFSMMFLMYALTAAYISGAGELLASSISDWTGISMSATAGVLLFTFVAGGVVCVGTSLVDLFNRFLFSAKIIFLVVMLVLLLPHIHKVNLLTLPLQQGLALSAIPVIFTSFGFHGSVPSIVSYMDGNIRKLRWVFIIGSAIPLVAYIFWQVATLGSIDSTTFMGLLANHAGLNGLLQALREMVASPHVELAVHLFADLALATSFLGVALGLFDYLADLFQRSNTVGGRLQTGAITFLPPLAFALFYPRGFVMALGYAGVALAVLALIIPSLLTWQSRKHNPQAGYRVKGGRPALVVVFLCGIAVIGVQFLIAAGLLPEVG

SEQ ID NO: 9906 - DNA, 1245 bp, Escherichia coli
  CDS (1)..(1245)
atggcaacactaaccaccacccaaacgtcaccgtcgctgcttggcggcgtggtgattatcggcggcaccattattggcgcagggatgttttctctgccagtggtcatgtccggggcgtggtttttctggtcaatggcggcgctgatctttacctggttctgtatgctgcattccggcttgatgattctggaagctaacctgaattacagaatcggttcgagttttgacaccatcaccaaagatttgctgggcaaaggctggaacgtggtcaacggcatttccattgcctttgtgctctatatcctgacctatgcctatatttctgccagtggttcgattctgcatcacaccttcgcagagatgtcactaaacgtcccggcacgggcggcgggttttggttttgcattgctggtagcgtttgtggtgtggttgagcactaaagccgtcagtcgcatgacagcgattgtgctgggggcgaaagtcattaccttcttcctcacctttggtagcctgctggggcatgtgcagcctgcgacattgttcaacgtcgccgaaagcaatgcgtcttatgcaccgtatctgttgatgaccctgccgttctgtctggcatcgtttggttatcacggtaacgtgccaagcctgatgaagtattacggcaaagatccgaaaaccatcgtgaaatgtctggtgtacggtacgctgatggcgctggcgctgtataccatctggttgctggcgacgatgggtaacatcccgcgtccggagtttatcggtattgcagagaagggcggtaatattgatgtgctggtacaggcgttaagcggcgtactgaacagccgtagtctggatctgctgctggtcgtgttctcaaactttgcggtagcgagttcgttcctcggcgtaacgctgggtttgtttgactatctggcagatctgtttggtttcgacgactcggctgtgggccgcttgaaaacggcattgctgacctttgccccgccagttgtgggggggctgttgttcccgaacggattcctgtacgccattggttatgctggtttagcggctaccatctgggcggcaattgttccggcgctgttagcccgtgcatcgcgtaaacgctttggcagcccgaaattccgcgtctggggtggcaagccgatgattgcgctgattctggtgtttggcgtcggcaacgcactggtgcatattttatcgagctttaatttactgccggtgtatcagtaa

SEQ ID NO: 9907 - protein, 414 aa, Escherichia coli
MATLTTTQTSPSLLGGVVIIGGTIIGAGMFSLPVVMSGAWFFWSMAALIFTWFCMLHSGLMILEANLNYRIGSSFDTITKDLLGKGWNVVNGISIAFVLYILTYAYISASGSILHHTFAEMSLNVPARAAGFGFALLVAFVVWLSTKAVSRMTAIVLGAKVITFFLTFGSLLGHVQPATLFNVAESNASYAPYLLMTLPFCLASFGYHGNVPSLMKYYGKDPKTIVKCLVYGTLMALALYTIWLLATMGNIPRPEFIGIAEKGGNIDVLVQALSGVLNSRSLDLLLVVFSNFAVASSFLGVTLGLFDYLADLFGFDDSAVGRLKTALLTFAPPVVGGLLFPNGFLYAIGYAGLAATIWAAIVPALLARASRKRFGSPKFRVWGGKPMIALILVFGVGNALVHILSSFNLLPVYQ

SEQ ID NO: 9908 - DNA, 1248 bp, Escherichia coli
  CDS (1)..(1248)
atgactgatcaagctgaaaaaaagcactctgcattttggggtgttatggttatagcaggtacagtaattggtggaggtatgtttgctttacctgttgatcttgccggtgcctggtttttctggggtgcctttatccttatcattgcctggttttcaatgcttcattccgggttattgttattagaagcaaatttaaattatcccgtcggctccagttttaacaccatcaccaaagatttaatcggtaacacctggaacattatcagcggtattaccgttgccttcgttctctatatcctcacttatgcctatatctctgctaatggtgcgatcattagtgaaacgatatcaatgaatttgggttatcacgctaatccacgtattgtcgggatctgcacagccattttcgttgccagcgtattgtggttaagttcgttagccgccagtcgtattacctcattgttcctcgggctgaagattatctcctttgtgatcgtgtttggttcttttttcttccaggtcgattactccattctgcgcgacgccaccagctccactgcgggaacgtcttacttcccgtatatctttatggctttgccggtgtgtctggcgtcatttggtttccacggcaatattcccagcctgattatttgctatggaaaacgcaaagataagttaatcaaaagcgtggtatttggttcgctgctggcgctggtgatttatctcttctggctctattgcaccatggggaatattccgcgagaaagctttaaggcgattatctcctcaggcggcaacgttgattcgctggtgaaatcgttcctcggcaccaaacagcacggcattatcgagttttgcctgctggtgttctctaacttagctgttgccagttcgttctttggtgtcacgctggggttgttcgattatctggcggacctgtttaagattgataactcccacggcgggcgtttcaaaaccgtgctgttaaccttcctgccacctgcgttgttgtatctgatcttcccgaacggctttatttacgggatcggcggtgccgggctgtgcgccaccatctgggcggtcattattcccgcagtgcttgcaatcaaagctcgcaagaagtttcccaatcagatgttcacggtctggggcggcaatcttattccggcgattgtcattctctttggtataaccgtgattttgtgctggttcggcaacgtctttaacgtgttacctaaatttggctaa

SEQ ID NO: 9909 - protein, 415 aa, Escherichia coli
MTDQAEKKHSAFWGVMVIAGTVIGGGMFALPVDLAGAWFFWGAFILIIAWFSMLHSGLLLLEANLNYPVGSSFNTITKDLIGNTWNIISGITVAFVLYILTYAYISANGAIISETISMNLGYHANPRIVGICTAIFVASVLWLSSLAASRITSLFLGLKIISFVIVFGSFFFQVDYSILRDATSSTAGTSYFPYIFMALPVCLASFGFHGNIPSLIICYGKRKDKLIKSVVFGSLLALVIYLFWLYCTMGNIPRESFKAIISSGGNVDSLVKSFLGTKQHGIIEFCLLVFSNLAVASSFFGVTLGLFDYLADLFKIDNSHGGRFKTVLLTFLPPALLYLIFPNGFIYGIGGAGLCATIWAVIIPAVLAIKARKKFPNQMFTVWGGNLIPAIVILFGITVILCWFGNVFNVLPKFG

SEQ ID NO: 9910 - DNA, 1233 bp, Pseudomonas aeruginosa
  CDS (1)..(1233)
atgggtatgcgagaagcgaacgacaacgcatcgggcctcaaggcccatcccctgggctcgctcgagacgatcgcgatcatcatcggcaccaacatcggcgccggcgtgctgagcatggcctacgccgcccgcaaggtcggctacgtgccgttgctggtatgcctggccctgacctgcctcttctgcatcgtcaccatgctctacgtgaccgaagcctgcctgagaacccgcggcaacaaccagctcagcggcctctcccggcgttacctgggcccgctcggcggctggctgatcttcatcgcggtggcggccaacagctacggggccctggtcgcctacatgaccggcagcggcaacatcatgctcgagttcttcggccagtacggcctcacgcgccaggtcggcagcctgatcttcttcgtcccctcggcgctggtgctctacctgggcctgaaggcgctcggcgtgggcgagaagctgatcagcgccggcatggtggccatcgtctgcatcctcatcggcgctaccctgatgcacgacgacgcccgtctcgcccacctttggcagagccagtggcaatacgtggttccagtgttcaacctggcggtcttcgtgttcggcgcgcagttcctggttccggagctggtgcgcggcaacctggcaacccccgggcgcgtgccgcgcctgatcgtggtcggcatgctgctgaccttcctgctggtggcggccattcctgcctcggtcatcgccctggtcggccccgacaacctcagcgaggtggcgaccttgagctggggacgctccctcggccaatgggcctactacgtggcgaacaccttcgccttgctggcgatgctgacctcctactggggactcggcgggtgcctgttcaccaatatcttcgaccacttccgcctgggcagcgaaaccaaccggcgcaaacgcctggcggtgctcgccgcggtctcggtcccgccgttcctgctggcctatgcggggctcggcggcttcgtgaacgcgctgtacttcgccggtaccttcggcggcgtactgatgggcatcatccccatcctcctgctcaacgcggcgcggcgccacggcgaccaactgccggcattcagctgcggctggtatgcccatccgctgatacaggggctgatcgtcctggtgttcgcctccagcggggtctacgcgatcgcctcggcactggggatgctgcccgccagttggtga

SEQ ID NO: 9911 - protein, 410 aa, Pseudomonas aeruginosa
MGMREANDNASGLKAHPLGSLETIAIIIGTNIGAGVLSMAYAARKVGYVPLLVCLALTCLFCIVTMLYVTEACLRTRGNNQLSGLSRRYLGPLGGWLIFIAVAANSYGALVAYMTGSGNIMLEFFGQYGLTRQVGSLIFFVPSALVLYLGLKALGVGEKLISAGMVAIVCILIGATLMHDDARLAHLWQSQWQYVVPVFNLAVFVFGAQFLVPELVRGNLATPGRVPRLIVVGMLLTFLLVAAIPASVIALVGPDNLSEVATLSWGRSLGQWAYYVANTFALLAMLTSYWGLGGCLFTNIFDHFRLGSETNRRKRLAVLAAVSVPPFLLAYAGLGGFVNALYFAGTFGGVLMGIIPILLLNAARRHGDQLPAFSCGWYAHPLIQGLIVLVFASSGVYAIASALGMLPASW

SEQ ID NO: 9912 - DNA, 1209 bp, Yersinia pestis
  CDS (1)..(1209)
atgaagaatcgcactctgggcagtatatttatcgttgcaggtaccaccattggtgcgggcatgttggccatgccactggcggcggccggcgtagggtttggcgtcacactggccttgcttgtttctctttggttattaatgtgttacaccgcattattgctggtggaagtttatcaatatgaagcggctgataccgggcttggtacattagccaaacgttacctcggtggccatggtcaatggctgacgggttttagtatgatgtttctgatgtatgcgcttactgcggcttatatcagtggtgctggcgagttattggcaaccagtatcagccaatggactcagcaatcattcccgacctatctcggcgttttactgtttaccctagtcgccggaggagtggtttgcatcggtacccattcggtcgatttgttcaatcgtatcctgttcagtgccaaaatcattttcctgatcgtaatgctggcactgatgatgccgcatatcgaaaaaaccaacctactgacattgccgctagagcaagggctagcactctctgcgatcccggtaatttttacgtcattcggtttccacggcagcgtacccagcattgttaattatatgggcggtaatatccgtaaactgcgctgggtatttatcatcggcagtgcgataccgcttatcgcttatatcttctggcaattagcgacactgggggcgatttcctctcatacttttgtcggtattctggcccagcaagcgggtttgaacggtttactccaggctgtgcgcgacgtcgtggcctctccccatgtcgaactggcggtgcatttgtttgctgatctggcactggcaacctcattcctgggggtagcattagggctatttgactatttggctgatttatttaaacgccgaaattccatacgtggtcgtttacaaacggggttaattacctttacgccgccattactgtttgcgctgttttatccgcgtggctttattatggcgttgggttttgccgctgtggcattgtcagtattggcattaattctgcctgcaatgttagcgtggaaagcccgtaaacttcatcagggcaaatatcaggtttggggtgggagacccgcgctggcaatcgtgtttgcctgtggtgttaccgtgattggtattcagattggtattgtcactggcgcattacctgcggtagggtga

SEQ ID NO: 9913 - protein, 402 aa, Yersinia pestis
MKNRTLGSIFIVAGTTIGAGMLAMPLAAAGVGFGVTLALLVSLWLLMCYTALLLVEVYQYEAADTGLGTLAKRYLGGHGQWLTGFSMMFLMYALTAAYISGAGELLATSISQWTQQSFPTYLGVLLFTLVAGGVVCIGTHSVDLFNRILFSAKIIFLIVMLALMMPHIEKTNLLTLPLEQGLALSAIPVIFTSFGFHGSVPSIVNYMGGNIRKLRWVFIIGSAIPLIAYIFWQLATLGAISSHTFVGILAQQAGLNGLLQAVRDVVASPHVELAVHLFADLALATSFLGVALGLFDYLADLFKRRNSIRGRLQTGLITFTPPLLFALFYPRGFIMALGFAAVALSVLALILPAMLAWKARKLHQGKYQVWGGRPALAIVFACGVTVIGIQIGIVTGALPAVG

SEQ ID NO: 9914 - DNA, 1212 bp, Salmonella enterica subsp. enterica serovar Typhi
  CDS (1)..(1212)
atgaaaaacagaactctgggcagtatttttatcgtggcaggcaccactatcggcgccgggatgctggcaatgccgctggcagcggctggcgttggtttcagcgtcacgctgggattgttgattggtctgtgggcgctgatgtgttataccgcgctactattactggaagtatatcaacatgttccggcggataccgggctgggctcgttggcaaaacgctatcttggacgttacggacagtggcttacgggattcagcatgatgttcttaatgtatgcgctcaccgccgcctacatttccggagccggagaattactggcatccagtattaataactggcttggcgccacgctctcgcccgctgccggggtgctgctgttcacctttgttgccggtggggtggtgtgtgtgggcacctcgctggtcgacctttttaaccgcttcctgtttagcgcgaagatcatttttctggtcatcatgcttgcgttgctcacgccacatattcataaagtaaatcttcttacgcttcctttacagcaggggctggcattgtccgccataccggtcattttcacctcgtttggttttcacggaagcgtaccgagtattgtgagttatatgaacggcaacattcgccggctgcgttgggtctttatgacgggtagcgccattccgctagtggcctatattttttggcagctcgccacgctgggaagtatcgactcgccgacattcagagggctactggccagccatgccgggttaaatggcctgctgcaggcgctcagagaagtggtcgcttcgccacatgtcgaactggcggtccacctgttcgccgatctggcgctggcgacctcttttctgggcgtagcgctaggattatttgattacctggccgatctattccagcgccgcagtacggtgtccggacgcctgcaaaccgggctgattacctttctgccgccgctggcgtttgcgcttttctacccacgtggatttgtgatggcattaggctatgccggcgtagcgctggcagtgctggcactactcatccctgccatgctggtctggcaatgccgtaaacagagccctcaggcgggatatcgtgtggcaggcggcacgccagcgctggcgctggtgtttatctgcggcattgtcgtgattggcgtccagttttcgatcgcactggggttcctgcccgatccaggttaa

SEQ ID NO: 9915 - protein, 403 aa, Salmonella enterica subsp. enterica serovar Typhi
MKNRTLGSIFIVAGTTIGAGMLAMPLAAAGVGFSVTLGLLIGLWALMCYTALLLLEVYQHVPADTGLGSLAKRYLGRYGQWLTGFSMMFLMYALTAAYISGAGELLASSINNWLGATLSPAAGVLLFTFVAGGVVCVGTSLVDLFNRFLFSAKIIFLVIMLALLTPHIHKVNLLTLPLQQGLALSAIPVIFTSFGFHGSVPSIVSYMNGNIRRLRWVFMTGSAIPLVAYIFWQLATLGSIDSPTFRGLLASHAGLNGLLQALREVVASPHVELAVHLFADLALATSFLGVALGLFDYLADLFQRRSTVSGRLQTGLITFLPPLAFALFYPRGFVMALGYAGVALAVLALLIPAMLVWQCRKQSPQAGYRVAGGTPALALVFICGIVVIGVQFSIALGFLPDPG

SEQ ID NO: 9916 - DNA, 1245 bp, Yersinia pestis
  CDS (1)..(1245)
atgtcgatggccttatcccaaccgttgtcacggccttccgttttgggtggcgcgatgattgtcgcaggtaccgcagtgggtgcgggcatgttctcaatcccaatcgtgacagccggggtatggttcagcggctcagtggtgctgctgatctacacctgggcatgtatgttagtgtccgggctgatgattctggaagctaacctgaactacccaagtggcgccagtttccacaccatggtgcaagacctgctaggcaaggtgtggagctcaattaacgggctgtccattacctttgtgctctacattctgacctacgcctatatctccgccggtggttcgatcatcgcccatacgctgcaaaacgtagccggaattggccagaccagcgcaggctttatctttgcacttttggtggcctttatcgtgtggttatccacccgagcagtggatcgcctcagtacaatattaatcggcggcatggttatcacatttgtcatgtctgtcggtgatatgttcagccatgtagaaagtgcggtgttgtttaatcagacagacagtaatgcccactatctgccctatgcactggcggcattgccttatttgctgacctcttttggctaccacggcaatgtgccgggcctggtgaagtactacaacaaagacagcaaagccgttgtgcgcagcctgctgtacggaacattgattgccttggtgatttatctcctttggcagtatgccattcagggcaatatcgcccgggatgctttcaaacaggttattgccgatggcggtaatatcggcaatctattgcaacaaatggacaccgtttctgccagtaaagccaccagccagctactcaatgccttctcttatatggcactggccagttcgttccttggcgtgtcgctcgggttgtttgattatatttctgatttatttgactttaccgatgaccgcagcgggcgaactaaatcagcattaatgacctttgtccctccgactctcggtgccctgctgttcccggatggcttcttatatgccattggctttgcggggttagccgccaccatttgggcggttattgtgcccgcattaatggcgcgagccagccgtaaacgcttcccacaagcccgttaccgtgctcccggaggccgttttatgattggttttattatcctgtttggcctggtcaatgcggtagcccatatttcagccttgttcggcctattgccggtttatcaatag

SEQ ID NO: 9917 - protein, 414 aa, Yersinia pestis
MSMALSQPLSRPSVLGGAMIVAGTAVGAGMFSIPIVTAGVWFSGSVVLLIYTWACMLVSGLMILEANLNYPSGASFHTMVQDLLGKVWSSINGLSITFVLYILTYAYISAGGSIIAHTLQNVAGIGQTSAGFIFALLVAFIVWLSTRAVDRLSTILIGGMVITFVMSVGDMFSHVESAVLFNQTDSNAHYLPYALAALPYLLTSFGYHGNVPGLVKYYNKDSKAVVRSLLYGTLIALVIYLLWQYAIQGNIARDAFKQVIADGGNIGNLLQQMDTVSASKATSQLLNAFSYMALASSFLGVSLGLFDYISDLFDFTDDRSGRTKSALMTFVPPTLGALLFPDGFLYAIGFAGLAATIWAVIVPALMARASRKRFPQARYRAPGGRFMIGFIILFGLVNAVAHISALFGLLPVYQ

SEQ ID NO: 9918 - DNA, 1245 bp, Salmonella enterica subsp. enterica serovar Typhi
  CDS (1)..(1245)
atggcaacacttaccaccacccaaacgtcaccttcgctgcttggcggcgtggtgattatcggcggcaccatcattggcgcggggatgttctccctgccggtggtcatgtccggggcgtggttcttctggtcgatggcggcgctggtctttacctggttttgtatgctgcactccgggctgatgatcctcgaagctaaccttaactaccgcattggttcgagtttcgacaccatcaccaaagatctgttggggaaaggctggaacgtggtaaatggcatctctattgcctttgtgctctacatcctgacttacgcctatatctcggcgagcggctcaattctgcatcatacctttgctgagatgtcgctgaacgttccggcgcgagcggcaggttttgcctttgcgctgctggtggcgtttgtcgtgtggctgagtacgaaggcggtcagccggatgacggcgattgtgctgggcgcgaaagtgattactttcttcctgaccttcggcagcctgttagggcacgttcagccgaccacgttgtttaacgtggctgaaagccacgcgtcatatacgccgtacctgctgatgacgctgccattttgtctggcctcttttggttatcacggtaacgtaccgagcctgatgaaatattacggcaaagatccgcgcaccatcgtgaaatgcctgatttatgggacgttactggcgctggcgctctattccgtctggctgctggggacgatgggcaacatcccacgtccggaatttatcggcattgcgcagaaaggcggcaatattgatgtgctggtacaggcgttgagcggcgtgctgaacagccgcagcctggatctgctgctggtggtgttctctaactttgcggtcgccagttccttccttggcgtgacgctggggctgtttgactatctggcggatctgtttggttttgatgactcggcaatgggacgttttaaaacggcgctgctgactttcctgccgccgatgattggtggcctgctgtacccgaacggttttctgtacgccattggctatgcaggtttagctgcaactatctgggcggccattgtgcctgcgctgttggcgcgcaaatctcgcgaacgtttcggcagcccaaaatttcgcgtctggggcggtaaaccgatgattgccctgattctggtcttcggtgtcggcaacgcggttatccatattctgtcgagctttaatttgctgccggtgtaccagtaa

SEQ ID NO: 9919 - protein, 414 aa, Salmonella enterica subsp. enterica serovar Typhi
MATLTTTQTSPSLLGGVVIIGGTIIGAGMFSLPVVMSGAWFFWSMAALVFTWFCMLHSGLMILEANLNYRIGSSFDTITKDLLGKGWNVVNGISIAFVLYILTYAYISASGSILHHTFAEMSLNVPARAAGFAFALLVAFVVWLSTKAVSRMTAIVLGAKVITFFLTFGSLLGHVQPTTLFNVAESHASYTPYLLMTLPFCLASFGYHGNVPSLMKYYGKDPRTIVKCLIYGTLLALALYSVWLLGTMGNIPRPEFIGIAQKGGNIDVLVQALSGVLNSRSLDLLLVVFSNFAVASSFLGVTLGLFDYLADLFGFDDSAMGRFKTALLTFLPPMIGGLLYPNGFLYAIGYAGLAATIWAAIVPALLARKSRERFGSPKFRVWGGKPMIALILVFGVGNAVIHILSSFNLLPVYQ

SEQ ID NO: 9920 - DNA, 1203 bp, Haemophilus influenzae
  CDS (1)..(1203)
atgaacaaaactgtaggcagcacacttcttgttgctggtacgatgattggcgcgggaatgttggctatgccactcacttccgctggcattggcttcggctttactttagtcttgttattggggctttgggcattattaacttttagcgcacttttattcgttgaactctatcaaactgcggaaagtgatgcaggtatcggcacacttgcagaacaatattttggtaaaacaggacgcattattgccacagccgtgctaattattttcttatacgcattaattgccgcttatatcagcggtggcggttcactactaaaagatttattaccagaaagttttggcgataaagttagcgtcttattatttaccgtgattttcggttcatttattgtcatcggcacacatagcgtagataaaattaatcgcgtgttatttttcgttatgcttgctgcctttgccgtggtgttaagcttaatgttgccagaaatcaaatttgataacttaatggcgacgccaattgataaggctttaattatctctgcaagccctgtatttttcacggcatttggtttccacggttccattccaagtttaaataaatacttagatggcaatgtaaaagcattgcgcttctctattttggtcggctctgccataacactttgtgcttatattctatggcaactatccacgcacggcttgcttacacaaaatgaatttttacaaatcttaaaagaagatgcgactttaaatggcttagtaaaagcaaccttcgccatcactggaagcaatgtgatcgcaagtgcggtaaaattattttctacattagcacttatcacttctttcttaggtgtgggattaggattattagaatgtattgaagatttactaaaacgttcatttaacgttacagcaggtagaatttcacttggtttactgacttttattccaccacttgtttttgcattattttacccagaaggttttattttagcactaggctacgcaggtcaaatgtttgcattctacgccgtagtattgccagttagccttgtttggaaagctcgtcgtgcccacgctaatttgccatacaaagtgtggggaggaaatctgactttaattatcgtattggtattaggcgtgctcattacatccattccatttgcgattcgtgcgggttatttaccctttgttgtaggttaa

SEQ ID NO: 9921 - protein, 400 aa, Haemophilus influenzae
MNKTVGSTLLVAGTMIGAGMLAMPLTSAGIGFGFTLVLLLGLWALLTFSALLFVELYQTAESDAGIGTLAEQYFGKTGRIIATAVLIIFLYALIAAYISGGGSLLKDLLPESFGDKVSVLLFTVIFGSFIVIGTHSVDKINRVLFFVMLAAFAVVLSLMLPEIKFDNLMATPIDKALIISASPVFFTAFGFHGSIPSLNKYLDGNVKALRFSILVGSAITLCAYILWQLSTHGLLTQNEFLQILKEDATLNGLVKATFAITGSNVIASAVKLFSTLALITSFLGVGLGLLECIEDLLKRSFNVTAGRISLGLLTFIPPLVFALFYPEGFILALGYAGQMFAFYAVVLPVSLVWKARRAHANLPYKVWGGNLTLIIVLVLGVLITSIPFAIRAGYLPFVVG

SEQ ID NO: 9922 - DNA, 1254 bp, Proteus vulgaris
  CDS (1)..(1254)
atggaaaatacttcagtaaataaagaaccctcaattattgtagggggatttgttctgggtggtgctatgataggtgcaggtatgtttagcctgccaacaataatgtctggtgcttggtttataaactcactatttatattgtttattgtttgtttctttatgttccactcggggatatatattcttgaatgtatttctaaatatggcgcaggaacaaattactttgatatatccaaagagttattaccgaagtgggcttgttatattgccaatgcttcattgatctttgtattatatatattgatctatgcttatatctctgcggcgggttctattatctatgaagcatcactgttatatggtattaattttaatctgagagctatattttttatttttacgatagcccttggtgctacaatatggtggggtggcgcttgtgctagccgtttaacctcaattttcttattcattaagatagtattatttatattagcgttttcgggtttgttttttaaagcaaaaggtgatttattatttagtgcaacttttgcaggaaaaagccaattatatctttatccttttatttttattatcattccttatgccattacctcatttggatatcatggtaatgtttgtagtctttataagctttataatcaaaacgaaagaaaagtagttaagagttgtatcattggttgcttgttagcattagtcatctatttactttggatgattggcactatgggtaatttaccgagagaacaatttattactattatccaaaaaggcggtaacttagatgcctttattgattcactctatacggtattaaatagtaaatatattgaaggatttttattatggttctctattagtgctgttttttgctcttttttaggtgtcgcgataggtctttttgattatattttagcgtcattaaaatttaaagataataaaacagggcgattgaaatcaggtgtgctttgttttacacctccattgctattatgtctatttttccctaatggtttcttaattgctattgcgtatgcaggcactgctgcttgtgtatgggccattatttgtccggcagtaatggcactgaaagcacgacagaagtttcctaactcaggctttaaagtatggggtggtaaaaagctgatttatgcagttattgcttttggtgttgttggtattatttgtcaatcgtggcgcaatttaatttactgcctatttatcgttaaataa

SEQ ID NO: 9923 - protein, 417 aa, Proteus vulgaris
MENTSVNKEPSIIVGGFVLGGAMIGAGMFSLPTIMSGAWFINSLFILFIVCFFMFHSGIYILECISKYGAGTNYFDISKELLPKWACYIANASLIFVLYILIYAYISAAGSIIYEASLLYGINFNLRAIFFIFTIALGATIWWGGACASRLTSIFLFIKIVLFILAFSGLFFKAKGDLLFSATFAGKSQLYLYPFIFIIIPYAITSFGYHGNVCSLYKLYNQNERKVVKSCIIGCLLALVIYLLWMIGTMGNLPREQFITIIQKGGNLDAFIDSLYTVLNSKYIEGFLLWFSISAVFCSFLGVAIGLFDYILASLKFKDNKTGRLKSGVLCFTPPLLLCLFFPNGFLIAIAYAGTAACVWAIICPAVMALKARQKFPNSGFKVWGGKKLIYAVIAFGVVGIICQSWRNLIYCLFIVK

SEQ ID NO: 9924 - DNA, 1248 bp, Chlamydia trachomatis
  CDS (1)..(1248)
atggaatcgagaagtcgcaaatccatgcgactctctaaaaaaggtattctcatgataaacaaaatgttgggcggagccttgcttgtcgcaggaacaaccattggcgccggagtattagccgtccccgtttctacctcagaagggggattcctgcctacgacgttactctatattgtttcttggttcattgctgtggcttccgggtattgctttttggaagtattgacctggacacattcaagaaagaatgtaaatatggtctctatggcagagtatactttaggccataaaagcaagatcattatgtggttggtatacctactgctcttttattccctcttggtggcttatttttgtgatggtgggaatattctcatgcgagtcatgggatgtcgcagttgggatactccttggattcgacatgctatgcctgtagtattttttgctttgttttccccattattaatggcgaaaacatccattatcgatcaatgtaacagggttttcgtttttggcttaggaatcgcattcgctatgttttgctatttcggtttccctcttatgaaaacggatttgttagtaagatctgcttggggagctaccttaaaaggatttcccattttatttttggcatttggatttcaaaacgttgttcctacgttgtatcactacatggataagaacgtaaaagatgtgaagaaggccattgttattggaagttcgattcctttggttctgtacatcatttgggaagccattgtgttaggagccgttcctatttctttcttagaacaagcgaaagtagagggatggactgctattggagcattacaaacagctttgaaatgctcggctttttatgttgcaggggagttttttggattttttgctttgatttcctcatttattggcgtctctttgggtttaaaagacttttttatagatgcttttcaatgggatgagaaaaagcgtaaagtggaaatctttttcttagtttttgttttccctttggtgtgggctgttttctatccaggcattgttttgaaatgtttggagtgcaccggcgctttaggtgagacgatagttttaggagttttccccgtattgatggtatggaaagggcgctacggaaagaaacgttattacggtaaacgcattcttcctggcgggaaagggactctcttggttatgtcagggctagtgcttcttaacctggtgttgattgcccagaagtttctaggctattaa

SEQ ID NO: 9925 - protein, 415 aa, Chlamydia trachomatis
MESRSRKSMRLSKKGILMINKMLGGALLVAGTTIGAGVLAVPVSTSEGGFLPTTLLYIVSWFIAVASGYCFLEVLTWTHSRKNVNMVSMAEYTLGHKSKIIMWLVYLLLFYSLLVAYFCDGGNILMRVMGCRSWDTPWIRHAMPVVFFALFSPLLMAKTSIIDQCNRVFVFGLGIAFAMFCYFGFPLMKTDLLVRSAWGATLKGFPILFLAFGFQNVVPTLYHYMDKNVKDVKKAIVIGSSIPLVLYIIWEAIVLGAVPISFLEQAKVEGWTAIGALQTALKCSAFYVAGEFFGFFALISSFIGVSLGLKDFFIDAFQWDEKKRKVEIFFLVFVFPLVWAVFYPGIVLKCLECTGALGETIVLGVFPVLMVWKGRYGKKRYYGKRILPGGKGTLLVMSGLVLLNLVLIAQKFLGY

SEQ ID NO: 9926 - DNA, 1311 bp, Arabidopsis thaliana (mouse-ear cress)
  CDS (1)..(1311)
atggatgatttggagattacccacgaaacgaagaagggaaagagtttttgggctgccgttagtttgatcatcggaacagccgttggtccaggaatgctcggcctcccagctgcaactatcagatctggttctatcccatcgaccattgctttactttgttcttgggtttacgtcatttcctctattcttctcgtggctgagctcagctttgcagcaatggaagaagacaatgcagcagaggttagtttcacaggacttgcaactaaatcctttgggaacaaatttggagttttcgtggcttttgtgtatgcttcactaagtttctctttgatggttgcttgtgtctcgggtattggctccattgtgtctcaatggtttccttcaatgaatccatttttggccaatgctatattccctctagtttccggaatcttgatcgggtttttccctttcaatgccattgatttcaccaacaggggtctctgcttcctcatgctcttctctataacttcacttgtggccattggtttatctgtggctaggtccaatgtgttagcctcatttggtcaatcatgttggaaagtctccatggttttacccgcggttcctgttatggtactgacactagggtttcatgtgatcacgcctttcatatgcaatctcgctggggattcggtttcagatgctcggagagccattcttgtaggcggtgttgtgccattggctatggtgttgtcttggaatctaattgttttggggcttgcaagaatcactgtgcctgctgcaccttcttcaaccattgacccaatctctcttcttctatctgtgaatccttctgccttatctgctgttcaaggctttgctttctcagccttagctaccagtttaatcggatatgctgttagcttcccgaaacagctcctcgacacatggaagcttgtgtctaagcaatcaaatggaaatggaagacttgggtctgtaagtttctcatcaaaagagcgtgataggagaactaatgggagagcctcatacaatgaaccagcaagagctcgtgatgggtttgaagcagtagtgatgctatttgtccttggagttccagctctaattgcaacattctttccctcaacgttctcgagagctctggattttgccggtgtttatgcaaactgtttcctctttggtgtcctgcctcctgcaatggcttatattcaacagtccagaaagaagctcaggccatgggttcttcccggaggcaactttaccttgttgatcttatttgcaatcgccattattctgggaatatggcattag

SEQ ID NO: 9927 - protein, 436 aa, Arabidopsis thaliana (mouse-ear cress)
MDDLEITHETKKGKSFWAAVSLIIGTAVGPGMLGLPAATIRSGSIPSTIALLCSWVYVISSILLVAELSFAAMEEDNAAEVSFTGLATKSFGNKFGVFVAFVYASLSFSLMVACVSGIGSIVSQWFPSMNPFLANAIFPLVSGILIGFFPFNAIDFTNRGLCFLMLFSITSLVAIGLSVARSNVLASFGQSCWKVSMVLPAVPVMVLTLGFHVITPFICNLAGDSVSDARRAILVGGVVPLAMVLSWNLIVLGLARITVPAAPSSTIDPISLLLSVNPSALSAVQGFAFSALATSLIGYAVSFPKQLLDTWKLVSKQSNGNGRLGSVSFSSKERDRRTNGRASYNEPARARDGFEAVVMLFVLGVPALIATFFPSTFSRALDFAGVYANCFLFGVLPPAMAYIQQSRKKLRPWVLPGGNFTLLILFAIAIILGIWH

SEQ ID NO: 9928 - DNA, 1188 bp, Chlamydia muridarum, Chlamydia trachomatis MoPn
  CDS (1)..(1188)
atgcggaataaatgtataggaggggttttaattgttgctggaaccgtgatcggagccggagtattagctgtgcctgttttaacagctttggatgggtttttgcctgctgccttactgtatatgcttgcttggttagtgtcattggcctctggttatggttatttggaggttttgacctggtgcaaagggaataagcaagcgaatttgtgctccatggcagaagaaactttggggaaagtaggacgcatagttttgtgtttagtctacttgtttttattttattccttacttgttgcctacttttgcgatggggggaatattctttctcgtatgcttggagatggggttcttgaaaatccatgggctcggcatgttatgcctatcttatttttctgcatttttgctcctttacttatggcaaaaacctcgatcatcgattactgcaaccgagtatttgttttcggtcttatcctggttttcggtcttttctgtatcttgggagctccgcgtgtgcaaggggatcttttattaagagcatcatggttttcttccctaaatagtttgcctatttttttcttggcttttggttttcaaaatgtcgtgccttcattgtaccattacttagatggggatgttcgagaagttaaacgggcaatttttataggaagcctgattcctttagttttgtatgtaatttgggaagcattggttcttggtacagttccattagtttatttgctgaaagctaaggaactaggatggactgctgcaggtgctcttcaaggagctttaaaaaattctgcttttcatatcgctggagaattattcggattctttgcgctagtcacctcttttatagggactgcattggccttgaaagatttttatatagatatttttaaatgggatgctcgtaagcagcgattgaatttatttttattagttttggtgttcccattggtatgggcggtttcttatcccgagattgttttgtcttgtttgcgttatgctgggggaatagggggagcttgtattatcgtattgttcccggtagcgatgctatggaatggccggtatggaaaacggcattgttctggcaaacaaatattgccaggaggaaagaccgtcctattgattttattaggatatactgtgctaaatctcgcacccctgtattatacgttttag

SEQ ID NO: 9929 - protein, 395 aa, Chlamydia muridarum, Chlamydia trachomatis MoPn
MRNKCIGGVLIVAGTVIGAGVLAVPVLTALDGFLPAALLYMLAWLVSLASGYGYLEVLTWCKGNKQANLCSMAEETLGKVGRIVLCLVYLFLFYSLLVAYFCDGGNILSRMLGDGVLENPWARHVMPILFFCIFAPLLMAKTSIIDYCNRVFVFGLILVFGLFCILGAPRVQGDLLLRASWFSSLNSLPIFFLAFGFQNVVPSLYHYLDGDVREVKRAIFIGSLIPLVLYVIWEALVLGTVPLVYLLKAKELGWTAAGALQGALKNSAFHIAGELFGFFALVTSFIGTALALKDFYIDIFKWDARKQRLNLFLLVLVFPLVWAVSYPEIVLSCLRYAGGIGGACIIVLFPVAMLWNGRYGKRHCSGKQILPGGKTVLLILLGYTVLNLAPLYYTF

SEQ ID NO: 9930 - DNA, 1203 bp, Vibrio cholerae
  CDS (1)..(1203)
atgacgcaatcgaagcttttaggcagtactttgattatcgcgggcaccacgattggtgcaggaatgctagctctgcctctagcttccgccggtattggcttctcaacctcattgatgattatgctcggcttgtggatgctgatggcatttactgcattgctgatggtagaaatccaccagtacgcggataaagaggcaactttgcatactctcgccaaacagattttaggcgataaaggcaaatgggttgcgacgttcgctatgttatttttgttttactcgctgtgtgcggcctacattgctggcggcggcgcacaatttacccaacgaattaccgatttcactggcgtgaacgttgaaagttcgagcggtactttgctgtttaccttgattgtcgctttggtcgtcaccgttggaacaggcacagtggatcgcgtcaaccgcgtattatttgccggaaagatgatcgctatggtagcggtactgtttttcctcgcgcccaatgtttcgcagtcttacctactgagtatgccgattcagcagggcttgattgtcgcggccattcccgtcatttttacttcctttggtttccacggcagtattcctgcgattgtgaattacttggatggtgatacccctgcgctgcgcaaagcgattttgatcggctctgcgattccgctagtgatttacattttctggcagttggtcactcttggagtagtaagtcaatctgccctactcgacaatatggggctcacagcgctcatcggtgtactctcgaccacggttcaccaatcaaatcttggcaacatcatcggcgtattcgctgaccttgctctactcacctcgtttttgggtgttagtctaggtttgtttgaatttatgggtgattctctacgtaaccaacaaggtaaaatgaaccgcccattagcgtctgtcgtcaccttcttaccaccgctgatttttgctctgttctacccgcaaggcttcattatggcgctgggctatgccgcgattgcgctcgccattctggccatctttttacctctggtgatggtgatcaaagtgcgccaacaagccactgagcaacactatcaagtcacagggggcaatggggctctgcttgtgacaggtttggtcgggctgctcatcatcggcgcacagctattgattacgttaggcatacttcccgctctcggttaa

SEQ ID NO: 9931 - protein, 400 aa, Vibrio cholerae
MTQSKLLGSTLIIAGTTIGAGMLALPLASAGIGFSTSLMIMLGLWMLMAFTALLMVEIHQYADKEATLHTLAKQILGDKGKWVATFAMLFLFYSLCAAYIAGGGAQFTQRITDFTGVNVESSSGTLLFTLIVALVVTVGTGTVDRVNRVLFAGKMIAMVAVLFFLAPNVSQSYLLSMPIQQGLIVAAIPVIFTSFGFHGSIPAIVNYLDGDTPALRKAILIGSAIPLVIYIFWQLVTLGVVSQSALLDNMGLTALIGVLSTTVHQSNLGNIIGVFADLALLTSFLGVSLGLFEFMGDSLRNQQGKMNRPLASVVTFLPPLIFALFYPQGFIMALGYAAIALAILAIFLPLVMVIKVRQQATEQHYQVTGGNGALLVTGLVGLLIIGAQLLITLGILPALG

SEQ ID NO: 9932 - DNA, 1242 bp, Neisseria meningitidis
  CDS (1)..(1242)
atgcccaacaaaaccccttcactgttcggcggcgcgatgattatcgccggcacggtcatcggcgcaggcatgctcgccaacccgaccgccacatccggcgtatggtttaccggctcgctggccgtgttgctgtacacctggttttctatgctttccagcggcctgatgattttggaagtcaacacccattatccgcacggcgcaagtttcgacacgatggtcaaagacctgctcggacgcggctggaacatcatcaacggcatcgccgtcgccttcgttttatacctgcttacttacgcttatatcttcgtcggcggcgacctgaccgccaaaggcttaggcagcgcggcaggcggcgacgtttcactcaccgtcggacaactcgtcttcttcggcatcctcgccttttgcgtatgggcatccgcacgcttggtcgaccgcttcaccggcgtccttatcggcggcatggtattgacctttatttgggcggccggcgggctgattgccgatgccaagccgtccgtcctcttcgatacccaagcccccgccggcacaaactactggatttacgccgccaccgccctgcccgtctgcctcgcttccttcggcttccacggcaacgtctccagcctgctcaaatactttaaaggcgacgcgcccaaagtggctaaatccatctggacgggcacactgattgcgctggtaatttacgtcctctggcaaaccgccatccaaggcaacctgccgcgcaacgagttcgcccccgtcatcgccgccgaagggcaagtctccgtcctcatcgaaaccctgtccaaattcgcccaaaccggcaatatggacaaaatattgtccctgttttcctatatggcgatcgccacctcgtttttaggcgtaacgctcggactcttcgactacatcgccgacatcttcaaatggaacgacagcatctccggccgcaccaaaaccgccgcgctgaccttcctgccgcccctgatttcctgcctgctcttccccaccggcttcgttaccgccatcggctacgtcggcctggcggcaaccgtctggacaggcatcatccccgccatgctgctctaccgttcgcgcaaaaaattcggcgcaggcaaaacctataaagtttacggcggcttgtggctgatggtttgggtcttccttttcggcatcgtcaacatcgccgcacaggtattgagccaaatggaactcgtccccgtatttaaaggataa

SEQ ID NO: 9933 - protein, 413 aa, Neisseria meningitidis
MPNKTPSLFGGAMIIAGTVIGAGMLANPTATSGVWFTGSLAVLLYTWFSMLSSGLMILEVNTHYPHGASFDTMVKDLLGRGWNIINGIAVAFVLYLLTYAYIFVGGDLTAKGLGSAAGGDVSLTVGQLVFFGILAFCVWASARLVDRFTGVLIGGMVLTFIWAAGGLIADAKPSVLFDTQAPAGTNYWIYAATALPVCLASFGFHGNVSSLLKYFKGDAPKVAKSIWTGTLIALVIYVLWQTAIQGNLPRNEFAPVIAAEGQVSVLIETLSKFAQTGNMDKILSLFSYMAIATSFLGVTLGLFDYIADIFKWNDSISGRTKTAALTFLPPLISCLLFPTGFVTAIGYVGLAATVWTGIIPAMLLYRSRKKFGAGKTYKVYGGLWLMVWVFLFGIVNIAAQVLSQMELVPVFKG

SEQ ID NO: 9934 - DNA, 1254 bp, Pseudomonas aeruginosa
  CDS (1)..(1254)
atgtcgtcctctccagctcaaacgcccagccgccggccctcgctgctcggcggttcgatgatcatcgccggcaccgccgtcggcgccggaatgttctccctgcccatcgccatgtccggcatctggttcggctggtcggtggcggtgttcctgctcacctggttctgcatgctgctgtcggggatgatgatcctcgaggccaacctcaactacccggtgggctcgagcttctcgaccatcacccgcgacctgctcggccagggctggaatgtggtcaacgggctgagcatcgccttcgtcctctatatcctcacctatgcctatatctccggcggcggctcgatcatcggctacaccctgtccagcggcctcggcgtgaccctgccggaaaagctcgccgggctgctgttcgccctggcggtggcgctggtggtgtggtggagcacccgcgcggtggaccgcatcaccacgctgatgctcggcggcatgatcattaccttcggcctctccatcagcggcctgctcgggcgcatccagccggcgatcctgttcaacagcggcgagccggacgcggtttactggccctacctgctggcgaccctgccgttctgcctgacttccttcggttaccacggcaacgtgccgagcctgatgaagtactacggcaaggacccgcagcggatcagccgttcgttgtggatcggcaccctgatcgccctggccatctacctgctgtggcaggccagcaccctgggcaccatcccgcgcgagcagttcaagggcatcatcgccggcggcagcaacgtcggcaccctggtggaatacctgcaccggatcaccgcgtcggattcgctgaaagcgttgctcaccaccttctccaacctggcggtggccagctccttcctcggcgtgaccctcggcctgttcgactacctggccgacctgtgcaggttcgacgacagccacttcgggcgcttcaagaccgcgttgctgaccttcgtcccaccgaccatcggcgggctgctgttccccaacggcttcatctacgccatcggtttcgccgggctggccgcggcgttctgggcggtgatcgttccggcgctgatggcgcgggcctcgcgcaagcgcttcggcagcccgctgttccgcgcctggggcggcacgccggcgatcgtgctggtgctgctgttcggcgtggccaacgcggtcgcgcacatcctggccagcctgcactggctgccggagtaccgttga

SEQ ID NO: 9935 - protein, 417 aa, Pseudomonas aeruginosa
MSSSPAQTPSRRPSLLGGSMIIAGTAVGAGMFSLPIAMSGIWFGWSVAVFLLTWFCMLLSGMMILEANLNYPVGSSFSTITRDLLGQGWNVVNGLSIAFVLYILTYAYISGGGSIIGYTLSSGLGVTLPEKLAGLLFALAVALVVWWSTRAVDRITTLMLGGMIITFGLSISGLLGRIQPAILFNSGEPDAVYWPYLLATLPFCLTSFGYHGNVPSLMKYYGKDPQRISRSLWIGTLIALAIYLLWQASTLGTIPREQFKGIIAGGSNVGTLVEYLHRITASDSLKALLTTFSNLAVASSFLGVTLGLFDYLADLCRFDDSHFGRFKTALLTFVPPTIGGLLFPNGFIYAIGFAGLAAAFWAVIVPALMARASRKRFGSPLFRAWGGTPAIVLVLLFGVANAVAHILASLHWLPEYR

SEQ ID NO: 9936 - DNA, 1257 bp, Haemophilus influenzae
  CDS (1)..(1257)
atgatacaacaaaaatctccttctctcttaggcggtgcaatgatcattgcaggtacagcgattggtgcaggcatgctggctaacccaacttcaacggcaggtgtatggtttatcggttcaattcttgctttaatttatacttggttttgtatgacaacctcaggattaatgatcctagaagctaatctacattatccaacaggttcaagttttgacactatcgttaaagatttattaggaaaaagttggaatactatcaatggtctttctgttgctttcgtcttgtatattttgacttatgcctacataacctcaggcggaggcattacacagaatctgctcaaccaagcattcagttctgctgaaagtgcggtagatattgggcgaacttcaggatctttaattttctgccttattcttgcagcctttgtatggctttcaaccaaagcagtggatcgtttcacaaccgtgttaattgtcgggatggtggttgcttttttcctttctactactggtttattaagctctgtaaaaacagcagttttattcaataccgttgctgaaagtgagcaaacatatttaccttatttattgaccgcacttccagtttgtctcgtgtcgtttggtttccacggaaatgtcccgagtctcgtcaaatattacgatcgtgatggtcgtcgcgtgatgaaatcgatctttattggtacaggcttagcattagtgatttacatcttatggcagctcgctgtacaaggtaatttaccacgcactgaatttgcgccagtcattgaaaaaggcggcgatgtttctgcattattagaggctttacataaatatattgaagtggaatacctttccgtcgcattaaatttctttgcttatatggcaatttctacttcattcttaggcgtcactttagggttatttgactatattgcggatctatttaaatttgacgatagcttattaggcagaacaaaaacaacacttgttacttttttaccgccattattgctaagcctgcaatttccttatggatttgtgattgccattggttacgctggattggcggcaacaatttgggctgcaattgtccccgcacttcttgccaaagcaagccgtcaaaaattcccacaagcaagttataaagtatacggcggaaattttatgattggttttgtaattttatttggcatattaaatattgtggcgcaaattggggcaaacttaggttggtttgcaagttttactgggtaa

SEQ ID NO: 9937 - protein, 418 aa, Haemophilus influenzae
MIQQKSPSLLGGAMIIAGTAIGAGMLANPTSTAGVWFIGSILALIYTWFCMTTSGLMILEANLHYPTGSSFDTIVKDLLGKSWNTINGLSVAFVLYILTYAYITSGGGITQNLLNQAFSSAESAVDIGRTSGSLIFCLILAAFVWLSTKAVDRFTTVLIVGMVVAFFLSTTGLLSSVKTAVLFNTVAESEQTYLPYLLTALPVCLVSFGFHGNVPSLVKYYDRDGRRVMKSIFIGTGLALVIYILWQLAVQGNLPRTEFAPVIEKGGDVSALLEALHKYIEVEYLSVALNFFAYMAISTSFLGVTLGLFDYIADLFKFDDSLLGRTKTTLVTFLPPLLLSLQFPYGFVIAIGYAGLAATIWAAIVPALLAKASRQKFPQASYKVYGGNFMIGFVILFGILNIVAQIGANLGWFASFTG

SEQ ID NO: 9938 - DNA, 1221 bp, Haemophilus influenzae
  CDS (1)..(1221)
atgctaaaaaacaaaacttttgggagtgcgctgattattgcaggcacaaccattggagcaggtatgcttgctatgccgcttacatcagcaggtatgggctttggttataccctgttattgctcgttggcttgtgggctttgttggtttacagcggattgttgtttgtagaagtgtatcaaacagcggatcagttggatgatggtgtcgccacgctcgctgaaaaatattttggggttcctgggcgaattttcgcaacgttgagtttgttagttttactttatgcactttcagccgcttatattactggtggtggatctttactttcaggcttgccaactgcgtttggaatggaagcgatgtcgcttaaaacggcgattattatctttacggtggtattaggttctttcgtggttgtaggaacgaaaggcgtggatggcttaactcgcgtgttatttattggtaagttaatcgcctttgcttttgtgctgtttatgatgcttccaaaagtagcaacagataatttaatggcattgcctttggattatgcttttgtggtttctgcggcaccaatatttttaacttctttcggtttccacgttattatggcgagtgtgaatagctacttaggtggaagtgttgataaatttcgtcgtgccattttgattggtactgcgattccattagccgcttaccttgtatggcagttagcaactcatggtgtattaagtcaaagtgaatttgtgcgtattttacaagctgacccaacgctaaatggcttagtgaatgcaacgcgtgaaattacaggttctcattttatgggagaggttgtgcgtgtgttctcatcacttgcactgatcacttctttcttaggcgtaatgcttggtgtatttgagggattgggggatttattcaagcgttatcatttgccaaataatcgctttgtattaaccattgccgcatttttaccgccacttgtatttgcattgttttatcctgaaggatttattactgcattaagttacgctggtttgttgtgtgcgttctattgcttaattttaccaattagcttggcatggcgtacacgtattgaaaatccaacattgccatatcgagtcgctggcggtaattttgctttggtgcttgcgttattaattggcgtcgtgattatgctcattccatttttaattcaatggggatatttaccagtggtggcggggtaa

SEQ ID NO: 9939 - protein, 406 aa, Haemophilus influenzae
MLKNKTFGSALIIAGTTIGAGMLAMPLTSAGMGFGYTLLLLVGLWALLVYSGLLFVEVYQTADQLDDGVATLAEKYFGVPGRIFATLSLLVLLYALSAAYITGGGSLLSGLPTAFGMEAMSLKTAIIIFTVVLGSFVVVGTKGVDGLTRVLFIGKLIAFAFVLFMMLPKVATDNLMALPLDYAFVVSAAPIFLTSFGFHVIMASVNSYLGGSVDKFRRAILIGTAIPLAAYLVWQLATHGVLSQSEFVRILQADPTLNGLVNATREITGSHFMGEVVRVFSSLALITSFLGVMLGVFEGLGDLFKRYHLPNNRFVLTIAAFLPPLVFALFYPEGFITALSYAGLLCAFYCLILPISLAWRTRIENPTLPYRVAGGNFALVLALLIGVVIMLIPFLIQWGYLPVVAG

SEQ ID NO: 9940 - DNA, 1191 bp, Chlamydophila pneumoniae, Chlamydia pneumoniae
  CDS (1)..(1191)
atgtcaaataaagttctaggtgggtccttgcttattgcaggttctgccatcggtgctggtgttttagcagttcctgtattgaccgcaaaaggcggttttttccctgcaacttttctctatattgtctcctggcttttttctatggcctcaggcctttgccttcttgaagtcatgacttggatgaaagaatcaaagaacccagtgaacatgctttctatggcggaatctattttaggtcatgtaggcaagatttctatatgccttgtctacttgtttctcttttactccctactgattgcctatttctgcgaagggggaaacatcttatgccgcgtgtttaattgtcaaaatttaggaatctcgtggattcgtcaccttggccctctaggttttgctatattgatggggcctatcattatggcgggaacaaaagtgattgattactgtaatcgtttctttatgttcggcttaactgtagcttttggaattttctgtgcccttggatttttaaaaatccaacctagctttctggtgcgttcctcatggttaactacaataaacgcatttcctgtgtttttccttgcttttggattccaaagtatcattcctacgttgtactactacatggacaaaaaagttggagatgttaaaaaggcaattctcataggaacgttgattcctcttgttctctatgtcttatgggaagttgtggttttaggtgctgtctctcttccgattctttcccaggctaagataggtggatatactgctgtagaagctctcaagcaggcccatcgttcttgggcattttatattgctggagaactttttggcttctttgctttggtctcctcttttgtaggagttgctctcggtgttatggacttcctggcagacggtttaaaatggaataaaaaatcacatccattttcaattttctttttaacatttattattccccttgcttgggctgtttgttatcctgaaattgttttgacctgtcttaagtatgctgggggattcggggccgccgtgattatcggggtattcccaacattgattgtgtggaaagggcgttatggcaaacaacatcacagagagaaacagttagttccaggaggaaagtttgctttatttttgatgttcttgttgatagtaataaatgtagttagcatttatcatgagctttaa

SEQ ID NO: 9941 - protein, 396 aa, Chlamydophila pneumoniae, Chlamydia pneumoniae
MSNKVLGGSLLIAGSAIGAGVLAVPVLTAKGGFFPATFLYIVSWLFSMASGLCLLEVMTWMKESKNPVNMLSMAESILGHVGKISICLVYLFLFYSLLIAYFCEGGNILCRVFNCQNLGISWIRHLGPLGFAILMGPIIMAGTKVIDYCNRFFMFGLTVAFGIFCALGFLKIQPSFLVRSSWLTTINAFPVFFLAFGFQSIIPTLYYYMDKKVGDVKKAILIGTLIPLVLYVLWEVVVLGAVSLPILSQAKIGGYTAVEALKQAHRSWAFYIAGELFGFFALVSSFVGVALGVMDFLADGLKWNKKSHPFSIFFLTFIIPLAWAVCYPEIVLTCLKYAGGFGAAVIIGVFPTLIVWKGRYGKQHHREKQLVPGGKFALFLMFLLIVINVVSIYHEL

SEQ ID NO: 9942 - DNA, 1218 bp, Haemophilus influenzae
  CDS (1)..(1218)
atgttctacgaaaaaacaacttccatttttggtggcgcctgtattattgctagtgtttgcgtcggagctggaatgcttggtttaccaacatctggtgctggagcttggacaatatggtcagcattagcaatttgcttaacgatgataatcatgacattatcaggctggttattacttgaggcctattctacttatgatttaagagcatcatttagtaccgtaactaaagatatgctcggttcaactatcaattctattaataatcttgcggtgtattttgtcgggggtattttactttatgcttataccactgcatctggaggtatactagaaaaccttattaaaccgtggattgattttggttcatctacattggcaatttgctccactgtatttgtattagtcttttccttctttgtttggcattccactcgcattgtagacagaatatctgttttattgattgtattcatggggtttacttttatttttagtacttatggattagcaactaatattagtttagatactttattagatattggtggaaaagatacaaactatgcaaaatatgcggtagggatgtttcctgttgcattaacatcttttggttaccatcattctgtttgtactatgcgagcctattatggagacgagaaaaaagctaaatatgccatttcaggtggaacagccattgctcttactctttatttactttggattttttcaattttcggaaatttgcctcgcaatcaatttgcacctgtaatagctagtgatggcaatctagatatattacttaacgctttaggtagagtaatagaatctaacacggttaaacaaatgattaatgccttttctatcgccgcaattttgtcatcttttattggcgtaggattaggcgtattcgattatctcgctgatttcttcaaatttgataatagcaaaattggacgaacaaagtcatgggctgtgactttcctacctccactaattatgtcaattttatttccattgggtttcttaaaagccattggatatgccggcgcagtagcgacaatttggacttgcataattccagcacttcttgcttataaatctcgcaaaataaatgcagcagcaacaacattccgagtttgtggtggaaatggcttaataatctttattgtattatttgggtgttttgtggctattttccattttcctagcaatgtttga

SEQ ID NO: 9943 - protein, 405 aa, Haemophilus influenzae
MFYEKTTSIFGGACIIASVCVGAGMLGLPTSGAGAWTIWSALAICLTMIIMTLSGWLLLEAYSTYDLRASFSTVTKDMLGSTINSINNLAVYFVGGILLYAYTTASGGILENLIKPWIDFGSSTLAICSTVFVLVFSFFVWHSTRIVDRISVLLIVFMGFTFIFSTYGLATNISLDTLLDIGGKDTNYAKYAVGMFPVALTSFGYHHSVCTMRAYYGDEKKAKYAISGGTAIALTLYLLWIFSIFGNLPRNQFAPVIASDGNLDILLNALGRVIESNTVKQMINAFSIAAILSSFIGVGLGVFDYLADFFKFDNSKIGRTKSWAVTFLPPLIMSILFPLGFLKAIGYAGAVATIWTCIIPALLAYKSRKINAAATTFRVCGGNGLIIFIVLFGCFVAIFHFPSNV

SEQ ID NO: 9944 - DNA, 1209 bp, Erwinia carotovora subsp
  CDS (1)..(1209)
atgaaaaatcgtactcttggcagtgtttttatcgttgctggtaccacaattggagcaggaatgttggcgatgccgttggcaacggctggcgtcggatttggtaccacattgatgatattgatcggcctgtgggcactgatgtgttatagcgccttgttgctggttgaagtgtatcagcatcagccgtcacacaccgggttaggcacattggcaaaaatctacctcggccgctggggacagtggattaccggtttcagtatgctatttctgatgtatgcactaacggcggcctatatcagcggcgcaggcgaactgatcgccagtagcatcagccagtggagtggctactcacttccgatgtccgcagggattttgctcttcacgctggttgctggcggcgtcgtctgtatcgggacatcctcagtcgacttgtttaatcgcatcctgtttagcggcaaagtgctgatgctcgtcatcatgctggccgtcatggttccgcatattcagcgcgtcaatctcttaacgctgccgctgcaacagggcctcacgctctcggcattaccggtcattctgacctcattcggctttcacggcagtatccccagcatcgtctactacatggggggagacagccgcaagctgcgccggatatttcttatcggtagcgtgataccgctgattgcctatattttctggcagttcgtgatactaggcagcctcagctcttcgacattcaatgctattttggccgatcaggcaggattgaatgggttgatgcaggcaattcgcacactcgttgcctctccacacgttgaactggccgtccacctgtttgccgatctggcactggcgacctctttcctcggcgtggcgctcgggttgttcgattatttagccgatctgtttaaacgtaaaaatagcgtcacagggcgcgcgcagacgggcttactgacctttattccaccactggtgttcgcactcttttatccacaagggtttgtgatggcgctgggctatgcggcgattgcactggccgtgctggcattacttattcccgttctgctgagctggcaagtacgcaaacagaatcctgaaatacgcgcgactcgcggtggtgtaccggtattggcgctggtgttcgccagcggcgtaagcatcatcctgatccaactagcgatggtggcaggctggttgccatccatcagttaa

SEQ ID NO: 9945 - protein, 402 aa, Erwinia carotovora subsp
MKNRTLGSVFIVAGTTIGAGMLAMPLATAGVGFGTTLMILIGLWALMCYSALLLVEVYQHQPSHTGLGTLAKIYLGRWGQWITGFSMLFLMYALTAAYISGAGELIASSISQWSGYSLPMSAGILLFTLVAGGVVCIGTSSVDLFNRILFSGKVLMLVIMLAVMVPHIQRVNLLTLPLQQGLTLSALPVILTSFGFHGSIPSIVYYMGGDSRKLRRIFLIGSVIPLIAYIFWQFVILGSLSSSTFNAILADQAGLNGLMQAIRTLVASPHVELAVHLFADLALATSFLGVALGLFDYLADLFKRKNSVTGRAQTGLLTFIPPLVFALFYPQGFVMALGYAAIALAVLALLIPVLLSWQVRKQNPEIRATRGGVPVLALVFASGVSIILIQLAMVAGWLPSIS

SEQ ID NO: 9946 - DNA, 1275 bp, Erwinia carotovora subsp
  CDS (1)..(1275)
atggcaacacgtgcagtgaaagaaaatacagtagaaaaaaacggtacagaaaagcgtcttccttcgctgtttggcgggtcgatgattattgcagggacgattattggcgctgggatgttttccctgccggtggtgatgtcgggtgcctggtttttttggtcatttgccgtgttggtcttcacctggttttgtatgtatcactctgggctaatgatattggaggctaaccttaattatcaggcaggtgccagcttcgatacactgaccaaagatttgttgggtaagggttggaatgtgattaacggcatatcgattgcctttgtcctctacattctgacctacgcctatatctctgcgagcggttcaattatccatcacacgcttactgagatgtcgatcgatttctctgcccgcgtcggcggctgcctgtttgcgctatttgttgcgtttaccgtatggctgagcacggcggcggtgagccgcatgaccgcgttttttctggcagcaaaggtactgacctttttcatgacgttcggcagcctgctgtggaatgtgaagccggttgttttactcaatgttgcggaggaggcacccagctaccttccatatgtgttgatgacgctgccattttgtctggcctctttcggttttcatggcaacgttcccagtttggtgaagcattacggccacaagccacaggtaatcaagcgttgtctgtttattggcagcgcgctggcgctggtgatgtatgccatctggctgattggtacgatgggaaatattgctcgtccagattttatcgggattgcagagcggggcggtaatattgacgttctggtacagacgttggccggcgtgctgaatagcccttatctggacgtgttgctcacggtcttttccaacttcgccgtcgcctgttcgtttcttggggtaacgctggggctgtttgattatctggcagatttgctgaaatttgacgatagccgaatgggtagggctaaaacggcgctggtaacctttctgccgcctattattggcgggctggtctatccgaacggttttatttacgcgattggatttgccgggttagctgccaccatatgggcggtgattacgcctgcgttgctggcgcttgcgtcgcgtcgccgcttcggtagcccgcagttccgcgtgcggggcggtaatgcgatggtggtgctggtgctgctatttggcgtcggcaccgcgctgatacatattctttccagcctcgatttgctaccggtttatcgctag

SEQ ID NO: 9947 - protein, 424 aa, Erwinia carotovora subsp
MATRAVKENTVEKNGTEKRLPSLFGGSMIIAGTIIGAGMFSLPVVMSGAWFFWSFAVLVFTWFCMYHSGLMILEANLNYQAGASFDTLTKDLLGKGWNVINGISIAFVLYILTYAYISASGSIIHHTLTEMSIDFSARVGGCLFALFVAFTVWLSTAAVSRMTAFFLAAKVLTFFMTFGSLLWNVKPVVLLNVAEEAPSYLPYVLMTLPFCLASFGFHGNVPSLVKHYGHKPQVIKRCLFIGSALALVMYAIWLIGTMGNIARPDFIGIAERGGNIDVLVQTLAGVLNSPYLDVLLTVFSNFAVACSFLGVTLGLFDYLADLLKFDDSRMGRAKTALVTFLPPIIGGLVYPNGFIYAIGFAGLAATIWAVITPALLALASRRRFGSPQFRVRGGNAMVVLVLLFGVGTALIHILSSLDLLPVYR

SEQ ID NO: 9948 - DNA, 1149 bp, Photobacterium profundum
  CDS (1)..(1149)
atgctggggctcccaagtgcgggagcaggtgcatggacaacttggtcagttttcgcgattacaataaccatggtcgtcatgaccatttcgggttggatgctgctagaggcattcaagaattatgacttaaaggtatctttcaacacggtaaccaaagacatacttggtgataaggtcaacatgttcaataacctgatggtgtactttgtagggggtattttgctgtacgcctacatcacatcttcaggccttatccttcaagatgttctgggcctcgatagcaaaatcacctctatcttgtttgtttttgtattttctcccttcgtttggcactcaactcgagcagtagaccgaatttccgttattttaatcttatttatggtcttaagttttgtatttggtgtgtcagggctggcgatcaaagtagatatgtccatcttgtttaataccattgatgaaaaaacgagctacgcaccctacgcaatggcgatgctgcctgtcgctttgacgtcgtttggttatcaccattctgtggcaacaatgcgtgcttattacggcgaagaggaaaaagcgaaatacgcgattttgggtggcacaataatcgcgttaagtctgtatgttctatggttgttcagcatttatgggaatttacctagaagtcaatttggacctgtgattgagcaaggcggtaacgtagatgcactactaactacattaggctcagtcattgaatctgaaaaagtagcgcatgcgatccataccttctcaatggcggcaattctatcttctttcattggtgttggacttggggtgtttgactatttggctgatttgttcaagttcgaagacaccaaacaaggccgtgcaaaaacgtggctaatgactttcataccacctttgatcctgtcattgctatttccgtttggttttgtcattgccattggctatgccggcgctgcggcaaccgtctggacatgtattattcctgcacttctcgtaagaaaagcacgcacgttagagaatggtgataaaggctttaaagcgccaggcggcaagccaatgactgttctcgtcattagctttggtattttaactgccgtgtttcacttcatgtcgatgttaggcatgcttccagcgtttacaggctaa

SEQ ID NO: 9949 - protein, 382 aa, Photobacterium profundum
MLGLPSAGAGAWTTWSVFAITITMVVMTISGWMLLEAFKNYDLKVSFNTVTKDILGDKVNMFNNLMVYFVGGILLYAYITSSGLILQDVLGLDSKITSILFVFVFSPFVWHSTRAVDRISVILILFMVLSFVFGVSGLAIKVDMSILFNTIDEKTSYAPYAMAMLPVALTSFGYHHSVATMRAYYGEEEKAKYAILGGTIIALSLYVLWLFSIYGNLPRSQFGPVIEQGGNVDALLTTLGSVIESEKVAHAIHTFSMAAILSSFIGVGLGVFDYLADLFKFEDTKQGRAKTWLMTFIPPLILSLLFPFGFVIAIGYAGAAATVWTCIIPALLVRKARTLENGDKGFKAPGGKPMTVLVISFGILTAVFHFMSMLGMLPAFTG

SEQ ID NO: 9950 - DNA, 1266 bp, Photobacterium profundum
  CDS (1)..(1266)
atgacttcaatgagtatgagtaaaacgttcggcagtacgctgatcatcgcaggcacaacaatcggggcgggtatgctagctctccctctcgcatcagcagggttagggttcaccgcagcaacattaacgatgatgggtatttgggcattaatgatttataccgctctattaatgctagaggtacaccaacatgccgataaaaatgcaacattgcataccctggcacatcaattattgggccgcaaaggtcaagtgattgccagcttcgcaatgatgttcctattttacgcattatgtgccgcatacattgcaggcggcggcagccaacttaatgacaagttaacgaattggatggggctaagtcttgcacctcaagtgggtacagttggatttaccgttattattgcaatcgttgtatccataggtacgcattcagtcgatatggttaatcgcgtattattctcactaaaagttattgcattagccgttatgtttgttctattaatgccacatgttcaagcggttaatttggttgagatgccgattcaaaaaggattaatcatttcagcactgcccgtcatttttacctcttttggctttcacggtagcattccctccattgttcgttacgttggtttggatattaaagcactgcgaaaaataatggtcattggctctgcaacaccactgatggtctacatattatggcaagtagcaagtcaaggtgtgcttggtcagcccgatttaatggcaagtacaacactgggttcgtttatagcaacacttagcaatattttacataacccgctcgttagccaatctgtatcagtatttgctgacctagccttggcaacgtctttcttgggggtgagtttaggcttatttgattttatctctgatattttaaatcgtaataatcaagtaaaaggtcgtatgcaaacagcgctggtgacctttgttccacctctttgctttgccctattctacccacaaggctttattatggctttaggctatgcggcgattgcactggttattttggctatttttctacctgttgcgatggtgcgagctcagcgtaagcaaataaacactctaccagtaggtcaagaaacacatacgacaacaactgataaagaaataaagacagcgacttaccaagttcgtggaggtacaccagcattaattactgtgacaagcattggaatactcatcatctctgcacaattgttacaaatgattggggtcatcccttccgtcggataa

SEQ ID NO: 9951 - protein, 421 aa, Photobacterium profundum
MTSMSMSKTFGSTLIIAGTTIGAGMLALPLASAGLGFTAATLTMMGIWALMIYTALLMLEVHQHADKNATLHTLAHQLLGRKGQVIASFAMMFLFYALCAAYIAGGGSQLNDKLTNWMGLSLAPQVGTVGFTVIIAIVVSIGTHSVDMVNRVLFSLKVIALAVMFVLLMPHVQAVNLVEMPIQKGLIISALPVIFTSFGFHGSIPSIVRYVGLDIKALRKIMVIGSATPLMVYILWQVASQGVLGQPDLMASTTLGSFIATLSNILHNPLVSQSVSVFADLALATSFLGVSLGLFDFISDILNRNNQVKGRMQTALVTFVPPLCFALFYPQGFIMALGYAAIALVILAIFLPVAMVRAQRKQINTLPVGQETHTTTTDKEIKTATYQVRGGTPALITVTSIGILIISAQLLQMIGVIPSVG

SEQ ID NO: 9952 - DNA, 1179 bp, Photobacterium profundum
  CDS (1)..(1179)
atgaatttaaaattagtgggtagttcgttaatcattgcaggtaccgcgctgggcgcaggtatgttagccattccaatggtactggcgcagtttggtcttttatggggcacccttttgatgctggtgatttggttgggtacaacctacgccgcattgttattacttgaagccagtattaaatccggtggtggcttagggatgaacaccattgcgcgtaaaaccttgggtaaaggcggccagctggtcaccaacggtttactttacgcgttgttagtatgcttattgatggcttacatcatcggagccggtgatttagtgaagaagatgctgcacggtgttggcattgaaatgtcgatgatgcagacacaaatcttgttcacactggttgcgggcgtagttgttgcctctggtactgctgctatcgataaggttaaccgtctgttgtttgctgtaatggttgtcgtattaggtatcacgctattctcgctcgtgccgactatgtcttttgaacaccttttagatgcggcaagcaatgataaagttgagctaataaaaaccagctcagtgttgttcaccagctttggttttatggtcgtgattccatcacttgtaacctacaacaaaggcgcgtcacaccgtgatttgcgtaacatggttattgtaggctctgttatcccattagcttgttacttattgtggttatatgccgttgtgggtaacttaaccccagaacaattggtgaagttctcgaatgtatctgaattgattgctgcattgggcacgcgtttcagcggtattcaagtgattctgtctaccttcacaggcctagcgttactgacgtcgttcttgggtgtggcgatggcactgtttgatcaaaatgcagatacatttaagcaaaataaagccgttacctatgtacttacctttatttttccgttagttggcgcactttgggctgctgatcagttcttatctgtattgggttatgctggctttattcttgtgttcttggctatctttgtaccaatggcgatgacaatgaaactgcgtagttttgaaaagcaaaagtcagcagggcatgaagtattggctgaagcttaccaagcgggtggcggttcaattgctatggggcttagtttcgtatttggttgcttcttaattggtgctcagctggtataa

SEQ ID NO: 9953 - protein, 392 aa, Photobacterium profundum
MNLKLVGSSLIIAGTALGAGMLAIPMVLAQFGLLWGTLLMLVIWLGTTYAALLLLEASIKSGGGLGMNTIARKTLGKGGQLVTNGLLYALLVCLLMAYIIGAGDLVKKMLHGVGIEMSMMQTQILFTLVAGVVVASGTAAIDKVNRLLFAVMVVVLGITLFSLVPTMSFEHLLDAASNDKVELIKTSSVLFTSFGFMVVIPSLVTYNKGASHRDLRNMVIVGSVIPLACYLLWLYAVVGNLTPEQLVKFSNVSELIAALGTRFSGIQVILSTFTGLALLTSFLGVAMALFDQNADTFKQNKAVTYVLTFIFPLVGALWAADQFLSVLGYAGFILVFLAIFVPMAMTMKLRSFEKQKSAGHEVLAEAYQAGGGSIAMGLSFVFGCFLIGAQLV

SEQ ID NO: 9954 - DNA, 1290 bp, Photobacterium profundum
  CDS (1)..(1290)
atgattcaatatttatgtgagttactcatgaataaattaaatgtatcgaatccagaaaagcaagtgtctttaatgtatggagtggctgttgtcaccagtactgcgataggggttggcatgatgagcttaccgatcgtgagtatcggaatgtggtttcctctaagtatttttgtcatcgctattacggctgtatatatcatctcggcaggctccttattgctcgaagtgaatatgaattaccctcctggtactggcattcatagcatggtgaatgacttgatgggaggaaagcatgcaatgttcaatgattttatgatgttatttaacggctttattctcttgtatgcttatatcaccgtgggaacggaagctgttcagttttatatcgataaaatagtgggttttgaactgaataatgttctctctggtctcttatttaccgctttttttggggtgattttttatacacctcccttaattatcagtcgtatcctgagtgtctttattggcttaatggtcctttcttttatctacatcgcttattccttagggatcaatgtcaacctcggtaatattttgcttccaagcatcgaaaatagtcactcctttggtctcttaccttttgtttttataacacttcccttttttatggccgcgatgggtttccagcagacgatcccaatgctaagacatctttaccatgataatccgcagcgggtagtcaggagtatctttctgggtattactttagtttcctgtatttatcttgtttggctttttgtcatcatggggaatcaatctcaaaacagtatgattttacaggtcgcttcaggggaaagtagcttagaaaatattgtggagaccttaagcagaagtgaagacataaaagccttgatgttcttttttgtacaagtggctgttgtgacttctttcgtgggcgttgctaaaggtttgttggactatttaatggatatttttgttaatcattttaaattaatggcagtgtatcccaaagccttagtgattcttcccccgctcttattatctctactttttccttatgggtttcttattgcgataggctttgccggactcgctggagcaatatggggcggtatttatcctgctttaatggcgcaaataatccggaaaagaatacccacagacgacatggaatttgtgactgtgggagggaagtacacgccctggtttaccttactctacagtttcttaatcatcgttgtgatgttgttggaactggtcgattttttacctaaatatccgaattaa

SEQ ID NO: 9955 - protein, 429 aa, Photobacterium profundum
MIQYLCELLMNKLNVSNPEKQVSLMYGVAVVTSTAIGVGMMSLPIVSIGMWFPLSIFVIAITAVYIISAGSLLLEVNMNYPPGTGIHSMVNDLMGGKHAMFNDFMMLFNGFILLYAYITVGTEAVQFYIDKIVGFELNNVLSGLLFTAFFGVIFYTPPLIISRILSVFIGLMVLSFIYIAYSLGINVNLGNILLPSIENSHSFGLLPFVFITLPFFMAAMGFQQTIPMLRHLYHDNPQRVVRSIFLGITLVSCIYLVWLFVIMGNQSQNSMILQVASGESSLENIVETLSRSEDIKALMFFFVQVAVVTSFVGVAKGLLDYLMDIFVNHFKLMAVYPKALVILPPLLLSLLFPYGFLIAIGFAGLAGAIWGGIYPALMAQIIRKRIPTDDMEFVTVGGKYTPWFTLLYSFLIIVVMLLELVDFLPKYPN

SEQ ID NO: 9956 - DNA, 1375 bp, Corynebacterium glutamicum
  CDS (101)..(1348)
gagaaggcggaaccgaaggaatcgaagaatatctctccgtgcgttacctcgctttgccgtgacacatgagctgtccggtgaataacccgaaggaaaaaacatgactaccgaatcaatagttgcgcacaatgctgcaggtacagcacctcagaatgtgtcctctgctaagaagaagtacctcagcgttgcccaaggcgttgcccttatctacggaaccaacatcggcgccggtgtgctcagcctcccatacgctgcccgcaacggtggtttcctcgccctggttgttgccctgctcattgcgggaacactgaccaccatctccatgctctacatcgccgaagtatccctgcgcaccaagaagccactgcagctttccggcctggcagaaaaatacctggggcagtggggccgctggctggtgttcattgccattgtggtcaacagcgtgggtgcactgattgcctacgcatcaggatccggcattttgataggcaacctcaccggcctgccaccaatcgtgggcacccttggattctttgttttaggcaccttgatcatgtggaaaggcctgcacacggcaagcttcgtggaggcattgatcaccactggcatggcaacgatcatcatcgtgctgtgtggatggacagtgcttggccctggaatttccgcagacaacctgatcgtgttccacccattcttcatcgttccgatcatgaacctcgcggtctttaccttccttgcccaatatgtggttccagaaatcgcacgaggagttaaccctgccaccccgaaggcagtgccacgcgcgatcatcatcggcatggtcgcaactggtgtcaccctggcagctgtaccattcgcggcactagggcttctgggcacaggcgtcagtgaagttgtcaccatctcctggggcgaagcactcgccccagtggcctattacatggccaatgccttcgcactattggccatgttcacttcattcatcgccattggattcaccgcgatgcgcaacgtactagatattggccactggccacaacacggatggcagcgatccgttgctgtcggactaactgttcttccaccactggcaatttcacttgcgggattaggcggattcgtggcagcactgagctacgccggaggatttgccggagcaatcatgtccatcatccccgtgctgttgctgcgcaactcccgcaagagtggtgaccaagaaccagtgtggaaagccacctggcaagcgcaccccatcttccagatcctgttgattgtggtgtactccctggcgtttgtgtactcggttctcgcgatcgtcggattaatgcctgcgggttgggcatagtcacttcctgttgtggctgcctgttgc

SEQ ID NO: 9957 - protein, 415 aa, Corynebacterium glutamicum
MTTESIVAHNAAGTAPQNVSSAKKKYLSVAQGVALIYGTNIGAGVLSLPYAARNGGFLALVVALLIAGTLTTISMLYIAEVSLRTKKPLQLSGLAEKYLGQWGRWLVFIAIVVNSVGALIAYASGSGILIGNLTGLPPIVGTLGFFVLGTLIMWKGLHTASFVEALITTGMATIIIVLCGWTVLGPGISADNLIVFHPFFIVPIMNLAVFTFLAQYVVPEIARGVNPATPKAVPRAIIIGMVATGVTLAAVPFAALGLLGTGVSEVVTISWGEALAPVAYYMANAFALLAMFTSFIAIGFTAMRNVLDIGHWPQHGWQRSVAVGLTVLPPLAISLAGLGGFVAALSYAGGFAGAIMSIIPVLLLRNSRKSGDQEPVWKATWQAHPIFQILLIVVYSLAFVYSVLAIVGLMPAGWA

SEQ ID NO: 9958 - DNA, 1284 bp, Parachlamydia sp
  CDS (1)..(1284)
atggaagacaaggaaacgaatcctgaaaaaggaagtttaatttctgcaatattcttagtagcaggaacatgcattggtggaggaatgttagcacttcctgtatcaacaggaataagcggatttattccttcaacaatcgtaatgggatgctgttggattgcgatgactttgtcagcattattgttattagaagtgaatttatggatgaaggaaggcgcgcatgtgattactatgtcttccaccattttaggtccggtaggccgtgtgattagttggattctctttttatttatctcttatgcttctattgtggcttatacatctgctggaggatcgttggttagagatgtagccccttctttattgggaatgtctatttcgaaagaatggggatgcttaatttttatcgtttgctttggaggaattatttactttggaagtcgtattgtgggaaaagtaaatgcgattttttttgttgcgatgattgtggcttatttagctttaatcagtactggattgtctgaagtgaaattagaaatgcttggacatcgtcgttggtcaacatcatttttagcgattcctattttattaacgacatttagttttcaaacaatgttacctagtttgactccttatctaaaaaggaatgcgatagcattacgttgggctattattggaggaacaactttaactttttttgtttatttgatttggcagtttttagttcttggagtcattcctctttttggaccaaatagccttttaaaagctttagaagtaggtgaacctgtaactcaattcgttcgacaacatgtgcaaagctcttgggtttctagtttggccgaatattttggattttttgctcttgttacttcttttttaggaatagctttaggtttgttcgattttttgtctgatggtttaaaaataaaaaagcaaggggtaggaaagattgttttaggtttattgatcgtaattcccacatttattttttctgcttattttgaacgaattttcttgcttgctttagatacttctggagggtttggtgattctattttaaatggaattatgcctgtattaatggtttggattggccgctattatcttcattttcccaatgaaaatcgcgttcctggtggaaaaccgttacttttatttgtcttcgctttctttttgacttcactgattattgaaattttaattcatacaggatttatttgttccatttttgaagcttgtcaaatcatgttaaatcaacaacaatacggtattagcttttaa

SEQ ID NO: 9959 - protein, 427 aa, Parachlamydia sp
MEDKETNPEKGSLISAIFLVAGTCIGGGMLALPVSTGISGFIPSTIVMGCCWIAMTLSALLLLEVNLWMKEGAHVITMSSTILGPVGRVISWILFLFISYASIVAYTSAGGSLVRDVAPSLLGMSISKEWGCLIFIVCFGGIIYFGSRIVGKVNAIFFVAMIVAYLALISTGLSEVKLEMLGHRRWSTSFLAIPILLTTFSFQTMLPSLTPYLKRNAIALRWAIIGGTTLTFFVYLIWQFLVLGVIPLFGPNSLLKALEVGEPVTQFVRQHVQSSWVSSLAEYFGFFALVTSFLGIALGLFDFLSDGLKIKKQGVGKIVLGLLIVIPTFIFSAYFERIFLLALDTSGGFGDSILNGIMPVLMVWIGRYYLHFPNENRVPGGKPLLLFVFAFFLTSLIIEILIHTGFICSIFEACQIMLNQQQYGISF

SEQ ID NO: 9960 - DNA, 1200 bp, Parachlamydia sp
  CDS (1)..(1200)
atgaccaatgataaatatcgtttattaggcggtattctccttgttgctggaacgacaataggagcagggatgctcgctcttccaattgtaacaggatttgcagggtttattccttcgattgttctgtttgtgatttattgggtttttatgactttcacagcccttttgatgttagaggttaacttatggatgggagagcatactaatctgattacgatggctaaaaaaacgcttggaagaggtggacaagcgattagttggatgatttacctcttccttttatatacattgacaactgcgtatgtagcggggggaggtcatatcattgttgattttgcaaggcaagttactgaatggaatctgccaagctggatagggcctcttcctttgttgggaatttttggtttttttgtttataaaggagctcgttcagtagattatgttaatcgaattttgatgggcggattagttttgacttatgtttgcatggtcttctttttatcatctcatatacaaccgattcttttaaaacatcaaaggtgggatgcgctttggattgcagtccctattgtgtcaacctcatttggttttcatattattattcctaccctgactgactatttgaaacgagatgtcaagcaaattagaaatgtcattttaatcggcggtgcaatcccgcttttgatttacgttagctgggaattgctaacacttggaattattccattgcagggagaaaatgggttgttaatgggatatgaaaaaggtttagatggggccactttaatgagtcaattacttgaacactctgaactttctcttttagcaaggttgttttccctttttgccattctaacttcatttttaggggtctcattgagtttgcgagattttttatctgacggattgaaaattcaaaaatcaaataaaggaagatttgttctttatttactgacatttattcctcctcttcttctaactttaacagatccacgggcgtttttaaatgccttagaatacgctggggcatttggagttgttaccttacttggcttgattcctattttaatggtttggcgtggacgttatcatttaaaattgccttcaacttttaaagctcctggaggcaaaatagctttaatcttagcattacttgtgtcattaggcgtgattggaatggaaatttttaataaagtgtag

SEQ ID NO: 9961 - protein, 399 aa, Parachlamydia sp
MTNDKYRLLGGILLVAGTTIGAGMLALPIVTGFAGFIPSIVLFVIYWVFMTFTALLMLEVNLWMGEHTNLITMAKKTLGRGGQAISWMIYLFLLYTLTTAYVAGGGHIIVDFARQVTEWNLPSWIGPLPLLGIFGFFVYKGARSVDYVNRILMGGLVLTYVCMVFFLSSHIQPILLKHQRWDALWIAVPIVSTSFGFHIIIPTLTDYLKRDVKQIRNVILIGGAIPLLIYVSWELLTLGIIPLQGENGLLMGYEKGLDGATLMSQLLEHSELSLLARLFSLFAILTSFLGVSLSLRDFLSDGLKIQKSNKGRFVLYLLTFIPPLLLTLTDPRAFLNALEYAGAFGVVTLLGLIPILMVWRGRYHLKLPSTFKAPGGKIALILALLVSLGVIGMEIFNKV

SEQ ID NO: 9962 - DNA, 1191 bp, Parachlamydia sp
  CDS (1)..(1191)
atgaaaacttatgcaacccaaaagggaagtctcttaggaggaatcttattagtggctggttgttgcattggagctggaatgttaggcttaccagtgttgagcgcaatggctggttttatccctagtgtcgccatgtttatgacttgttgggcttttatggtttgcacaggccttctgttgttagaagtgaatttatggtttggccaagaaattagtattattacgatggcagaaaaaactttgggagaagtaggaaaaggtgtgagttggtttgtttttctttttcttttttattcgctaatggtggcttatgtagcggcaagtggatctttagtttcagatttagttgaacaagggttcaatcactcttttccccaagggttaggaagtgttttgttttgcttactttttggagtgctcatttatttaggtattggggctgttgactggtttaatcgatttttaatgtgtgggttaattttgacttatgtttgtttaatgataacgggaattccttatatagatgcttctcttttaaaacatcaagattggaatgccgcgactttagttcttccagcagttattgtttcgtttgggtttcataatttgatccctagtttaacaacctatcttaacagcgatcgaaaaactcttttaaaggctatcttgattggaagcgccattcctttagtgatttatttagcttgggaatggttgattttaggattggttcctcttggagaatttaaagaagctttagataaaggggaaatagcaacagaagctttaaaagatgtggtaggaatttcttggattctcgatgttgcacaaggttttgctttttttgcaatagtcacttcttttttaagcgtagctattagttttgttgactttctagcagatggattaaatattcaaaaaactgccggaggtaaaatgtttttagcaggacttgtactagttcctccacttatttgttctatagtttaccctaggatttttttgtcggctttaaattatgctggaggatttggagccgtgattctttttggtatcttgccggctctcatggtttggaaaggtcgttatacaaaaaagattaacttacctcaaattgttcccggagggaggccacttttaattggcgtcattctattttctctatggattatggcccttcaacttatttaa

SEQ ID NO: 9963 - protein, 396 aa, Parachlamydia sp
MKTYATQKGSLLGGILLVAGCCIGAGMLGLPVLSAMAGFIPSVAMFMTCWAFMVCTGLLLLEVNLWFGQEISIITMAEKTLGEVGKGVSWFVFLFLFYSLMVAYVAASGSLVSDLVEQGFNHSFPQGLGSVLFCLLFGVLIYLGIGAVDWFNRFLMCGLILTYVCLMITGIPYIDASLLKHQDWNAATLVLPAVIVSFGFHNLIPSLTTYLNSDRKTLLKAILIGSAIPLVIYLAWEWLILGLVPLGEFKEALDKGEIATEALKDVVGISWILDVAQGFAFFAIVTSFLSVAISFVDFLADGLNIQKTAGGKMFLAGLVLVPPLICSIVYPRIFLSALNYAGGFGAVILFGILPALMVWKGRYTKKINLPQIVPGGRPLLIGVILFSLWIMALQLI

SEQ ID NO: 9964 - DNA, 1260 bp, Desulfovibrio vulgaris
  CDS (1)..(1260)
atgcagaacgcggctcatcgccccgggcagaacgcggcacatcgccccggagtcttcggtggcaccatgatcatcgccggtacgtccatcggcgcaggcatgctcgccctgcccaccatctcggcgggcatgtggttcggctggtcgcttgcggtcatgctgctggcgtggctggtcatgctgctttcgagtcaggcactgctcgaggtgaacctgcatttcgaaccgggggccagcttccacaccctcgtccgcgagacactcggccccggctggagcgtcatcaacggcgcggccgtggctttcgtgctgtacatcctcgtctacgcctacgtcagcgggggcggttccatcatgcggcacaccctgctggcggtctcgggctacgaaccctcgaagctggcggcgggcctctccttcgcgttgctgctggcggcatgtgtgtggtggagcacatggatcgtcgaccgtctgtccgtcatcatgatgggtggcatggtcgtcagcttcatcctctccatgtccgggatgctctcggacatccgcgccgacgtactcttcgacgccggaggcgaaggcggttcggccctcttcgtgtggggggccctctcgacctatctcacctcgttctgcttccacgccagcgtgcccagcctcgtgaagtacttcgggcgcaggcccgccgacatcaaccgctgtctcgtggggggcacgggcatcgccctcgtctgctacctgctgtggatagtggcgtgcgacggcaccatcccccgcgcggagttcagggatgtcatcgccgcaggcggcaacgtgggcgacctcgtgcgtgcggcaggttccaacctgaacagcgggttcatcctgcggatgctcgaagccttctctgcgcttgcggtggcgacgtcgtttctcggggcgggcttgggcctgttcgactacatcgccgacctgtgccgcttcgacgacacgcgcgccggacgcacgaagaccacgctggtcaccttcggccctcccaccgtgggcggtctgctgtggcctgacggcttcctgctggccatcggctgggcggggcttgccgccacggtgtggtcggtggtcgttcccgcactcatgctgcgggcgagtcgcgccacacgtcccgcgccgggctaccgtgtcggcggcggcagccttacggtgcctgcactgctggccttcggcctcgtcaccgccgtgtgccacacgctcttcgtcttcggtgtgctgcccatgtacaggtag

SEQ ID NO: 9965 - protein, 419 aa, Desulfovibrio vulgaris
MQNAAHRPGQNAAHRPGVFGGTMIIAGTSIGAGMLALPTISAGMWFGWSLAVMLLAWLVMLLSSQALLEVNLHFEPGASFHTLVRETLGPGWSVINGAAVAFVLYILVYAYVSGGGSIMRHTLLAVSGYEPSKLAAGLSFALLLAACVWWSTWIVDRLSVIMMGGMVVSFILSMSGMLSDIRADVLFDAGGEGGSALFVWGALSTYLTSFCFHASVPSLVKYFGRRPADINRCLVGGTGIALVCYLLWIVACDGTIPRAEFRDVIAAGGNVGDLVRAAGSNLNSGFILRMLEAFSALAVATSFLGAGLGLFDYIADLCRFDDTRAGRTKTTLVTFGPPTVGGLLWPDGFLLAIGWAGLAATVWSVVVPALMLRASRATRPAPGYRVGGGSLTVPALLAFGLVTAVCHTLFVFGVLPMYR

SEQ ID NO: 9966 - DNA, 1278 bp, Desulfovibrio vulgaris
  CDS (1)..(1278)
atgtcacagtgcatgacagccaacgggcagaccgccacgcaagccggggtgaagaatccctcggttcttggcggcgccatgatcatagccgggacgaccatcggcgcgggcatgttctcgctgccgagcgtctctgccggcatgtggttcttctattccctcttcgtcctgttcggcacgtggctttgcatgtgccattccggcctgatgatcctcgaggccaacctcaactatcccgccgggacatccttcgacaacatcgccaaggactgccttgccagacccgtgcggctgctgaacagcctctcggtggccttcgtgctctacattctcacctacgcctatatcagcggcggcgggtccatcgtcgcgcatacggtgaaggcggctgtgggcatcgacgttcccatgaagctgggcggcttcctcttcgcgcttgtgctcgcgttcgtcgtatggctgagcacccgcgccgtcgaccgcatctccaccatcatgctcggcggcatgatactcaccttcttctcgtcggtgagcggcctcatgttcaacgtgcagcccgctgtgctcttcgacaccggcgacaccagtgcgccatactcgcccttcatactcgccacgcttccctactttctcacctcgttcgggtaccacggcaacgtccccggactcgtgaagtactacaacaaggacccgaaggccgtcgccaagaccatcatctacggcagcttcctcggcctcattctctacgtgtgctggcaactcagcgtactgggcaacatcccgcgcgaggaattcctcgacatcgtcgccaagggcggcaacatgggcatcctcgtgggggcgctgtccaaggtcacaggcagcaccaacctcgactacctgctccaggtcttctcgcatcttgccgtggcgacctcgttcctcggcgtgacgcttggcctgttcgactgcatcgccgatacgctcggcttcgacgactcgcgtctcggacgtaccaagaccgccatcgtcaccttcgtgcccccggccattggcggcctgttctaccccgacggattcatcatggccatcggctttgccgggcttgcagccaccgtgttcgctgtcatcgtacccgccatgatggcactggccacacgcaggaagttcggcaacaccacctaccgcgcccccggcggcaacgtgatgctctatgtgaccatcgcctatggcatcaccgtggccatctgccatgtgctgaccatgttcgacatgctgcctgtctacggcaagtag

SEQ ID NO: 9967 - protein, 425 aa, Desulfovibrio vulgaris
MSQCMTANGQTATQAGVKNPSVLGGAMIIAGTTIGAGMFSLPSVSAGMWFFYSLFVLFGTWLCMCHSGLMILEANLNYPAGTSFDNIAKDCLARPVRLLNSLSVAFVLYILTYAYISGGGSIVAHTVKAAVGIDVPMKLGGFLFALVLAFVVWLSTRAVDRISTIMLGGMILTFFSSVSGLMFNVQPAVLFDTGDTSAPYSPFILATLPYFLTSFGYHGNVPGLVKYYNKDPKAVAKTIIYGSFLGLILYVCWQLSVLGNIPREEFLDIVAKGGNMGILVGALSKVTGSTNLDYLLQVFSHLAVATSFLGVTLGLFDCIADTLGFDDSRLGRTKTAIVTFVPPAIGGLFYPDGFIMAIGFAGLAATVFAVIVPAMMALATRRKFGNTTYRAPGGNVMLYVTIAYGITVAICHVLTMFDMLPVYGK

SEQ ID NO: 9968 - DNA, 951 bp, Oryza sativa
  CDS (1)..(951)
atgtgtgaactaggatctggaggtgtctccctggtctcaatggctatgcgcactctagggacatttggagtaagaacagcttgcatctcatatttgtttatacattatgcacttctggttgcatatgtggcacgctcttcagagatcataacaaactcagtgggcattccattatgggagagtgctgccctgttttcactggcttttggggggctatgctactttggaagccagcgagtcattggtgcggttaatggttttttggtgttcagcatcctagcatccttcacaactcttgtggtggtggcaagtggaaacctgcagtggagttctcttcttgaagcaaattttgctgctgccccacaaagtataccgataattgctctttcatttgtataccagaatgtagttcctgttctgtgtacaaatttggagggagacctatcaaaagtaaggaaggcaattgtagtaggtaccgccataccccttgctctgtttctcatatgggatgctgtaatcctggggacacttccaggccttgcaggggatggaaccattattgatccactagaacagcttcgatcaagtaatggaacagtggggcctattgttgaggcattctcatttcttgcaattggcacatcatacattggatttgttctaggactctcagacttcatagcagacttgcttaaactaccaggtggacagaacaaacctctgccgtaccttctgactttgctcccaccgcttgttctgtcattgcttgatccagagatatttttcaaggcattggactttgcaggaacttatggaggcaaggatccttttaaactatctcttattatgaatagatgtagagaagaaacatgtatagtcctatgctattttaaaatttattttactagaagacttgtcaagttgtcatgcaatgaaaccaaccaatcatga

SEQ ID NO: 9969 - protein, 316 aa, Oryza sativa
MCELGSGGVSLVSMAMRTLGTFGVRTACISYLFIHYALLVAYVARSSEIITNSVGIPLWESAALFSLAFGGLCYFGSQRVIGAVNGFLVFSILASFTTLVVVASGNLQWSSLLEANFAAAPQSIPIIALSFVYQNVVPVLCTNLEGDLSKVRKAIVVGTAIPLALFLIWDAVILGTLPGLAGDGTIIDPLEQLRSSNGTVGPIVEAFSFLAIGTSYIGFVLGLSDFIADLLKLPGGQNKPLPYLLTLLPPLVLSLLDPEIFFKALDFAGTYGGKDPFKLSLIMNRCREETCIVLCYFKIYFTRRLVKLSCNETNQS

SEQ ID NO: 9970 - DNA, 1215 bp, Vibrio vulnificus
  CDS (1)..(1215)
atgtcaaagcaaccctcgttaattgggggagcgtgcattattgccagcgtctgtgtcggcgctggaatgctcggcctccccagtgcaggggctggcgcgtggacgctctggtctctattggctctcactcttaccatggtcgtcatgacgctatctggttggctactgctcgaagcatttaaacactacgaactgcgggtctccttcaatactgtcaccaaagatatgctcggcagcaaagtaaactggttcaacaatttgatggtttactttgtgggtggcattttgctgtacgcttacatcacttcttctggtcttatcttgcaagatgttctgcaaatagacagtaaagtggcctctatcttgttcgttgcggtattttcggcttttgtttggcattcaacacgcgcggttgaccgtatctcggtcattctcattgtctttatggttctcagttttatctttggcgtttcagggttagcgatcaacgtcaaaacctccgttttattcgataccatcaatgagaatgccgattacgctccctacgccatggcgatgcttcccgttgctctaacctcttttggttatcaccattccgtctcttctatgcgctcttattacggcgaagaacgaaaagccaaatacgccattcttggcggaacgattattgcgcttagcctctatttcttatggttactgagcatcttcggcaacttacctcgctcagagtttggctcggtgatcgaacaaggtggcaatgtcgatgtgttgctcaaagcactgggttctgtgattgaatcagagaaggtctcgcaagcgatcaacgcattctcgatggcggcgattctctcctctttcattggcgttggattaggggtgtttgatttcttggctgatctgtttaagtttggcaactgcaagcgtggcagaagcaaaacttggctggtaacgtttcttccaccgttaatcttgtcgctactgttcccgtttggcttcattattgccattggttatgctggcgcggcggccaccgtctgggcttgtattatccctgtactgctcgcctacaaatctcgttcgatggagaatggctatcaaggctttgtggtaccaggaggcatgtcagtgctggttctggtactgggttttggtgtgttaaccgccatcttccatatgctggccatggccaacatgttgcccacatttacggggtaa

SEQ ID NO: 9971 - protein, 404 aa, Vibrio vulnificus
MSKQPSLIGGACIIASVCVGAGMLGLPSAGAGAWTLWSLLALTLTMVVMTLSGWLLLEAFKHYELRVSFNTVTKDMLGSKVNWFNNLMVYFVGGILLYAYITSSGLILQDVLQIDSKVASILFVAVFSAFVWHSTRAVDRISVILIVFMVLSFIFGVSGLAINVKTSVLFDTINENADYAPYAMAMLPVALTSFGYHHSVSSMRSYYGEERKAKYAILGGTIIALSLYFLWLLSIFGNLPRSEFGSVIEQGGNVDVLLKALGSVIESEKVSQAINAFSMAAILSSFIGVGLGVFDFLADLFKFGNCKRGRSKTWLVTFLPPLILSLLFPFGFIIAIGYAGAAATVWACIIPVLLAYKSRSMENGYQGFVVPGGMSVLVLVLGFGVLTAIFHMLAMANMLPTFTG

SEQ ID NO: 9972 - DNA, 1206 bp, Photorhabdus luminescens
  CDS (1)..(1206)
atgaagaatcgtactcttggcagtatttttatcgtagcgggcacgacaattggcgcaggaatgctggcgatgccgctggcagcagccggtgtcggttttggaacaaccttcgtgatgttaatcactctttgggttttgatgagctataccgctttattgttggtggaagtttatcaatacagcccggccgatacgggcctgggaacgctggcaaaacgttatcttgggcgaggaggccaatggctcaccggtttcagtatgcttttcctcatgtatgctctgacaaccgcttatatcagtggtgcaggtgagttgctgtcaggcagcctctcttcatggctggataaacctattcctgtttcatacggtgtgctgattttcactcttgtcgcgggttgtgttgtcactatcagtactcaatctgtcgatatgattaaccgcctgctatttacggcaaaaatcatctttctggttattatgctgaccgtcatgatgccccacatcaaaagcactaacttgatgtcaatgcctttggaacaaggtttggtattatcagctattcccgtggtattcacctcttttggttttcacggcagtgtgccaagtatcgtcaattatatgggaggtgatacccgtaagttacgcaaaatatttgttatcggcagtgctatcccactgactgcctatatcttatggcaattagccactctgggtgccatctcttcccatacttttgtcggcatcttagcggagcaatcagggctgaatggactgttaaaagcggtgagagaagttgtcgcgacgcctcgtgtagagcttgctgtccgtctgtttgctgatttggcactggcaacctcatttcttggggtctccttaggtttgtttgactatatggcagatctgttcaaacgccgtaataatgcgacaggccgcctgcaaaccggcatcatgacttttgttccaccactactttgctccttgtactatccaaactttgttatggcgttaactttcgccgcagttgcactgtccattctcgccctgttactgccttccatgctggcttggcgcagtcgtcaaattgaacaaaaagcctatcgggtaaaaggcggaaaacccgttctgattctggtatttctttgcggaattacggtcattaccatccagataggtattgtcagtggtttactgccagaagtaggttaa

SEQ ID NO: 9973 - protein, 401 aa, Photorhabdus luminescens
MKNRTLGSIFIVAGTTIGAGMLAMPLAAAGVGFGTTFVMLITLWVLMSYTALLLVEVYQYSPADTGLGTLAKRYLGRGGQWLTGFSMLFLMYALTTAYISGAGELLSGSLSSWLDKPIPVSYGVLIFTLVAGCVVTISTQSVDMINRLLFTAKIIFLVIMLTVMMPHIKSTNLMSMPLEQGLVLSAIPVVFTSFGFHGSVPSIVNYMGGDTRKLRKIFVIGSAIPLTAYILWQLATLGAISSHTFVGILAEQSGLNGLLKAVREVVATPRVELAVRLFADLALATSFLGVSLGLFDYMADLFKRRNNATGRLQTGIMTFVPPLLCSLYYPNFVMALTFAAVALSILALLLPSMLAWRSRQIEQKAYRVKGGKPVLILVFLCGITVITIQIGIVSGLLPEVG

SEQ ID NO: 9974 - DNA, 1260 bp, Photorhabdus luminescens
  CDS (1)..(1260)
atgtccactgagacaccccagagtttaaagcgccctcccatactgggtggtgcaatgatcattgccggaactgctgtcggtgcaggaatgttctctactcctgtggcaacttccggtgtctggtttactggctcaattattctgctggtttacacatgggtgtgtatgtatttctccggcttgatgatactagaaaccaacctgaactacccatcaggtgcaagcttccataccatgactaaagatttactcggtaaaggatggaatgcaatcaatggtatctctattgcattcgtgctttatatattaacctacgcctatatttcagcgggtggctcaattattgcccacaattttaaaaatattatttcgatatcacaggcaaatgctggctttattttcgcttttatcgttgcatttattgtctggttatcgactcaagctgtcgatcgtttgagcacaattttgatcggcggtatggttattactttttttatgtccgttggcggcatgtttaccgaagttaaatatgtcattttgtttaatcagacggatactacatcaaacgacacggcaacaagttatatatcttacgctttaaccgctctaccctatttactcgtttcattcggatatcacggtaacatcccaagtttagtaaaatattatcataaagatagaaaagccgttattcgcagcctgttattaggtacattaatcgcattaactatttatatcctatggcaatatgtcattcagggaaatattccccgcgaagcattcaaacagattattgctgatggcgggaatatcggtgatttattaaaacacatggataatacaacaaacagcaaaaccgttcaccagcttctaaatgccttctcttatatggcattagcaagttcatttcttggtgtctctttagggctatttgattacatagccgatttcttcggttttaaagataacaacaccggccggttaacatctgcattagtgacatttattccgccaacagcgctagctttactgttccccaatggttttctatatgccattggctttgctggattcgctgcaaccatctgggctgtcattattccagcactgatggctagggcaagtcgccagcgcttccctgaagccagttaccgagcaccaggagggaaattcctcattgggttcgtcattctgtttggtttgataaatgctatagcccatattttgtcctctcttgatttattacctgtgtatcattga

SEQ ID NO: 9975 - protein, 419 aa, Photorhabdus luminescens
MSTETPQSLKRPPILGGAMIIAGTAVGAGMFSTPVATSGVWFTGSIILLVYTWVCMYFSGLMILETNLNYPSGASFHTMTKDLLGKGWNAINGISIAFVLYILTYAYISAGGSIIAHNFKNIISISQANAGFIFAFIVAFIVWLSTQAVDRLSTILIGGMVITFFMSVGGMFTEVKYVILFNQTDTTSNDTATSYISYALTALPYLLVSFGYHGNIPSLVKYYHKDRKAVIRSLLLGTLIALTIYILWQYVIQGNIPREAFKQIIADGGNIGDLLKHMDNTTNSKTVHQLLNAFSYMALASSFLGVSLGLFDYIADFFGFKDNNTGRLTSALVTFIPPTALALLFPNGFLYAIGFAGFAATIWAVIIPALMARASRQRFPEASYRAPGGKFLIGFVILFGLINAIAHILSSLDLLPVYH

SEQ ID NO: 9976 - DNA, 1209 bp, Photorhabdus luminescens
  CDS (1)..(1209)
atgaagaaccgtacttttggcagtacttttattatcgccggaacaaccatcggtgctggtatgctagccatgccattagccaccgccggtgtaggatttggtgtaagtttgatcatgttggttagcttgtgggttttgatgagttacaccgcattattgctggttgaaacttaccaatatgaatcccctgatacggggttagggacacttgctcaacgttatcttggcagcagcggcaaaatattagccggtttcagcatgatgtttctaatgtatgcattaacatcagcctacattagtggcgcaggggaattactgacagtcagcctcaacaaatggctgaatctatctcttcctgcctcagtcggtgttatcctgtttaccgtgattggtgggggagttgtttgcattggtacccgttcagtagatatggttaaccgagttatttttggtgcaaaaattattttcttggtattaatgttggggatgatgatgccgcatgttcagcatattaacttactgaccatgccattagaacaaggattaatactatcttcaattccggtgatattcacctcgtttggttttcacggtagtgttcccagtattgtgaaatatatggatggcgatatccgtcgactccgctgggtgtttatcatcggcagcgcaattccgctaattgcttatattctctggcaattggcgacactcggaagtattaattccagcacattcgtcaatattttagctgaaaacgcagggttgaatggcttattacacagcattcgcgaagttgttgcttcaccgaaaactgagcttgcagtacaaatgtttgccaacctggcgctcgcaacctcattcctcggtgtcacacttggcctgtttgattttctgggtgatctatttaaacgcaaaaatagcgtagccgggcgtatgcaaactggtttgttaactttcgttccgccattgattttcgcgctattttacccaaaaggatttgtaatggcgttaggatatgccgcggtcgcgctatcaattttggcgttagtattgcctagcctcctggcatataaatcccgccagcaaaatgaacgtcgatatcgggtacctggtggtaagcctgtactattactggtgtttgcctgcggtattgcagtaatagcaatccaaattggcatagtcagtggaatgttgccggaagtagggtga

SEQ ID NO: 9977 - protein, 402 aa, Photorhabdus luminescens
MKNRTFGSTFIIAGTTIGAGMLAMPLATAGVGFGVSLIMLVSLWVLMSYTALLLVETYQYESPDTGLGTLAQRYLGSSGKILAGFSMMFLMYALTSAYISGAGELLTVSLNKWLNLSLPASVGVILFTVIGGGVVCIGTRSVDMVNRVIFGAKIIFLVLMLGMMMPHVQHINLLTMPLEQGLILSSIPVIFTSFGFHGSVPSIVKYMDGDIRRLRWVFIIGSAIPLIAYILWQLATLGSINSSTFVNILAENAGLNGLLHSIREVVASPKTELAVQMFANLALATSFLGVTLGLFDFLGDLFKRKNSVAGRMQTGLLTFVPPLIFALFYPKGFVMALGYAAVALSILALVLPSLLAYKSRQQNERRYRVPGGKPVLLLVFACGIAVIAIQIGIVSGMLPEVG

SEQ ID NO: 9978 - DNA, 1245 bp, Photorhabdus luminescens
  CDS (1)..(1245)
atggctactttgccgataaaaaaatcgtctccatctttatttggcggtgccatgatcattggtggaacggttattggtgcgggcatgttttctttaccagttgtcatgtcaggggcatggttttactggtcaattgccactttgatttttacctggttttgcatgttgcattcaggattaatgatattggaagccaatcttaattatcgaattggctcaagtttcagtactataacaaaagatctgttgggcaatggttggaatatcattaatggtattacccttgcttttgttttatatatactgacttacgcttatatttccgcgagcggatcgattattcaacatgctatgcgagaagtatcgatagatttttcacctgggtttgctggttttttatttgctcttgtggttgcatttattgtctggttaagtactaaaacggttagccggatgacgtcgattattcttggtgctaagatattaactttctttatgacgttcggcggtttggtttataacgttaaaccagcggtattgtttaatacaactgaagttaatccaacttactggccttatgtattaatgactttacctttctgtctggcctcctttggatatcatggtaatgttcctagcctgatgaaatattatggaaaagaaccagagaaaataaagagatgcctgtttattgggacatcaatggccttggtgctttatttgatctggttgattggaacaatgggaaatatttcccggcctgattttgtcgaaatcatcgcaaaggggggcaatattgatgttttggttcaatcattaagtggaggattgaacagttctgctctgggtttattattgactcttttttctaactttgcggttgccagctcattccttggtgtcacgcttgggttgttcgattacctggctgatctgcttaaatttgatgacaccaagctggggcgctttaaaacggcattagtgacgtttcttccgccaatggttggtggaatgatttatccgaatggttttattcatgcgataggttttgctggccttgctgcaacagtttgggcggctattgttcccgcattacttgccagagcatcccgtaaacgatttggtagccctatgtatcgagtttggggaggtaatgtgatgatcggcttgattttgctatttggcgtactaaatgctgcggcccatatcttgtcaaattttaacctgctgcccgtttattcataa

SEQ ID NO: 9979 - protein, 414 aa, Photorhabdus luminescens
MATLPIKKSSPSLFGGAMIIGGTVIGAGMFSLPVVMSGAWFYWSIATLIFTWFCMLHSGLMILEANLNYRIGSSFSTITKDLLGNGWNIINGITLAFVLYILTYAYISASGSIIQHAMREVSIDFSPGFAGFLFALVVAFIVWLSTKTVSRMTSIILGAKILTFFMTFGGLVYNVKPAVLFNTTEVNPTYWPYVLMTLPFCLASFGYHGNVPSLMKYYGKEPEKIKRCLFIGTSMALVLYLIWLIGTMGNISRPDFVEIIAKGGNIDVLVQSLSGGLNSSALGLLLTLFSNFAVASSFLGVTLGLFDYLADLLKFDDTKLGRFKTALVTFLPPMVGGMIYPNGFIHAIGFAGLAATVWAAIVPALLARASRKRFGSPMYRVWGGNVMIGLILLFGVLNAAAHILSNFNLLPVYS

SEQ ID NO: 9980 - DNA, 1227 bp, Haemophilus ducreyi
  CDS (1)..(1227)
atgattatgaataaaactttaggcagtacattattggtttcagggacgatgattggtggcggtatgttggctatgccattgacgtcagcaggtattggtttttgtttaactttagtattattggtcgtgctgtggatattgcttacttatagtgccttattatttgtggaagtatatcaaactgcagaacatgatgttggtattggcacattagcggcgcgatattttggtaaaacaggacgagtcattgctacgttagtattaatggtctttttgtatgcgttgttatccgcttatgttacgggcggtggtaatattttagcgtcaatgtttccagctgcgcctgatcatttaatgacagagaaagagaaaattgcgatagtcatgtttacgataatttttggtgcttttattgtttttggcactagaagtgttgatggtattaaccgttttctgttttttattatgttagccggtttagcgttggtactgtttgctttaatgccttttattcagatagataatttactcgcaatgcctgtggataacttattattagtttctgctagcccgatctttttcaccgcttttggatttcatggctctattccaagtttaaataattatttaaatggtaatgtgaaagcattacgttttgctattatagttggttcattgattaccttaatggtttatattttatggcaaatggcgacccacggtttattaagtcaaaccgcatttcttgatatcttacagaaagatccaaccttgaatggtttagtcgtggcaacggcgcaaacaactggcagtaatattattggttatatagtgaagtttttctcggcatttgctttaatcacttcttttttgggggttgcgcttggcttatttgaatgtattaacgatttattaaagcaatcgtttaattttgcatcaaatcgtttaaatgttggcttactgactttctcgccaccattattatttgcattgttttatcctgaaggctttgtgttagctttacgttatgctgggcaaatgtttgcgttttatgctgtagtgttgccggtgttattagtttggaaagttcgtcaactacaccctaatttgccttatcgagtatggggcggcaatgtattactctggttagtggctttacttggtattgtcatcacgtgcattccttttatggtaaaaacaggttgtttacctacagtggtagggtag

SEQ ID NO: 9981 - protein, 408 aa, Haemophilus ducreyi
MIMNKTLGSTLLVSGTMIGGGMLAMPLTSAGIGFCLTLVLLVVLWILLTYSALLFVEVYQTAEHDVGIGTLAARYFGKTGRVIATLVLMVFLYALLSAYVTGGGNILASMFPAAPDHLMTEKEKIAIVMFTIIFGAFIVFGTRSVDGINRFLFFIMLAGLALVLFALMPFIQIDNLLAMPVDNLLLVSASPIFFTAFGFHGSIPSLNNYLNGNVKALRFAIIVGSLITLMVYILWQMATHGLLSQTAFLDILQKDPTLNGLVVATAQTTGSNIIGYIVKFFSAFALITSFLGVALGLFECINDLLKQSFNFASNRLNVGLLTFSPPLLFALFYPEGFVLALRYAGQMFAFYAVVLPVLLVWKVRQLHPNLPYRVWGGNVLLWLVALLGIVITCIPFMVKTGCLPTVVG

SEQ ID NO: 9982 - DNA, 1218 bp, Haemophilus ducreyi
  CDS (1)..(1218)
atgaaaaataaaatattaggcagtgcattaatgattgccggcacaacgattggtgcgggaatgcttgcaatgccattaacttcagcaggaatgggctttggcgcgaccttgtttttgttgattagtttgtggggattattagcttacactggattattgtttatggaagtctatcaaactgcaccaaaacgcgatgtcggtgtggctagtttagctgagcaatattttggtattgttggacgtgtacttgcgactgctactttattagttttactttatgctttattagccgcctatattacaggcggtggctcattattatccggtattttgcctgaaataatggatagtcaattaaccaacaagatcgctatcttattattcactactttattaggtacttttgtcgtggtgggtattaaaggggtagatggattaactcgtgtgctatttatgggcaaaattatagcgtttttacttgtattagcaatgatgttaccaaaagcaaaaattgagaatttatttgctatgccactggataacttattggttatttctgtggtgccaatttttttcacatcatttggttttcacgtaattatggcaagcattaataattacttagaggcggatatcggtaaaattcgcattgcaatttatattggtaccgctattccattaattgcttacttattatggcaattagcaacgcatggcgtattaacgcaagccgaatttgttgaaattttaaagtcagatccaagcttaaatggtttagtaaaagcaactagtcaaattacaggaagtacatttttaggtgaaatgttgcgtttattttctgccttagcattaattacgtcatttttaggcgttgctatgggtatttttgaatgtatcggcgatttattaaaacggattaatttacccacaaatcgtttagtattaacattagtaacctttattcctcctttattatttgctttattttatcctaatggttttattgcagcattaggttatgccggtttattatttgctttttacggaatgttattaccaatagggcttgcatggcgagcacgtaaattacaccctaatttaccttatcgcgtctcgggggggaatagcgcattgctgattgcattattaatgggcattattattatgattattccatttttaattcaatttggttatctaccacaagtaatgggctaa

SEQ ID NO: 9983 - protein, 405 aa, Haemophilus ducreyi
MKNKILGSALMIAGTTIGAGMLAMPLTSAGMGFGATLFLLISLWGLLAYTGLLFMEVYQTAPKRDVGVASLAEQYFGIVGRVLATATLLVLLYALLAAYITGGGSLLSGILPEIMDSQLTNKIAILLFTTLLGTFVVVGIKGVDGLTRVLFMGKIIAFLLVLAMMLPKAKIENLFAMPLDNLLVISVVPIFFTSFGFHVIMASINNYLEADIGKIRIAIYIGTAIPLIAYLLWQLATHGVLTQAEFVEILKSDPSLNGLVKATSQITGSTFLGEMLRLFSALALITSFLGVAMGIFECIGDLLKRINLPTNRLVLTLVTFIPPLLFALFYPNGFIAALGYAGLLFAFYGMLLPIGLAWRARKLHPNLPYRVSGGNSALLIALLMGIIIMIIPFLIQFGYLPQVMG

SEQ ID NO: 9984 - DNA, 1200 bp, Haemophilus ducreyi
  CDS (1)..(1200)
atgcaaaaacaaccttctatttttggcggcgcctgtattattgctggtgtatgtgttggagccggtatgctcggcttacctacttcaggtgctggagcatggacaatttggtcaattattagcttaacattaacaatgattgttatgacactatctggttggctcttactcaatgtttaccaaaattatgatgcacgcgcctctttcaatacggtaacaaaagatttgttaggcaataacattaatattgtaaataatcttgccgtttattttgttggtggcattttactttatgcctatacaaccgcttctggtgggattttatctaacctaaccaactcaacttttgaattaggtgaatacagtaatcgaatttggtcaactatttttgtctttatcttttcattctttgtatggcattctactcgcttagttgatcgtatttcagtgctattgatcctgtttatggcattttcttttgcctttagtatttctggattagtgatcaatatcgatctgccaacgttatttgaccaacaaaatcagcaaggcgaatacgctaaatatgcgttagcaatgttccctattgctttaacgtcttttggttatcatcactcagtatcatcaatgcgcgcctattatggtgaagaacaaaaagcaaaatatgcgattgcaagcggtacatttattgctttaattctctatttattatggattataagtattttgggcaacttaccgcgtcaacaatttattcccattattgctagcaatggtgatttagaaatattactcaatactgtcggtaaagttgttgaatcaccttatgttcgccaagcgattaatgctttttcaatggccgctattctttcttcttttattggtgttggtttggggacctttgattttttagctgatttctttaaatttgataacagtaaaatgggtcggatgaaaagctgggcggcgacttttctaccgccgttagtattttcattaattgcaccgcttggtttcttaaaagcgatcggttatgccggtgctgtcgcaacattatggacctgtattatccccgctttattagcctataaagctcgaaaagggcatttattggtgattacgttggtcttgctatttggtgtttgtacggcaattttccatttccttgcgatgtttgaaattttacctgtcttcaattaa

SEQ ID NO: 9985 - protein, 399 aa, Haemophilus ducreyi
MQKQPSIFGGACIIAGVCVGAGMLGLPTSGAGAWTIWSIISLTLTMIVMTLSGWLLLNVYQNYDARASFNTVTKDLLGNNINIVNNLAVYFVGGILLYAYTTASGGILSNLTNSTFELGEYSNRIWSTIFVFIFSFFVWHSTRLVDRISVLLILFMAFSFAFSISGLVINIDLPTLFDQQNQQGEYAKYALAMFPIALTSFGYHHSVSSMRAYYGEEQKAKYAIASGTFIALILYLLWIISILGNLPRQQFIPIIASNGDLEILLNTVGKVVESPYVRQAINAFSMAAILSSFIGVGLGTFDFLADFFKFDNSKMGRMKSWAATFLPPLVFSLIAPLGFLKAIGYAGAVATLWTCIIPALLAYKARKGHLLVITLVLLFGVCTAIFHFLAMFEILPVFN

SEQ ID NO: 9986 - DNA, 1188 bp, Chlamydophila caviae
  CDS (1)..(1188)
atgtctaacaaggttttaggaggttcccttattgttacagggaccgccataggagctggtgtgttagcagttcctgtaataacagcgtatgcaggttttctccccacgactcttctttatgtgctatcttggcttttctctgtggcatccggactttgttacctcgaaattatgacttggtttaaggaaaagcaacaagttaacttgttgtcgatggcgcaatataccttaggggatattggtaagatcttcatgtggctcctttacctgttcctattttactctttgcttattgcttacttttgtgagggagggaatatcctatttcgtatttttggttgtcagggattagacattccttggatacgtcacatggcccctttggcatttgcagttttgatttgccctgcattgatgatgggagcaaaagttgtagattactgtaatcgcttttttgttttaggattagctattgctttcgcggtattttgtatcttaggagttttttctttacaaccccagctacttttacgtgcttcgtgggcgcgctctacagaaggtttatctgttctgtttctctcctttggtttccacaatgtagtgccctcactgtattactacatggataagaacgttaaagatgttaaaaaagctatctttattggtagtttgattcctttgattttatacgtgatttgggaggctcttgttttgggagttgttcctttagactttcttatgaaagctaaggaacatggctatacagcagtagaggctatgaaaacttcattgcagtgttcaatgttttatcttgctggggagttttttggtttctttgctttagtttcttcatttttaggcgtggctctgggggttatggacttcctcgcggatgctcttcaatggaataaaaagaaacgtagtttttctattttctttttaactgttattatccctttagcttggtcaatgtgctatcccgagatcgtgcttaaatgtctcagttatgctggaggtttcggcgctgctttaattatcggagtttgcccagtgttaatgatctggaaagggcgttatgggaaaaaacattatcaagcaaaacatttagtcccaggtggaaaaattgtcttggtattaatgcttgtagtaatagtaattaatttagctagcttttattacaaattttaa

SEQ ID NO: 9987 - protein, 395 aa, Chlamydophila caviae
MSNKVLGGSLIVTGTAIGAGVLAVPVITAYAGFLPTTLLYVLSWLFSVASGLCYLEIMTWFKEKQQVNLLSMAQYTLGDIGKIFMWLLYLFLFYSLLIAYFCEGGNILFRIFGCQGLDIPWIRHMAPLAFAVLICPALMMGAKVVDYCNRFFVLGLAIAFAVFCILGVFSLQPQLLLRASWARSTEGLSVLFLSFGFHNVVPSLYYYMDKNVKDVKKAIFIGSLIPLILYVIWEALVLGVVPLDFLMKAKEHGYTAVEAMKTSLQCSMFYLAGEFFGFFALVSSFLGVALGVMDFLADALQWNKKKRSFSIFFLTVIIPLAWSMCYPEIVLKCLSYAGGFGAALIIGVCPVLMIWKGRYGKKHYQAKHLVPGGKIVLVLMLVVIVINLASFYYKF

SEQ ID NO: 9988 - DNA, 1281 bp, Coxiella burnetii
  CDS (1)..(1281)
atgattatggaacccccaaatatcctcttcgatgaatctcaagacgtcacattcgtcaatgagattgaatccccaaaagctgaaacgactcgcggaaaagtttttggcgctattttattaattattggcacatcggtcggcggaggcatgttggctttgcccatggcaatcgctgccggtggctattatcactccattttcttattttttggcgcttggctaatcacggtgttggccgctttttacattttagaagctaatttatggctgccggaaaatacgaatctcatttcaatggcgcgaataacgctgggcaaagcgggtcagttaatcacctggattagctatttattgttgttatatacgctattagctgcctacatgtctggcgggaccgatttaattcacaatttactgtcattaattaatatccccacgccgacgtggctggattcgattttattcgttgtgattttaggtgcagttttgttttatggggtgcgcgccgtggattgggtcaaccgcggtttgatgtcaacgaaattagcggtttattttttactggtcttatttatttcgccgcacatcgatgtgggcaaactttctggcggtcgtttagcacttttatccggggcggtcatggtgattatcacttctttcggttatgccactattgtgcctactttgcgaagttatttgaaaagccaagtcaatgccttgcgattaacgatcgccatcggaagcctaatgccgttaattttatatttattatggactttcgttgtcaacggaacgctgggaagccatggagctaatggtttaattcacatggccgcttccaccgacgccgtgagcgaattaagtaatactttatctgctcacgtaaatggcgaacttgtgaaaggattaatccacttttttacttctatttgtatcgcgacttcttttctcggggtctcgttgtgcttatcagattttatggcggatggtttaaaaattaaaaaagaaaaaaacggccgctggttattggttgcattaacccttgcgccgccgcttttagtcattctgttttatccaggcgctttcattgcaagtttaaattacgccggcgttttatgcgtcattttacttatcttcttgcccgcattaatggtctggagcggccgttatgttaaaaagatcgctatcggttacgaagtcatcggcggaaaaacatttattatccttgaaatcctcgtcgcccttgcgttgctgatttttgcgttaatgcatttagggtga

SEQ ID NO: 9989 - protein, 426 aa, Coxiella burnetii
MIMEPPNILFDESQDVTFVNEIESPKAETTRGKVFGAILLIIGTSVGGGMLALPMAIAAGGYYHSIFLFFGAWLITVLAAFYILEANLWLPENTNLISMARITLGKAGQLITWISYLLLLYTLLAAYMSGGTDLIHNLLSLINIPTPTWLDSILFVVILGAVLFYGVRAVDWVNRGLMSTKLAVYFLLVLFISPHIDVGKLSGGRLALLSGAVMVIITSFGYATIVPTLRSYLKSQVNALRLTIAIGSLMPLILYLLWTFVVNGTLGSHGANGLIHMAASTDAVSELSNTLSAHVNGELVKGLIHFFTSICIATSFLGVSLCLSDFMADGLKIKKEKNGRWLLVALTLAPPLLVILFYPGAFIASLNYAGVLCVILLIFLPALMVWSGRYVKKIAIGYEVIGGKTFIILEILVALALLIFALMHLG

SEQ ID NO: 9990 - DNA, 1158 bp, Vibrio parahaemolyticus
  CDS (1)..(1158)
atgaacctaaaacttgtcggcagctccctgatcgttgcaggtactgctcttggcgctggtatgcttgccatacctatggtgcttgctcaatttggcctcctttggggcactcttcttatgttgttcatctgggctggaacgacttatgccgctttgcttctacttgaagcgagttgcaaagtcggtggtggcgtaagtatgaacgcaatcgcccgcgaaacacttggtaaaggcggtcagttagtgactaatggtctgctttacgcgttgcttgtttgtctattgatggcttacatcattggcgctggcgatctagtgcaaaaaatcacggcatcagtcggcctctctgtttccactgtttctagccaagttggctttaccatcttagtgggtctgattgtttctgctggcactggtgtggtcgacaagcttaaccgtggtctgtttatcggtatgattgttgcgcttgttttaacgctgtttgctcttgctcctagtgtttcattcgaaggcctaaacgaagtcgttagtagcgacaaaatggcactgatcaaaaccagttctgtgctattcaccagttttggctttatggtcgtcattccttcgttggtgacttacaacaaagaagcgagcaaaactcagctgcgcaacatgatcgttgtcggctctacgattcctttggtttgttacctattgtggttgtttgcggttgtgggtaacttgccgccacatgagctggtacagtactcaaacgtcactgaacttatctcggttcttggtcaacagtacaatggcttggagtttattctgtccatgtttactggtttggcgttgctaacttcattcttgggtgtggcaatggcgctttacgaccaaaacgcggacttgctcaaaaccagcaagccagtggtattcgtcaccacatttattctgccgctacttggtgctgtatttgctccggaacatttcttagcaattttaagctacgcaggcattattcttgtgttcttggcggtttttgttccattgtcgatgacaatgaaagtgcgccgtgtacctgtcgaagacaacagcgtttatgaagctggtggtggtgtgatgggcatgagtatgatcttcctgtttggctgtttcctactatttgcgcaagctgtgtaa

SEQ ID NO: 9991 - protein, 385 aa, Vibrio parahaemolyticus
MNLKLVGSSLIVAGTALGAGMLAIPMVLAQFGLLWGTLLMLFIWAGTTYAALLLLEASCKVGGGVSMNAIARETLGKGGQLVTNGLLYALLVCLLMAYIIGAGDLVQKITASVGLSVSTVSSQVGFTILVGLIVSAGTGVVDKLNRGLFIGMIVALVLTLFALAPSVSFEGLNEVVSSDKMALIKTSSVLFTSFGFMVVIPSLVTYNKEASKTQLRNMIVVGSTIPLVCYLLWLFAVVGNLPPHELVQYSNVTELISVLGQQYNGLEFILSMFTGLALLTSFLGVAMALYDQNADLLKTSKPVVFVTTFILPLLGAVFAPEHFLAILSYAGIILVFLAVFVPLSMTMKVRRVPVEDNSVYEAGGGVMGMSMIFLFGCFLLFAQAV

SEQ ID NO: 9992 - DNA, 1206 bp, Vibrio parahaemolyticus
  CDS (1)..(1206)
atgagtcgttctaaagtgtttggtagtaccttaattattgctggtactacaattggggctggtatgctagctcttcctcttgcctccgctggcattggttttactacatcactgatcatcatgttgagtttgtgggcattgatggcctttactgcgttactgatgcttgaacttcaccaatatgctgaaagtagtgcaacacttcataccttggcgaaacaaatccttggtcaaaagggtaaatgggttgccagttttgcgatgctatttttgttctactcattgtgtgcggcatacatcgctggtggtggtgcccaatttggtgaccgcttatctcagtggtttgagttagacatttctggcccgacagcgacagtgattttcactctgatcgttactttagtggtgactataggtacaggaacagttgataaagtaaaccgtgtgttgtttgcgttaaagctagtcgcaatggttgcggtactgtcatttttagcgccaaacgttaccgagtcatacttgctaagcatgcctatcgaacagggacttattgttgcggcgattccagtgattttcacatcgtttggtttccacggcagtattcctgcaatcgtaaactacctagatggcgatacgtcatctttgcgcaaagcggttattgttggttcgacgattcctttagttatctacattttctggcaaatcgttaccttaggcgtagtaagccaagatgcgcttattgaaaacggtggcttgagtgcacttattggtcaattatctcaaactgttcacaaatccaacttgagcagcattgtaggtgtatttgccgatcttgcacttctcacctcgtttttaggtgtgagcttaggtttgttcgaatttttaggtgatacgatcaaaggcaaaagtgagaaaccaaatcgcttgttagctgcagtgattacgtttactccaccacttggttttgcgcttttttacccacaaggctttattatggcgctgggttacgcggcaattgcattggctattcttgcgattttccttcctcttgtcatggtgatcaaggttcgtcgttccgatgatttctcaggtgaatatcgtgtcgcaggtgggcaaggagcgctggtcgtcactggtatagcgggtacgggcatcgttttagcgcaagtgctaattactttaggtgtattacctgctctaggttag

SEQ ID NO: 9993 - protein, 401 aa, Vibrio parahaemolyticus
MSRSKVFGSTLIIAGTTIGAGMLALPLASAGIGFTTSLIIMLSLWALMAFTALLMLELHQYAESSATLHTLAKQILGQKGKWVASFAMLFLFYSLCAAYIAGGGAQFGDRLSQWFELDISGPTATVIFTLIVTLVVTIGTGTVDKVNRVLFALKLVAMVAVLSFLAPNVTESYLLSMPIEQGLIVAAIPVIFTSFGFHGSIPAIVNYLDGDTSSLRKAVIVGSTIPLVIYIFWQIVTLGVVSQDALIENGGLSALIGQLSQTVHKSNLSSIVGVFADLALLTSFLGVSLGLFEFLGDTIKGKSEKPNRLLAAVITFTPPLGFALFYPQGFIMALGYAAIALAILAIFLPLVMVIKVRRSDDFSGEYRVAGGQGALVVTGIAGTGIVLAQVLITLGVLPALG

SEQ ID NO: 9994 - DNA, 1206 bp, Vibrio vulnificus
  CDS (1)..(1206)
atgagccgttcaaagatttttggtagtactttgattattgcaggcaccactattggtgctggaatgcttgcattgccccttgcttcagcagggattggtttttccacctccgtcatgattatgatcggcttttgggttttgatgtcgtataccgcgttgttgatggtggagctccatcaagaggcagatagaagtgcgacgctgcacacgctggcaaaacaaattctaggcacgaaaggaaaatgggttgccagtttcgctatgctgtttctgttttacgcgctttgcgcggcttacattgctggtggtggtgcgcagtttggtgaacgcgttgctgcttggttttccatcgaaatggatgcctctgtggcaacggtcatttttaccgtgattgtggctgcggtggtgaccagtggcacggcgaccgtcgataaagtaaaccgcgttttatttggtttgaaaatggttgccatggtcgcggtgcttttctttcttgctcctaacgtgacggaatcttacttgctcagtatgccgattcaacaagggttgattgtcgctgctctgccagtcatttttacgtcgtttggtttccacagcagcattcctgctattgtgaattaccttgatggggacaccaaagcgctgcgcaaagcgattgtcattggctcgtccatccctctggttatttatgtgttctggcaactggtcacgcttggcgtggtgaatcaagaggtactgcttaataactcagggttgacggcgttgattgcccagttggccgcgaaagttcagcaatcttacttaagccaattggtaggcgtgttcgcggacttggcactgttaacctcatttttaggggtgagcctaggtttgtttgagtttcttggcgatgtcatcaagaagagtggtcagaaacaaaatcgcgtcattcctgctgtggtgacatttacaccgccgctgatgtttgcgcttttctacccacagggcttcattatggcgcttggttacgccgcaattgcattggctgttttggcgattttcttgccggtggtgatggtaaacaaagtacgtaaatcaccagagaagcaggggagttaccaagtggctggtggacaattagcgctaacgctcacaggtgtgaccggggttgtgattgttgctgctcagatcctgataaccgttggggttctgcctgcgttagggtaa

SEQ ID NO: 9995 - protein, 401 aa, Vibrio vulnificus
MSRSKIFGSTLIIAGTTIGAGMLALPLASAGIGFSTSVMIMIGFWVLMSYTALLMVELHQEADRSATLHTLAKQILGTKGKWVASFAMLFLFYALCAAYIAGGGAQFGERVAAWFSIEMDASVATVIFTVIVAAVVTSGTATVDKVNRVLFGLKMVAMVAVLFFLAPNVTESYLLSMPIQQGLIVAALPVIFTSFGFHSSIPAIVNYLDGDTKALRKAIVIGSSIPLVIYVFWQLVTLGVVNQEVLLNNSGLTALIAQLAAKVQQSYLSQLVGVFADLALLTSFLGVSLGLFEFLGDVIKKSGQKQNRVIPAVVTFTPPLMFALFYPQGFIMALGYAAIALAVLAIFLPVVMVNKVRKSPEKQGSYQVAGGQLALTLTGVTGVVIVAAQILITVGVLPALG

SEQ ID NO: 9996 - DNA, 1245 bp, Shewanella oneidensis
  CDS (1)..(1245)
atgaatgcggtaaaaaataagccggtagggaagtctctgctcggtggcgccatgattattgcggggaccactgttggggctgggatgttttcattgcccgttgttggctcaggcatgtggtttggctattcgatattgatgttgctgggtatttggttttgtatgttgatgtcggggctgttactgctcgaaaccaatttacatttcgagccaggcgcaagtttcgataccctcaccaaggaaaccctaggccagttctggcgtatagtgaacggggtttctatcgcctttgtgctctatatcttaacctacgcctatatcagcggtggtggttcgatagtaaaccatagcctacaggggatggggattgaactaccccaaagtgttgccggattagtgtttaccgtggtgctcgcctgtatcgtgttgattagcactaaggctgtcgatcgcattacaaccattatgctaggtgggatgatcatcactttcttcctcgcgattggtaatctactgattgagatcgatgtgactaagttactcgagccggatggaaatcaacgttttataccatatctatgggttgcattgccctttgggctcgccagttttggttatcatggcaacgtgcctagcttggtgaagtattacggcaaagattcctctaccattattaaggccatttttgttggtacttttatcgcgttgattatttacgtttgttggttagtggcgactatgggcaatattccccgcagccaatttagcgagattattgcccaaggtggcaatatgggggtgctcgtcggtgcgctgtcaaaagtgatggaaagtagttggttaaacagtatgttaacgctatttgccaacttagccgtcgcttcatctttcctaggtgtcacactcggtttattcgattacctagccgatttgtttggttttgatgattcgcgctcaggccggatgaaaaccgcgattgttacctttgtgccgccaacagtattcggtttgttattccccgatggctttttgattgctatcggttttgctgctttagcggcaaccgtgtgggcagtgatagtgcccgcgctgatggcttataagtcgaggcaactctttcccaatcaccaaggttttagggtttttggtggcacgccgctgattatccttgtggtgttgtttggtgtggtgacgggggcttgccatttactggcaatggcgaatttattgccgcagttttcctaa

SEQ ID NO: 9997 - protein, 414 aa, Shewanella oneidensis
MNAVKNKPVGKSLLGGAMIIAGTTVGAGMFSLPVVGSGMWFGYSILMLLGIWFCMLMSGLLLLETNLHFEPGASFDTLTKETLGQFWRIVNGVSIAFVLYILTYAYISGGGSIVNHSLQGMGIELPQSVAGLVFTVVLACIVLISTKAVDRITTIMLGGMIITFFLAIGNLLIEIDVTKLLEPDGNQRFIPYLWVALPFGLASFGYHGNVPSLVKYYGKDSSTIIKAIFVGTFIALIIYVCWLVATMGNIPRSQFSEIIAQGGNMGVLVGALSKVMESSWLNSMLTLFANLAVASSFLGVTLGLFDYLADLFGFDDSRSGRMKTAIVTFVPPTVFGLLFPDGFLIAIGFAALAATVWAVIVPALMAYKSRQLFPNHQGFRVFGGTPLIILVVLFGVVTGACHLLAMANLLPQFS

SEQ ID NO: 9998 - DNA, 1188 bp, Shewanella oneidensis
  CDS (1)..(1188)
atgacacaaaataaatttttcggcagtttactgctgattgcaggcaccaccattggcgcgggcatgctcgcactccccatcgcatcggccggccttggctttggcatgtcgagcatgattatgctgatcttctgggcattaatggcctacactgccctactcatggtcgaaatccaccaatttgccccgagtgatgccagcctcaaccaattagcccgtcatctattgggcacaaaaggccaagtggttgcctgtatcgcgttaatgtttttactctatgccctgtgcgccgcctacatcgctggcggtggtgagcaagtgcatcaaaaactcacctcttggttagggctagcactgccgccacaggcgggcgccatcttatttaccctcttgattggtacgattgtgggtttaggtacgcactgtgtcgatttgattaatcgcgtactctttagtttaaaaatcattgcgttaatcctaatgctggccttattactgccacaggtggaaggcacgcatttactcgaactgccgctagagcaagggcttattgtgtcggccatcccagtgatttttacctcgtttggttttcatggttcgattccgtccgtggtgcgctacttaggcatcgaagtgaaagcgctgcgcaaaattatgctgctcggctcagcgttacccctgctgatttacctgctgtggcaactgggtagccaaggcgtactaagccaaagccaattgatgaccaatcaaagtctttctggctttattagtcaattagcgagtgtacttcacagccaatacttaagctcagcgattagtgtgtttgccgatctcgcccttgcgacctcctttttaggcgtgagcctaggtctatttgactttatagccgccaacttaaggcaagaggataatgcgacgggtcgcagtgtcaccgcggcgatcacttttgtgccgccattaggctttgcccttttctacccacagggatttattaccgctctaggctacgcggcaatcgctttagtgatcctcgcgatttttttaccggtttctatggtatgggtacaaagaaaacaacgggataaagccaagcttccccaaggctaccgcgtcgcagggggaacattaggcttagtgctcgcactactatgtggccttgcggtgattagtgcgcagcttttaggctag

SEQ ID NO: 9999 - protein, 395 aa, Shewanella oneidensis
MTQNKFFGSLLLIAGTTIGAGMLALPIASAGLGFGMSSMIMLIFWALMAYTALLMVEIHQFAPSDASLNQLARHLLGTKGQVVACIALMFLLYALCAAYIAGGGEQVHQKLTSWLGLALPPQAGAILFTLLIGTIVGLGTHCVDLINRVLFSLKIIALILMLALLLPQVEGTHLLELPLEQGLIVSAIPVIFTSFGFHGSIPSVVRYLGIEVKALRKIMLLGSALPLLIYLLWQLGSQGVLSQSQLMTNQSLSGFISQLASVLHSQYLSSAISVFADLALATSFLGVSLGLFDFIAANLRQEDNATGRSVTAAITFVPPLGFALFYPQGFITALGYAAIALVILAIFLPVSMVWVQRKQRDKAKLPQGYRVAGGTLGLVLALLCGLAVISAQLLG

SEQ ID NO: 10000 - DNA, 1188 bp, Shewanella oneidensis
  CDS (1)..(1188)
atgaattcaaaaatgttaggctcgatagccattgttgcaggcaccgctattggcgcgggaatgttagctttaccgctcgctacagcggccttaggtatggtacctgctattttgttgatggtagtgatttgggggctatcagcttatacctcattgttaatgcttgagattaaccttcgctctggcgtgggtgataatgtccatgcgattacaggcaaattactcggcaagaaaggccagatagtgcagggggcatcatttttgagtctgctggttgctttaacggctgcttatctaacggggggctcgtccctgttggtgcttaaagcccaaaatatgtttgacatagtgttagataaccaactggcggtggtgttatttaccattgtgctcggcggttttgcagcgttaggggtggcttgggttgataaagtctcacgctttttattttcgttgatgattttattgctaattgtcgtggtgctgtttctattacctgaagtcagtatttccaccatagcaactagtgcagtggcgcaatccttgaccagcagttggatggcggctatccccgtggtatttacttcctttggttttcacgtctgtatcgcgaccttagtacgttatttagatggcgataccgtgtctctgcgcaaggtgctattgattggttcaaccattccgctagcctgttatatcttctggttattggtgaccttaggtacggtaggcggcaacgaaattaatggctttaatggttctttacctgcgcttatcagtgcgttacaagagattgcccacacgcctttgatcagcaaatgtatttctctgtttgctgatttagccttaatcacttccttccttggcgttaccttaagcctatacgattttgtggctgagttaacccgtgccaagaagaccttcgtcgggcgggcgcaaacctggttattaacctttgtgccaccgctgttatgcgcactttatgtgccagaaggcttcgttgccgtattaggttttgccgctgtgccgttggtggtgatgattatcttcttgccaattgcgatggccctgcgtcagcgtcaaatacagcctcaaggatatcaggttgtaggcggcacatttgcgctcggtcttgccgggatcttgggggccattattattggtgctcagttatttgtcgcactctaa

SEQ ID NO: 10001 - protein, 395 aa, Shewanella oneidensis
MNSKMLGSIAIVAGTAIGAGMLALPLATAALGMVPAILLMVVIWGLSAYTSLLMLEINLRSGVGDNVHAITGKLLGKKGQIVQGASFLSLLVALTAAYLTGGSSLLVLKAQNMFDIVLDNQLAVVLFTIVLGGFAALGVAWVDKVSRFLFSLMILLLIVVVLFLLPEVSISTIATSAVAQSLTSSWMAAIPVVFTSFGFHVCIATLVRYLDGDTVSLRKVLLIGSTIPLACYIFWLLVTLGTVGGNEINGFNGSLPALISALQEIAHTPLISKCISLFADLALITSFLGVTLSLYDFVAELTRAKKTFVGRAQTWLLTFVPPLLCALYVPEGFVAVLGFAAVPLVVMIIFLPIAMALRQRQIQPQGYQVVGGTFALGLAGILGAIIIGAQLFVAL

SEQ ID NO: 10002 - DNA, 1227 bp, Pasteurella multocida
  CDS (1)..(1227)
atgaaaaagacgccttcaattttcggtggtgcctgtattattgccagtgtgtgtgtcggcgcgggtatgttagggttaccaagctcgggtgccggtgcttggacaatttggtctattttgacgatctgttttacgatgtttaccatgacaatttcaggttggttattattagaagcctacaagcattatgatctgcgtgcttcgtttaataccgtgaccaaaagcatgctcgggaattccgtcaatacgatcaataatcttgcagtttattttgtcggggggattttattgtatgcttatactaccgcgtctgggggtatcttaagtggacttgcggcaccgtattttgccttagattcacggatttggtcagtgatttttgtctttgttttttccttctttgtttggcattcaacgcgtattgttgaccgtgtttccgttttactgatcatctttatggcgctttcattcctttttagtgtctttggtttaaccgtaaatattgatttaagcactttatttgatacgaaaggtacagaatcacattatgcgatgtatgcaatgggattattacccgtggcattaacttcctttggctatcatcattcagttgcaacaatgcgagcttactatggtgatgagcgtaaagcgaaatatgcgatccttggcggtaccggtatcgcgttaactctttatctattatgggtggtatcgatttttgggaacttaccacgcgatcaattcgcaccagtgttagccagtgacggaaatttagatgtattacttggcgctttgggtaatgtgattgagtctgcttcagtcaaacaagcgattaatgcgttttcaattgcggcgattttatcttcatttattggtgtgggattaggggtgtttgatttcttagcagatttctttaaatttgataacagcaaagaaggacgtgcgaagtcttgggcggtaaccttcttaccaccactaattctttctgtcgcctacccactcggtttcttaaaagcgattggttatgctggcgcggtagccactatttggacttgtattatccctgccttattagcaagaaaatcacgtagcttaccaaatggacaaacgggctttatggtcggtggcggcaatattacgattgttgtggtcatggtatttggtattgtgactgcgttattccacttccttgccatgtttggcatgttacctgcatttaaagggtaa

SEQ ID NO: 10003 - protein, 408 aa, Pasteurella multocida
MKKTPSIFGGACIIASVCVGAGMLGLPSSGAGAWTIWSILTICFTMFTMTISGWLLLEAYKHYDLRASFNTVTKSMLGNSVNTINNLAVYFVGGILLYAYTTASGGILSGLAAPYFALDSRIWSVIFVFVFSFFVWHSTRIVDRVSVLLIIFMALSFLFSVFGLTVNIDLSTLFDTKGTESHYAMYAMGLLPVALTSFGYHHSVATMRAYYGDERKAKYAILGGTGIALTLYLLWVVSIFGNLPRDQFAPVLASDGNLDVLLGALGNVIESASVKQAINAFSIAAILSSFIGVGLGVFDFLADFFKFDNSKEGRAKSWAVTFLPPLILSVAYPLGFLKAIGYAGAVATIWTCIIPALLARKSRSLPNGQTGFMVGGGNITIVVVMVFGIVTALFHFLAMFGMLPAFKG

SEQ ID NO: 10004 - DNA, 1257 bp, Pasteurella multocida
  CDS (1)..(1257)
atgacaacaaaacaattgccttctcttttaggtggcgccatgattattgccggtacagcgatcggtgctggtatgttagccaatccaacggctacagcaggcgtttggtttatcggttctcttcttctattagcctacacttggttttgcatgaccacgtcaggcttaatgatccttgaagccaatttacactacccaacaggggcgagttttgacaccatcgtgaaagatttactcggcaaacgctggaatctcatcaatggcttatctatcgcttttgtattatatattttaacgtatgcttatatcacatctggtggtggcattacccaacatctcttaaatcaagttctcagccgccctgacaatacggtggaaattggacgtggcttggggtctttacttttttgttgcgtgctcgctggatttgtctggttatcgactaaagccgtggatcgttttaccactgtactgatcggtggcatgatcatcgcctttcttctttccacgagtggactcatggcttctgtcagaagtgatgtgcttttcaataatcttgcgcaaggggaaacacactatttaccttattttctcaccgcacttcctgtttgcttagtctcctttggctttcacggtaatgtaccaagcttagtaaaatactacgatcgtcatgctcaatctgtggtcaaagcaatcttcctcggtaccggtatcgccttcgtgatctatgcattttggcagcttgcggtacaagggaatttacctcgccatcaatttgcaccagtcattgaaaaagggggtgatattgctgccttactaaaagccttatcgcaatatatccaaaccgattacatgggcgtcgtacttaatttctttgcttatatggcgattgcaagctcatttttaggcgtcagtttgggtttatttgattaccttgcggacttattaaaatttgatgacagtagcttagggcgaactaaaaccacgttagtgacctttctgcctccgctcttactcagcttacaattcccttatgggtttgtcgtggcaattgggtatgcaggcttagccgccaccatttgggcagcgattgtcccagccctattagcgaaagccacacgccagcgtttcacggaatctcactatactgtttatggtggtaacttcatgatttattttgtgattttatttggtttgttaaatattttggcacaaattgctgctcaatttggtgttttaccgacatttttaggttaa

SEQ ID NO: 10005 - protein, 418 aa, Pasteurella multocida
MTTKQLPSLLGGAMIIAGTAIGAGMLANPTATAGVWFIGSLLLLAYTWFCMTTSGLMILEANLHYPTGASFDTIVKDLLGKRWNLINGLSIAFVLYILTYAYITSGGGITQHLLNQVLSRPDNTVEIGRGLGSLLFCCVLAGFVWLSTKAVDRFTTVLIGGMIIAFLLSTSGLMASVRSDVLFNNLAQGETHYLPYFLTALPVCLVSFGFHGNVPSLVKYYDRHAQSVVKAIFLGTGIAFVIYAFWQLAVQGNLPRHQFAPVIEKGGDIAALLKALSQYIQTDYMGVVLNFFAYMAIASSFLGVSLGLFDYLADLLKFDDSSLGRTKTTLVTFLPPLLLSLQFPYGFVVAIGYAGLAATIWAAIVPALLAKATRQRFTESHYTVYGGNFMIYFVILFGLLNILAQIAAQFGVLPTFLG

SEQ ID NO: 10006 - DNA, 1215 bp, Pasteurella multocida
  CDS (1)..(1215)
atgaataaaacattgggaagtactttgcttgtttcaggtaccatgatcggcgcagggatgttagcgatgcccttaacgtctgcgggaattggtttcacctttaccgtagttctgttacttgtcctttggttcttattgacatacagtgcattgttatttgttgaagcgtatcaaaccgtagaaagtgatgcggggattggttctctgagtgcggtctattttggtggttttggtcgatttatttctacagcagcattattgatctttttatatgccttgttagccgcgtatgtgacgggcggtggtggtttattgtcttctattctaccaacaattcaatcagccgaaacaacctctcacatttctattgtcattttcacgacagtttttggtgctttcattatcattggtacgcaaacagttgatggactaaatcgtcttttattttttaccatgttagttgcattgggtgctgtattatttttgttagtgcctgaagtaaaaatggataatttaatggcgatgccaattgataaagccctgttgatttctgccagtccggtcttttttacttcctttggttttcatggctcaatacctagcttgaataaatacctgggtgggaatattaaggcattacgtatttcgattttagtcggttcattcattacactgtgtggctatattttatggcaatttggtacgcatggggtgttaacacaatctgttttcttacagattttacaagatgaacctactttgaacgggctggtagccgctaccaaacaagtgacgggaagcagtgtcatttctggtgctgtgaaattattctcggctttggctttaattacttccttcttaggggttgctttagggctttttgagtgtattgaagacttgttaagccgcgtctttaaatttaaagcaggtcgtattacacttgggctactgacttttattccaccattattatttgctttattttatccaaaagggtttattctagccttagggtatgcaggacaaatgtttgctttttatgcggtagtattacctgcagcattagtgtggaaagtgagaaaattgcatccaaatctcccttatcgtgtatcgggtggttcagcattactggtcatttcggcggtattaggtgtgatcattacctcgatcccatttgcgattaaagcaggttatttacctgctgtcgtgggataa

SEQ ID NO: 10007 - protein, 404 aa, Pasteurella multocida
MNKTLGSTLLVSGTMIGAGMLAMPLTSAGIGFTFTVVLLLVLWFLLTYSALLFVEAYQTVESDAGIGSLSAVYFGGFGRFISTAALLIFLYALLAAYVTGGGGLLSSILPTIQSAETTSHISIVIFTTVFGAFIIIGTQTVDGLNRLLFFTMLVALGAVLFLLVPEVKMDNLMAMPIDKALLISASPVFFTSFGFHGSIPSLNKYLGGNIKALRISILVGSFITLCGYILWQFGTHGVLTQSVFLQILQDEPTLNGLVAATKQVTGSSVISGAVKLFSALALITSFLGVALGLFECIEDLLSRVFKFKAGRITLGLLTFIPPLLFALFYPKGFILALGYAGQMFAFYAVVLPAALVWKVRKLHPNLPYRVSGGSALLVISAVLGVIITSIPFAIKAGYLPAVVG

SEQ ID NO: 10008 - DNA, 1212 bp, Pasteurella multocida
  CDS (1)..(1212)
atgaaaaataaaacctttggaagcgcattattagttgcgggaaccaccatcggtgccggcatgcttgctatgccattaacctcggccgaaatgggctttacttacacgttaattctattatttatcctatggggactgctctcttatagtgcgttactttttgttgaagtttaccaaaaagcagaaaccaaaaatgctggaatcgctacccttgcggaacaatattttggcttaccgggacgtattttagctaccttatcacttgtcgtttttatgtacgcgattttatcagcctatgtcacagggggcggttcacttttagccggtgtccttccttttttaggtgagcatgccacaccaatttctatcgtttctttcacgattgtccttggggtatttattgtgatcagtacaggcgcagtagatatgctcacacgcttcctatttatgattaagttagtggcttttgtgtttgtcttattgatgatgttacctttggtcaatggcgataacttactggcaatgccattaaaagattttttaattatttctgccagtcccgtattttttacctcttttggtttccatgtcatcattccaagtattaacagctatttagacggcaatattcgtcgtttacgtattgcaattattacggggacagcgattcctttagtggcttacattatttggcaattagccactcatggtgttttcccacaagcccagttcgtacaaattttaaacactgaccctactttaaatggtttaatcacggcgacttaccaagctacagaaagcgctattatcagccatgcgatgcgtttattctttaccttagcactgattacgtctttcttgggtgtcgcgttatctttattcgattgtttatacgatttacttaaacgagtaaaaatcaaaacaaaccgtgtgtcgctaggtttacttaccttcttacccccattaatttttgcgttgttctaccctgagggttttgtcatggcattaggttatgcggggcaaatgtttaccttttacggtttagtattacctgttggcatggcatggcgtgctagaaaacgttatccggatctaccatatcgtgtcatgggaggcaaccttaccttattcggtgccttaatcttaggtatcttgattatgaatgtgcctttcttaatcaaagccggttatctccctgctgttattggttaa

SEQ ID NO: 10009 - protein, 403 aa, Pasteurella multocida
MKNKTFGSALLVAGTTIGAGMLAMPLTSAEMGFTYTLILLFILWGLLSYSALLFVEVYQKAETKNAGIATLAEQYFGLPGRILATLSLVVFMYAILSAYVTGGGSLLAGVLPFLGEHATPISIVSFTIVLGVFIVISTGAVDMLTRFLFMIKLVAFVFVLLMMLPLVNGDNLLAMPLKDFLIISASPVFFTSFGFHVIIPSINSYLDGNIRRLRIAIITGTAIPLVAYIIWQLATHGVFPQAQFVQILNTDPTLNGLITATYQATESAIISHAMRLFFTLALITSFLGVALSLFDCLYDLLKRVKIKTNRVSLGLLTFLPPLIFALFYPEGFVMALGYAGQMFTFYGLVLPVGMAWRARKRYPDLPYRVMGGNLTLFGALILGILIMNVPFLIKAGYLPAVIG

SEQ ID NO: 10010 - DNA, 1499 bp, Klebsiella pneumoniae
  CDS (294)..(1370)
ggatcctggataggtaacgaacacctcgccattacgatgtgcaaaaaactgcacgatcccggcttcgccacgacagtggtgatgtatccaaccgttgaggaaggacacgccattctgcgttgcgcattgtctgcgcttcatgagagcggccaaatcgacgacttccataaaaacttcagtgaatcactggctgaagccacaaaataaatagctactgccggcctgcttcgtcaggccgcttacggacattcgctatataaggaacaaatttcccgctacggggaacgtctcttatggtggcgaccattatcggtggaggcatgttcgcgttgccggttgctttcgtcaacgtgtggtttataaagggccttctggtcctgtcggtaacaggcatattgatgctgattacagggttgatcctcgtcgacattacgatgcgctttcctcctggcgccagttttcataccttcacccatgccctgctcggacccgctgccagcgtaatcatcggcgtggctttctgtttcgtactttatttactgacctacgcgtacatatcaggcgcagcatcgatagtgtgggatctccttcctcccgatattgctggccgcagctggctgccgatcattttgctgtcgctgacgacctcgctgattctgtgggccggcggcaaattgcccggttttctcctctccggccttatcgccgccaaattcaccctttttctcctgctgttcgccggtgccgcaggaggcgtaaaagtactcagattactcgacttcgccggcagcacgccgctccagtattacctgccgatcgtaccggtctgcgttatcgcttttggatttcatggcagcgtcccctctctgacaagaatgtaccggggggataatcatcgtgcggtcctccgctctctctattacggtttcgccgtttcattaactgtctacgccttctggctgacgctcacgatgggcgcgctcacgcctcaggctatccggcatgtcagcgatgaaggcgggaatatgggcgcctttatcacggccctcaatatccacaggaccgcctcagctaccagtctgatactggtcgcctttgggtgtattgccgttttagcttcactgatgtcggcttcaatcggcttaagtgattatcttgaagatacactgaacaaaattaactgtccagtgctcacgcccgctggcaatatttctgacttatttccctcctgcactggcctgtattattgctccgcaaggttttttgtctgccttgtcctttgcagggatatcactggtattatggagtattatactccccccttatttactcatcaaagccaggcgttccactctgcctccggtatataactttccgggaaacaatcccttcctgaaaataattattgttaccggagtcatactctggctattgatgatttacgcttttctttaataacaattcgtctcattcacaactgactttgcaaggaaattatt

SEQ ID NO: 10011 - protein, 358 aa, Klebsiella pneumoniae
MVATIIGGGMFALPVAFVNVWFIKGLLVLSVTGILMLITGLILVDITMRFPPGASFHTFTHALLGPAASVIIGVAFCFVLYLLTYAYISGAASIVWDLLPPDIAGRSWLPIILLSLTTSLILWAGGKLPGFLLSGLIAAKFTLFLLLFAGAAGGVKVLRLLDFAGSTPLQYYLPIVPVCVIAFGFHGSVPSLTRMYRGDNHRAVLRSLYYGFAVSLTVYAFWLTLTMGALTPQAIRHVSDEGGNMGAFITALNIHRTASATSLILVAFGCIAVLASLMSASIGLSDYLEDTLNKINCPVLTPAGNISDLFPSCTGLYYCSARFFVCLVLCRDITGIMEYYTPPLFTHQSQAFHSASGI

SEQ ID NO: 10012 - DNA, 1251 bp, Erwinia herbicola
  CDS (1)..(1251)
atggttattaagaaaacaacacccggtttaatgagtggaacgatgcttatcattgccaccgtcataggtggcggaatgttctcactgccgattgctatggctggcatatggttcccaggcgcatcaattattttaacgctcattgccataatgatgctgttaaccggactgatgctggttgaagtcaatctccattatggcggtggtgcgagttttaacaccttcacacaggatttattaggtcataaatggaatgttgtggtgggtatcgcatttggctttgtcttgtatattttaacttatgcttatatttctggctcttctgctgtcatctctcagacggtagaaaaatacagcggattttatcttccagcccgcttatctgtgatcatcgtaagcgtgttggtcggtggcatcgcatggtacagctcgcttttggttggccgtattacaacggtgttaattatcgggaagtttgttgccttttttgctaccttctctggcctgatatggcatgtcgaaggcgctaaacttattgacagtgccgcctgggcgctgcctgatacgcaatatctgccatatattttaatgacgctacctttctgcatcatctcttacggtttccacggcaacgtgcccagtctggtgaagctgtatggcactcagggggttaagaatatcacccggtcgatttttattggcacggctttcgctctgctgctttacatattctggttggtcgtcaccatgggcaatatcagccgcgccgatttttcgcccattatcgccaaaggggggaatattgatgtatttgtcgaggcaatagggggcttatttaccagcacgtctatggatctgatcctcactttctttggtaattttgcggtagccagttcattgctagccgcgacgctggggcttttcgattatattgccgatctgtttcatttttcagacgaccgttctggccggtttaagacggccctggtaacgtatttgccacccgctgtcgtttgtttcatcctgcccggtggctttgtctatgcaattggctatgccggtctggcctttacgatctggagcgttattctgccgccttttcttgtgaaagcggcccgcaagcgttttcccactgcagtctataccgcaccctgtaataacatgatccttaatctggttatcgtggtggggggattcgtttacctgacggtggtacttgatgtattccggctgctgccttcgtttagctaa

SEQ ID NO: 10013 - protein, 416 aa, Erwinia herbicola
MVIKKTTPGLMSGTMLIIATVIGGGMFSLPIAMAGIWFPGASIILTLIAIMMLLTGLMLVEVNLHYGGGASFNTFTQDLLGHKWNVVVGIAFGFVLYILTYAYISGSSAVISQTVEKYSGFYLPARLSVIIVSVLVGGIAWYSSLLVGRITTVLIIGKFVAFFATFSGLIWHVEGAKLIDSAAWALPDTQYLPYILMTLPFCIISYGFHGNVPSLVKLYGTQGVKNITRSIFIGTAFALLLYIFWLVVTMGNISRADFSPIIAKGGNIDVFVEAIGGLFTSTSMDLILTFFGNFAVASSLLAATLGLFDYIADLFHFSDDRSGRFKTALVTYLPPAVVCFILPGGFVYAIGYAGLAFTIWSVILPPFLVKAARKRFPTAVYTAPCNNMILNLVIVVGGFVYLTVVLDVFRLLPSFS

SEQ ID NO: 10014 - DNA, 25 bp, artificial sequence
  primer
atgaaaaacagaaccctgggaagtg

SEQ ID NO: 10015 - DNA, 24 bp, artificial sequence
  primer
ttaccccacttctggtaacaaccc

SEQ ID NO: 10016 - DNA, 777 bp, Escherichia coli K12
  CDS (1)..(777)
atgctggcaaaacgcataattccatgtctcgacgttcgtgatggtcaggtggtaaaaggcgtacagtttcgcaaccatgaaatcattggcgatatcgtgccgctggcaaaacgctacgccgaagaaggtgcagacgaactggtgttctacgatatcaccgcttccagcgatggccgtgtggtagataaaagttgggtatctcgcgtggcggaagtgatcgacattccgttctgcgtggcgggtgggattaagtctctggaagatgccgcgaaaattctttcctttggcgcggataaaatttccatcaactcccctgcgctggcggacccgacgttaattactcgcctggcggatcgatttggcgtgcagtgtattgtggtgggtattgatacctggtacgacgctgaaaccggtaaatatcatgtgaatcaatataccggcgatgaaagccgcacccgcgtcactcagtgggaaacgctcgactgggtacaggaagtgcaaaaacgcggtgccggagaaatcgtcctcaacatgatgaatcaggacggcgtgcgtaacggttacgacctcgaacaactgaaaaaagtgcgtgaagtttgccacgtcccgctgattgcttccggtggcgcgggcaccatggaacacttcctcgaagccttccgcgatgccgacgttgacggcgcgctggcagcttccgtattccacaaacaaataatcaatattggtgaattaaaagcgtacctggcaacacagggcgtggagatcaggatatgttaa

SEQ ID NO: 10017 - protein, 258 aa, Escherichia coli K12
MLAKRIIPCLDVRDGQVVKGVQFRNHEIIGDIVPLAKRYAEEGADELVFYDITASSDGRVVDKSWVSRVAEVIDIPFCVAGGIKSLEDAAKILSFGADKISINSPALADPTLITRLADRFGVQCIVVGIDTWYDAETGKYHVNQYTGDESRTRVTQWETLDWVQEVQKRGAGEIVLNMMNQDGVRNGYDLEQLKKVREVCHVPLIASGGAGTMEHFLEAFRDADVDGALAASVFHKQIINIGELKAYLATQGVEIRIC

SEQ ID NO: 10018 - DNA, 768 bp, Campylobacter jejuni
  CDS (1)..(768)
atgcttacaaaacgcataattgcatgtttagatgtcaaagatggcagagtagtaaaaggaacacaatttaaaaaccataaagatatgggagatatcatagagcttgctaggtattattctcaaaatggtattgatgagcttgttttttatgatattgctgcaagtgctagaaaagaacgcatatcaagagaatgggtaagtgaagtagcaaaaaatatcaatatttctttttgtgttgcagggggtattaaaagcgaagaagatgcagctgaacttttggctaatggggcagataaaatttctatcaattctcctgctttaaatgatccaagcctaatcacacgccttgctaaaagctttggcgtgcaatgcgtagtagtagggattgatagttttaaagatgaaaatggaaatttaaaagtatttcaatacacaggggatgaaaaaacaagtaaacatagtggaaaaagcactttagaatgggttaaaaaagtgcaagatctaggtgcaggcgaaattgttttaaatatgatgaatcaagatggtgttaaaaatggctatgatttagaacaattagaagctgtatataaaatttgtaaagtacctttaatcgcaagtgggggagcgggaaaaatggaacattttttagaagcttttaaactaggtatagatggggctttagctgcttctgtttttcatcaaaaacttatagacattaaagaattaaaaatttatcttaaaaatcaaggcttaagtataaggatataa

SEQ ID NO: 10019 - protein, 255 aa, Campylobacter jejuni
MLTKRIIACLDVKDGRVVKGTQFKNHKDMGDIIELARYYSQNGIDELVFYDIAASARKERISREWVSEVAKNINISFCVAGGIKSEEDAAELLANGADKISINSPALNDPSLITRLAKSFGVQCVVVGIDSFKDENGNLKVFQYTGDEKTSKHSGKSTLEWVKKVQDLGAGEIVLNMMNQDGVKNGYDLEQLEAVYKICKVPLIASGGAGKMEHFLEAFKLGIDGALAASVFHQKLIDIKELKIYLKNQGLSIRI

SEQ ID NO: 10020 - DNA, 774 bp, Xylella fastidiosa
  CDS (1)..(774)
atgttgagccgccgcctcattccatgcttggacgtgcgtgatggacgcgtggtgaaaggcgtgaagtttcgtgaccacgtggatatgggcgatatcgtcgaactggccttgcgttaccgtgatcatggcgctgatgagttggtgttttatgacatcggcgccagtccacgagggcgttctgtggattaccgttgggttgaacgcgtcgcgcgcctgatcgacattccattttgtgtggccggtggtatcggccaggttgagactgcccgtgctgtcttgcatgccggtgccgataagatttcgatcaactcaccggcactgcgccaacctgcgctgattagcgccttagccgaagcctttggggtgcaatgcgtcgtcgtcggcattgattcgatccgtgaggccgatggtcagtggcgcgtccgctgcaataccggggatccagataaaacccaagccttgccgctgcgcaccctggattggattgttgaggcgcagcgcctaggggcaggggagatcgtattaaattgcatggacagcgacggggtgcgctgtggttacgacattgcacagctgtctcaggcgcgggcactgtgtcaggtgcccttggtggcttctggcggcgccgggaacatgcagcattttgcggatgtatttcacaaggctgatgttgatggtgcattggcggccagcgtattccatagcggcgcgattttgattccgggtttaaaacagtttctgcgtgagcagcaaatcgaggtccgcgatgtgtaa

SEQ ID NO: 10021 - protein, 257 aa, Xylella fastidiosa
MLSRRLIPCLDVRDGRVVKGVKFRDHVDMGDIVELALRYRDHGADELVFYDIGASPRGRSVDYRWVERVARLIDIPFCVAGGIGQVETARAVLHAGADKISINSPALRQPALISALAEAFGVQCVVVGIDSIREADGQWRVRCNTGDPDKTQALPLRTLDWIVEAQRLGAGEIVLNCMDSDGVRCGYDIAQLSQARALCQVPLVASGGAGNMQHFADVFHKADVDGALAASVFHSGAILIPGLKQFLREQQIEVRDV

SEQ ID NO: 10022 - DNA, 756 bp, Pseudomonas aeruginosa
  CDS (1)..(756)
atggtccggaggcgcgttatcccatgcttgctgctcaaggatcgcggtctagtgaaaaccgtgaagttcaaggagcccaagtacgttggagacccgatcaacgcaatacgcatcttcaatgagaaagaagtcgacgaactgattttgctggatatagatgcttccaggctcaatcaagagcctaactatgagttgatcgcggaagtggctggtgagtgttttatgcctatttgctatgggggcggtatcaagacattggagcatgcggaaaaaatcttttccctaggtgtcgaaaaagtttcgataaataccgccgctcttatggatctttcgttgattcgaagaattgccgataagtttggttcgcaaagcgtagttggctctatcgactgccgcaagggtttctggggaggacactccgtgttctcagagaatgggacgcgcgacatgaaacgctccccattggagtgggcgcaagcgctcgaagaggctggagtgggtgagatttttctaaattctattgatcgagatggagtgcagaaaggcttcgacaacgctctagtggaaaatatcgcttctaacgtccatgtgccagtgatcgcctgtggtggagctggctccatcgctgacctcatcgatctttttgagcgtacgtgtgtgtcggcagtagcggcgggaagcctattcgttttccatggcaagcatcgtgcggtactgattagttatccggatgtcaacaagctcgacgtcggttag

SEQ ID NO: 10023 - protein, 251 aa, Pseudomonas aeruginosa
MVRRRVIPCLLLKDRGLVKTVKFKEPKYVGDPINAIRIFNEKEVDELILLDIDASRLNQEPNYELIAEVAGECFMPICYGGGIKTLEHAEKIFSLGVEKVSINTAALMDLSLIRRIADKFGSQSVVGSIDCRKGFWGGHSVFSENGTRDMKRSPLEWAQALEEAGVGEIFLNSIDRDGVQKGFDNALVENIASNVHVPVIACGGAGSIADLIDLFERTCVSAVAAGSLFVFHGKHRAVLISYPDVNKLDVG

SEQ ID NO: 10024 - DNA, 720 bp, Clostridium acetobutylicum
  CDS (1)..(720)
atgataattttaccggcaatagatataaagcagggaaaatgtgtaagactttatcaaggaagatttgaaaaatcaagtgtcgttgcggaaagtccagcattaacggcaaagtcttttgaaaatgatggagcaaaatatatacatgtggttgatttagatggtgctttagaaggggaaattataaacttagatgctgttaaaagtatagttcaggttaccagtgttcccatagaattaggtggaggaataagaaatataaaggttgttgaaaaacttataaatataggtgttaaaagaataatattaggaacggctgctcttaaggataaagaatttacaagagaagctataaaggaatatggtaagagtatagcagttggaatagatgcaaaagatggatatgttgcagtaaatggatggcttaatgtgagcaaaataaactacatagagtttgcaaaaataatggaggatatgggcacagaagatataattctaacagatataagtaaggatggaacgttaaagggacctaattttgatatgcttaaaaaactacaggaaaatgtaaactgtaatataacagcttcaggtggaataaaggatttagatgatcttattaaattgaaagaaatgaatatatacggagctattgttggaaaagcaatatatagcgaaaaaattaatcttaaggaagccatagctgtaatagaaaagaggtga

SEQ ID NO: 10025 - protein, 239 aa, Clostridium acetobutylicum
MIILPAIDIKQGKCVRLYQGRFEKSSVVAESPALTAKSFENDGAKYIHVVDLDGALEGEIINLDAVKSIVQVTSVPIELGGGIRNIKVVEKLINIGVKRIILGTAALKDKEFTREAIKEYGKSIAVGIDAKDGYVAVNGWLNVSKINYIEFAKIMEDMGTEDIILTDISKDGTLKGPNFDMLKKLQENVNCNITASGGIKDLDDLIKLKEMNIYGAIVGKAIYSEKINLKEAIAVIEKR

SEQ ID NO: 10026 - DNA, 759 bp, Staphylococcus aureus
  CDS (1)..(759)
atgattaaaaaacgtatcattccatgtttagatgtcaaagatggtcgtgtcgttaaagggattcaatttaaaggattaagggatatagggaatcctgttgatttagcaatatattacaatgaagcgggtgctgatgaattagtatttttagacatctctaagacggaagagggtcatagcttaatgctagaagtgattgaacagacagcgtcacgcttgtttatccctcttactgtagggggtgggattcaaagtctcgatgatattacccaattgttaaatcatggtgcagataaagtatcattaaattcaagtgctttaaaaaatccacagctcattaaacaagcgagtgataaattcggtagacaatgcatctgtatagcaattgatagctattatgatcctgaaagaaaagcacattattgttgtacgcatggtggtaaaaaaatgacaaatattaaagtatatgactgggtacagcaagtagaacagttaggtgcaggtgagctcctcgttacaagtatgggacatgatggtatgaaacaaggatttgatattgagcatcttgcaaaaataaaatcccttgtaaatattccaatcattgcttctggtggtggtggcaatgcacaacactttgtagaactatttaatcagacggatgtttctgcaggtttagctgcaagtatattacatgaccgagaaacgacggttcaatcaattaaagaagtgatacggcaagggggtatagcagtaagatga

SEQ ID NO: 10027 - protein, 252 aa, Staphylococcus aureus
MIKKRIIPCLDVKDGRVVKGIQFKGLRDIGNPVDLAIYYNEAGADELVFLDISKTEEGHSLMLEVIEQTASRLFIPLTVGGGIQSLDDITQLLNHGADKVSLNSSALKNPQLIKQASDKFGRQCICIAIDSYYDPERKAHYCCTHGGKKMTNIKVYDWVQQVEQLGAGELLVTSMGHDGMKQGFDIEHLAKIKSLVNIPIIASGGGGNAQHFVELFNQTDVSAGLAASILHDRETTVQSIKEVIRQGGIAVR

SEQ ID NO: 10028 - DNA, 774 bp, Nostoc sp. PCC 7120
  CDS (1)..(774)
atggatgtaattccagcaattgatttactagcaggtcgttgtgtgcgactctatcagggagactacgatcgctcacaagtgtttagcgaaaatcctgttgatgttgctaaacagtgggtagatgagggtgcaacacgtctgcacatagtagatttagatggtgcaaaagcaggtaaagtagtaaatctaggagcaattgaagcgatcgctcaagctatttctataccgattgaaattggtggcggattgcgcgatcgttctagtgtggaacaggtgtttaatttaggtgtacagtgggcaattctcggtactgtcgccgtagaacaaccccagcttgtacaagaactctgtcaacaataccccggacaaattattatcggtattgatgcccgtaacggactagtagctactcgtggttggttggaaacatctgaggttttagccactcaattggctatacagatgcaggaaatgggtgcagcagccatcatttatacagatatccaccgtgacgggactcttgcaggcccgaatttagacgcactacgagaactagcagcagccatttccatccctgtgattgcatctggtggggtgagttctgtcaccgatttgttgagtttgttggcgttggaaccccaaggcgtgacaggtgtgattgtgggacgtgcattgtatacgggtgatattagcttaaaagaggcattgcaggcgatcggcccaggacgtattcaagacataccaccgaatttagacttctcttcctttgcttaa

SEQ ID NO: 10029 - protein, 257 aa, Nostoc sp. PCC 7120
MDVIPAIDLLAGRCVRLYQGDYDRSQVFSENPVDVAKQWVDEGATRLHIVDLDGAKAGKVVNLGAIEAIAQAISIPIEIGGGLRDRSSVEQVFNLGVQWAILGTVAVEQPQLVQELCQQYPGQIIIGIDARNGLVATRGWLETSEVLATQLAIQMQEMGAAAIIYTDIHRDGTLAGPNLDALRELAAAISIPVIASGGVSSVTDLLSLLALEPQGVTGVIVGRALYTGDISLKEALQAIGPGRIQDIPPNLDFSSFA

SEQ ID NO: 10030 - DNA, 777 bp, Yersinia pestis
  CDS (1)..(777)
atgctggcaaaacgtataattccttgtctggatgtgaaagacggccaggtcgttaaaggtgttcagttccgcaatcatgagatcatcggcgatatcgtgcctttggcgcagcgctatgctcaagaaggggctgatgagttggtgttttacgatatcactgcctcatccgatggccgtgtcgtcgataaaagctgggtagcgcgggtcgcagaagtgatcgatatccctttctgtgtggccggggggatcaaaagtgtcgaagatgcaagccagatcctgacattcggtgcggataaaatctcaatcaactctcccgcattggcagacccaacactcattacccgcttggctgaccgctatggcgtacaatgcatcgtggtgggaattgatacctggtatgacaccgaaagcgacagctatcaggtttaccagtttaccggtgatgagaagcgtaccaaagccaccacgtggcaaaccgaagattgggtcaaagaggtccagttacggggagccggtgagattgtattaaatatgatgaatcaggacggcgtccgtaacggctatgatttgcgtcagcttcaacagatgcgtgctatttgccacgttccgttaatcgcctctggcggtgccgggacaccggatcacttccttgaagccttccgcgacgcggatgttgatggcgcgctggcggcatcggtattccataaacaaatcattaatatcggcgaattgaaaaagtatttgtctgaacagggcgtggagataagagtgtgttaa

SEQ ID NO: 10031 - protein, 258 aa, Yersinia pestis
MLAKRIIPCLDVKDGQVVKGVQFRNHEIIGDIVPLAQRYAQEGADELVFYDITASSDGRVVDKSWVARVAEVIDIPFCVAGGIKSVEDASQILTFGADKISINSPALADPTLITRLADRYGVQCIVVGIDTWYDTESDSYQVYQFTGDEKRTKATTWQTEDWVKEVQLRGAGEIVLNMMNQDGVRNGYDLRQLQQMRAICHVPLIASGGAGTPDHFLEAFRDADVDGALAASVFHKQIINIGELKKYLSEQGVEIRVC

SEQ ID NO: 10032 - DNA, 786 bp, Brucella melitensis
  CDS (1)..(786)
atgactttgaaagcaagagtgattccctgtctcgatgtgaaagatggccgcgtcgtcaaaggtgtgaacttcgttgatctgatcgatgccggtgatccggtggaagccgcccgcgcctatgatgcggcaggcgccgacgaattgtgctttctcgacatcacggcgtcttcggacaatcgcgagacaattttcgatgtggtggcgcgtacagccgaacagtgcttcatgcccttgaccgttggtggcggggttcgccaggtggccgatatccgcaagcttcttttggcgggagccgacaaggtgtcgatcaataccgcagcggtgaagaacccggaattcgtggcggaagccgccgacaagtttggcaatcaatgcattgttgtcgccatcgatgcgaaaaaggtttccggcgcgggtgaaaatgatcactgggaaatcttcacccatggcgggcggcagccgaccggcatcgatgcggtggaatttgcacagaaggtcgtggaccttggcgcaggcgaaatcctgctcacctccatggaccgcgatggcaccaaggcggggtacgacgtggcgctgacccgcgccgtggccgatagcgtgcgcgcgccggtcatcgcatcgggcggcgtcggcactctcgatcatctggtggcgggcattcgcgatggccatgcgacggcggttctcgccgcttcgattttccacttcggcacctatacgatcggcgaggccaagcgctatatggccgaagccggcattccgatgcggctcgatccggtccgttga

SEQ ID NO: 10033 - protein, 261 aa, Brucella melitensis
MTLKARVIPCLDVKDGRVVKGVNFVDLIDAGDPVEAARAYDAAGADELCFLDITASSDNRETIFDVVARTAEQCFMPLTVGGGVRQVADIRKLLLAGADKVSINTAAVKNPEFVAEAADKFGNQCIVVAIDAKKVSGAGENDHWEIFTHGGRQPTGIDAVEFAQKVVDLGAGEILLTSMDRDGTKAGYDVALTRAVADSVRAPVIASGGVGTLDHLVAGIRDGHATAVLAASIFHFGTYTIGEAKRYMAEAGIPMRLDPVR

SEQ ID NO: 10034 - DNA, 756 bp, Listeria monocytogenes
  CDS (1)..(756)
atgcttactaaacgaatcatcccatgtcttgatgtcacagcaggtcgagttgtcaaaggtgttaattttgtttccttaacagatgtcggtgaccccgtcgaaattgctaaagcttataatgaagctggtgccgatgagctcgtttttcttgatatcacagcaactgtcgaactccgtcaaactatgatagatgttgtggaacgaactgccgagcaagtttttattccactcacagttggtggaggtatcagtagtgtttctgacatgaaagaactccttcaagctggtgccgacaagatttcgctcaattccgccgccatcaaacggccagaactcatccaagaaggagcagcaaaattcggaaaccaatgtatcgttgtcgcaattgatgccaaatggaatggcacaaactggagcgtcttcaccagaggcggtcgaaatgataccggacttgatgctattgaatgggccaaaaaagcagtccaactcggtgctggtgaaattctactaacaagcatggacggtgatggtaccaaaaacggctacgatatcccgctcacaaaagcaatttcagaagcagtttccgtcccagtcattgcttcgggcggctgtggtaatgccgcacatatggttgaagtttttgaaaaaacaaaggcaaccgccgcgctcgctgcaagcatttttcactacggcgaactaagcatcaaaaatgtcaaaacaaccttactcgaaaaaggagtgaatatccgtccatga

SEQ ID NO: 10035 - protein, 251 aa, Listeria monocytogenes
MLTKRIIPCLDVTAGRVVKGVNFVSLTDVGDPVEIAKAYNEAGADELVFLDITATVELRQTMIDVVERTAEQVFIPLTVGGGISSVSDMKELLQAGADKISLNSAAIKRPELIQEGAAKFGNQCIVVAIDAKWNGTNWSVFTRGGRNDTGLDAIEWAKKAVQLGAGEILLTSMDGDGTKNGYDIPLTKAISEAVSVPVIASGGCGNAAHMVEVFEKTKATAALAASIFHYGELSIKNVKTTLLEKGVNIRP

SEQ ID NO: 10036 - DNA, 756 bp, Listeria innocua
  CDS (1)..(756)
atgcttactaaacgaatcatcccatgccttgatgttacagctggacgcgtagttaaaggagttaattttgtttcattaaccgatgtaggtgatccagtcgaaattgccaaagcttataatgaagctggagccgatgaacttgttttcctcgatattactgcaactgttgaactacgccaaacgatgatagatgttgtggaacgaacggcagaacaagtttttattccactgacagttggtggaggtataaatagcgtgaacgatatgaaagaattacttcaagcaggagcagacaaaatatcgcttaattccgccgcaataaaaagacccgaacttatccaagaaggtgctaacaaatttggaaaccaatgcattgtagtcgcaattgacgctaaatggaacggctccaattggcatgttttcactcgaggtggacgagatgacactggtttagatgccattgaatgggccaaaaaagcgactcaacttggcgccggtgagattctgttaacaagcatggacggtgatggtacgaaaaacggatatgacattccactcacaaaagcaatttccgaagctgtctccgtcccagttatcgcttcaggaggatgcggtaatgcgagccatatggtagaagtttttgaacaaacaaacgcaaccgccgcactcgctgccagtattttccattacggtgaacttagtatcaaaaacgtcaaaactactttacttgaaaaaggagtgaacattcgcccatga

SEQ ID NO: 10037 - protein, 251 aa, Listeria innocua
MLTKRIIPCLDVTAGRVVKGVNFVSLTDVGDPVEIAKAYNEAGADELVFLDITATVELRQTMIDVVERTAEQVFIPLTVGGGINSVNDMKELLQAGADKISLNSAAIKRPELIQEGANKFGNQCIVVAIDAKWNGSNWHVFTRGGRDDTGLDAIEWAKKATQLGAGEILLTSMDGDGTKNGYDIPLTKAISEAVSVPVIASGGCGNASHMVEVFEQTNATAALAASIFHYGELSIKNVKTTLLEKGVNIRP

SEQ ID NO: 10038 - DNA, 723 bp, Listeria monocytogenes
  CDS (1)..(723)
atgcaaatcttcccagcaatagatttaaaaaatggacaatgtgtccgtcttttccaaggcgacttttctaaaaaaacagttgtcaatgaagacccgattgcccaagcaaaagcatttgcaacagatggcgcgacttacctgcatatcgttgaccttgacggcgcattagaaggacgccccatcaacctagaagtcatccaaaaaatgaaaataacagccaaaatacccgtacaagttggtggaggaattcgtagcatggcgcaagtggattattacctcgagtccggcatcgaccgagtgattatcggttctgccgctctaacagatccagatttcctacgtgcggcagttcaaaaatatggagctaaaatcgcagcaggtatcgatgccaaaaacggttttgtcgcaacaagaggttggctcgatgtcagtcaggtaagctatttagatttggctaaacgaatggaaaaagtgggtgttgagacaatcatttacactgatattagccgtgatggtacgctaactggacctaatttagaacaaatggctaatcttaaagaacacgttaaagttaatttaattgcatctggtggagtgagcagtcgcgcagatttggaagcactcgcccaactcggcttatacggagcaattgccggaaaagccctttataatcatcatatttctatgtcagatattgtagaggtggaacaaattgcttactaa

SEQ ID NO: 10039 - protein, 240 aa, Listeria monocytogenes
MQIFPAIDLKNGQCVRLFQGDFSKKTVVNEDPIAQAKAFATDGATYLHIVDLDGALEGRPINLEVIQKMKITAKIPVQVGGGIRSMAQVDYYLESGIDRVIIGSAALTDPDFLRAAVQKYGAKIAAGIDAKNGFVATRGWLDVSQVSYLDLAKRMEKVGVETIIYTDISRDGTLTGPNLEQMANLKEHVKVNLIASGGVSSRADLEALAQLGLYGAIAGKALYNHHISMSDIVEVEQIAY

SEQ ID NO: 10040 - DNA, 723 bp, Listeria innocua
  CDS (1)..(723)
atgcaaatcttcccagcaatagatttaaaaaatggacaatgcgtccgacttttccaaggtgatttttccaaaaaaataattgtaaatgaagatccgattgcccaagctaaatcatttgctaaaagtggcgccacctatttgcacattgttgatttagacggagctttagaaggtcgtcccgttaatctagaaattatccaacaaatgaaaaaagctgcaaaggtgccggtccaagttggtggcggtattcgtagtatggcgcaaattgattattaccttcagtccggtattgaccgagttattatcggttcagctgcactaacagacccagactttttacaggcagcagtgaaaaaatacggctctaaaatcgcagctggcatcgatgcaaaaaacggctttgttgcgacgagtggttggttaaatatcagtcaagtaagctttttagatttagccaaacaaatggaagcgatggatgttgaaaccattatttatacagatattagccgcgatggcacgctaactggtccgaatttagaacagatggccgcacttcaaaaacacgttacaatcaatttaattgcctctggtggcgttagcagtcgcgctgatttagaagcccttagtgaactcggattatacggagcaattgctggaaaagccctttacaacggaaatatttcgatgtcagacatagtggaggtggaacaaagtgcttactaa

SEQ ID NO: 10041 - protein, 240 aa, Listeria innocua
MQIFPAIDLKNGQCVRLFQGDFSKKIIVNEDPIAQAKSFAKSGATYLHIVDLDGALEGRPVNLEIIQQMKKAAKVPVQVGGGIRSMAQIDYYLQSGIDRVIIGSAALTDPDFLQAAVKKYGSKIAAGIDAKNGFVATSGWLNISQVSFLDLAKQMEAMDVETIIYTDISRDGTLTGPNLEQMAALQKHVTINLIASGGVSSRADLEALSELGLYGAIAGKALYNGNISMSDIVEVEQSAY

SEQ ID NO: 10042 - DNA, 780 bp, Nostoc sp. PCC 7120
  CDS (1)..(780)
atgttatctaaaagaatcttaccttgtttagatgtgaaggcgggacgggtagttaaaggagttaactttgttgatcttaaggatgctggcgatcctgtagaactggcgaaggtttacaacgatgctggggctgatgagttagtgtttctggatattacggctactcatgaagaccgagatactatcattgacgttgtttaccggactgccgagcaggtctttattcccctgactgtaggtggtggtattcaatccttagaaaatgttaaagctttgttacgcgctggggcagacaaggttagtattaactctgcggcggtacgtgacccagaattaattgatcgagcgagcgatcactttggtaatcagtgcattgttgtagcaattgatgctagacgcagagtagatcctagtaatcccggctgggatgtttacgtgcgtggtggtagggaaaacactggtttagatgccttatcatgggcgaaggaagtagaaaagcggggtgcaggagaactattggtaacaagtatggatgctgatggtactcaagccggttatgatatcgagttaacacgggcaattgctgagtcagtagaaataccagtcgttgcctccggtggtgcgggtaactgtgaacatatatacactgccttaactgaagggaaagcggaagctgcgttattggcatcgctgctacattatggtcaactcagcgtggctgaaattaagaattatttgcacgagagccaagttcctgtccgcttatacacacagttctaa

SEQ ID NO: 10043 - protein, 259 aa, Nostoc sp. PCC 7120
MLSKRILPCLDVKAGRVVKGVNFVDLKDAGDPVELAKVYNDAGADELVFLDITATHEDRDTIIDVVYRTAEQVFIPLTVGGGIQSLENVKALLRAGADKVSINSAAVRDPELIDRASDHFGNQCIVVAIDARRRVDPSNPGWDVYVRGGRENTGLDALSWAKEVEKRGAGELLVTSMDADGTQAGYDIELTRAIAESVEIPVVASGGAGNCEHIYTALTEGKAEAALLASLLHYGQLSVAEIKNYLHESQVPVRLYTQF

SEQ ID NO: 10044 - DNA, 735 bp, Lactococcus lactis subsp. lactis
  CDS (1)..(735)
atgctaactaaaagaatcatcccttgtcttgatattaaaaatggtaaggttgttaaaggaatcaattttgtgggtttaagagaaataggtgatccagtggaattggccaaaatatatgaagaacagtgtgcagatgaaattgtttttcttgatattacagcatcttttgaagaacgtgaaattattggtgaattaattggtcgggcggcgcgtgaactttcaattccattaaccgttggtggaggaattcgttcaattgacgattttagaagaattcttgctagaggagctgataaagtatccgtcaactcagctgcaattgaaaatcctgaacttattcgtcaagcggctaacgaatttggcgttcaatgtgttgttgttgctattgatgctaaaaaacgagcagaccataggggatatgatgtctatatcaaaggtgggcgtgaaaatgcaggtcttgacttagttgattgggctaaaaagtgtgaaagattaggagcaggcgaaattttactaacctcaatggataaggatggaacaaagacaggctacgatttggaaatgctgaatgacgtttgtactgctgttaatattcctgttgtagcaagtggcggttgtggcaagatttcggacattgttgaagtttttcaaaatacaagaagcgatgctgccctttttgcttcattatttcattatggcgaagaacagttgatgaagttaaagacgaacttataa

SEQ ID NO: 10045 - protein, 244 aa, Lactococcus lactis subsp. lactis
MLTKRIIPCLDIKNGKVVKGINFVGLREIGDPVELAKIYEEQCADEIVFLDITASFEEREIIGELIGRAARELSIPLTVGGGIRSIDDFRRILARGADKVSVNSAAIENPELIRQAANEFGVQCVVVAIDAKKRADHRGYDVYIKGGRENAGLDLVDWAKKCERLGAGEILLTSMDKDGTKTGYDLEMLNDVCTAVNIPVVASGGCGKISDIVEVFQNTRSDAALFASLFHYGEEQLMKLKTNL

SEQ ID NO: 10046 - DNA, 1052 bp, Klebsiella pneumoniae
  CDS (223)..(999)
gcacgtgctgtgcaccgatatttcccgcgacgggacgctggctgggtcgaacgtctcgctgtatgaagaagtctgcgcccgctatccgcaggtggcgtttcagtcttccggcggcattggcgatctcaatgatatcgccgcgctgctcggaaccggagtgcgcggggtgattgtcggtcgggcgctgctggaaggtaaatttaacgtaacggaggccattcaatgctggcaaaacggataatcccctgtcttgacgttcgcgacggccaggtagtgaaaggcgtgcagttccgtaatcacgaaatcatcggcgatatcgtcccgctggctaaacgctatgccgacgaaggcgcggatgagctggtgttctacgatatcaccgcctccagcgacggccgcgtggtggataaaagctgggtgtcgcgggtcgcggaagtgatcgacattccgttctgcgttgccggcggcattaagtcgctggacgatgcagcgcaaatcctctccttcggcgcggataaaatctccatcaactcccctgccctggcggatccgacgctgattacccgcctggccgatcggttcggcgtgcagtgtattgtggtgggcattgatacctggtttgacgccgcgagcggcaagtatcacgtcaaccagtataccggcgatgagagccggacgcgggtgacgcagtgggaaaccctggactgggtgcaggaagtgcaaaagcgcggggccggcgagatcgtcctcaatatgatgaaccaggacggcgtgcgtaacggctacgatctggagcagttaagcaaggtgcgcgccgtgtgccgcgtgccgctgattgcctccggcggcgcgggcactatggagcacttcctggaagcgttccgcgacgctagcgtcgacggcgcgctggccgcctcggtgttccacaagcaaattatcaacattggcgaactgaaaacgtacctggcagcacagggcgtggagattagggtatgttaagtgaacagctggattggcaaaaaaccgacggtctgatgccggtcatcgtgcag

SEQ ID NO: 10047 - protein, 258 aa, Klebsiella pneumoniae
MLAKRIIPCLDVRDGQVVKGVQFRNHEIIGDIVPLAKRYADEGADELVFYDITASSDGRVVDKSWVSRVAEVIDIPFCVAGGIKSLDDAAQILSFGADKISINSPALADPTLITRLADRFGVQCIVVGIDTWFDAASGKYHVNQYTGDESRTRVTQWETLDWVQEVQKRGAGEIVLNMMNQDGVRNGYDLEQLSKVRAVCRVPLIASGGAGTMEHFLEAFRDASVDGALAASVFHKQIINIGELKTYLAAQGVEIRVC

SEQ ID NO: 10048 - DNA, 759 bp, Bacillus subtilis
  CDS (1)..(759)
atgatcacaaaacggattatcccatgccttgatgtcaaagaaggacgcgttgtcaaaggaattcaatttctcgaattgaaggatgccggtgacccagttgaactcgccgaagtgtacgaccgggaaggtgcggatgaacttgtttttcttgatatctccgcctcgcacgaaggacgaaagacgatggttgacgttgtggagcaggttgccgcgaagcttgccattccgtttacagtcggcggcggcatcaatcagctcagcgatatgaaaacgatactgcgtgccggagcggacaaagtgtcggtgaacacggcagctgttctccgccctgagctgattacagaaggagccgagtttttcggttctcaatgcatcgtacttgccattgatgccaagtatgacaaagaatctgacacatataaggtctacacgcacggcggcagaaagaaaacagattgggaggtcaccgcgtgggcaaaagaaggcgtcaaacgcggggcaggagaaatattgctgacaagcatggactccgacggtgagaaaaaaggtttcgaccacacgctgacaaagcttgtttccgaagctgtccccgtccctgttatcgcttcgggaggcgcgggaaacgcacagcatatgcttgaggcttttacaaaaggagaagccgacgccgcgctggccgcctcaatttttcattataaagaaacatcgattaaagaagtgaaatcatacttgaaagagtacggggtgaatgtgagatga

SEQ ID NO: 10049 - protein, 252 aa, Bacillus subtilis
MITKRIIPCLDVKEGRVVKGIQFLELKDAGDPVELAEVYDREGADELVFLDISASHEGRKTMVDVVEQVAAKLAIPFTVGGGINQLSDMKTILRAGADKVSVNTAAVLRPELITEGAEFFGSQCIVLAIDAKYDKESDTYKVYTHGGRKKTDWEVTAWAKEGVKRGAGEILLTSMDSDGEKKGFDHTLTKLVSEAVPVPVIASGGAGNAQHMLEAFTKGEADAALAASIFHYKETSIKEVKSYLKEYGVNVR

SEQ ID NO: 10050 - DNA, 768 bp, Neisseria meningitidis
  CDS (1)..(768)
atggcactggcaaaacgcatcatcccctgtctcgacgtaaaagacgggcgcgtcgtcaaaggcgtgaacttcatcggtttgcgcgacgcgggcgaccccgtcgaagccgccaaacgctacaacggcgaaggcgcggacgaattgaccttcctcgacatcaccgcctcatccgacaaccgggataccatcctgcacatcatcgaagaagttgccggacaagtcttcatccccctgaccgtcggcggcggcgtacgcaccgttgccgacatccgccgcctgctcaatgccggcgcggacaaagtcagcatcaacaccgccgccgttacccgtcccgacctgattgacgaagccgccggatttttcggttcgcaagccatcgtcgccgccgtcgatgccaaagccgtcaaccccgaaaacacacgctgggaaatctttacccacggcgggcgcaatccgaccggtttggatgcggtggaatgggcgatcgaaatgcaaaaacgcggcgcgggcgaaatcctgcttaccggtatggacagggacggtacgaaacagggtttcaacctgccgctgacccgcgccgttgccgaagccgtcgacatccccgtcatcgcctccggcggggtcggcaatgtccggcacctgattgaaggcataaccgaaggcaaagccgatgccgtacttgccgccggcgttttccatttcggggaaatcgccatccgcgaagccaaacacgctatgcgcgaagccggcatcgaagtgcgcctctga

SEQ ID NO: 10051 - protein, 255 aa, Neisseria meningitidis
MALAKRIIPCLDVKDGRVVKGVNFIGLRDAGDPVEAAKRYNGEGADELTFLDITASSDNRDTILHIIEEVAGQVFIPLTVGGGVRTVADIRRLLNAGADKVSINTAAVTRPDLIDEAAGFFGSQAIVAAVDAKAVNPENTRWEIFTHGGRNPTGLDAVEWAIEMQKRGAGEILLTGMDRDGTKQGFNLPLTRAVAEAVDIPVIASGGVGNVRHLIEGITEGKADAVLAAGVFHFGEIAIREAKHAMREAGIEVRL

SEQ ID NO: 10052 - DNA, 759 bp, Bacillus halodurans
  CDS (1)..(759)
atgctcacaaagcggatcattccatgcttagatgtgaaggatggccgggtcgtcaaaggggtgcaattcgttgacttacgtgatgctggtgaccctgtagagcttgctgccttttacgatgaacaaggagcagatgaactcgtatttcttgatatttccgcctcccacgaagggcgtgagacgatgattgatgtggtcgaaaaagtggcaggaacgttggcgattccgttcaccgttggaggagggatcaactccctagaggacatgaagcgcgtgctgcgtgcaggggcagataaagtatcgttaaatacagcagcggttacgcgtccagagcttattactgaaggtgccgactattttggctcccagtgtatcgtcgttgcgattgatgcaaaatacgatgaagcccttggatcttggcgtatttacacccatggaggacggacaccgacagaatgggaagtgtgtgactgggcgagagaagcagtccgtcgcggagctggggaaattttgctcacaagcatggatcaagatggtgcgaagacgggctttgaccttgccttgacgaccaaggtgagtgaagccgtgagcgttccagtgattgcctcaggtggtgccggagcaaaggaagattttgtggacgtttttatgaatgcttatgcggatgccgctttggccgcttccattttccattataaagaaacatcagttgctgaagtgaaaacgcatttgcgtgaagaaggggtggcggtacgatga

SEQ ID NO: 10053 - protein, 252 aa, Bacillus halodurans
MLTKRIIPCLDVKDGRVVKGVQFVDLRDAGDPVELAAFYDEQGADELVFLDISASHEGRETMIDVVEKVAGTLAIPFTVGGGINSLEDMKRVLRAGADKVSLNTAAVTRPELITEGADYFGSQCIVVAIDAKYDEALGSWRIYTHGGRTPTEWEVCDWAREAVRRGAGEILLTSMDQDGAKTGFDLALTTKVSEAVSVPVIASGGAGAKEDFVDVFMNAYADAALAASIFHYKETSVAEVKTHLREEGVAVR

SEQ ID NO: 10054 - DNA, 762 bp, Clostridium acetobutylicum
  CDS (1)..(762)
atgcttacaaagagaataataccatgtcttgatgttgatatgggaagagttgttaagggtgtcaattttgttaacttaaaggatgttggtgacccggttgagatagcggatttttacaatagagaaggcgcagatgaaatagtatttttggacataagtgccacaaatgaaggcagaaataccatgatagatgtggtaagaagaacggcagagaaggtatttataccacttacagtaggtggtggaataagagatgtagatgattttaaaaatatattgagggcaggagcagataagatatctataaattcagcagcaataagaaatccagagcttataaatgaagctgcaaaaaaatttggaagtcaatgtgtcgtagttgcagtggatgcaagaagaaatatagaaacaggaggctttaatgtttttataaatggaggaagagtagatacaagtttagatgccatagaatgggttaaaaaatgtgaaagtcttggtgcaggagaaatacttcttacaagtatggatgcagatggtactaaaaatggatatgatgttgagctcacaggtgcagtatgtgatgcagttaggataccggttatagcttcaggaggatgtggaaggcttgaagattttgatgaaatatttaaaaagacttcagctgatgcagcacttgtggcatcactttttcattataaagagtatacagttggagaagttaaaaactatttaagagaaaatagtattcaagttagattataa

SEQ ID NO: 10055 - protein, 253 aa, Clostridium acetobutylicum
MLTKRIIPCLDVDMGRVVKGVNFVNLKDVGDPVEIADFYNREGADEIVFLDISATNEGRNTMIDVVRRTAEKVFIPLTVGGGIRDVDDFKNILRAGADKISINSAAIRNPELINEAAKKFGSQCVVVAVDARRNIETGGFNVFINGGRVDTSLDAIEWVKKCESLGAGEILLTSMDADGTKNGYDVELTGAVCDAVRIPVIASGGCGRLEDFDEIFKKTSADAALVASLFHYKEYTVGEVKNYLRENSIQVRL

SEQ ID NO: 10056 - DNA, 819 bp, Methanococcus jannaschii
  CDS (1)..(819)
atgctaacaaagagaattattccatgcttagatattaaagacggaagagttgttaaaggaactaagtttttgaatttgagggatgctggagacccagttgagttagcccaatactatgatgatgaaggagctgatgagcttgtatttttagatataaccgcctcagctgaaaagagggacataattattgatgttgtagagagaacagctgaaaaagtatttatcccattaactgttggtggaggaattaagtcaattgaagattttaggagaatactgagagccggggctgataaagtttcgataaacactgccgcagtaaaaaatccaaatttaattaaagaggcaagtgagatatttggctctcaatgtgttgttgttgcaattgatgctaaaagacactatgttaatgaagatgagatagataagataaataaaaatgtcgttaaagtagaggatggttattgctggtttgaagtttatatatacggagggagaaaagaaacaggtatagatgccataaactgggctaaaaaagttgaagaattgggagctggagagattttattgacaagtattgataaagatgggacaaaaagtggctatgatttgatattgacaaaggagatttctaaaagtgttaaactccctgttattgcaagtggaggttgtggaaaaccagaacatgtttatgaggcatttgtttatggaaaggcagatgccgcattaatggcagggatattgcactatagagaatatacaatagaagagataaaaaaatactgtgctgatagaggaatacctatgagattattataa

SEQ ID NO: 10057 - protein, 272 aa, Methanococcus jannaschii
MLTKRIIPCLDIKDGRVVKGTKFLNLRDAGDPVELAQYYDDEGADELVFLDITASAEKRDIIIDVVERTAEKVFIPLTVGGGIKSIEDFRRILRAGADKVSINTAAVKNPNLIKEASEIFGSQCVVVAIDAKRHYVNEDEIDKINKNVVKVEDGYCWFEVYIYGGRKETGIDAINWAKKVEELGAGEILLTSIDKDGTKSGYDLILTKEISKSVKLPVIASGGCGKPEHVYEAFVYGKADAALMAGILHYREYTIEEIKKYCADRGIPMRLL

SEQ ID NO: 10058 - DNA, 714 bp, Methanococcus jannaschii
  CDS (1)..(714)
atgataataatccctgcagttgatttaaaagataaaaagtgcgttcagctaattcaaggagacccaaataaaaagcatttggaactaaacaatccagtagaagttgctaaaaaatttgtagatgaaggggctgagtatctacatataatcgatttagatgccgcatttggaacaggaaataatagagacgttattaagaacattataaaagaggttaatgttccagttgaggttggaggaggaattagaaatttagagatagcaaaggaattaattagcttgggagttgatagagttatagtgggaactaaggcaattttagaaccaaaattcatagatgatttaaataaagagattggaaaagataagatagttttagctgtagaatgtaaagagggaaaggttgttattaaaggatggaaggaaaaagtagataaaactccaatagaagttattaaggaatttgaagataaggttggctatatattatttacaaatgtagatgttgagggcttattaaaaggaataaatgttgatataattaaagagttaattgaaaagactgatattcctatcatctactctggtggaattacaaccttagaagacataaaagctttaaaagaacttggtatttatggagttgttattggttcagcactatataaaggtttaattgatttaaaaaaggcgttagagatagttaaaaattaa

SEQ ID NO: 10059 - protein, 237 aa, Methanococcus jannaschii
MIIIPAVDLKDKKCVQLIQGDPNKKHLELNNPVEVAKKFVDEGAEYLHIIDLDAAFGTGNNRDVIKNIIKEVNVPVEVGGGIRNLEIAKELISLGVDRVIVGTKAILEPKFIDDLNKEIGKDKIVLAVECKEGKVVIKGWKEKVDKTPIEVIKEFEDKVGYILFTNVDVEGLLKGINVDIIKELIEKTDIPIIYSGGITTLEDIKALKELGIYGVVIGSALYKGLIDLKKALEIVKN

SEQ ID NO: 10060 - DNA, 816 bp, Archaeoglobus fulgidus
  CDS (1)..(816)
atgctggccaaaagaataatcccctgtctcgacgtaactcttgacgaaagtgaagcgagggttgttaagggagtggagttcgtcaatcttagggatgctggcgacccagttgagctggcgaagaggtacgacgaggagggggcagacgagcttgtttttcttgacatcacagcctctccagaagggagaaggacgatgattgatgttatagagagaactgcggagcaggttttcatccccttcaccgttggaggggggataaagagcattgaggacataaacaccattctctctgctggagcggacaaggtttctatcaacaccgccgccgtcaaaaaccccgaatttgtgagagaggctgcggatattttcggcagccagtgcattgttgttgccattgactgcaggaggaacttcgacctgagcaagggtgaatacatcgtggagcttgaggatggcacgaaggcgtggtacgaggttgtgatttacggcgggagaaagcccgtcggcatagatgcggtctggtgggcgaagagggttgaggagcttggcgctggagagattctgctcacgtcgatgaacagagacggcacgaaggatggtttcgacatccccataacgagaaagataagcgaggaggttaacattccagtcatagcttcaggaggagctggaacaaaggagcacttctacgaggggtttgtggaagggaaggccgatgcgtgcttagctgcaagcatcttccactacagagaaattggaatcagggaaattaaggagtatctggctgagaggggcgtgcaggtgagattgtga

SEQ ID NO: 10061 - protein, 271 aa, Archaeoglobus fulgidus
MLAKRIIPCLDVTLDESEARVVKGVEFVNLRDAGDPVELAKRYDEEGADELVFLDITASPEGRRTMIDVIERTAEQVFIPFTVGGGIKSIEDINTILSAGADKVSINTAAVKNPEFVREAADIFGSQCIVVAIDCRRNFDLSKGEYIVELEDGTKAWYEVVIYGGRKPVGIDAVWWAKRVEELGAGEILLTSMNRDGTKDGFDIPITRKISEEVNIPVIASGGAGTKEHFYEGFVEGKADACLAASIFHYREIGIREIKEYLAERGVQVRL

SEQ ID NO: 10062 - DNA, 762 bp, Aquifex aeolicus
  CDS (1)..(762)
atgctggcaaagagaataattccctgccttgacgtggataaagggagagttgtgaaaggtgtgaagttcctaaacctcagggacgcgggagacccagtggaagtggcaaaaaggtacgaagaagaaggagcggatgaactggtattcctggacataacagcctcggcggaagacagggaaataatgatagacgtagtaaagaaggttgccgaaaccgtcttcatgcccttcacagtgggaggagggataaggagcttggaggatatgaggagactcttagaagcgggagcggacaagatatctataaacacggcagcggtgaagaatccgaatcttatttacgagggggcaaagaggttcggatctcagtgtatagtggttgctatagacgcaaaaaggaagggaaattcgtgggaggtttacatacacggtggaagaacacctacgggacttgacgctgttgagtgggctaaaaaagttgaaagtttgggagctggagagattctcttgacttccatggacagagacgggacaaaggacgggtacgatatagaactaaacagagccatctcggaagcggtgaacatacccgttatagcttctgggggtgcgggcaagaaggaacacttttacgaagttttttcaaagacaaaggtagaggctgcccttgccgcttcagtattccacttcagggaaataagtattccggagctgaaggagtatcttctggaaagaggtattaacgtgagacctcttgactga

SEQ ID NO: 10063 - protein, 253 aa, Aquifex aeolicus
MLAKRIIPCLDVDKGRVVKGVKFLNLRDAGDPVEVAKRYEEEGADELVFLDITASAEDREIMIDVVKKVAETVFMPFTVGGGIRSLEDMRRLLEAGADKISINTAAVKNPNLIYEGAKRFGSQCIVVAIDAKRKGNSWEVYIHGGRTPTGLDAVEWAKKVESLGAGEILLTSMDRDGTKDGYDIELNRAISEAVNIPVIASGGAGKKEHFYEVFSKTKVEAALAASVFHFREISIPELKEYLLERGINVRPLD

SEQ ID NO: 10064 - DNA, 762 bp, Thermotoga maritima
  CDS (1)..(762)
atgctcgctaaaagaataatcgcgtgtctcgatgtgaaagacggtcgtgtggtgaagggaacgaacttcgaaaacctcagggacagcggtgatcctgtcgaactgggaaagttctattccgaaattggaatagacgaactcgtttttctggatatcaccgcgtccgttgagaagaggaaaaccatgctggaactggtcgaaaaggtggccgagcagatcgacattccgttcactgttggaggaggtatccacgacttcgaaacggcctcggagctcattctccgtggtgcggacaaggtgagcataaacacggcggctgtggagaatccttctttgatcacacagatcgctcaaacttttgggagtcaggccgttgtcgtggcgatagatgcaaaaagagtggatggagagttcatggtcttcacctactccggaaagaagaacacgggcatacttctgagagactgggtggttgaagtagaaaagagaggagcaggagagatcctgctcaccagtatcgacagagacggcacaaaatcgggttacgatacggagatgataaggttcgtgaggccactaaccacacttcccatcatcgcttccggtggtgcgggaaaaatggaacatttccttgaagccttcctggcaggtgccgacgctgcccttgcggcttctgtctttcacttcagagagatcgacgtgagagaactgaaagagtacctcaaaaaacacggagtgaacgtgagactggaggggttgtga

SEQ ID NO: 10065 - protein, 253 aa, Thermotoga maritima
MLAKRIIACLDVKDGRVVKGTNFENLRDSGDPVELGKFYSEIGIDELVFLDITASVEKRKTMLELVEKVAEQIDIPFTVGGGIHDFETASELILRGADKVSINTAAVENPSLITQIAQTFGSQAVVVAIDAKRVDGEFMVFTYSGKKNTGILLRDWVVEVEKRGAGEILLTSIDRDGTKSGYDTEMIRFVRPLTTLPIIASGGAGKMEHFLEAFLAGADAALAASVFHFREIDVRELKEYLKKHGVNVRLEGL

SEQ ID NO: 10066 - DNA, 798 bp, Deinococcus radiodurans
  CDS (1)..(798)
atgctgcggggcgtgctcgccaaacgcatcgttccctgcctggatgtccaaaatggccgcgtggtcaaaaacgtgcgctttttcgaggatcaccgcgacgcgggcgacccgctggtgctcgcgcaggcctacgaggcgcaacaggccgacgaactcgtcttctacgacatcaccgcaacgcacgagggccggtcactcatgctggacgtggccgcccgcgtggccgagcaggtgatgatgccgctcaccgtgggcggcggagtgggtgccctctccgattttcgtcaactgctgctcgccggggccgacaaaatcagcgtgaacagcggcgcggtaaagcggcccgaacttatccgcgaggcgagcgaccactacggggcgcagtgcgtgatgctcagcatcgacgccaagcgccgccctggtgggcagggctggaccgtccatatcggcggcgggcgggtggacactggcctggacctgctggcgtgggcgcggcgcggccaggaactcggggcgggtgagctgtgcctgaacgtgatggacgccgacggcacccgcgccggcttcgacctggaagcgacccgcgccgtggcccgcgaggtggacctgccggtcatcgcgtccgggggcgcgggcaaggtgcaggacttttacgacgtactgaccgctggcgaggccgacgccgcgctcgctgccagcgtctttcatttcggcgaactgacggtgccgcaggtcaagacctccctcgccgcgcagggcgtgccggtgcggcccgagtggcggggcgctaccgaataa

SEQ ID NO: 10067 - protein, 265 aa, Deinococcus radiodurans
MLRGVLAKRIVPCLDVQNGRVVKNVRFFEDHRDAGDPLVLAQAYEAQQADELVFYDITATHEGRSLMLDVAARVAEQVMMPLTVGGGVGALSDFRQLLLAGADKISVNSGAVKRPELIREASDHYGAQCVMLSIDAKRRPGGQGWTVHIGGGRVDTGLDLLAWARRGQELGAGELCLNVMDADGTRAGFDLEATRAVAREVDLPVIASGGAGKVQDFYDVLTAGEADAALAASVFHFGELTVPQVKTSLAAQGVPVRPEWRGATE

SEQ ID NO: 10068 - DNA, 735 bp, Bacillus halodurans
  CDS (1)..(735)
atggctaagtttatcatttacccggcgattgatatgcgcgacggcaaatgtgttcgtctcgtccaaggcgactacaatcaagagaccgtttatggggattctccgtttaccatggcaaagtcgtttgccgaacaaggtgccgaatggattcatatggtcgatttagatggagctaaggcaaaagaacgtatgaaccacgagcacgtcgttaaggtcgcaacagagctcgatgtgaacgttcaagttgggggcggaatccgaacggcagaggacatcgcgtattacctagaccggggaatcagtcgggtgattttagggagtgtggccgtgaacaatcctgcgtttacgaaagaaatgttgcagaaatatggcggagaaaaaatcgccatcggcttagatgcgcgcgacgggtacgtggcaacggaaggctggctggaaacgtcctcggtaaaagcggaaacgcttgggcaagagctcgcccggcatggggcagaagtctttatttttactgatatttctcgcgatggcatgctgtcgggcccgaatacggaggcgattgttcagctagcgaaggcgacaggaaaacaggtgatcgcatcaggaggggttagctccttacaagacctcgatgctctcagaaacgaaaagcagaacggaatcgcaggggctattgtcggtaaagccttgtacacgaatcaatttacgctggaagatgcgttaaaggaggagagctaa

SEQ ID NO: 10069 - protein, 244 aa, Bacillus halodurans
MAKFIIYPAIDMRDGKCVRLVQGDYNQETVYGDSPFTMAKSFAEQGAEWIHMVDLDGAKAKERMNHEHVVKVATELDVNVQVGGGIRTAEDIAYYLDRGISRVILGSVAVNNPAFTKEMLQKYGGEKIAIGLDARDGYVATEGWLETSSVKAETLGQELARHGAEVFIFTDISRDGMLSGPNTEAIVQLAKATGKQVIASGGVSSLQDLDALRNEKQNGIAGAIVGKALYTNQFTLEDALKEES

SEQ ID NO: 10070 - DNA, 729 bp, Halobacterium sp. NRC-1
  CDS (1)..(729)
atgacattcgagtcgttcacggtgctgccggccgtcgacatgcaggacggacaggtggtgcagctcgtgcagggggagcgtgggaccgagcgcacgtacggcgaccccgtggacgccgcgaccgactgggtggccgcgggcgccgaggcgttgcacctcgtggacttggacggcgccttcgagggtgcgcgcgcgaacgccaccgccgtcgaggacatcctcgacgcgaccgacgtgtcagtgcaggtcggtggcggcattcggagcgccgaggacgccacggccctgctcgaccggggcgtcgaccgtgtcatcctcggcaccgccgccatcgagaccccggacatcgtcggggagatcgccgccgcgtacagcgacggcgtgctcgtgagcctggacgccaaggacggcgaggtggtcgtggaaggctggaccgagggcaccggcatggacccggtggcggccgcccagcggtacgccgacctgggggcggcgggcatcctgttcaccgacgtggacgtggaggggaaacaggagggcgtgcgaaccgaccccgttcgagacctcgttgacagcgtcgacatcccggtgatcgccagcggcggcgttgccactgtcgacgacgtgcgcgcactcgaagccgcgggggcggccggcgcggtcgtcgggaccgcactctacgaggggaatttcacgcttgcggacgcgcaggcggccgtcgaggactga

SEQ ID NO: 10071 - protein, 242 aa, Halobacterium sp. NRC-1
MTFESFTVLPAVDMQDGQVVQLVQGERGTERTYGDPVDAATDWVAAGAEALHLVDLDGAFEGARANATAVEDILDATDVSVQVGGGIRSAEDATALLDRGVDRVILGTAAIETPDIVGEIAAAYSDGVLVSLDAKDGEVVVEGWTEGTGMDPVAAAQRYADLGAAGILFTDVDVEGKQEGVRTDPVRDLVDSVDIPVIASGGVATVDDVRALEAAGAAGAVVGTALYEGNFTLADAQAAVED

SEQ ID NO: 10072 - DNA, 774 bp, Vibrio cholerae
  CDS (1)..(774)
atgttggcaaaacggataattccttgtctggatgtacgtgatggacaggtagtgaaaggcgttcagtttcgtaaccacgaaatcattggagacattgtgccactggccaaacgttacgccgaagaaggcgcggatgagctggtgttttacgatattaccgcttccagtgatggccgcgttgtcgataaaagctgggtcgcgcgagtcgcggaagtgatcgacatccctttctgtgtcgcgggcgggatcaagtcggcgcaagatgctgcgcgaatcttggagttcggtgcagataaagtgtcaattaactcgcctgcactggcgaatccacaactgatcaccgatcttgcggatcgctttggcgtgcaatgtatcgtggttggcatcgactcttattttgataaagaaacaggtcaatatcaggtttatcagtttaccggtgacgaaagccgcacccgtgccacgcagtggcaaacttgcgattgggtgcaagaggtgcaaaagcgcggcgctggggaaattgtactgaacatgatgaaccaagatggtgtgcgcaatggttacgatcttgagcagctcaacttagtgcgctcggtgtgccgagttccgctgatcgcctccggtggtgcaggggcgatggaacatttcgcgcaagcttttactcaagcgaacgtcgatggtgctttagccgcttcggtgtttcacaagcagatcatcaatatcggtgaactcaagcagtatctaaaacaacaaggaattgaggtgagacgatga

SEQ ID NO: 10073 - protein, 257 aa, Vibrio cholerae
MLAKRIIPCLDVRDGQVVKGVQFRNHEIIGDIVPLAKRYAEEGADELVFYDITASSDGRVVDKSWVARVAEVIDIPFCVAGGIKSAQDAARILEFGADKVSINSPALANPQLITDLADRFGVQCIVVGIDSYFDKETGQYQVYQFTGDESRTRATQWQTCDWVQEVQKRGAGEIVLNMMNQDGVRNGYDLEQLNLVRSVCRVPLIASGGAGAMEHFAQAFTQANVDGALAASVFHKQIINIGELKQYLKQQGIEVRR

SEQ ID NO: 10074 - DNA, 756 bp, Sulfolobus solfataricus
  CDS (1)..(756)
atgacaacgaaaagaataatagcttgcctcgatgtaaaggacggtaacgtagttaaaggagtaaatttccttaatctccaattgaaaggagatccggttagcctagccagtctatatgaagaagaaggcgctgatgagatagtcttcttagatataactgcaacgatagaagctagaaaagcattatataatgtcattaaggatactgcgagcgtattgtccattcccttaacagttggtggtggtattagaacacctgacgacgtgtcaatggcgttaagatctggagcagataaggttagtataaatactgctgcagttgaaagtagccaaatagtgaaaaaatctgcagaagagtttggatcacaagcagtagtagtagccatagatgttaagaaggtaagcggaaattggatagtcttcacaaaatccggaacttacaataccagacttgatgctataaagtgggctaaaaaggtggaagaacttggtgcaggtgaaatattgctaacgagtattgatagagatggtactagacttggttatgacttagaattaactaggaaaatagttgattctgtcaatatcccagtaatagctagtgggggagctggaaaaatggaacatttttatgaggttttttccctcgcgaaggccgacgcagcgttagctgctggcatattccatgatggaataattaaaataaaagacttgaagtcgtatttaagccagaaaggcatcgaggtgagaatgtga

SEQ ID NO: 10075 - protein, 251 aa, Sulfolobus solfataricus
MTTKRIIACLDVKDGNVVKGVNFLNLQLKGDPVSLASLYEEEGADEIVFLDITATIEARKALYNVIKDTASVLSIPLTVGGGIRTPDDVSMALRSGADKVSINTAAVESSQIVKKSAEEFGSQAVVVAIDVKKVSGNWIVFTKSGTYNTRLDAIKWAKKVEELGAGEILLTSIDRDGTRLGYDLELTRKIVDSVNIPVIASGGAGKMEHFYEVFSLAKADAALAAGIFHDGIIKIKDLKSYLSQKGIEVRM

SEQ ID NO: 10076 - DNA, 738 bp, Bacillus subtilis
  CDS (1)..(738)
atgagtgcttttacattatatccggcaattgatatgagaaacggcaaatgtgttcgccttgttcaaggggattataataaggaaacgatatatggcgattcaccgtacgacatggctgagttatttgagaaagagggtgccgaatggatccatctcgttgatctcgacggggccaaagaagggaaaagagtgaatgaccgccatgtgattgagattgcgcaaaagctgaacctgaaagtcgaaatcggcggtgggatccgttctgaaaatgacgtctatgaatatttatcagcaggagtcgagcgggtgatcctgggaagctcagcagtttctaaccctccgtttgtcaaaaaaatgctgaaacaatatggcgagaaaattgcaatcggactggatgcgagaaacggttttgtttcaacagagggatggcttgaaacatcaacccttaaggcaactgaactgggcaaagagctagccaatgaaggtgcggaagtctttatttttactgacatcgcgacagatggaatgctgtcaggccccaatgttaaaagcacggtcgagcttgctaaggaaacggggaaatcggtgatcgcttccggcggagtcagctccgtcgcggatctcgaagctctcgcccgcaatgaggcggacggcgtctctggagcgatcatcggaaaagcgctgtataccaatcagtttacgctgagtgaggcgcttgaaagggtgaagcgcaaatga

SEQ ID NO: 10077 - protein, 245 aa, Bacillus subtilis
MSAFTLYPAIDMRNGKCVRLVQGDYNKETIYGDSPYDMAELFEKEGAEWIHLVDLDGAKEGKRVNDRHVIEIAQKLNLKVEIGGGIRSENDVYEYLSAGVERVILGSSAVSNPPFVKKMLKQYGEKIAIGLDARNGFVSTEGWLETSTLKATELGKELANEGAEVFIFTDIATDGMLSGPNVKSTVELAKETGKSVIASGGVSSVADLEALARNEADGVSGAIIGKALYTNQFTLSEALERVKRK

SEQ ID NO: 10078 - DNA, 822 bp, Halobacterium sp. NRC-1
  CDS (1)..(822)
atgacactcaccaagcgcgtcatcccctgcatcgacgtggacctcgacgacgacggggagcccgcagtgtacaccggcgtcaacttcgaggagctggcgtacacgggcgaccccgtcgagatggcgaagcggtacaacgaagcgggcgccgacgagttcgtgttcctcgacatcacggccagcgccgagggccgggagacgatgctcgacaccgtttcggcggtcgccgacgaggtgttcatcccgctgaccgtcggcggcggcatccgggacaccgacgacatccgggagacgctgcgcgcgggcgccgacaaggtctcgatcaactcgggcgcgatcgccgacccgtcgctggtggaccgcggcgcgaaagccttcggcagccagtgcatcgtcatcagcgtcgacgcccggcggcgcttcgacgaacagggccaacactacacgcaggtcgacggcgagtcgtgctggttcgagtgcacggtccacggcggccgcgaaggcaccggcatggacgccatcgagtgggtccaggaggcacagcgacgcggcgcgggcgagctgttcgtgaactccatcgacgccgacggcacacaggacggctacgacgttccgctcacggcggcggtctgtgacgccgtttcgacgcccgtgatcgcgtcctcggggtgtggcgcgcccggcgacatggccgacgcctacgacgccggcgctgacgcggcgctggcggcgtcgatcttccacttcgacgagtacagcatcgcggagacgaaagagacgctcgctgacgccggctatccgatccgcgccccggacgcgtga

SEQ ID NO: 10079 - protein, 273 aa, Halobacterium sp. NRC-1
MTLTKRVIPCIDVDLDDDGEPAVYTGVNFEELAYTGDPVEMAKRYNEAGADEFVFLDITASAEGRETMLDTVSAVADEVFIPLTVGGGIRDTDDIRETLRAGADKVSINSGAIADPSLVDRGAKAFGSQCIVISVDARRRFDEQGQHYTQVDGESCWFECTVHGGREGTGMDAIEWVQEAQRRGAGELFVNSIDADGTQDGYDVPLTAAVCDAVSTPVIASSGCGAPGDMADAYDAGADAALAASIFHFDEYSIAETKETLADAGYPIRAPDA

SEQ ID NO: 10080 - DNA, 726 bp, Caulobacter crescentus
  CDS (1)..(726)
atgatcctctatcccgccatcgacctgaaggacggccagtgcgtgcgcctgctgcatggcgacatggacaaggccacggtcttcaacacctcgcccgccgaccaggcccagcgcttcgtccaggacggcttctcgtggctgcacgtcgttgacctgaacggcgccatcgagggcaagtcggtcaatacggccgctgtcgaacagatcctggagtcgatctcgatcccggtgcagctgggcggcggcatccgcaccctggaaggcgtcgaagcctggatcgaggcgggcgtgtcgcgcgtgatcctcggcaccgtggccgtgcacgatcccgaactggtcaagaaggccgcgcgcctgtggcccgagcagatcgccgtggcggtcgacgtgcgcgacggcaaggtcgcggtcgacggctggacaggcctgtcggacctgtcggcgatcgacctttcgcgccgcttcgaggacgccggcgtcgcagccctcattatcaccgacatcagccgcgacggcgccctgacgggcgtcaatgtcgaaggcgtgggcgagctggccgacgccgtctcgatccccgtcatcgcctcgggcggtgtggccgccgtggccgatatcgagcgcctgaaggcccgtcagggcgtcgagatcgccggcgcgatcctgggccgttcgctctatgccggcacgatcaagccttccgaagccctgatcgcggcggccgcctga

SEQ ID NO: 10081 - protein, 241 aa, Caulobacter crescentus
MILYPAIDLKDGQCVRLLHGDMDKATVFNTSPADQAQRFVQDGFSWLHVVDLNGAIEGKSVNTAAVEQILESISIPVQLGGGIRTLEGVEAWIEAGVSRVILGTVAVHDPELVKKAARLWPEQIAVAVDVRDGKVAVDGWTGLSDLSAIDLSRRFEDAGVAALIITDISRDGALTGVNVEGVGELADAVSIPVIASGGVAAVADIERLKARQGVEIAGAILGRSLYAGTIKPSEALIAAAA

SEQ ID NO: 10082 - DNA, 777 bp, Agrobacterium tumefaciens
  CDS (1)..(777)
atgaccctcaaagcccgcattattccctgcctcgacgtgaaagacggacgtgtcgtcaagggtgtgaacttcgtcgacctgatcgatgctggcgacccggtcgaggcagcaaaagcctatgacgcggcgggagcggatgaactctgcttcctcgacatcaccgcgtcctcggacaatcgcgacaccatcttcgatgtcgtctcacgcactgcggaccattgcttcatgccggtgacggtcggtggcggggttcgtagcgtcgcggatattcgtaagctgcttctttgcggtgcggacaaggtctctatcaactccgcagctgtcaaggatcccgacttcgttgcgcaggcggccgacaagttcggcaaccaatgcatcgtcgtttccatcgacgccaagcgggtttccaaagatggcgaagctgaccgctgggaaatttttacccatggcggacgccagccaactggtatcgatgccgtggaattcgccatcaagatggttgaacggggtgccggcgaattgctcgtcacctcgatggatcgcgacggcaccaagagcggttatgatatcggcctgacgcgcagcattgccgatcaggttcgcgtgcccgtcatcgcctcgggcggcgttggtacgcttgatgatctggtggcaggtgttcgcgatggccacgcgacggcagtgcttgccgcttccatcttccacttcggcacctattcgatcggtgaagccaagagctacatggccgaacatggcattgccatgcgtctcgactga

SEQ ID NO: 10083 - protein, 258 aa, Agrobacterium tumefaciens
MTLKARIIPCLDVKDGRVVKGVNFVDLIDAGDPVEAAKAYDAAGADELCFLDITASSDNRDTIFDVVSRTADHCFMPVTVGGGVRSVADIRKLLLCGADKVSINSAAVKDPDFVAQAADKFGNQCIVVSIDAKRVSKDGEADRWEIFTHGGRQPTGIDAVEFAIKMVERGAGELLVTSMDRDGTKSGYDIGLTRSIADQVRVPVIASGGVGTLDDLVAGVRDGHATAVLAASIFHFGTYSIGEAKSYMAEHGIAMRLD

SEQ ID NO: 10084 - DNA, 747 bp, Campylobacter jejuni
  CDS (1)..(747)
atgttaaaaactagaattatcccttgtgtgttattaaaaaattctcaacttgttaaaagtatagaatttaaagattttcgcactatagggcatttaacttcaacaatgagaatttataatgcacgcaatgttgatgagcttattatcttagatatagatgcttcaaaaagtggagaaatagattttgaaagtatagaagatcttgctaaagaatgttttatgcctttaactataggtggcgggataaaaacccttgaagatatacaaaagattttaaatttaggtgcggataaaatttctatcaattctaaggccttagaagatatggattttataagtaaagcgggtaatcgttttggttctcaatgtatagtttgttctatagatgttaaaagaaaaggagatcaattttgtgtttatgataggggaaatttacttgaaaaaagtcctttagaacttgctttagaatatgaaaaaaaaggagctggagagcttcttttaacttctgtggattttgagggaaaagcaaagggttatgatttagaacttttaaagatttttcaaaataaacttaaaattcctcttattatcaatggaggacttagcaagccaagtgatggagttgaggctttaaatttaggcgccgatgctttagcgggtgcttatatttttcatttttctaaatatacccctaaagatgtaaaagaagaattagctaggcaaggctttgcagtgagattgctttaa

SEQ ID NO: 10085 - protein, 248 aa, Campylobacter jejuni
MLKTRIIPCVLLKNSQLVKSIEFKDFRTIGHLTSTMRIYNARNVDELIILDIDASKSGEIDFESIEDLAKECFMPLTIGGGIKTLEDIQKILNLGADKISINSKALEDMDFISKAGNRFGSQCIVCSIDVKRKGDQFCVYDRGNLLEKSPLELALEYEKKGAGELLLTSVDFEGKAKGYDLELLKIFQNKLKIPLIINGGLSKPSDGVEALNLGADALAGAYIFHFSKYTPKDVKEELARQGFAVRLL

SEQ ID NO: 10086 - DNA, 783 bp, Caulobacter crescentus
  CDS (1)..(783)
atgctgaagacccggatcattccctgcctcgacgtgaaggacgggcgggtggtcaagggggtcaacttcgtctccctgcgcgacgccggcgacccggtggagcaggcgcgggcctatgacgccgccggcgccgacgagctgatgttcctggacatcaccgcttccagcgaaggacgcggcctgatcctggacgtcatctcgcgcaccgccgaggtctgcttcatgcccgtctcggtgggcggcggggtgcggcaggtctcagacatgcgccgcctgttgctggccggcgccgacaaggtctcggtcaacaccgccgccgtcgagaaccccgacctgatcgccggcggcgccgacgccttcgggtcccagtgcgtggtcgtggccatcgacgctaaggcgcgcgaggacggctcgggctggaacgtctggacctatggcggccgcaaggacaccgggatcgacgtggtcgaatgggccgccaaggtcgtggaacgcggcgcgggcgagatcctgctgacctcgatggaccgcgacggcgccaagatcggctacgatatcccgctgctgcaggcggtgacgggcgcggtcaatgtgccggtgatcgcctcgggcggcgcgggcaagaccgaacatctgatcgaagccgcccgcgaaggccacgccgccgccgtgctggccgcctcgatcttccacttcggcgagatttcgatcggcgaggccaagcaggccatggccgacgccggcatccccgtgcgcctagacgcgctgaagggagccgcatga

SEQ ID NO: 10087 - protein, 260 aa, Caulobacter crescentus
MLKTRIIPCLDVKDGRVVKGVNFVSLRDAGDPVEQARAYDAAGADELMFLDITASSEGRGLILDVISRTAEVCFMPVSVGGGVRQVSDMRRLLLAGADKVSVNTAAVENPDLIAGGADAFGSQCVVVAIDAKAREDGSGWNVWTYGGRKDTGIDVVEWAAKVVERGAGEILLTSMDRDGAKIGYDIPLLQAVTGAVNVPVIASGGAGKTEHLIEAAREGHAAAVLAASIFHFGEISIGEAKQAMADAGIPVRLDALKGAA

SEQ ID NO: 10088 - DNA, 771 bp, Pseudomonas aeruginosa
  CDS (1)..(771)
atggcactggcaaaacgcatcatcccctgcctcgacgtggacaacggccgagtggtcaagggcgtcaagttcgagaacatccgcgacgccggcgacccggtcgagatcgctcgccgctacgacgagcagggtgccgacgagatcaccttcctcgatatcaccgccagcgtcgacgggcgcgacaccaccctgcataccgtcgagcgcatggctagccaggtgttcattccgctgaccgtgggcggcggcgtacgcagcgtgcaggacatccgcaacctgttgaatgccggcgcggacaaggtctcgatcaacaccgccgcggtgttcaaccccgagttcgtcggtgaggccgccgaccgcttcggctcgcagtgcatcgtggtcgccatcgacgcgaagaaggtttccgccccgggcgaggcgccgcgctgggaaatcttcacccatggcgggcgcaagcccaccgggctggatgccgtgctctgggcgaagaagatggaagacttgggcgctggcgagattctcctgaccagcatggaccaggacggcgtgaagagcggttacgacctgggcgtgacccgcgccatcagcgaggcggtgaacgtgccggtgatcgcttccggcggcgtcggcaacctggagcacctggccgccggcatcctcgagggcaaggccgacgcggtgctcgcggcgagcatcttccacttcggcgagtacaccgtgccggaagccaaggcctacctggccagccgcggtatcgtggtgcgctga

SEQ ID NO: 10089 - protein, 256 aa, Pseudomonas aeruginosa
MALAKRIIPCLDVDNGRVVKGVKFENIRDAGDPVEIARRYDEQGADEITFLDITASVDGRDTTLHTVERMASQVFIPLTVGGGVRSVQDIRNLLNAGADKVSINTAAVFNPEFVGEAADRFGSQCIVVAIDAKKVSAPGEAPRWEIFTHGGRKPTGLDAVLWAKKMEDLGAGEILLTSMDQDGVKSGYDLGVTRAISEAVNVPVIASGGVGNLEHLAAGILEGKADAVLAASIFHFGEYTVPEAKAYLASRGIVVR

SEQ ID NO: 10090 - DNA, 777 bp, Buchnera sp
  CDS (1)..(777)
atgctggcaaagagaatcatagcgtgtcttgatgttgatgatggtgtagtagtgaaaggaattaaatttcagaatcataaaatcgtaggcgatattgtaccattagccagacgctacgcaaaagaaggtatagatgaattagttttttatgatattactgctgcaacaaaaaataaattagttgatcgtagttggataaaaaatgtttctaaagttataaatattccattttgcgtagctggaggtattaaaagtgtagaagatgctaaaaaagttttatctagtggtgcagataaaatatcaatcaattcttcagcattaatagatcctaatttaattactaaaatttcagaacgttttggtgtacagtgtgtagttattggaattgattcttggtttgataaaacaaaaaattcttatatggtacaacaatatacaggagatattagtaaaacttatcaaacgtcttggaaaacatctgattgggtaaaaaaagtacaagaaaaaggtgctggtgaaatagtgttaaatatgatgaataaagatggattacaaaaggggtatgatatatcacatttaagtgaaataagaaaaatatgtaaagtacccttaattgcatcaggtggcgctggaagtgtagaacacttttatgaagcattatattattctaatgttgatggagtgctagctgcatctgtttttcataaaaatatagtagagataaaagtgttgaaaaaaaaattaattgcgcgaggaatggagattagagagtgttaa

SEQ ID NO: 10091 - protein, 258 aa, Buchnera sp
MLAKRIIACLDVDDGVVVKGIKFQNHKIVGDIVPLARRYAKEGIDELVFYDITAATKNKLVDRSWIKNVSKVINIPFCVAGGIKSVEDAKKVLSSGADKISINSSALIDPNLITKISERFGVQCVVIGIDSWFDKTKNSYMVQQYTGDISKTYQTSWKTSDWVKKVQEKGAGEIVLNMMNKDGLQKGYDISHLSEIRKICKVPLIASGGAGSVEHFYEALYYSNVDGVLAASVFHKNIVEIKVLKKKLIARGMEIREC

SEQ ID NO: 10092 - DNA, 777 bp, Haemophilus influenzae
  CDS (1)..(777)
atgttggcaaaacggataattccttgtttggatgtacgtgatggacaggtggtaaaaggggtacaattccgtaaccacgaaattattggcgatattgtgccacttgctcaacgctatgcgcaagaaggagctgatgaattggtattttatgatattacggcttcatcagacggtcgtaccgtggataaaagttgggtagaacgaatcgctcaggtaattgatattccgttttgcgtagcaggtgggattaaaaccattgaagatgcggaaaaattgtttgcatttggggcggataaaatttcgattaattcccctgctctcgctgatccaacgctcatttctcgcttagcagatcgttttggcgtacaagcgattgtagtaggtattgatagttggtttgaacaggaaacaggtaagtattgggtaaaccaatatacaggcgatgaaacacgtacccgacaaactcattggcagttgttagattgggtaaaagaagtacaacaatgcggtgcaggagaaatcgtgctaaatatgatgaatcaagatggtttacgaaacgggtacgatttagcccagctcaagctggtgcgaggagtatgtagagtacctctaattgcatctggcggtgcgggtaaaatggtacattttcgtgatgcttttattgaagcaaaagtagatggggcattagctgccagcgtattccataaacagattattgaaattggcgagttaaaatcctaccttgtgcaatcagccatcgagattcggagtgaataa

SEQ ID NO: 10093 - protein, 258 aa, Haemophilus influenzae
MLAKRIIPCLDVRDGQVVKGVQFRNHEIIGDIVPLAQRYAQEGADELVFYDITASSDGRTVDKSWVERIAQVIDIPFCVAGGIKTIEDAEKLFAFGADKISINSPALADPTLISRLADRFGVQAIVVGIDSWFEQETGKYWVNQYTGDETRTRQTHWQLLDWVKEVQQCGAGEIVLNMMNQDGLRNGYDLAQLKLVRGVCRVPLIASGGAGKMVHFRDAFIEAKVDGALAASVFHKQIIEIGELKSYLVQSAIEIRSE

SEQ ID NO: 10094 - DNA, 774 bp, Corynebacterium glutamicum
  CDS (1)..(774)
atgggcgtggcaattcgagttattccttgcctggacgtggacaacggccgggttgttaaaggcgtgaactttgaaaacctcgcgatgctggctgatcctgtggagttggcaaagcgctatgacgaggaaggggcagatgagctgaccttcctggatgtcaccgcctcgaagcatggtcgcggcaccatgctggatgttgttcgacgcaccgctgatcaggtgttcatccctctgactgtcggtggcggcgtgcgcagcgaagaagatgttgatcaattgctgcgcgctggggccgacaaggtttcggtgaacacgtctgcgattgcccgtccagaactgctgtcagagctgtggaagcgttttggtgctcagtgcatcgtgttgtctgtggatgccaggcgcgttcctgaaggtggaactcctcagccatctggttttgaagtcaccacccacggcggttccaagtccgcagaacttgatgcaatcgagtgggcaaagcgcggcgaagagctgggcgttggcgaaattctgctcaactccatggacggcgacggcaccaaaaacggctttgacctagagctgctggaaaaagttcgcgcagccgtatccattcctgtaatctccggcggcgctggcaaggcggagcatttcccaccagctgttgcacgtggcgccaacgcagtgcttgccgcgaccattttccacttccgcgaagtaaccatcgccgaagtaaagggagccattaaagatgcaggatttgaggtgcggaaatga

SEQ ID NO: 10095 - protein, 257 aa, Corynebacterium glutamicum
MGVAIRVIPCLDVDNGRVVKGVNFENLAMLADPVELAKRYDEEGADELTFLDVTASKHGRGTMLDVVRRTADQVFIPLTVGGGVRSEEDVDQLLRAGADKVSVNTSAIARPELLSELWKRFGAQCIVLSVDARRVPEGGTPQPSGFEVTTHGGSKSAELDAIEWAKRGEELGVGEILLNSMDGDGTKNGFDLELLEKVRAAVSIPVISGGAGKAEHFPPAVARGANAVLAATIFHFREVTIAEVKGAIKDAGFEVRK

SEQ ID NO: 10096 - DNA, 777 bp, Salmonella typhimurium
  CDS (1)..(777)
atgctggcaaaacgtataattccgtgtctggacgttcgtgatggtcaggtggtaaaaggcgtacagtttcgcaaccatgagatcattggcgatatcgttccgctggccaaacgctatgccgacgaaggcgcggacgaactggtgttctatgacattaccgcctccagcgatggtcgcgtagtcgataaaagctgggtagcgcgcgttgccgaggtgatcgacattccgttttgtgtagcgggcggtatccggtcaattgacgacgccgccaaaattctctctttcggggcggataagatctctatcaactcccctgcactggctgacccaacgctgattacccgtctggctgaccgttttggcgtgcagtgcattgtcgtcgggattgatacctggtttgacgacgccacggggaaatatcatgttaaccagtataccggcgatgaaaaccgtacccgcgtgacgcagtgggagacgctggactgggtgcaagaggtacaacagcgcggcgcgggggaaatcgtcctgaatatgatgaaccaggacggcgtgcgtaacggttatgatctgacgcagttgaaaaaagtccgtgacgtttgccgcgtgccgctgatcgcctccggcggcgcgggcacgatggaacactttcttgaggcattccgtgatgccgatgtcgacggcgcgcttgccgcctccgtttttcacaagcaaatcatcaatattggcgaattaaaagcgtacctggcaggccagggcgtggagatcaggatatgttaa

SEQ ID NO: 10097 - protein, 258 aa, Salmonella typhimurium
MLAKRIIPCLDVRDGQVVKGVQFRNHEIIGDIVPLAKRYADEGADELVFYDITASSDGRVVDKSWVARVAEVIDIPFCVAGGIRSIDDAAKILSFGADKISINSPALADPTLITRLADRFGVQCIVVGIDTWFDDATGKYHVNQYTGDENRTRVTQWETLDWVQEVQQRGAGEIVLNMMNQDGVRNGYDLTQLKKVRDVCRVPLIASGGAGTMEHFLEAFRDADVDGALAASVFHKQIINIGELKAYLAGQGVEIRIC

SEQ ID NO: 10098 - DNA, 786 bp, Azospirillum brasilense
  CDS (1)..(786)
atgctcaagatgcgcgtcatcccctgcctggacgtcaaggacgggcgggtcgtcaagggggtcaacttcgtcgatctgatcgacgccggcgaccccgtggagcaggcccgcgtctatgaccgggaaggggcggacgagctgaccttcctcgacatcacggccagccacgagaaccgcgacaccatctacgacgtggtgcgccgcaccgccgagcaggtgttcatgccgctgaccgtcggcggcggcgtgcgcacggtggacgacatccgcaagctgctgctggccggcgccgacaaggtgtcgatcaacaccgcggccatccaccgtccggagttcgtccaagaggcggcggagaagttcggcgcccaatgcatcgtcgtcgccatcgacgccaagcaggtcgagccaggccgctgggagatcttcacccacggcgggcgcaaggccacgggcatcgacgccatcgagtgggccaagcgcatggagtcctacggggccggcgaaatcctgctgacctcgatggaccgcgacggcaccaagagcggcttcgacctcgccctgacccgcaaggtggccgacgggctgcgcataccggtgatcgcgtcgggcggcgtcggcaccctggaccatctggtggagggcatccgtgagggccacgccacggcggtgctggcggcctccatcttccatttcggcacctacaccatcgggcaggccaaggcggcgctggccgaggccggcattccggtgcgcccggcccgcatggcggaggccgcacatggctga

SEQ ID NO: 10099 - protein, 261 aa, Azospirillum brasilense
MLKMRVIPCLDVKDGRVVKGVNFVDLIDAGDPVEQARVYDREGADELTFLDITASHENRDTIYDVVRRTAEQVFMPLTVGGGVRTVDDIRKLLLAGADKVSINTAAIHRPEFVQEAAEKFGAQCIVVAIDAKQVEPGRWEIFTHGGRKATGIDAIEWAKRMESYGAGEILLTSMDRDGTKSGFDLALTRKVADGLRIPVIASGGVGTLDHLVEGIREGHATAVLAASIFHFGTYTIGQAKAALAEAGIPVRPARMAEAAHG

SEQ ID NO: 10100 - DNA, 2429 bp, Saccharomyces cerevisiae
  CDS (420)..(2078)
tagatgtttttttaatgatatatgtaacgtacattctttcctctaccactgccaattcggtattatttaattgtgtttagcgctatttactaattaactagaaactcaatttttaaaggcaaagctcgctgacctttcactgatttcgtggatgttatactatcagttactcttctgcaaaaaaaaattgagtcatatcgtagctttgggattatttttctctctctccacggctaattaggtgatcatgaaaaaatgaaaaattcatgagaaaagagtcagacatcgaaacatacataagttgatattcctttgatatcgacgactactcaatcaggttttaaaagaaaagaggcagctattgaagtagcagtatccagtttaggttttttaattatttacaagtaaagaaaaagagaatgccggtcgttcacgtgattgacgttgaaagtggtaacctacagtcactaaccaatgcaattgagcatttaggttacgaagtacaactggtgaaatcaccaaaggattttaacatatcaggcacgtcaagattgattttgcctggtgtcggaaattatggccatttcgtcgacaatttatttaatagaggattcgaaaagccgataagagaatacattgaatctggaaaaccaataatgggaatttgcgtcgggctacaagcgctctttgccggttccgtggaaagccctaagagtacgggtctgaactacattgattttaagttgtccaggttcgatgattcagaaaagccagtaccagaaataggttggaattcttgcattccctcggaaaacctattctttggattggatccatacaagaggtactatttcgtccattcttttgctgccattctgaattcagaaaagaaaaaaaacctagaaaatgacggttggaaaattgcaaaagctaagtacggttcagaggaatttattgcggcagtcaacaagaataatatattcgctactcagttccatcctgaaaaatcaggtaaagctggtttgaacgtcattgagaattttttgaagcaacaaagtcctccgattccaaactatagtgcggaagagaaggaactcttaatgaatgactattcaaattatggtctaacacgcagaattattgcttgtcttgatgtacgtactaatgaccaaggtgatttggtggttactaaaggtgatcaatacgatgtacgtgaaaaaagtgatggtaaaggtgttagaaaccttggtaagcctgttcagttggcacagaaatattaccaacagggtgcggatgaagtaacatttttgaatataacttcttttagagattgtcctttgaaggatactccgatgctagaggttctgaaacaagccgcaaagacagtctttgttccattgacagtcggtggggggatcaaggatattgtcgatgttgatggaaccaaaatacctgctttagaagttgcaagtctatacttcagatctggtgctgataaagtatcgatcggtacggatgcagtctatgcagccgaaaaatactacgagttgggtaacagaggagatggaacgtcaccaatagagacaatctcgaaagcatacggtgctcaggcagttgttatttctgtcgaccctaagagagtatatgtaaattcacaagcagatacgaagaacaaagtcttcgagacagaatatccgggccccaatggagagaaatactgctggtaccaatgtacaatcaaaggtggaagagaatctagagaccttggtgtgtgggaattaacaagggcatgtgaagctctaggtgctggggagattttattgaactgcatagacaaggatggctctaattctggttatgatctggaattgatagaacatgttaaagatgcggtcaagattcccgtcattgcatccagtggcgccggtgtacccgaacatttcgaagaggccttcctaaagacccgcgcagatgcttgcttgggtgcaggtatgttccacagaggtgaattcactgttaacgatgtaaaggagtatttactagagcacggattaaaggttagaatggatgaagagtaatgtggttggatatgtatactttataatcttgactcagtctatatacgcaataatgatagatgttaaatcagacatttcacaacacaagaggatgtacagcttggagaaattgtaccaacttatatggttgtattattggtggtgtcagtaggggaagaaatagaacatatttttccactttttcattttttttttttagcgaggcatcggaaatgaaaatttttaaaaatcgatgagctcccacttcttcaacattgacgaaaggaaatatgcactaagttgttttaaatccaagatttgtctcgttttaagacttacagataaaacaatatattagaaagattaactata

SEQ ID NO: 10101 - protein, 552 aa, Saccharomyces cerevisiae
MPVVHVIDVESGNLQSLTNAIEHLGYEVQLVKSPKDFNISGTSRLILPGVGNYGHFVDNLFNRGFEKPIREYIESGKPIMGICVGLQALFAGSVESPKSTGLNYIDFKLSRFDDSEKPVPEIGWNSCIPSENLFFGLDPYKRYYFVHSFAAILNSEKKKNLENDGWKIAKAKYGSEEFIAAVNKNNIFATQFHPEKSGKAGLNVIENFLKQQSPPIPNYSAEEKELLMNDYSNYGLTRRIIACLDVRTNDQGDLVVTKGDQYDVREKSDGKGVRNLGKPVQLAQKYYQQGADEVTFLNITSFRDCPLKDTPMLEVLKQAAKTVFVPLTVGGGIKDIVDVDGTKIPALEVASLYFRSGADKVSIGTDAVYAAEKYYELGNRGDGTSPIETISKAYGAQAVVISVDPKRVYVNSQADTKNKVFETEYPGPNGEKYCWYQCTIKGGRESRDLGVWELTRACEALGAGEILLNCIDKDGSNSGYDLELIEHVKDAVKIPVIASSGAGVPEHFEEAFLKTRADACLGAGMFHRGEFTVNDVKEYLLEHGLKVRMDEE

SEQ ID NO: 10102 - DNA, 759 bp, Rhodobacter sphaeroides
  CDS (1)..(759)
atgctcaagacccgcatcatcccctgcctcgacgtggccgacgcgcgcgtggtcaagggtgtcaatttcgtcgatctgcgcgacgcgggcgatccggtcgaggccgcccgcgcctacgatgccgcaggggcggacgagctctgcttcctcgatatccacgccacgcatgagaaccgcggcacgatgtatgacctcgtgacccgcaccgccgagcagtgcttcatgccgctgaccgtgggcggcggcgtgcggacccatcaggacgtgcgggcgctccttctggccggagccgacaaggtcagcttcaactcggccgccgtggccgatccgggcgtggtgccgagccgccgaccgcttcgcagccagtgcatcgtggtggcgatcgacaccaagacggtggctccgggccggtgggagatcttcacccacggcgggcgccgcgccacgggcatcgatgcggtggcgttcgcctgcgaaatggcaagccgcggcgcgggcgagatcctgctgacctcgatggaccgcgacggcacacgggcgggcttcaacctccccctcacccgcgccatctcggacgccgtgccgatcccggtcatcgcgagcggcggagtgggcacgctcgatcatctcgtcgagggcgtgaccgaaggcggtgcgtccgctgtgctcgcggcctcgatcttccatttcggcgaattcaccatcggcgaggccaaggcccacatggccgccgccggcatccccgtgaggctcgcatga

SEQ ID NO: 10103 - protein, 252 aa, Rhodobacter sphaeroides
MLKTRIIPCLDVADARVVKGVNFVDLRDAGDPVEAARAYDAAGADELCFLDIHATHENRGTMYDLVTRTAEQCFMPLTVGGGVRTHQDVRALLLAGADKVSFNSAAVADPGVVPSRRPLRSQCIVVAIDTKTVAPGRWEIFTHGGRRATGIDAVAFACEMASRGAGEILLTSMDRDGTRAGFNLPLTRAISDAVPIPVIASGGVGTLDHLVEGVTEGGASAVLAASIFHFGEFTIGEAKAHMAAAGIPVRLA

SEQ ID NO: 10104 - DNA, 786 bp, Synechocystis sp
  CDS (1)..(786)
atgaccttagcaaaacggattttgccttgtttagatgtcaatgcagggcgggtggtcaagggcataaactttgttgatctccaagatgccggggatccggtggagttggcccgggcctataacgaagcgggggcagacgagttggtgtttttagacatcactgctacccacgagcaacgggacaccattattgatgtggtttatcgcactgcggaagaggtgtttattcccctaacggtagggggcggcatttctacgttggaacatattaaaaatctgctccgggctggggcagataaggtgagtgttaattcctctgctgtgcgggacccggactttattagtcgagctagtgaccgttttgggcggcaatgcattgtggtggcgatcgatgcccgtcgtcggttagatgcggataatcccggctgggatgtgtatgtgcggggggggcgggaaaacaccggcctagatgcgatcgcctgggcggaggaagtggccaaacggggggcaggggaattgctggtcaccagtatggacggggatggcacccaagcgggttacgatctggccctcacagcggcgatcgccgaacgggtggaaattccggtgattgcttccgggggagcgggtaattgtcagcacgtgtacgaagcattcacggaaggcaaagctgaagcggcactgttagcttccctattgcactatggtcagttaaccattggggagttgaaaacctttttagaagcgagacaaattccagtcaggcacactgcggtttgtggctaa

SEQ ID NO: 10105 - protein, 261 aa, Synechocystis sp
MTLAKRILPCLDVNAGRVVKGINFVDLQDAGDPVELARAYNEAGADELVFLDITATHEQRDTIIDVVYRTAEEVFIPLTVGGGISTLEHIKNLLRAGADKVSVNSSAVRDPDFISRASDRFGRQCIVVAIDARRRLDADNPGWDVYVRGGRENTGLDAIAWAEEVAKRGAGELLVTSMDGDGTQAGYDLALTAAIAERVEIPVIASGGAGNCQHVYEAFTEGKAEAALLASLLHYGQLTIGELKTFLEARQIPVRHTAVCG

SEQ ID NO: 10106 - DNA, 771 bp, Synechocystis sp
  CDS (1)..(771)
atgaaaattttaccggcgatcgatctgctaggtggcaagtgtgtgcgcctctatcaaggggattatgaccagtcccaggtgtaccacgaagatccggtggaagtagcccgccagtggcaagcccagggagctagtcgtttgcatttagtcgatcttgatggagctaaggaaggacaaccagttaacctaacggcgatcgccaatattgttgaagccctaaccattcctgtacaggtaggcggaggcttaagggatagaaaccgggtcaaacaattgctggatttgggggtgggccgagttattctaggtacgatcgccgtggaaaatcctgacttagtgggggaattatgtgccgaatttcctgggcaaattgtggtgggtattgatgcccgcaatggcaaagtggccactagggggtggttagaaacttctacggtggaagcgggggaattggcccaacgcatggaaaagctaggagcggcggccattatctacactgatattcaccgggatggcacaatgcaggggcccaacttagatgctctgcgacaattagctagtcagttaaccattccagtgattgcatcggggggagtcagccaagtagaagacctgttgaatctgcttagcttggaaagtctgggggtcaatggagtcatcatcggcaaagccctttacaccggggacattcagttggcagaagcaatccgggcagtgggcaatggtcgctggcaagatgtgccgccgttggactttccccgtttgggctag

SEQ ID NO: 10107 - protein, 256 aa, Synechocystis sp
MKILPAIDLLGGKCVRLYQGDYDQSQVYHEDPVEVARQWQAQGASRLHLVDLDGAKEGQPVNLTAIANIVEALTIPVQVGGGLRDRNRVKQLLDLGVGRVILGTIAVENPDLVGELCAEFPGQIVVGIDARNGKVATRGWLETSTVEAGELAQRMEKLGAAAIIYTDIHRDGTMQGPNLDALRQLASQLTIPVIASGGVSQVEDLLNLLSLESLGVNGVIIGKALYTGDIQLAEAIRAVGNGRWQDVPPLDFPRLG

SEQ ID NO: 10108 - DNA, 2514 bp, Arabidopsis thaliana (mouse-ear cress)
  CDS (33)..(1811)
aacaatcgaagcagtgactgagtttgatatcaatggaggctacggcggcgccattctcttcaattgtctcttccagacaaaacttctcttcatcttcttcgattcgcgcttcttctccggcttctttattcctctcccagaagagtattggcaatgttaatcgcaaattcaaatctcccagaagcctctccgtccgcgcatcttctacctcagattctgttgtgactttgcttgactacggagctggaaatgttcggagcatccgcaatgctcttcgtcatctcggcttcagcatcaaagacgttcaaacgccgggagacattctgaatgctgatcgactcatatttccaggcgttggtgcttttgcacccgccatggatgtacttaacagaactgggatggctgaagctttgtgcaaatatattgagaatgaccgtccatttctaggcatatgtcttggtctacaactacttttcgattctagtgaagagaatggaccagtcaaaggtcttggtgtgataccgggaatagttggacgctttgatgcttcagctggtataagagtaccccacattggctggaatgctttgcaagttgggaaggattctgaaattttggatgatgttggaaaccgtcatgtctattttgttcattcgtacagggccattccatcagatgaaaataaggactggatttcgtctacctgtaattatggtgaatcatttatatcttccataagaaggggaaatgtgcatgcagttcaattccatcctgaaaagagcggggaggtggggctttctgttttaagaaggttcttgcatccaaaattacctgcaacacagaagccaatggaaggaaaggcctcaaaacttgcaaagagggtgattgcttgtcttgatgtgaggacgaatgataaaggagatctcgtagttactaaaggggatcagtatgatgtgagagagcaatctaatgaaaacgaggttcgaaaccttggcaaacctgttgatttggctgggcagtattacaaagatggtgcagatgagattagctttttaaacataactggattccgcgattttcctctaggggatttgccgatgattcaggtgttgaggcagacatcaaagaatgtctttgtaccactaactgttggaggtggtattagagactttacagatgctagtggcaggtactattctagcttggaagttgctgctgagtatttcagatccggtgctgataagatctccataggaagtgacgctgtttctgctgcagaggagttcataaaatcaggggtgaagacaggaaagagtagtttagaacagatatccagagtttatggaaatcaggcagtggttgtaagtattgatcctcgtagagtttatgtgaaccatccggatgatgtgccatacaaagtcatcagagtaactaatccaggcccaaatggagaagaatatgcctggtatcagtgcacggtcagtggaggacgagaaggtcgacctattggagcatttgagcttgcgaaagcggttgaagaattaggtgccggtgaaatactattgaactgcatagactgtgatggtcaagggaaaggattcgacatagacttagtaaagctcatctcagattcagtaggcataccggtgatcgcaagcagtggagcaggtactcccgaccacttttccgaggtgtttgagaagacaaacgcatctgccgcgcttgctgccggcattttccaccggaaagaggtaccaatccaatctgtgaaagagcacttacaagaggagcgcatagaagtcaggatctgagaattttctggtctgcgtgttaccataattcatgacacattcaacaagatagaatctttaccttcaataaattaaattaagtcggaaccatcggagctccaataggtctgagtgaatcctcttatagttgatttccttttgttgacagtaagactgatacaatttatggatttcccttgaaagtaagaaagcaacgtatgttcactttctcagcttttctatttaatacaaagaaagcatgtaacttctctctcgtctagatcttattaggaaatcattcaatccgaaaaacctcaaaagggtatcttattcagtcaaaattgaacatatctgtatcaaactgtgtaaaaagtaagaacgtagacactgaggcctattcttccaatcccgcaatactcgggaaactgtaaagaaacttgaaagataagaattgttgttacccccaaacgttttaaagacactgcaggtctataactggcaaaagccagacactttgtgactcctcgaaaccaaatcttttatatgtcaagaagaagcctttgtggatcctccacaacatccttgacacggcgcaggaagtacacagcctctctaccatcaatcagcctgtgatcatacgtaagtgcgacatacatcattggtctaggcactacgcttcctcctactaccattggacgtgacacaatcgagtgcatgccgagta

SEQ ID NO: 10109 - protein, 592 aa, Arabidopsis thaliana (mouse-ear cress)
MEATAAPFSSIVSSRQNFSSSSSIRASSPASLFLSQKSIGNVNRKFKSPRSLSVRASSTSDSVVTLLDYGAGNVRSIRNALRHLGFSIKDVQTPGDILNADRLIFPGVGAFAPAMDVLNRTGMAEALCKYIENDRPFLGICLGLQLLFDSSEENGPVKGLGVIPGIVGRFDASAGIRVPHIGWNALQVGKDSEILDDVGNRHVYFVHSYRAIPSDENKDWISSTCNYGESFISSIRRGNVHAVQFHPEKSGEVGLSVLRRFLHPKLPATQKPMEGKASKLAKRVIACLDVRTNDKGDLVVTKGDQYDVREQSNENEVRNLGKPVDLAGQYYKDGADEISFLNITGFRDFPLGDLPMIQVLRQTSKNVFVPLTVGGGIRDFTDASGRYYSSLEVAAEYFRSGADKISIGSDAVSAAEEFIKSGVKTGKSSLEQISRVYGNQAVVVSIDPRRVYVNHPDDVPYKVIRVTNPGPNGEEYAWYQCTVSGGREGRPIGAFELAKAVEELGAGEILLNCIDCDGQGKGFDIDLVKLISDSVGIPVIASSGAGTPDHFSEVFEKTNASAALAAGIFHRKEVPIQSVKEHLQEERIEVRI

SEQ ID NO: 10110 - DNA, 756 bp, Streptomyces coelicolor
  CDS (1)..(756)
atgaccctggcggtccgagtcattccctgcctggacgtggacaacggccgggtcgtcaagggcgtcaacttccagaacctgcgcgacgcgggcgaccccgtcgagatggccaaggtgtacgacgccgagggcgccgacgagctgacgttcctggacatcaccgcctcgtcgggcaaccgcgagacgacctacgacgtggtgcgccgcaccgccgagcaggtgttcatcccgctgaccgtcggcggcggggtgcgcaccgccgaggacgtcgacaagctgctgcgggccggtgcggacaaggtgggcgtcaacaccgccgccatcgcccgccccgacctgatccgtgagatcgccgagcgcttcggccgccaggtcctggtgctgtcggtcgacgcccggcgcaccgaggcggggaccttcgaggtgaccacccacggcggccggcgcggcaccggcatcgacgccgtggagtgggcgcaccgggccgccgagctgggcgcgggggagatcctgctcaactcgatggacgcggacggcacgaaggacggctacgacctggagatgctggcggcggtacgcaagcacgtcagtgtcccggtcatcgcctccggcggcgcgggcagcctcgcccacttcgccccggcggtcgaggcgggcgcggacgcggtgctggcggcgtccgtcttccacttcggcgacctgcggatcggcgaggtgaagaccaccctgcgcgaggcgggtcaccccgtcaggtag

SEQ ID NO: 10111 - protein, 251 aa, Streptomyces coelicolor
MTLAVRVIPCLDVDNGRVVKGVNFQNLRDAGDPVEMAKVYDAEGADELTFLDITASSGNRETTYDVVRRTAEQVFIPLTVGGGVRTAEDVDKLLRAGADKVGVNTAAIARPDLIREIAERFGRQVLVLSVDARRTEAGTFEVTTHGGRRGTGIDAVEWAHRAAELGAGEILLNSMDADGTKDGYDLEMLAAVRKHVSVPVIASGGAGSLAHFAPAVEAGADAVLAASVFHFGDLRIGEVKTTLREAGHPVR

SEQ ID NO: 10112 - DNA, 786 bp, Mycobacterium leprae
  CDS (1)..(786)
atgtactcgggtaacggtcttgcggtacgagtgattccttgcctggacgtctattgtgggcgtgtggttaaaggggtcaatttcaagaacctccgggatgcgggtgatctcgtggagttggctgccgcctacgatgctgaaggcgccgacgagctggcttttcttgacgtgactgcgtcgtcgtcgggcagggccaccatgctggaggtggtgcgctgcaccgccgagcaggtgttcatcccgttgatggtcggcggtggggtgcgtacggtcgctgacgtcgacgtgttgctgcgtgcgggagctgacaaggttgcggtcaacaccgcagcaattgctcgtcccgagctattggccgacatggcagggcaattcggttctcaatgcatcgtgttatctgtcgacgcgcgcacggtacccaccggatcagcgcgaacaccgtccgggtgggaggccactactcatggcggttaccgcggcaccggtattgacgctgttgagtgggcggcccgtggggccgaccttggggtgggagaaatcctgctgaactcgatggacgccgacggcactaaagccgggttcgacttggcgatgttgcgggctgttcgtgccgcggtcacggtgccggtcatagctagcggcggcgccggggcaatcgaacacttcgtgccagcggttactgccggtgctgatgcggttttggcggccagtgtctttcatttccgagagctaacgatcgggcaggtgaaagacgctatggccgcagcagggatcgcggtgcgatga

SEQ ID NO: 10113 - protein, 261 aa, Mycobacterium leprae
MYSGNGLAVRVIPCLDVYCGRVVKGVNFKNLRDAGDLVELAAAYDAEGADELAFLDVTASSSGRATMLEVVRCTAEQVFIPLMVGGGVRTVADVDVLLRAGADKVAVNTAAIARPELLADMAGQFGSQCIVLSVDARTVPTGSARTPSGWEATTHGGYRGTGIDAVEWAARGADLGVGEILLNSMDADGTKAGFDLAMLRAVRAAVTVPVIASGGAGAIEHFVPAVTAGADAVLAASVFHFRELTIGQVKDAMAAAGIAVR

SEQ ID NO: 10114 - DNA, 1994 bp, Arabidopsis thaliana (mouse-ear cress)
  CDS (6)..(1787)
tatcaatggaggctacggcggcgccattctcttcaattgtctcttccagacaaaacttctcttcatcttcttcgattcgcgcttcttctccggcttctttattcctctcccagaagagtattggcaatgttaatcgcaaattcaaatctcccagaagcctctccgtccgcgcatcttctacctcagattctgttgtgactttgcttgactacggagctggaaatgttcggagcatccgcaatgctcttcgtcatctcggcttcagcatcaaagacgttcaaacgccgggagacattctgaatgctgatcgactcatatttccaggcgttgggccttttgcacccgccatggatgtacttaacagaactgggatggctgaagctttgtgcaaatatattgagaatgaccgtccatttctaggcatatgtcttggtctacaactacttttcgattctagtgaacagaatggaccagtcaaaggtcttggtgtgataccgggaatagttggacgctttgatgcttcagctggtataagagtaccccacattggctggaatgctttgcaagttgggaaggattctgaaattttggatgatgttggaaaccgtcatgtctattttgttcattcgtacagggccattccatcagatgaaaataaggactggatttcgtctacctgtaattatggtgaatcatttatatcttccataagaaggggaaatgtgcatgcagttcaattccatcctgaaaagagcggggaggtggggctttctgttttaagaaggttcttgcatccaaaattacctgcaacacagaagccaatggaaggaaaggcctcaaaacttgcaaagagggtgattgcttgtcttgatgtgaggacgaatgataaaggagatctcgtagttactaaaggggatcagtatgatgtgagagagcaatctaatgaaaacgaggttcgaaaccttggcaaacctgttgatttggctgggcagtattacaaagatggtgcagatgagattagctttttaaacataactggattccgcgattttcctctaggggatttgccgatgattcaggtgttgaggcagacatcaaagaatgtctttgtaccactaactgttggaggtggtattagagactttacagatgctagtggcaggtactattctagcttggaagttgctgctgagtatttcagatccggtgctgataagatgtccataggaagtgacgctgtttttgctgcagaggagttcataaaatcaggggtgaagacaggaaagagtagtttagaacagatatccagagtttatggaaatcaggcagtggttgtaagtattgatcctcgtagagtttatgtgaaccatccggatgatgtgccatacaaagtcatcagagtaactaatccaggcccaaatggagaagaatatgcctggtatcagtgcacggtcagtggaggacaagaaggtcgacctattggagcatttgagcttgcgaaagcggttgaagaattaggtgccggtgaaatactattgaactgcataaactgtgatggtcaagggaaaggattcgacatagacttagtaaagctcatctcagattcagtaggcataccggtgatcgcaagcagtggagcaggtactcccgaccacttttccgaggtgtttgaagaagacaaacgcatctgccgcgcttgctgccggcattttccaccggaaagagggtaccaatcccaatctgtgaaagagcacttacaagaggagcgcatagaagtcaggatctgagaattttctggtctgcgtgttaccataattcatgacacattcaacaagatagaatctttaccttcaataaattaaattaagtcggaaccatcggagctccaataggtctgagtgaatcctcttatagttgatttccttttgttgacagtaagactgatacaatttatggatttcccttgaaagtaagaaagcaacgtatgttcactt

SEQ ID NO: 10115 - protein, 593 aa, Arabidopsis thaliana (mouse-ear cress)
MEATAAPFSSIVSSRQNFSSSSSIRASSPASLFLSQKSIGNVNRKFKSPRSLSVRASSTSDSVVTLLDYGAGNVRSIRNALRHLGFSIKDVQTPGDILNADRLIFPGVGPFAPAMDVLNRTGMAEALCKYIENDRPFLGICLGLQLLFDSSEQNGPVKGLGVIPGIVGRFDASAGIRVPHIGWNALQVGKDSEILDDVGNRHVYFVHSYRAIPSDENKDWISSTCNYGESFISSIRRGNVHAVQFHPEKSGEVGLSVLRRFLHPKLPATQKPMEGKASKLAKRVIACLDVRTNDKGDLVVTKGDQYDVREQSNENEVRNLGKPVDLAGQYYKDGADEISFLNITGFRDFPLGDLPMIQVLRQTSKNVFVPLTVGGGIRDFTDASGRYYSSLEVAAEYFRSGADKMSIGSDAVFAAEEFIKSGVKTGKSSLEQISRVYGNQAVVVSIDPRRVYVNHPDDVPYKVIRVTNPGPNGEEYAWYQCTVSGGQEGRPIGAFELAKAVEELGAGEILLNCINCDGQGKGFDIDLVKLISDSVGIPVIASSGAGTPDHFSEVFEEDKRICRACCRHFPPERGYQSQSVKEHLQEERIEVRI

SEQ ID NO: 10116 - DNA, 729 bp, Methanococcus voltae
  CDS (1)..(729)
atgtatattatacctgctgtggatatgaaagaaggcaaatgcgtgcagttaatacaaggagaccccacaaagagacatgtggagtatgacaaccctgacgaaatagctaaaatgtggatagaaaatggtgcagagatgttgcaccttgtagatttggatggtgcaattgacggagagcgtgtaaatttaccctgtgttaagaaaataattcaagagtcaaaagtacctgttcaaatgggtggtggcataagaaccatacaagatgtggaagaattagtcgatttggggattaataaagttattatcggtactgtggcagttcaaaatccagattttgttgaacaacttgctaaaaaagtaggtagtgacaaaataatggttgctttagatgcaaaagatggtaaagtagttataaaaggatggaaggaaaaaacagagtacacaccagttcaaatgggtaaaattttagaagaaaaaggtgctggtagtattttatttacaaatgtagactctgaaggtcttttaaatggtataaatatcacacctacaaaagaactcgtagataacttaaatataccgattatagcatctggcggagtaactacaatcgaagatttaattgaattcaaaaaaataggtgtagctggcgttgttgtaggttctgcattgtacaaaaacaattttaaactacaggacgcaataaatacagtaaataactttaaaatttaa

SEQ ID NO: 10117 - protein, 242 aa, Methanococcus voltae
MYIIPAVDMKEGKCVQLIQGDPTKRHVEYDNPDEIAKMWIENGAEMLHLVDLDGAIDGERVNLPCVKKIIQESKVPVQMGGGIRTIQDVEELVDLGINKVIIGTVAVQNPDFVEQLAKKVGSDKIMVALDAKDGKVVIKGWKEKTEYTPVQMGKILEEKGAGSILFTNVDSEGLLNGINITPTKELVDNLNIPIIASGGVTTIEDLIEFKKIGVAGVVVGSALYKNNFKLQDAINTVNNFKI

SEQ ID NO: 10118 - DNA, 717 bp, Methanococcus vannielii
  CDS (1)..(717)
atgcttataattcccgcagttgatatgaaaaataaaaagtgcgtgcaacttatacagggaaatcctgataaaaaacacgtggaacttgataatcctcctgaaattgcaaaaaaatgggttgaacaaggtgctgaaatgcttcatcttgttaacctcgatggtgcaataaatggaaagcgtgtaaacgacgaatttattgaagaaacaatcaaaaattcaggagttcccgttcaaattggtggggggataaggagcgtttcagatgcactttattttattgaaaagggtgcagaaaaagtgatacttggaacagttgcaattcaaaatcctaaaatcgttcgtgaaatctccagtattgtgggaaaggaaaaagtaacagttgcactcgatgcaaaagacggtaaagtattaataaaaggttggactgaaaaaacggactatagtccagttcaaattggaaaaatacttgaaaatatgggtgcaggaagtattttatttacaaatgtagatagtgaaggactacttgaaggtattaatgttttaccaacaaaagaacttgttgataatctaaacattccaataattgcctcaggcggagttacaaccgttgaagacctcttaaaatttaaagaaatcggagtttatgcagttgtagttggttcagcactttataaagatatgataaacttaaaagatgcaattttagcatcgaaatag

SEQ ID NO: 10119 - protein, 238 aa, Methanococcus vannielii
MLIIPAVDMKNKKCVQLIQGNPDKKHVELDNPPEIAKKWVEQGAEMLHLVNLDGAINGKRVNDEFIEETIKNSGVPVQIGGGIRSVSDALYFIEKGAEKVILGTVAIQNPKIVREISSIVGKEKVTVALDAKDGKVLIKGWTEKTDYSPVQIGKILENMGAGSILFTNVDSEGLLEGINVLPTKELVDNLNIPIIASGGVTTVEDLLKFKEIGVYAVVVGSALYKDMINLKDAILASK

SEQ ID NO: 10120 - DNA, 765 bp, Symbiobacterium thermophilum
  CDS (1)..(765)
atgcccctcgcgaagcgcatcatcccgtgcctggatatccgggacgggcgggtggtgaagaacgtccagttccacctgaacacctgggacgccggcgacccggtggccctggccgccgagtacgaccggcagggggcggacgagatcgtctttctggacatcaacgcctcctgggaggggcggtcggccacgctggacgtcctgagccgggccgccgagcaggtcttcgtgcccctgaccatcggcgggggggtgagcgccgtcgagcacgtgaaggcgtacctgcgggcgggggcggacaaggtgtcggtcaacaccgcggccgtgcagcggcccgacctcatcgacgagatcgccgacctgttcggctcctccaccctggtggtggccatcgactgcaagcggcggcccgaggggggctgggaggtctacctgcacggcggacgcacgcccaccggcatcgacgccgtcgcctgggccgaggaggcggcccggcgcggggcgggcgagttgctggtcacgtcgatggacgccgacggcacccggcaggggtacgacatcgcgctccaccaggccctggccgacgcggtcggggtgcccgtcatcgcctccggcggggcagggagcccggaggacatcctcgaagttctgaccgtgggccgggcggatgccgccctggccgcctcgatcttccacagcggcaggcacacggtgggggaggtgaaggccttcctccgggagaggggggtgctggtacggtcatga

SEQ ID NO: 10121 - protein, 254 aa, Symbiobacterium thermophilum
MPLAKRIIPCLDIRDGRVVKNVQFHLNTWDAGDPVALAAEYDRQGADEIVFLDINASWEGRSATLDVLSRAAEQVFVPLTIGGGVSAVEHVKAYLRAGADKVSVNTAAVQRPDLIDEIADLFGSSTLVVAIDCKRRPEGGWEVYLHGGRTPTGIDAVAWAEEAARRGAGELLVTSMDADGTRQGYDIALHQALADAVGVPVIASGGAGSPEDILEVLTVGRADAALAASIFHSGRHTVGEVKAFLRERGVLVRS

SEQ ID NO: 10122 - DNA, 756 bp, Propionibacterium acnes
  CDS (1)..(756)
atggctatacgtgtcattccatgtctggacgttaaggatgggcgggtcgttaaaggggttaacttcgtcggtctgcgcgatgccggtgatcccgtggagctagcggcggaatacgggcggctcggtgccgacgaggtgactttcctcgacatttctgcctcaacagaggggcgcgccaccactcgcgagatggtgacacggtgcgctgagacagttttcgtgcccctcactgtaggtggtggggtgcgcggggtcgacgacgtcgatgtcctgctgagggcgggagctgacaaagttggtgtcaacaccgcagcgattgctcatcccgggatgatcgacgaggtcgctgaccggtttggcaatcaggtcatcgtgttgtctgtcgatgcccgtcgcgaaccagatcggccatccggttttggggtgacgacccatggtggcacccgttcggcagggttggacgccgttgagtgggcttgccaagccgtggagcgtggggcaggtgagattctgctcaattcgatggacgccgatggtacggctgatggcttcgatattgagatgatcgaggcagtgagagcagctgtcgacgtccccctcatcgcttcaggtggagctggaaaggttgccgatttcgtcgaggcggcgcgcgccggagttgacgcggtgctcgccgcgtcagtttttcactatcacaccctgacgatcgcgcagatcaaggacggcctgcgtcatgccggctttgaggtccgctga

SEQ ID NO: 10123 - protein, 251 aa, Propionibacterium acnes
MAIRVIPCLDVKDGRVVKGVNFVGLRDAGDPVELAAEYGRLGADEVTFLDISASTEGRATTREMVTRCAETVFVPLTVGGGVRGVDDVDVLLRAGADKVGVNTAAIAHPGMIDEVADRFGNQVIVLSVDARREPDRPSGFGVTTHGGTRSAGLDAVEWACQAVERGAGEILLNSMDADGTADGFDIEMIEAVRAAVDVPLIASGGAGKVADFVEAARAGVDAVLAASVFHYHTLTIAQIKDGLRHAGFEVR

SEQ ID NO: 10124 - DNA, 1593 bp, Desulfotalea psychrophila
  CDS (1)..(1593)
atgaaagtaacgctattggattatggggctggcaatgttcgtagtatacgtaatgctattcgggcgttaggatgtgaaattgtagaggtacagcatcccgaagatattttaacggcagataaactgatctttccgggggtcggaagctttggctctgtgatgcacaccctgcgtgaccgtggctatatagaacctctcaagcgaagaatagaggaagacaagccctttcttggcatctgtgttgccctgcaggccctgtttgaaggcagtgaagagacccccggcgtggcggggcttggcatcctgccggggcagatcaaaaaatttgtgcgctcggccctatcggtgccgcagattggctggaatggcattcatctcctcaaagaatctccctcctttgctggctatgaggaagaaaagctctattttgttcactcctaccatgcaccccttgatactgtgcctgaggattgggccttaacagcaacagattacggtactcgctttatctcggcggtggaaaagggaaatgttaccgcatttcagttccacccggaaaagagcggacaagccggtttgaaccttctccagaatttcctctcctcccagaagaggccctcgcagactccaatcgtaccgattgagatagagaagaagacagagcatgcaaagcgtgttattgcctgccttgatgtacgctccaatgataacggtgatcttgttgtgaccaagggcgatcagtatgatgttcgtcaggagggtgaggtgcgaaatctgggcaaaccggtggatcttgcccgtcgctactatcaggagggggccgacgaggtaactttcctcaatataacaggctttagagattttcccatggaggaccagcccatgattgaggtgctgcagaaggcctctgaaaatgtatttgtaccccttaccattggtggtggcatccgtgactttaccgatagcaatggtaagtattactctgcccttgacgttgccgctcagtatttcagatccggggccgataaaatatctattggctccgatgccgtagccattgttgaggaatatctggccaccggcaagaagagcggcaagagctccatcgaacagatctctgccgtctatggtgtgcaggcagttgttatctctgtagatccgcgcagagtctacgtacaaagcccggacgagactactcatacctgtgttaaaacagggagtttaggacctaatggcgaagagtactgttggtatcagtgtacgattaagggcggtcgggagggaagtaagctcgatgctgtccagttggtgcagggctgtgaggccctgggggcgggagagattctgctcaactgtattgataaggatggtaccaacgatggttttgagcttgaactgatctctctggtcaagaaggctgtctccattccggttattgcctccagtggtgctggctctgcccgggattttgtcgaggtcttccgagaaacagatgccgatgcggctctggcagcgggaatctttcacagagaagaggttccaatctctgaggtaaagacaacccttatgcaggcaggaatctcctgtcgctga

SEQ ID NO: 10125 - protein, 530 aa, Desulfotalea psychrophila
MKVTLLDYGAGNVRSIRNAIRALGCEIVEVQHPEDILTADKLIFPGVGSFGSVMHTLRDRGYIEPLKRRIEEDKPFLGICVALQALFEGSEETPGVAGLGILPGQIKKFVRSALSVPQIGWNGIHLLKESPSFAGYEEEKLYFVHSYHAPLDTVPEDWALTATDYGTRFISAVEKGNVTAFQFHPEKSGQAGLNLLQNFLSSQKRPSQTPIVPIEIEKKTEHAKRVIACLDVRSNDNGDLVVTKGDQYDVRQEGEVRNLGKPVDLARRYYQEGADEVTFLNITGFRDFPMEDQPMIEVLQKASENVFVPLTIGGGIRDFTDSNGKYYSALDVAAQYFRSGADKISIGSDAVAIVEEYLATGKKSGKSSIEQISAVYGVQAVVISVDPRRVYVQSPDETTHTCVKTGSLGPNGEEYCWYQCTIKGGREGSKLDAVQLVQGCEALGAGEILLNCIDKDGTNDGFELELISLVKKAVSIPVIASSGAGSARDFVEVFRETDADAALAAGIFHREEVPISEVKTTLMQAGISCR

SEQ ID NO: 10126 - DNA, 1773 bp, Debaryomyces hansenii CBS767
  CDS (1)..(1773)
atgaagacagtatacgttatagatgttgagagcggtaatttgcaatccttattcaatgccataaaacgcatagggggttatgatgttaagtttattcatgatgcaaaagaattcgccgactacaatgatagtattgaaaaattaatattcccaggtgtgggtaactatgctcattttatcaagcaattacacgatagagagttagtggatccaattactaagtatatcgagagtggtagggctcttatgggtatttgtgttggattacaagcatttttcgaaagtagtgaagagagtgataattcggaatatcagggtttgggatatttgaaatttggcttatccaaattcaataagtcagatccagtctttactcaaagaaaacaattgaaagcggttccgcatatcggctggaatagtgttaatacaatcaaggctaataataccactctttcgaagacaacgtctttttttggaatcaatacagttaataaatactattttgttcattcatacgcggctatactaaaagatgaacaacaagaaaaggtgatcagcgaagccatttcaaatggctgggatattgcttttgcaagatacggatcagaaatcttcttagcagcggtatcgtataagaacttcttcgccacgcagttccacccagaaaaatctggcgttgctggtttgaaagttatcaaaagcttcttggaaggctcaaggtttagtgaggtcactacatctgatgctcagccggttgataatattgaaaatactttgagtggattaaccagaagaattattgcctgccttgatgttagaagtaatgatgacggagatttggttgtcacgaaaggtgatcaatataatgttcgtgaatcgtccggagattctgatgaaagtaaggtaagaaacttaggaaaacctgttgaattagcaacgagatattacaatcaaggggctgatgaggttacgtttttaaatataacttcattccgtaattcacctttgaaggatttgcccatgttgaaagtcttgagtacagcagcagaaacaatctttgtacctttaacagtaggtggtggaattaaagatttagttgacccaatctctggtgaaaaagtgccagctgccaaggtagccagtttgtattttagatctggtgctgataaagtgagtattggctctgatgctgtcacaatagccgagaattattatgcgaacaacaaacataagacgggaactacttcgattgaaaccatttctgctacctttggtagccaggctgtggttatatctgttgacccaaagcgtaaatacgttctgtccccatctgaaaccacaatggaaaccattcatattcaggatcctctgaagtatggtccagcaggcgagaaatattgctattatcaagtgacttctcaaggtggaagagtaactcacgaattaggtgcgcttgagttatgtcttgcgtgtgaagatttaggtgctggtgaaattttattgaattcaattgatcatgatggttctaataaaggttttaatttggaattattaagacaagttaaagaaaaagcttcaatccctgttatagctagttctggtgctggaaagcctgaacatttccaagaagtttttgacatggattgtggaattgacgctgctttaggagctggtttatttcacagaggtgaatatgaagtcaacgatgttaagagatatttacaaaaagaatgctctatggatgtcaggttagatgacactgtggaattatag

SEQ ID NO: 10127 - protein, 590 aa, Debaryomyces hansenii CBS767
MKTVYVIDVESGNLQSLFNAIKRIGGYDVKFIHDAKEFADYNDSIEKLIFPGVGNYAHFIKQLHDRELVDPITKYIESGRALMGICVGLQAFFESSEESDNSEYQGLGYLKFGLSKFNKSDPVFTQRKQLKAVPHIGWNSVNTIKANNTTLSKTTSFFGINTVNKYYFVHSYAAILKDEQQEKVISEAISNGWDIAFARYGSEIFLAAVSYKNFFATQFHPEKSGVAGLKVIKSFLEGSRFSEVTTSDAQPVDNIENTLSGLTRRIIACLDVRSNDDGDLVVTKGDQYNVRESSGDSDESKVRNLGKPVELATRYYNQGADEVTFLNITSFRNSPLKDLPMLKVLSTAAETIFVPLTVGGGIKDLVDPISGEKVPAAKVASLYFRSGADKVSIGSDAVTIAENYYANNKHKTGTTSIETISATFGSQAVVISVDPKRKYVLSPSETTMETIHIQDPLKYGPAGEKYCYYQVTSQGGRVTHELGALELCLACEDLGAGEILLNSIDHDGSNKGFNLELLRQVKEKASIPVIASSGAGKPEHFQEVFDMDCGIDAALGAGLFHRGEYEVNDVKRYLQKECSMDVRLDDTVEL

SEQ ID NO: 10128 - DNA, 1662 bp, Yarrowia lipolytica CLIB99
  CDS (1)..(1662)
atgccaattatccacgtgatcaacgtcgagtctggcaacctgcggtctctggaaaacgccctcaacgtgctgggatacacggtggagtgggtctctagcccagaccagatcactgactccattgagaagctcattttccccggagttggcaactttggccactttgtgaaggagattgacgcccgaggattcattggccccctcaagaagtacattgagagcaaacggccgttgtttggcatctgtgtgggtctccaggctttttttgagggatccgaggagtccaagactgttgcaggactgggtcttgtgcccggtgttctgagcaagtttgacgataaggacaagagcgtgccccagattggctggaactcggtggatagccgagatttcgccgagcacaagtctctgtacggcatggtgccttcttccaagtactactttgtgcattcgtacgcttgtattctggatgaggccgtcaagaacaagatcgaggctgcaggctgggatattgccacgtcacaatatggtaaccagacatttgtggctgctatttccaaggacaatgttgttgctacccaattccaccccgagaagtctggagcagccggtctgcgtgtgattgacgctttcctcaagggtaagaagtacgtggaggaccctgtaattgctccccagacatcgttcggtctcacaaagcgagtcatcgcctgtctggacgttcgaaccaacgaccagggtgatcttgttgttaccaagggagaccagtatgacgtgcgagagaagactggagagggccacgtacgaaacctcggaaagccagtttccatggccgaaaagtactacaaggacggagccgatgaggtcactttccttaacattacttcgttccgagactgccctgttcaggatcttcccatgctggaggttcttcgacagacttccaagactgtttttgtgcccctgactgtcggaggtggtatccgagacgtaactgactcttctggaaacgtcaccaccgctctacaggttgctacccagtactttatgtctggtgccgacaaggtgagtattggtagtgatgcggtctttgctgccgaggagtactacaagagcggcaagaagctatctggtaagacccccatggagactatttccgccgcatacggagtccaggccgttgttgtttctgtcgaccccaagcgagtctacgttgatgctcccctgaccgacagagtttgcattgagaccaaatacccctctgccgacggaaagaagtactgctggtaccagtgcaccgtcaagggcggacgagaggcccgagatcttggcgttttcgagctcgtccaggcgtgcgaggctctgggagctggagagattctgctcaactgcattgataaggacggaaccaactccggtttcgatcttgagctcatcgaccacgtcaagtctgccgtcaagatccccgtcattgcttcctccggcgctggaaaccccggtcacttcgaggaggtcttccgagagacctctgctgacgcggctcttggagctggtatgttccaccgaggagagtactccgtcaaggatgtcaaggacttcctggagaacaagggcgaggttgtgcgagcctttgagccaattgagctggttcacgttgagtaa

SEQ ID NO: 10129 - protein, 553 aa, Yarrowia lipolytica CLIB99
MPIIHVINVESGNLRSLENALNVLGYTVEWVSSPDQITDSIEKLIFPGVGNFGHFVKEIDARGFIGPLKKYIESKRPLFGICVGLQAFFEGSEESKTVAGLGLVPGVLSKFDDKDKSVPQIGWNSVDSRDFAEHKSLYGMVPSSKYYFVHSYACILDEAVKNKIEAAGWDIATSQYGNQTFVAAISKDNVVATQFHPEKSGAAGLRVIDAFLKGKKYVEDPVIAPQTSFGLTKRVIACLDVRTNDQGDLVVTKGDQYDVREKTGEGHVRNLGKPVSMAEKYYKDGADEVTFLNITSFRDCPVQDLPMLEVLRQTSKTVFVPLTVGGGIRDVTDSSGNVTTALQVATQYFMSGADKVSIGSDAVFAAEEYYKSGKKLSGKTPMETISAAYGVQAVVVSVDPKRVYVDAPLTDRVCIETKYPSADGKKYCWYQCTVKGGREARDLGVFELVQACEALGAGEILLNCIDKDGTNSGFDLELIDHVKSAVKIPVIASSGAGNPGHFEEVFRETSADAALGAGMFHRGEYSVKDVKDFLENKGEVVRAFEPIELVHVE

SEQ ID NO: 10130 - DNA, 1659 bp, Kluyveromyces lactis NRRL Y
  CDS (1)..(1659)
atgacagtcgtgcatattattgatgtggaatctggtaatttgcaatccttgcagaatgctatcaatcatttaggttacgagacaagattaatcaagtctgcttcagatccagagttacaaactgctgaaagaatcatcctgccaggtgtcggtaattttggccattttgtcgataacttaacttctcgtgggtttgagcaacctatcaaagattatattgcatccggaaggccgttgatgggtatttgtgttggcttgcaagcgcttttcgatggatcttctgaatctccttcaagcagagggttaggtttaatcccaggtactttgtccaaatttgatatcagtgaaggtaaaagtgttcccgaaattggatggaataccattattccacaggacgatctttcatttggtttagatccttataaaaggtactacttcgttcattcttttgctatgatcgtcgatgatgtacaacttgatgacttgcatagtaagggatggaaagttgctttgacaagatacggtaacgaaagatttgttgccgccattcacaaggataatgtgttttctacacaattccatccggagaaatctggtaaggccggtctagaaattatagataactttttgaaaggtattcacccagttacagagtacacagatgaacaaaaatctcttttagggaatgactatacaaactttggtttgacaagaagaataattgcttgtctcgatgtccgtacgaatgatcaaggtgatctagtggtaaccaaaggggaccaatacgatgtccgtgaaaaaacagaaggaggcaacgttagaaacttgggaaaacctgtagagctcgcacaacgttactatgaacaaggtgctgatgaagttactttcttaaatatcaccagtttcagaaactgtccattaaaggatactccaatgttggatgtgctaagacttgctgccaagactgtgtttgtaccactgacagtcggaggtggtatcaaagatgtcgtggatgttgacggcacaaaagtaccggctttagatgtggccggcatgtatttcagatctggtgctgataaggtttctattggtacagatgcagtgtttgctgcagaaaagtactatgctaacggagaaaagggtgatggaaaatctccaattgaaacgatttctaaagcttatggtgcacaagcggtggttatttctgtggaccctaaaagagtttatgttaacaataggaacgaaacccctaataaatgtttccaaactttatcgcctaatcctgaggggcaaaattggtgctggtatcaatgtacaatcaagggtggtagagaatccagagacctaggagcctgggaattggctcatgcatgtgaagcccttggtgctggtgagattctcctaaactgtattgataaagacggctcaaactcaggatacgatttggaattaatcgatcatattaaaagtgccgtttcaattcctgttattgcctcatcaggtgcagggaatccaggtcactttgaacaaggatttacaaagacaaaggctgatgcttgtttaggtgcaggtatgttccatagaggagaatacactgttaaccaggtcaaggattacctgatctctaaaggtttaaaagtcagaattgataacgagtaa

SEQ ID NO: 10131 - protein, 552 aa, Kluyveromyces lactis NRRL Y
MTVVHIIDVESGNLQSLQNAINHLGYETRLIKSASDPELQTAERIILPGVGNFGHFVDNLTSRGFEQPIKDYIASGRPLMGICVGLQALFDGSSESPSSRGLGLIPGTLSKFDISEGKSVPEIGWNTIIPQDDLSFGLDPYKRYYFVHSFAMIVDDVQLDDLHSKGWKVALTRYGNERFVAAIHKDNVFSTQFHPEKSGKAGLEIIDNFLKGIHPVTEYTDEQKSLLGNDYTNFGLTRRIIACLDVRTNDQGDLVVTKGDQYDVREKTEGGNVRNLGKPVELAQRYYEQGADEVTFLNITSFRNCPLKDTPMLDVLRLAAKTVFVPLTVGGGIKDVVDVDGTKVPALDVAGMYFRSGADKVSIGTDAVFAAEKYYANGEKGDGKSPIETISKAYGAQAVVISVDPKRVYVNNRNETPNKCFQTLSPNPEGQNWCWYQCTIKGGRESRDLGAWELAHACEALGAGEILLNCIDKDGSNSGYDLELIDHIKSAVSIPVIASSGAGNPGHFEQGFTKTKADACLGAGMFHRGEYTVNQVKDYLISKGLKVRIDNE

SEQ ID NO: 10132 - DNA, 777 bp, Erwinia carotovora
  CDS (1)..(777)
atgctggcaaaacggataatcccctgtctggacgtacgtaacggtcaggtcgtcaaaggtgtgcagttccgcaaccacgaaatcatcggtgacatcgtgccgctggcgcagcgctatgcgcaggaaggtgctgatgagctggttttttatgatatcacagcctcttcggatggccgtgtagtcgataaaagctgggtatcccgcgttgcggaagtcatcgatattcctttctgtgtggcgggcggcattaaaagcgtggaagaagccggtcaaatactctctttcggcgcggataaaatttccatcaactccccggcgctggccgaccctgagttaattacccgattggccgatcgctatggcgtgcagtgcatcgtcgtcgggattgatacctggcatgatgccgcgaccggccgctatcatgtgaatcaatacacgggtgatgaaacgcgaactaaggtcaccacctgggaaacgctggattgggtagaagaagtgcaaaagcgcggcgcgggtgagattgtcctgaacatgatgaatcaggacggcgtgcgcaacggctatgatttgcaccagttaaatctggtgcgtgatgtctgcaacgtcccgctgattgcttctggcggcgcaggcaccatggagcattttctggatgcgttccagaccgcccacgttgatggcgcgctggcagcatcggtgtttcacaagcaaattattaatattggcgaactgaaacaatatcttaagcaacaaggcgtggagattcgagtgtgttaa

SEQ ID NO: 10133 - protein, 258 aa, Erwinia carotovora
MLAKRIIPCLDVRNGQVVKGVQFRNHEIIGDIVPLAQRYAQEGADELVFYDITASSDGRVVDKSWVSRVAEVIDIPFCVAGGIKSVEEAGQILSFGADKISINSPALADPELITRLADRYGVQCIVVGIDTWHDAATGRYHVNQYTGDETRTKVTTWETLDWVEEVQKRGAGEIVLNMMNQDGVRNGYDLHQLNLVRDVCNVPLIASGGAGTMEHFLDAFQTAHVDGALAASVFHKQIINIGELKQYLKQQGVEIRVC

SEQ ID NO: 10134 - DNA, 738 bp, Erwinia carotovora
  CDS (1)..(738)
atgattattcccgcattagatctgattgatgggcaggttgtccgtctgcatcagggtgattatggccagcagcgccaatacggaagcgatccacttccccgcttgcaggattaccagcaacaaggtgcaggcgtgctgcatttggtggatttgaccggagcaaaaaatccctctgcccgacagattccactgttaaccacgctgttggctggcgttagcgtaccggtacagatcggcggcggcattcgtaccgagcaggacgtagaagcgttgctaaaagccggtgccagccgtgtcgttattgggtccaccgcggttaagcagccggaactcgttcagcaatggttcacccgctacggcgcagaggcgctggtgcttgcactagacgtgcgtatcgacgcaaacggcacgaagtacgtcgccatcagcggctggcaggagaattcagacgccacgcttgagcagatcgttgaacaatatctgccgttcggtctgaagcatgtgctgtgcaccgacatttcccgtgacggtacgctgagcggctccaacgtcgagctctatcgtgaaatcagtcagcgctacccgcagattgcctttcaggcgtccggcggcataggtaatctgaccgatatcgccaatttgcgcagcagcggtgtgcagggcgttatcgtcggccgtgcgctgttggaaggtaaatttaacgtcgcggaggctatttcatgctggcaaaacggataa

SEQ ID NO: 10135 - protein, 245 aa, Erwinia carotovora
MIIPALDLIDGQVVRLHQGDYGQQRQYGSDPLPRLQDYQQQGAGVLHLVDLTGAKNPSARQIPLLTTLLAGVSVPVQIGGGIRTEQDVEALLKAGASRVVIGSTAVKQPELVQQWFTRYGAEALVLALDVRIDANGTKYVAISGWQENSDATLEQIVEQYLPFGLKHVLCTDISRDGTLSGSNVELYREISQRYPQIAFQASGGIGNLTDIANLRSSGVQGVIVGRALLEGKFNVAEAISCWQNG

SEQ ID NO: 10136 - DNA, 810 bp, Acinetobacter sp
  CDS (1)..(810)
atgcaatctcggaaaatttatttatttagactcatactgttggatgccacaatgcttgcaaaacgtattattccctgccttgatgtcgataatggccgtgtggtcaagggcgtgcaatttttagatattcgtgatgcaggtgatcctgttgaagttgcacgtcgctacaatgagcaaggtgcagatgaaattacttttctggatattactgcaacgcatcatggtcgtgataccacctatcgtacagttgaacgtatggcagaaagcgtatttgtccctctgactgtcgggggtggtgtgcgtaaggtggaagacattcgtttattgctgaatgcaggtgcagataaagtgagcattaactcggcagccgtgtttaatcctgagtttgtacaagaagcatcacaacgctttggggcccaatgtattgtggttgcaattgatgctaaaaaaacaggcgacaacacatgggaaatttttacccacggtggtcgtaagcctacgggcattgatgcactggagtggtcggtgaagatggcagaatacggcgcaggcgaactgctggtgaccagtatggatgccgatggtaccaaagcaggttatgacattgccttgatgcgtgaaattaacaaccgtgtttcaattcccaccattgcctctggcggcgtagggaatttacagcatatggcagatgggattttaaaaggtggtgcagatgcggtactggcagccagtattttccactttggtcagcataccattcctgaagcaaaacagtttttggctgcacaaggcatcgaaatgcgtctctaa

SEQ ID NO: 10137 - protein, 269 aa, Acinetobacter sp
MQSRKIYLFRLILLDATMLAKRIIPCLDVDNGRVVKGVQFLDIRDAGDPVEVARRYNEQGADEITFLDITATHHGRDTTYRTVERMAESVFVPLTVGGGVRKVEDIRLLLNAGADKVSINSAAVFNPEFVQEASQRFGAQCIVVAIDAKKTGDNTWEIFTHGGRKPTGIDALEWSVKMAEYGAGELLVTSMDADGTKAGYDIALMREINNRVSIPTIASGGVGNLQHMADGILKGGADAVLAASIFHFGQHTIPEAKQFLAAQGIEMRL

SEQ ID NO: 10138 - DNA, 732 bp, Acinetobacter sp
  CDS (1)..(732)
atgctgatcatccctgcaattgacctgaaagatggtaaatgtgtccgcctcaagcaaggtcgtatggaagacgataccgttttctctgacgatccagttgcaaccgcacagcattgggtcaatgaaggtgcacgtcgtttacatttggtcgatttgaatggtgccttcgcaggaacccccattcataaaccagtggttgaagcaattgccaaagcacaacctgagcttcccatccagattggcggtggtattcgctcccttgaaaccattgagcattatttagatgcaggcgtatcctttgtcattattggtaccaaagccgtacaagatcctgagtttgtcgagcaggcatgcaaacagtttgctggtcatatcattgtaggcatcgatgccaaagatggcatggtggcaaccgatggctgggccaatgtgacagatgtaaaagcaactgatttggccaaacgttttgccgatgcaggtgtttcaagcattgtatataccgatattgcacgtgatggcatgatgcaaggtgtaaatgtcgagcagactgtcaatctggcgcagtattctggcttacccgtgattgcttctggcggtgttaccaatctggatgatgtacgcttactcaaaggcaagcctggtattttaggagccattactggtcgtgccatttatgaaggtacgctcagccttcgtgaagcacagttattgcttgatcaaaatacgctttaa

SEQ ID NO: 10139 - protein, 243 aa, Acinetobacter sp
MLIIPAIDLKDGKCVRLKQGRMEDDTVFSDDPVATAQHWVNEGARRLHLVDLNGAFAGTPIHKPVVEAIAKAQPELPIQIGGGIRSLETIEHYLDAGVSFVIIGTKAVQDPEFVEQACKQFAGHIIVGIDAKDGMVATDGWANVTDVKATDLAKRFADAGVSSIVYTDIARDGMMQGVNVEQTVNLAQYSGLPVIASGGVTNLDDVRLLKGKPGILGAITGRAIYEGTLSLREAQLLLDQNTL

SEQ ID NO: 10140 - DNA, 1659 bp, Candida glabrata CBS138
  CDS (1)..(1659)
atgtctacggtacatgttattgatgttgagagtggtaacttgcagtctctgaccaatgcaattgaatatctagggtttagagtccaattgatcaaggactcccaagatcctgaactgctgaaagcagaaaagttgatactgccaggtgttggtaactatgggcatgtgtatgagaatatattatccagagggtttgagaagcccatcagggaatacatagcttctggcaaaccgatcatgggtatttgtgttggtctacaagttttgtttaatagctctaccgaaagtccctccagcggcgggtttggctatgtgaaccatagactatctcgcttcaatgatgatgaaaagccagttcctgaaattggctggaacagcgtcatcccagaaaaggacttgttctttggcttagatccttacaagagatattatttcgttcactcatatgctggtatactagatgcagcaacagaatcaagcttgaaagctgacggctggaggattgcgaaggctaaatatggttctgaggaatttattgctgcagtttacaaggacaatatatttgctactcagttccaccctgagaaatcaggtttggcaggtttgcatataattgaaaactttctaaaacaggcacatccagggttaccagcttactcagaggatgaaaagtccttgcttggcaatgattactcaaactatggattaacgagaagaattatagcgtgtttggacgtacgtactaatgatcaaggagatctcgttgttacaaagggagaccaatatgatgtcagagagaaaagtggtgacaacgacgtaagaaatcttggtaagccagttcaattggctcaaaaatattatgaacaaggtgccgatgaagtgacatttttaaatattacatcattcagagacagtccggtgaaagataccccaatgcttgaagtgttgagacagactgcgaaaaaggtttttgtcccattaaccgttggtggtggtatcaaggatatcgtcgatccggatggaacccatgttagcgctcttgaagtagcaagtctgtacttcagatcaggtgctgataaagtctctatcgggaccgattctgtttatgctgcagagaaatactatgcgaatgaaggaaaaggggatggtacatcgccaattgaaactatctcaaaagcttacggtgctcaagcagttgtaatttctgttgatcccaagagagtttatgttaacgatccaagtgaaactaaaaacaaaacaataaaaacaaaattccctaatgagaagggacaagatgtatgctggtaccaatgcacaattaaaggtggtagagagagtagagatattggtgtttgggaactagctagagcgtgtgaagcattgggtgctggtgaaattcttctaaattgtattgataaagatggttctaactcaggctatgatcttgaactcatcaaccatgctaaggaagctgtgaaaattcccgttattgcgtcttcgggtgcgggaaaccctgcacattttgaagaaggtttcaagcaatctgctgcagatgcttgtctgggtgcaggtatgttccacagagaagaatacactgtaaatgatgtaaaggaatacttattgaaaaaagggttgaaagttagagtagataaaaactaa

SEQ ID NO: 10141 - protein, 552 aa, Candida glabrata CBS138
MSTVHVIDVESGNLQSLTNAIEYLGFRVQLIKDSQDPELLKAEKLILPGVGNYGHVYENILSRGFEKPIREYIASGKPIMGICVGLQVLFNSSTESPSSGGFGYVNHRLSRFNDDEKPVPEIGWNSVIPEKDLFFGLDPYKRYYFVHSYAGILDAATESSLKADGWRIAKAKYGSEEFIAAVYKDNIFATQFHPEKSGLAGLHIIENFLKQAHPGLPAYSEDEKSLLGNDYSNYGLTRRIIACLDVRTNDQGDLVVTKGDQYDVREKSGDNDVRNLGKPVQLAQKYYEQGADEVTFLNITSFRDSPVKDTPMLEVLRQTAKKVFVPLTVGGGIKDIVDPDGTHVSALEVASLYFRSGADKVSIGTDSVYAAEKYYANEGKGDGTSPIETISKAYGAQAVVISVDPKRVYVNDPSETKNKTIKTKFPNEKGQDVCWYQCTIKGGRESRDIGVWELARACEALGAGEILLNCIDKDGSNSGYDLELINHAKEAVKIPVIASSGAGNPAHFEEGFKQSAADACLGAGMFHREEYTVNDVKEYLLKKGLKVRVDKN

SEQ ID NO: 10142 - DNA, 750 bp, Picrophilus torridus
  CDS (1)..(750)
atgcttgcaaaaaggattatagctgcacttgatgtaaggaacggcagggttgtcaagggtgtaagattcatggatataaaagatgccggcgatcctgttgaaaatgctgttatataccaggatcagggtgcagatgagatcgtcttccttgatataagcgcaacagatgaaaaacgtgatataatgatcgatcttgttaaaagtgtctcaagggaattaaacataccatttactgttggtggtgggataagatctgtaaaaactgcattgaaccttctaagggagggctgtgacaaggtttttttaaatacatatgcaattgaaaatccatggataataaaagagatatcaagagaaactgggtctgcaaatcttgttatagcagttgacgcaatgtacaacaatggttattatgtttacaaaaacgctggcaggataaacagcggattaaaattaaatgaatggcttccaatggctgaataccttggcgccggcgagatacttttaacatcaatagacagcgatggtacaatgaaaggcttcgataacaggctaatatcagaggccgcatcaatgattgatataccagtaatagcatctggcggtgccggaaaaccggagcattttcttgatgcctttatggcaggtgcctcgggggcgcttgcggcatcaatactccattttaaaatcaacacagtaaatgatataaaaagatatttaaggagcaatggtgttaatgtcagattataa

SEQ ID NO: 10143 - protein, 249 aa, Picrophilus torridus
MLAKRIIAALDVRNGRVVKGVRFMDIKDAGDPVENAVIYQDQGADEIVFLDISATDEKRDIMIDLVKSVSRELNIPFTVGGGIRSVKTALNLLREGCDKVFLNTYAIENPWIIKEISRETGSANLVIAVDAMYNNGYYVYKNAGRINSGLKLNEWLPMAEYLGAGEILLTSIDSDGTMKGFDNRLISEAASMIDIPVIASGGAGKPEHFLDAFMAGASGALAASILHFKINTVNDIKRYLRSNGVNVRL

SEQ ID NO: 10144 - DNA, 735 bp, Methanococcus maripaludis
  CDS (1)..(735)
atgtataggaatagaataataccttgtttattattaaaagatgaaaggttagttaaaacagttaaatttaaagatccaaattatataggtgatcctttaaatgcagtcaggatattcaatgataaagaagctgatgaacttttttttattgatattagtgcttcaaaaagagagagtataaattttgatttacttaaaaaaatatcatcccaaagtttcatgcctctgggttatgctggcggcattaaatgtttaaatgatgcgaaaaagattttttccataggttttgaaaaaatctcgttaaataccattgttctcaaaaatcctgatttgataacggaaatttctaagatatatggttctcaaagtgtgttagtaactattgatgttaaaaaaaattttttcggaaaatattatgtctataaccatttgaaaaaaaaaataactaaatataatcccgtagattttgcaagaaaaatggaagttttgggtgctggagaactcgtaataaactgcgtagataatgatggtgttatgaaaggttataatttaaaattaataggtgaaatttcaaaagcagttaaaattccaatcgttgcgttgggtggtgcaggtagtttaaaagatttagacgatgcaattaatgtgggagcaagtgctgcaggtgcaggtagtttatttatatattatggcccgcataaagcggttttaataaactatccgagaggagattaa

SEQ ID NO: 10145 - protein, 244 aa, Methanococcus maripaludis
MYRNRIIPCLLLKDERLVKTVKFKDPNYIGDPLNAVRIFNDKEADELFFIDISASKRESINFDLLKKISSQSFMPLGYAGGIKCLNDAKKIFSIGFEKISLNTIVLKNPDLITEISKIYGSQSVLVTIDVKKNFFGKYYVYNHLKKKITKYNPVDFARKMEVLGAGELVINCVDNDGVMKGYNLKLIGEISKAVKIPIVALGGAGSLKDLDDAINVGASAAGAGSLFIYYGPHKAVLINYPRGD

SEQ ID NO: 10146 - DNA, 780 bp, Bdellovibrio bacteriovorus
  CDS (1)..(780)
atgttaagaccacgtataattccgtgcctcctagttaaggatggcggtctagttaaaacggtaaaattcaaggatcctaaatatgtgggcgatccgattaatgctgttaaaatatttaatgaaaagcgtgctgatgagctgattgttgtggacattgatgcaacagttaatggcgtcgagccaaattataaaatgatcagtaatctggctatggaatgccgtatgccgctatgttatggcggtggagttcgaacagccgctcaagcgaagaagattgtgtcattgggagtagagaaggtcgcaatcagtgcggcggctcttgaaaatatgagtcttatcactcagatggccgaggaaatcggacgccagagtgttgttgtcgtcttagacgtaaaaaagcggttgttagggcgtacatttgatgtttggactcacaatggcactaagaatacaaagcgcgagtttattgaggtagctaaagaggcagagcagcttggagcgggagagatagtcgttaactcaattgacgacgatggtaaaatgtctggctacgatgtcgctcttattaaaaagctgcgtgagtcggtgaaaattccggttacagttcttgggggggcgggttccctcgatgatatttctaaagttattgaggaatgcggtactgttggcgtggctgcaggaagtttgtttgtcttcaaggggccctataaggctgttctgatcaattacccggatttgcgtcagaaggatgaaatgatcaaaagcgcattgcgcaggtaa

SEQ ID NO: 10147 - protein, 259 aa, Bdellovibrio bacteriovorus
MLRPRIIPCLLVKDGGLVKTVKFKDPKYVGDPINAVKIFNEKRADELIVVDIDATVNGVEPNYKMISNLAMECRMPLCYGGGVRTAAQAKKIVSLGVEKVAISAAALENMSLITQMAEEIGRQSVVVVLDVKKRLLGRTFDVWTHNGTKNTKREFIEVAKEAEQLGAGEIVVNSIDDDGKMSGYDVALIKKLRESVKIPVTVLGGAGSLDDISKVIEECGTVGVAAGSLFVFKGPYKAVLINYPDLRQKDEMIKSALRR

SEQ ID NO: 10148 - DNA, 789 bp, uncultured bacterium 440
  CDS (1)..(789)
atgaaagaaatattaagaattattcccgttttgtttataaaaaatggactgattgtaagaagtcaaaatttttataaacatcagtttataggaaacgttatagaacaagcaaaaagacttaatgattatgatgtcgatgaacttgtatatattgatatcactagaaatgataattatgatttaggaagagacgatcttcttgttaaatctaaacgtgacataatgtcgattatcaaagatataagcaaagtttgttttatgcctctaacttttggtggtggcatcagaagtgtagatgatgctgttaatcggataagagcaggagcagacaaaataactattaacagtctcttatataaagatttaaatatagtaaaaaaaataatttcagaaattggatctcaagcagttgtagcttcaatagattataaaattataaacgaaaagttaataatttttaataacttcggtcaagataatacaaacatagagttaattgattttataaaaaaaattgaaaatttaggtgttggagaattttttattcaaaatgttgaattagacggcatgcaaaaaggttttgatttaaataatattaagaaaatagttaattcagttaatttaccagttatagcatgttctggcgcaggttctttagagcactttttagaagctgtaaaaataaaaggtttatcagcagttgctgctggtaattattttaattataaagaaagatcgtacccaataattaaaaaagaacttaaagactttaatataaatgtcagataa

SEQ ID NO: 10149 - protein, 262 aa, uncultured bacterium 440
MKEILRIIPVLFIKNGLIVRSQNFYKHQFIGNVIEQAKRLNDYDVDELVYIDITRNDNYDLGRDDLLVKSKRDIMSIIKDISKVCFMPLTFGGGIRSVDDAVNRIRAGADKITINSLLYKDLNIVKKIISEIGSQAVVASIDYKIINEKLIIFNNFGQDNTNIELIDFIKKIENLGVGEFFIQNVELDGMQKGFDLNNIKKIVNSVNLPVIACSGAGSLEHFLEAVKIKGLSAVAAGNYFNYKERSYPIIKKELKDFNINVR

SEQ ID NO: 10150 - DNA, 786 bp, Buchnera aphidicola
  CDS (1)..(786)
atgttggcaaaaagaattattccctgtttagatgtaaaaaatggtttagtagttaaaggtattcaatttaaaaatcaccgagttgtaggaaatatattatctttagcgaaaagatatgttaaagaaggagctgatgaattagttttttatgatatttctgcatctgtacaaaaaaaattagttaataaaaattggatttctatgattgctgaagtaattaatattccattttgtgtagctggtggaattaaaactctgaaagatgcaaaagaaatttttaattatggcgctgataaaatatctataaattctcatgctattaataatccttctttaattactgaaattgcagataaatttggagtacaagcggtggttattggaattgattcttattttcataaaatagaaaaaaagtattttgtacatcaatatactggagatgcaaaatatgaaaaaaaaacagttttagaaacttctaaatgggtaaaaattgtacaaaaatatggtgcaggagaaattgttttaaattgtatgaatcaagatggagtaaaaaatggatatgatattaaacaattaagaaaaataagaaaaatatgtaaagtacctttaattgcctctggaggagctggacatataaatcacttttatgatgtatttaaattttcagatgtagatggagctctagcagcatctatttttcatgaaaatattgttaatataaataaattaaaaaattttttatctagaaaaaatattgagattaggacacatgctaactattag

SEQ ID NO: 10151 - protein, 261 aa, Buchnera aphidicola
MLAKRIIPCLDVKNGLVVKGIQFKNHRVVGNILSLAKRYVKEGADELVFYDISASVQKKLVNKNWISMIAEVINIPFCVAGGIKTLKDAKEIFNYGADKISINSHAINNPSLITEIADKFGVQAVVIGIDSYFHKIEKKYFVHQYTGDAKYEKKTVLETSKWVKIVQKYGAGEIVLNCMNQDGVKNGYDIKQLRKIRKICKVPLIASGGAGHINHFYDVFKFSDVDGALAASIFHENIVNINKLKNFLSRKNIEIRTHANY

SEQ ID NO: 10152 - DNA, 723 bp, Listeria monocytogenes
  CDS (1)..(723)
atgcaaatcttcccagcaatagacttaaaaaatggacagtgcgtccgtctcttccaaggcgacttctctaaaaaaacagttgtcaatgaagacccaattgcccaagcaaaagcatttgctacagacggcgcaacctatttgcacatcgtcgacctagacggtgcattagaaggacgtcctatcaatctagaaattattcaaaggatgaaaaaagcagctaaaatccctgttcaagttggtggaggaattcgtagcatggcgcaagtggattattatcttgaatccggcatcgaccgcgtgattatcggttctgccgctctaacaaatccagatttcctacgtgcggcagtccaaaaatacggagctaaaattgtagcaggtatcgatgccaaaaacggttttgtcgcaacaagaggttggctcgatgtcagtcaggtaagctatttagatttggctaaacgaatggaaaaagtgggtgttgagacaatcatttacactgatattagccgtgatggcacgctaactggacctaatttagaacaaatggcaaatctcaaagagcacgttaaagttagtttaattgcttctggcggagtgagcagtcgtgcagatttggaagcactcgcccaactcggcttatatggagcaattgccggaaaagccctttataatcatgatatttccatgtcagatattgtagaggtggaacaaattgcttactaa

SEQ ID NO: 10153 - protein, 240 aa, Listeria monocytogenes
MQIFPAIDLKNGQCVRLFQGDFSKKTVVNEDPIAQAKAFATDGATYLHIVDLDGALEGRPINLEIIQRMKKAAKIPVQVGGGIRSMAQVDYYLESGIDRVIIGSAALTNPDFLRAAVQKYGAKIVAGIDAKNGFVATRGWLDVSQVSYLDLAKRMEKVGVETIIYTDISRDGTLTGPNLEQMANLKEHVKVSLIASGGVSSRADLEALAQLGLYGAIAGKALYNHDISMSDIVEVEQIAY

SEQ ID NO: 10154 - DNA, 1650 bp, Ashbya gossypii
  CDS (1)..(1650)
atggtacaggtcgtgcacatcgtggacgtcgaaagcggcaacctgcaatcgatcacaaacgcaattgagcatctaggctatgaggtgaagctgatacgaagtggcgctgatcctgagctggacaaggcggagacgctaattctaccgggcgtcgggaattttggccatttcactcgcaacatgcgcgcccgtgggtttgtggacgctatctcctcatacatcgcatctgggaggcccctgatgggcatctgcgttgggctacaagtgctatttagaagctccgaagaagaccctggcgcagaaggactggcgctggtcgacatgtcgctgtcgcggttccgcgatgagtcaaagccggttccggagataggttggaacaccctgcaactggacggagaccaattcttcggtcttgacccctgcggaaggtactacttcgtgcactcgtatgctgcgatgttggcaaatggtgcgggccggttgcgagagcagggctggcgcgtcgcgacagccaggtacggcgatgagcgatttgtagcggcgctggcacgtggaaacctgtttgcaacgcaattccacccagaaaagtcggggaagctcgggttgcaactactggccaacttcctgaagcagcaacacccttctattgaccgcggctcgcaggatatagagctgctcaccaatgattactctaattatgggttgaccagacggattatcgcatgtttagatgtgcgcgccaacgatgagggagatctcgtggtgacgaaaggcgaccaatatgatgtcagagacaagcaagaaagtggtgcgatcagaaacctaggcaagccggtcgagctggcgcagctttattacgagcaaggtgcagacgagattacattcctgaatataacgagcttcaaggattgtccattaagggatgcaccaatgctggaggtgctgcggctagctgctaagacgacttttgttccgttgactgtgggcggcggaatccgggatatagttgatccggacgggacaagaatctctgctctggacgttgctggcctttacttccgatccggtgcagataaagtttccatcgggacagacgctgtctatgccgcggagcggtactacgaggccgggacacgtggggatggctcgtctcccatagaaaccatttcgaaggcctacgggtcccaggcggtggtaatttctgttgatcctaagcgagtttatgttgattccccggatgatactcccaataagaccatcgagtccaagtatcctaattctaaaggtcaaagatggtgctggtaccaatgtactttgaaaggagggcgagaatgcagtaagattggcgtctgggaattagtaagggcatgcgaagccctaggtgccggcgagattctcttaaattgcatcgacagagatggtacaaatgttggatacgatctcgagttgcttaaactggttaagtatgccgtaaaaattcccgtcgttgcctcgagcggcgcagggaagcctgagcatttccaagaagcatttctcgagactggagtagatgcctgtttgggagcgggtatattccataggggagaatacaccgttcgagaagtcaaggaccatctcagcaggaacggattgaaagtgaggctgatttga

SEQ ID NO: 10155 - protein, 549 aa, Ashbya gossypii
MVQVVHIVDVESGNLQSITNAIEHLGYEVKLIRSGADPELDKAETLILPGVGNFGHFTRNMRARGFVDAISSYIASGRPLMGICVGLQVLFRSSEEDPGAEGLALVDMSLSRFRDESKPVPEIGWNTLQLDGDQFFGLDPCGRYYFVHSYAAMLANGAGRLREQGWRVATARYGDERFVAALARGNLFATQFHPEKSGKLGLQLLANFLKQQHPSIDRGSQDIELLTNDYSNYGLTRRIIACLDVRANDEGDLVVTKGDQYDVRDKQESGAIRNLGKPVELAQLYYEQGADEITFLNITSFKDCPLRDAPMLEVLRLAAKTTFVPLTVGGGIRDIVDPDGTRISALDVAGLYFRSGADKVSIGTDAVYAAERYYEAGTRGDGSSPIETISKAYGSQAVVISVDPKRVYVDSPDDTPNKTIESKYPNSKGQRWCWYQCTLKGGRECSKIGVWELVRACEALGAGEILLNCIDRDGTNVGYDLELLKLVKYAVKIPVVASSGAGKPEHFQEAFLETGVDACLGAGIFHRGEYTVREVKDHLSRNGLKVRLI

SEQ ID NO: 10156 - DNA, 756 bp, Rhizobium leguminosarum bv
  CDS (1)..(756)
atgagaaaaaggcttatacccgtcctgctagtcgatcagaagcgtcggctggtgaagacgatagagtttggcgagcgcacctacgtcggcgatcccttcaatgttgttcgcctgttcaacgaaaaggaagtcgacgagatctgcattctcgatatcgacgccacgcgtacggggcgaggtcctgacctcggcttcgttcgcgaactcgcaaccgaatgtttcatgcctttggcatatggcggcggcatcaccgagcttaagcagtgcgaggaacttaaccgctccggcgtcgagaagtttgtactcggtcaaggcgcgcgcaattcgcaactggtgggagcgatcgctgccgatatgggcagccaggctctggttgcctgtgtcgacgtagacggtcgcggcgcggcggcgagctgctacgcttcaagcggtgcgaggcaagagccgatagaattctgcctgaggttgcaggatgccggcgttggcgaaataattcttcagtcgaaaactctcgacggcacccgcaacggatatgatcttgagttgatccagtcgattacccgaaagctgagcattccggtcgttgccttgggtggcgccggagacgtcgcccacctgatggaaggccttcatgccggcgcttccgccgcggcctcggggagcgccttcacctttatcggtcggctaagggcagttcttataagctaccctgcaccagaaattttggaggaagcggagcaaggtgctcatggataa

SEQ ID NO: 10157 - protein, 251 aa, Rhizobium leguminosarum bv
MRKRLIPVLLVDQKRRLVKTIEFGERTYVGDPFNVVRLFNEKEVDEICILDIDATRTGRGPDLGFVRELATECFMPLAYGGGITELKQCEELNRSGVEKFVLGQGARNSQLVGAIAADMGSQALVACVDVDGRGAAASCYASSGARQEPIEFCLRLQDAGVGEIILQSKTLDGTRNGYDLELIQSITRKLSIPVVALGGAGDVAHLMEGLHAGASAAASGSAFTFIGRLRAVLISYPAPEILEEAEQGAHG

SEQ ID NO: 10158 - DNA, 1662 bp, Neurospora crassa
  CDS (1)..(1662)
atgccgaccgttcacctcctggattacgtcgccggcaacgtgcgcagcttggtcaatgccattgagagggttggctacagcgtcgagtgggtccggtcgccggaggaggttgccaatgctgataaactcatcctccctggcgtaggccacttcggccactgcctctcccagctcgcctccgccggctacatggcccccatccgcgcccacatcgagtccggtaagcccttcatgggcatctgcgtcggcctccaggctctcttcgaaggctcgtccgaagaccccaactgccccggtctgggtgtcctccccggcaagctcgaccgcttcgacgacacctccaagtccgtcccccacattggctggaacgacgcctcgtgcccgaccaacccgaacctctttggtctcaaccccgactccaaatactactatgtccactcgtacaagatgccctacaccaagggccagctcgagtcgcaagggtgggcggtggctaccggtgtctatggcggcgagacctttattggcgccattgccaagggcaacgtgatggccacccagttccaccctgagaagtcgggtgtcgccggtctgcgcgtcatccgggccttcctcgatggctctggcgccgctgctctggcttcccaccctccccaggaggtccccaacgccggcgacgatgccctcgtcagcaaggagggcctcacccgtcgtgtcattgcctgcttggatgtgcgcaccaacgaccagggcgacttggtggtcaccaagggtgaccaatatgatgtccgcgaaaagtctgacgaccgcaacgtccgcaacctcggcaagcccgtcgagatggcgcgcaagtactacgaacaaggcgccgacgaagtgaccttcctcaacatcacctccttccgcgactgccccgttgccgacctgcccatgctcgagatccttcgcctgacctccaagaccgtcttcgttcccctgaccgtcggcggcggcatccgcgacaccgtcgacacggacggcaccaaggtctccgccctcgaaatcgccaccatgtacttccagtcaggcgccgacaaggtgtccattggctccgacgccgtcatcgctgccgaggagtactatgcctccggcaagacgctctttggcaacacggccattgagcagatcagcaaagcctacggaaaccaggctgtcgtcgtctcggtcgatcccaagcgcgtctacgtccccaagcccgatgccacgagacaccacaccgtcaagacgtcgtaccccggccccaagggcgaggaatactgctggtacgcctgcacgatcaagggcgggcgcgagacgagggatctggatgtggttgaactcacgcaggccgtggaagccatgggctgcggcgagattctgttgaactgcattgacaaggacggcaccaacagcgggtttgatctggagttgatcaggcaggtcaaggcggccgtgaggataccggttattgccagctcgggggcgggcaacccgggtcactttgaggaggtgtttagggagacgacgacggacgccgcgctgggagcaggcatgttccaccgtggggagtatacagtacagcaggtcaaggaggagctgaaggcgagggggttggtggtcagacagtttgagggagatctctga

SEQ ID NO: 10159 - protein, 553 aa, Neurospora crassa
MPTVHLLDYVAGNVRSLVNAIERVGYSVEWVRSPEEVANADKLILPGVGHFGHCLSQLASAGYMAPIRAHIESGKPFMGICVGLQALFEGSSEDPNCPGLGVLPGKLDRFDDTSKSVPHIGWNDASCPTNPNLFGLNPDSKYYYVHSYKMPYTKGQLESQGWAVATGVYGGETFIGAIAKGNVMATQFHPEKSGVAGLRVIRAFLDGSGAAALASHPPQEVPNAGDDALVSKEGLTRRVIACLDVRTNDQGDLVVTKGDQYDVREKSDDRNVRNLGKPVEMARKYYEQGADEVTFLNITSFRDCPVADLPMLEILRLTSKTVFVPLTVGGGIRDTVDTDGTKVSALEIATMYFQSGADKVSIGSDAVIAAEEYYASGKTLFGNTAIEQISKAYGNQAVVVSVDPKRVYVPKPDATRHHTVKTSYPGPKGEEYCWYACTIKGGRETRDLDVVELTQAVEAMGCGEILLNCIDKDGTNSGFDLELIRQVKAAVRIPVIASSGAGNPGHFEEVFRETTTDAALGAGMFHRGEYTVQQVKEELKARGLVVRQFEGDL

SEQ ID NO: 10160 - DNA, 783 bp, Pseudomonas aeruginosa
  CDS (1)..(783)
atgctaaagcctagaataattccttgcctgctcatgcaagatggcggacttgtcaaaaccgtacgttttaaggatccacggtatatcggtgatccgattaatgcggtcaagatttttaatgagaaagaagcggatgagctgattatccttgacatcgatgctacctcgcagggtagagaacctgattataagaagattgctaaccttgctgccgagtgccgtatgcccttgtgctatggtggaggtattcgtaaaccagagcaagcgcgtttaattatttccctaggtgtcgaaaaagtagcaatcagtgctgctgcaattgaggacgcaaacttaatatctaaagttgctgaagaaataggtcggcaaagtgtcgtcgttgttctagaccataagcagcgactattgagcaaacagcatgatgtttggacacacaacgggacacataataccaagcgcaatgtcattgacgtggcgaagcagatggaggatgcaggtgccggtgagatcgtgctcaactcaattgacaacgatggacggttgtgtggttacgagatagcgcttgccgtccgtttacgggaagcagtgaatgtacctgttacaatacttggtggcgccggttcgctgaaggatatggggagcttgattgcagcctgtggagtggttggtgctgcggctggcagtctttttgtgtttaaaggcagctatcgagccgtcctgattaactatcccagtttccagcaaaaaaccgatgtaatattttcggtactgaactcccgataa

SEQ ID NO: 10161 - protein, 260 aa, Pseudomonas aeruginosa
MLKPRIIPCLLMQDGGLVKTVRFKDPRYIGDPINAVKIFNEKEADELIILDIDATSQGREPDYKKIANLAAECRMPLCYGGGIRKPEQARLIISLGVEKVAISAAAIEDANLISKVAEEIGRQSVVVVLDHKQRLLSKQHDVWTHNGTHNTKRNVIDVAKQMEDAGAGEIVLNSIDNDGRLCGYEIALAVRLREAVNVPVTILGGAGSLKDMGSLIAACGVVGAAAGSLFVFKGSYRAVLINYPSFQQKTDVIFSVLNSR

SEQ ID NO: 10162 - DNA, 2306 bp, Candida albicans
  CDS (161)..(2044)
tgtgcgagtcagatgttgaaaaaaaaaaaaaaaaattatccaacacattcaacctaacccaacccaactaaccaacttgccatttctttcgaactaatactaaaccccttttttatattcatattttttggatttaggggaagggaaattatttaaaatcatgacgaaaacaatccatatcatcgatgtagaaagtggtaatttacaatcactttcaaatgcaatcaaacgtatcgattctaattatatcattaaattcattcataatgaacaagatttcattgataatgattctcaaattgaaaaattgattttccctggtgttggtaattttggacattttgttaaacaattaaatgaacggaaattaattaatcatttaaaatcatatattaaacaagatcgtccattaatggggatttgtgttggtttacaatcgatttttcatgaatcggaagaaagtccaaatattaaaggattaggattattattagataatgatgataatgatgatgatgatgagaagaagttaaaattatataaatttgataatgatgatgaaaaatttaaaatcaggggcattaaaaaatctgttcctcatattggttggaataatattcatgatataattattaatggcaaacaaacaacgactaaatctttatatggattgaataagattgataaatattattttgttcattcttatgctgcaattattaaaaataataatgatgaaataattgaaaataaattcattaaggatttatcttcaaaaggttgggatttggcaattagtcaatatggatcagaaaaatttatatctgctatatcaaaaaataatttatttgctactcaatttcatccagaaaaatccggaattgttggtttaaaaattattaaaaattttttaaatggtgaaaagaacccaaccccaaccccaaccccaaccccaactccaaacaacctagcccaaggggtagattcttcttctactttggatgttgaaaccaccttaacggggttgactagaagaattattgcatgtcttgatgttagaactaatgatgatggtgatttagtggtcactaaaggtgatcaatataatgttcgagaacaattatcatcatcatcaactaacgaatctgccgaggaggattcttcacaggttcgtaatttaggtaaaccagttgaattagcaacaaaatattataatcaaggagctgatgaaattacatttttaaatatcacatctttccgtaattctcctttaaaagatttacccatgttacaagtattgaaaaaagctgctgaaactatatttgttccattgactgttggtggaggtattaaagatttatatgatccagaaactgggaaaactgttcctgctgttgatgtggctcatttatatttccaatcaggtgctgataaaattagtattggatctgatgccgttaccattgccgaaaattattatgccaataatggggaaattaccggtctttcatcaattgaaaccatttcttccaaatttggtaatcaagcagttgttatatcagttgatcctaaaagaaaatatatcaaagatccaacaactgaaactactactatgcaaacaataaaaatcactgatccttcacaatatggtccaaatggtgaacaatattgttattatcaagtaacttctcaaggtggaaggaaaattcatgaattaggtgcattagaattatgtttagcttgtgaaaaattgggagctggagaaattttattaaattcaatcgatcatgatggttccaataaaggatttaatttacaattattacaacaaattaaatctcaagtttcaatccccgtgattgctagtagtggtgctggtaatcctcaacatttccaacaagtatttgaaatggattgtggaattgatgctgctttaggtgctggtttgtttcatcgtggtgaatataccgttaatcaagtaaagaaatatttacaacaagaagcaaaaatggatgttagattagatgaagatttggagttgtaaaggggttgggtttacccaaccccgagaaggatgtgtgttttagttatatatatatatacagaagatgtattggagtttatgaatgtaaataaggtcaatcaatggtcaataacccatatccatacccattaccaacatattctgtattgtgtgcatcaagagagtagaccttatttgtttaattttgtgtaatttaatttcttgtacaaaaaaaaatcgacttgtcgaaaagtaaagacggacaacaactaactattcctat

SEQ ID NO: 10163 - protein, 627 aa, Candida albicans
MTKTIHIIDVESGNLQSLSNAIKRIDSNYIIKFIHNEQDFIDNDSQIEKLIFPGVGNFGHFVKQLNERKLINHLKSYIKQDRPLMGICVGLQSIFHESEESPNIKGLGLLLDNDDNDDDDEKKLKLYKFDNDDEKFKIRGIKKSVPHIGWNNIHDIIINGKQTTTKSLYGLNKIDKYYFVHSYAAIIKNNNDEIIENKFIKDLSSKGWDLAISQYGSEKFISAISKNNLFATQFHPEKSGIVGLKIIKNFLNGEKNPTPTPTPTPTPNNLAQGVDSSSTLDVETTLTGLTRRIIACLDVRTNDDGDLVVTKGDQYNVREQLSSSSTNESAEEDSSQVRNLGKPVELATKYYNQGADEITFLNITSFRNSPLKDLPMLQVLKKAAETIFVPLTVGGGIKDLYDPETGKTVPAVDVAHLYFQSGADKISIGSDAVTIAENYYANNGEITGLSSIETISSKFGNQAVVISVDPKRKYIKDPTTETTTMQTIKITDPSQYGPNGEQYCYYQVTSQGGRKIHELGALELCLACEKLGAGEILLNSIDHDGSNKGFNLQLLQQIKSQVSIPVIASSGAGNPQHFQQVFEMDCGIDAALGAGLFHRGEYTVNQVKKYLQQEAKMDVRLDEDLEL

SEQ ID NO: 10164 - DNA, 771 bp, Leptospira interrogans
  CDS (1)..(771)
atgagtaatcttactgccagagtaattccctgtctggacatcaaagacgggcgtgtagttaagggagtaaattttgtaaatctagtggacgctggagatccagtggaatcggctgcgatctacgaagagaatttagccgatgaactttgttttttagatataaccgcttcttcggatagaagagagatattacttcatcttgtagagaggatagccgaaaagattttcattccttttacagtaggaggaggaattagaaccgtagacgacgtaaaagccgttttagaaaaaggagcggacaaggtatcaatcaatactgcagcttttcaaaaccccaaattgttaacatattcttccgaaatttatggatctcaatgtatcgtttgtgcaattgatgttaagcatgaaaaagaaagagatcgatacgaagtttttttacacggaggaagaacagcaaccggaagggaggctttggattgggctcaagaggccgccgaaaaaggtgctggagaaattttacttacgtctatggatcgagatggaactagaaatggatttgatattcatcttctaaagaatttttcctcgtctctgggaattccaattatagcatctggaggggccggaaatccggagcatatggtggaagccattttacgcgggaaagcagatgcagtacttgctgcttctatttttcattttggagaatattctatccgtgagactaaaaaagctatggaagagatgggtatttcggttcgtttagattaa

SEQ ID NO: 10165 - protein, 256 aa, Leptospira interrogans
MSNLTARVIPCLDIKDGRVVKGVNFVNLVDAGDPVESAAIYEENLADELCFLDITASSDRREILLHLVERIAEKIFIPFTVGGGIRTVDDVKAVLEKGADKVSINTAAFQNPKLLTYSSEIYGSQCIVCAIDVKHEKERDRYEVFLHGGRTATGREALDWAQEAAEKGAGEILLTSMDRDGTRNGFDIHLLKNFSSSLGIPIIASGGAGNPEHMVEAILRGKADAVLAASIFHFGEYSIRETKKAMEEMGISVRLD

SEQ ID NO: 10166 - DNA, 771 bp, Prochlorococcus marinus
  CDS (1)..(771)
atggtcgcgcttcgtttgattccttgccttgacgtggctgatggtcgcgttgtgaagggcgtgaactttgtgggccttcgtgatgcgggtgatcccgtggagctcgcctgccgctatagccaggctggagctgatgagttggtgtttcttgatatcgccgccagccatgaaggtcgggccacgctggtggcgttagttcgacgtactgctgaggctgtgaccattccattcacagttggagggggtatcagctctttggatggcatcacagagctgcttcgggctggagccgacaaggtgagtcttaattcatctgcggtgcgggatccagatctcgtagcgcagggagccgaccgttttggctgtcagtgcattgtggtggccatcgatgctcggcgtcgtcctgagtgctcggggtgggatgtttttgttaagggtggacgccaaaacaccggtttggatgctgtgagctgggctcggcaggcagcggaacttggtgctggcgaaatcctgttgacctcaatggatggagatggaactcaggctggttatgacttggagctcacgcaagcagtcgtggaagcggtgccggtgcctgtgatcgcttcgggaggtgcaggttgtctagatcacatcgcagaagccttcacgattggcaaggcctcagctgcattgttggcctctctacttcacgatggcgtgctgagtgtggagcaaattaagactgatctgctgatgcgaggtttgtcgattcggcctcttgagttctga

SEQ ID NO: 10167 - protein, 256 aa, Prochlorococcus marinus
MVALRLIPCLDVADGRVVKGVNFVGLRDAGDPVELACRYSQAGADELVFLDIAASHEGRATLVALVRRTAEAVTIPFTVGGGISSLDGITELLRAGADKVSLNSSAVRDPDLVAQGADRFGCQCIVVAIDARRRPECSGWDVFVKGGRQNTGLDAVSWARQAAELGAGEILLTSMDGDGTQAGYDLELTQAVVEAVPVPVIASGGAGCLDHIAEAFTIGKASAALLASLLHDGVLSVEQIKTDLLMRGLSIRPLEF

SEQ ID NO: 10168 - DNA, 771 bp, Synechococcus sp
  CDS (1)..(771)
atggttgctctccgcttgattccctgcctggatgtcgcccgcggacgggtggtgaagggcgtcaacttcgtcggtctgcgagacgccggtgatcctgtggaactggcctgtcgctacagcggcgccggggcggacgagctggtctttcttgacatcgcggccagccacgaaggccgcggcaccctgatcgacatggtgcatcgcaccgccgaatcggtcacgattcctttcactgtgggtggtgggatctccacggtggagggcatcaccgatctgctgagggccggggccgacaaggtgagcttgaactcctctgcagtgcgacggcctgagttggtgcgtgagggggctgagcgttttggctgtcagtgcatcgttgtggcgatcgatgcccgcaggcgggatggggatggctgggacgtttttgtgaagggtgggcgcgagaacaccggtctggatgcggtggattgggcacgacgggtggcggagctcggtgctggcgaaattctgctgacctccatggacggcgatggcacccaggccggctacgaccttgccctgacccgtgcagtggccgatgcggtcccggtgcccgtgatcgcatccggtggggccggttgcatcgaccacatcgcccaggccctggagacaggaccggacggtggacatgcctccgctgcgctgctggcctccctgttgcatgacggtgttctcacggtcgaggagatcaagcaggatctgctggcgcgaggtctatcgattcgtccgtga

SEQ ID NO: 10169 - protein, 256 aa, Synechococcus sp
MVALRLIPCLDVARGRVVKGVNFVGLRDAGDPVELACRYSGAGADELVFLDIAASHEGRGTLIDMVHRTAESVTIPFTVGGGISTVEGITDLLRAGADKVSLNSSAVRRPELVREGAERFGCQCIVVAIDARRRDGDGWDVFVKGGRENTGLDAVDWARRVAELGAGEILLTSMDGDGTQAGYDLALTRAVADAVPVPVIASGGAGCIDHIAQALETGPDGGHASAALLASLLHDGVLTVEEIKQDLLARGLSIRP

SEQ ID NO: 10170 - DNA, 765 bp, Leptospira interrogans
  CDS (1)..(765)
atgctaaaacctcgaattatacctacattattggtccaacatggcggattagtcaaaacaataaagtttagtaatcagagatatattggagatccattgaatgctgttaggatttttaacgaaaaggaagcagacgaacttacagtcttggatatctctgctagtagggagggaaaggcccctgattatcgattgatagaaagacttgctaatgaatgtagaatgcctctttcatatggaggaggtattaaaaatcttgagcaagctagccggattctaagctttggagtggaaaaaataatagttagttctctagctatcgaaaatccaaaagtaatctcttcaatggcaacatatttaggaaatcaaagtgtcgtagttgcgattgattttaaaaagactttgttaactagaagatacgaagtttttatacataacggaaccaaaaaaacaggaatcagtcctgaagacttattaaaacacgcaattgaatttggggcgggtgaaattttactcaattcgatagatagagacggagttatggaaggatacgacttggagatgcttaaaaaatttagaagtatttgtactgttcctatgacagttttaggtggtgctggatcgctacaagatttaaaaagtttaattcaaaatcttggaatcgttggcgtctccgcaggaagtctttttgtttataaaggaattcacaaggccgtgcttattaattatcctaatcgtgaggataaggaagcattgttttattaa

SEQ ID NO: 10171 - protein, 254 aa, Leptospira interrogans
MLKPRIIPTLLVQHGGLVKTIKFSNQRYIGDPLNAVRIFNEKEADELTVLDISASREGKAPDYRLIERLANECRMPLSYGGGIKNLEQASRILSFGVEKIIVSSLAIENPKVISSMATYLGNQSVVVAIDFKKTLLTRRYEVFIHNGTKKTGISPEDLLKHAIEFGAGEILLNSIDRDGVMEGYDLEMLKKFRSICTVPMTVLGGAGSLQDLKSLIQNLGIVGVSAGSLFVYKGIHKAVLINYPNREDKEALFY

SEQ ID NO: 10172 - DNA, 786 bp, Prochlorococcus marinus
  CDS (1)..(786)
atgctgaaaaaacgccttataccaaagcttcagttctcgattaagccaagttatcgtggcccaaaacctgtcctagtcattacccgtcaatttgactcaaagagggctatcggcgaccctgtctcgcaggccaagatatatgaagctcagctcgccgacgaactcgttcttgtagatttagaaggaacttctgatagctggccaattttacttgacacgctttcgaatatgtctgaatcacttgcaactccactttctgtaggtggtggtataacatctttcgagcaagttcagcaattattagatcgaggagcagataaggttgtcctcaactctggagctgttaataatccccagctaatagaccttgtagctaattcatatggctcccaatgtgtagttattagtattgatattcgcaaggagtctgatctaagtagacacgtatatatagatggtggctctacagctactgattggagtttattttcatgggcaaatgattgcgcttccagaggtgctggtgaactattgattacttctatcgacaacgatggtactggtaccggacttgatttagattctattaggcaactcagatacgaagtcaatttgccacttattgcttctggaggatgtggcttggctcagcattttgttgctggttatgaggtaggagcctctgctgttgcagctggaaccttcttctcgcaacgtgatcagaatcctatgcagtgccgttctcatattcgtaatgcgggccttccaattagactagagcaatga

SEQ ID NO: 10173 - protein, 261 aa, Prochlorococcus marinus
MLKKRLIPKLQFSIKPSYRGPKPVLVITRQFDSKRAIGDPVSQAKIYEAQLADELVLVDLEGTSDSWPILLDTLSNMSESLATPLSVGGGITSFEQVQQLLDRGADKVVLNSGAVNNPQLIDLVANSYGSQCVVISIDIRKESDLSRHVYIDGGSTATDWSLFSWANDCASRGAGELLITSIDNDGTGTGLDLDSIRQLRYEVNLPLIASGGCGLAQHFVAGYEVGASAVAAGTFFSQRDQNPMQCRSHIRNAGLPIRLEQ

SEQ ID NO: 10174 - DNA, 819 bp, Vibrio vulnificus
  CDS (1)..(819)
atgtttcacatgcttaaaataagattaattccatgcatagtcaccaaaggtgaactagtagtgcagagttttgcattcaaaaactacttaccaataggaaatgtaaagacagcgattgatttttttgtgaactgggatgttgatgaaatcattgtaaatgatattgatgcatcgaaagagtttagagagccaaatgtcgatcttgttagctgggcagctaaagagtgttttgtaccgctgactgttggcggtggtatcaagactttggagcatataagaaatctactcaaagctggagcggataaagttaccataaatactaaagctattgatgacccggattttattaaaaatgcagcttcagtttttgggagccaatgcataactgtttcggttgatgcaattaagcagggtaatgtttataaactctatgattatagagatggtcgggttttagatgtagatgttgttgattgggttcgaaaagtagagtcctacggtgctggagaaattctactgaattctgtagatcgcgatggcagcagagaaggctatgacgtagagttattgaaaactgtaagcggtattgtgtccattccggtgattgcactaggagggattggaaggtttgaccagttagctgaaggagctatagaaggtggatgccaagccttatctgcggctaatatttttcagcatatggaacatagtactattgctgcaaaagctcaaatgagaaacgctaaactgaatgtacgacttagttccaaagttaagtatgagaactttgatctagattttcttggccgcccgtattga

SEQ ID NO: 10175 - protein, 272 aa, Vibrio vulnificus
MFHMLKIRLIPCIVTKGELVVQSFAFKNYLPIGNVKTAIDFFVNWDVDEIIVNDIDASKEFREPNVDLVSWAAKECFVPLTVGGGIKTLEHIRNLLKAGADKVTINTKAIDDPDFIKNAASVFGSQCITVSVDAIKQGNVYKLYDYRDGRVLDVDVVDWVRKVESYGAGEILLNSVDRDGSREGYDVELLKTVSGIVSIPVIALGGIGRFDQLAEGAIEGGCQALSAANIFQHMEHSTIAAKAQMRNAKLNVRLSSKVKYENFDLDFLGRPY

SEQ ID NO: 10176 - DNA, 783 bp, Vibrio vulnificus
  CDS (1)..(783)
atgcgagtttatagaatgttacgatctcgagttatccctgttttattaatgcgtgaaaaaggcttggtaaaaacagtaaagtttaaagagggaaaatatgttggcgatcctcttaatgctgtaaaaatatttaatgaacaagaagctgatgagttaacgttactcgatattgatgcatcacgtttaggtcatgagcctgactatgtgttaatagagcgaatagcgtctgagtgtagaatgcctctttgttatggcggtggtattaaaacggttgaacaggctgagagaatattaaagctcggtgttgagaaagtatcattaagttccgcggtgtttgaaaatccaaaaattatcacccaattagctgaaagagttggtcgccaaagtattgttgtttgtttagatgttaagaaaaggctatttggttctaagtttgattgttttactattaatggaacaaaaaaacagtctgttgatactattgaatttgtcaaacaaatacagacattaggcgctggtgagatagttttaaacttcattgataatgacggtgtaatgaaaggatacgatttagacgctgttagtaagtttaaagcgttggtaaaagtaccgttaacagtcgttggtggagctggttgcgtagatgatatagcaaaacttgttcaacaagaaaaattagtaggtgccgccgcaggaagtttatttgtatttaaaggtaaatacaaagcagtgcttattaactatccatcaccaagtgaaaagaaaaaagctttggagttgtaa

SEQ ID NO: 10177 - protein, 260 aa, Vibrio vulnificus
MRVYRMLRSRVIPVLLMREKGLVKTVKFKEGKYVGDPLNAVKIFNEQEADELTLLDIDASRLGHEPDYVLIERIASECRMPLCYGGGIKTVEQAERILKLGVEKVSLSSAVFENPKIITQLAERVGRQSIVVCLDVKKRLFGSKFDCFTINGTKKQSVDTIEFVKQIQTLGAGEIVLNFIDNDGVMKGYDLDAVSKFKALVKVPLTVVGGAGCVDDIAKLVQQEKLVGAAAGSLFVFKGKYKAVLINYPSPSEKKKALEL

SEQ ID NO: 10178 - DNA, 720 bp, Bacillus anthracis
  CDS (1)..(720)
atggaaatcttcccagctatcgatttaaaagaagggcgatgcgtgagactgtatcaaggcgagtttagtaaagaaacagtaatgaatgaggacccggttgcgcaagcgattatatttgaaaaatttggggcgaaaaggttgcacattgttgatttagatggagcagttgctggcgagtcattaaacttgtccgtcattgaaaggatttgcaaggcagtacgtattcctgtgcaagttggaggaggaattcgatcacttgtagcggtagagaagttattttcagtaggggtagataaagtgattttaggaacagctgctctttatgataagacatttttagaagaagcagttcttctatataaagaaaaaatcatcgttggaattgatgcgaaaaatggtttcgtagcaacgagaggttggcttgatgtgtctgaaatttcttacattgatttagcaaagcaaatggagaagataggtgttcaaacgattgtatttacagacatttcgaaagacgggacacttgcagggccgaatatagagcaattggagttactacaaaaaagcgttgctattcgtcttattgcttctggaggagttgcatctatacaagatgtgaaaaagttaaatgatatgaacatatacggcgtcataattggtaaggctctttacgagaaaacgattgatttagaagaagtggtagaggtaacaaagttatgttag

SEQ ID NO: 10179 - protein, 239 aa, Bacillus anthracis
MEIFPAIDLKEGRCVRLYQGEFSKETVMNEDPVAQAIIFEKFGAKRLHIVDLDGAVAGESLNLSVIERICKAVRIPVQVGGGIRSLVAVEKLFSVGVDKVILGTAALYDKTFLEEAVLLYKEKIIVGIDAKNGFVATRGWLDVSEISYIDLAKQMEKIGVQTIVFTDISKDGTLAGPNIEQLELLQKSVAIRLIASGGVASIQDVKKLNDMNIYGVIIGKALYEKTIDLEEVVEVTKLC

SEQ ID NO: 10180 - DNA, 783 bp, Chlorobium tepidum
  CDS (1)..(783)
atgctgattataccggctatagatattaaagaaggaaagtgcgtcaggctgacccgcggggacttcgctcagaagaaaatctatcttgacaatccgtgcgacatggcggtcatctggcggaagcagaacgccaagatgatccatgtggtcgatctcgacgcagccctgactggtgagacggtcaacttcgagaggattcgcgagatcgtcaatgtgctcgatattccgatccaggtcggcggtggcatccgctctgtcgaggcggttgaaaagtaccttgacattggcgtcagccgtgtggttattggctctgcggcggttaccaatcccggcctcatcgccgatctcctgaagaaatatcgtccttcgcagatcgtcgtcggcatcgatgccgagcacggcgtgcccaaaatcaaggggtggaccgagagcagcaatatgcaggattacgagcttgctggcgaaatgaagaagctcggcgtcgagcgcatcatttacaccgacatcacccgtgacggcatgttgcagggggtcggctacgaaaccaccaaacgctttgccgagaaggcgggcatgaaggtgaccgcgtctggtggcgcgaccacttccgatgacctgcacaagctccgctcgctcgaaaagtacggcgtcgattcggtcattatcggcaaggcgctttacgagtgcaattttccgtgccaggagctgtggtacgcctacgagcaggggcttggcatcgacggcgaattttccacggcccgcaagaaggagtgctgctcctga

SEQ ID NO: 10181 - protein, 260 aa, Chlorobium tepidum
MLIIPAIDIKEGKCVRLTRGDFAQKKIYLDNPCDMAVIWRKQNAKMIHVVDLDAALTGETVNFERIREIVNVLDIPIQVGGGIRSVEAVEKYLDIGVSRVVIGSAAVTNPGLIADLLKKYRPSQIVVGIDAEHGVPKIKGWTESSNMQDYELAGEMKKLGVERIIYTDITRDGMLQGVGYETTKRFAEKAGMKVTASGGATTSDDLHKLRSLEKYGVDSVIIGKALYECNFPCQELWYAYEQGLGIDGEFSTARKKECCS

SEQ ID NO: 10182 - DNA, 741 bp, Corynebacterium glutamicum
  CDS (1)..(741)
atgaccttcactattcttcctgcagtcgatgtagttaacggacaagcagttcgcctagatcagggcgaggccggcactgaaaagtcttatggcacccctttggaatccgcactgaagtggcaggagcagggtgcaaagtggttgcactttgtggacctggacgcagcgttcaaccgtggttccaaccatgagatgatggcggaaattgtcggcaagctcgatgttgatgtggagctcactggcggtatccgtgatgatgagtctctggagcgcgcgctggcaaccggtgcacgtcgtgtaaacattggtaccgctgctctggagaagccagagtggattgcttctgcgattcaacgctatggcgagaagattgctgtcgatatcgctgtgcgtttggaagatggtgaatggcgcacccgtggaaacggttgggtctccgatggtggcgatctgtgggaagttctcgagcgtttggattcccaaggttgtgcacgtttcgtggttaccgatgtgtccaaggacggcaccttgagtggtccaaatgttgagctgctgcgtgaggttgctgcagctacagacgcacctatcgtggcatctggtggaatttctgttttggaagatgttttggaactagccaagtaccaggatgagggcattgattccgtcatcattggcaaggcactttatgagcacaagttcaccctcgaagaggctttggctgcagtagaaaagctcggttaa

SEQ ID NO: 10183 - protein, 246 aa, Corynebacterium glutamicum
MTFTILPAVDVVNGQAVRLDQGEAGTEKSYGTPLESALKWQEQGAKWLHFVDLDAAFNRGSNHEMMAEIVGKLDVDVELTGGIRDDESLERALATGARRVNIGTAALEKPEWIASAIQRYGEKIAVDIAVRLEDGEWRTRGNGWVSDGGDLWEVLERLDSQGCARFVVTDVSKDGTLSGPNVELLREVAAATDAPIVASGGISVLEDVLELAKYQDEGIDSVIIGKALYEHKFTLEEALAAVEKLG

SEQ ID NO: 10184 - DNA, 735 bp, Geobacter sulfurreducens
  CDS (1)..(735)
atgatcgtcatacctgccattgacctgaaagaaggaaagtgcgtccgcctcgaacaggggctcatggaaaaggataccgttttctgtgacaatcccgccgaccaggccagggagtgggagcgccagggggcggagctgctccacattgtcgacctggacggcgcctttgccggcgaacccaagaaccgcgcctccatcgaggccatcgtcaaggccattgccatcccaacccagctggggggcggcatccgggacattcccaccatcgaggcgtatctctccctcggcattggccgggtgatcctcggtactgcggcccagcggaaccccgaactggtggaggaggcctgccgcctcttccccggccggatcgtggtggggatcgacgcaaagaacggcatggtggcggtccaggggtgggccgaggtcaccggcgtcacggcggtggatctggcaaaacggttcgagggatacggcgtcgccgccatcatttacaccgacatcgcccgggacggcatgatgcaggggccgaacattgaagcgaccagggctctggccgaggcgatctcgatcccggtcatcgcctccggaggggtgtcgtccctgaaggatatcgagaaccttatggccattgagacgagcggcatcgccggcgccatcaccggcaaggcggtctacaccggggccatcaatctggctgaagcggtagcactcacgaagcggggaggggcctga

SEQ ID NO: 10185 - protein, 244 aa, Geobacter sulfurreducens
MIVIPAIDLKEGKCVRLEQGLMEKDTVFCDNPADQAREWERQGAELLHIVDLDGAFAGEPKNRASIEAIVKAIAIPTQLGGGIRDIPTIEAYLSLGIGRVILGTAAQRNPELVEEACRLFPGRIVVGIDAKNGMVAVQGWAEVTGVTAVDLAKRFEGYGVAAIIYTDIARDGMMQGPNIEATRALAEAISIPVIASGGVSSLKDIENLMAIETSGIAGAITGKAVYTGAINLAEAVALTKRGGA

SEQ ID NO: 10186 - DNA, 768 bp, Gloeobacter violaceus
  CDS (1)..(768)
atggatattattcctgcgattgacatactcgacggccgctgcgtgcgcctctaccagggcaactaccagcttgctgagacctacggggaggacccggtggccgttgcctgcaactgggcgaaactgggggcgccgcggctgcacgtggtcgacctggacggtgcgcgccaggggatgcccgtgcacctcgacgccctcgaagcgatcgtcacccaggtgccctgcccggtacagttcgggggtggcctgcgcagcatcgaggcggtcagtgccgtgctcgatcgcggtgtggaccgggtgatcctgggcaccgccgcggtcgaaaatccggcgcttatccgcgagtgctgcgagcgcttcggcggcagaatcgccgtcggcctcgacgcgcgcggcgggcaggtggcggtgcgcggctggcgggaaacctcggaagtggaggtgaccgaactggccggcgagatggaaaagctcggcgtcagcgccatcgtctacaccgacatcctcaaagacggtaccctcaccggtccgaacctggtggagctgcagcggctcaccgacgcggtcaaagtgccgatcatcgcctccggcggcgtgggcaccctggcggatgtgctctacctgctggcgctggagccgcgcggattgcaaggagtgattatcggccgggccctctacacgggcgatgtcgatctggccgaggcgctcagggcggccgggccgagccgctggcaggatcttcccccggacgatgtggccttcgcctga

SEQ ID NO: 10187 - protein, 255 aa, Gloeobacter violaceus
MDIIPAIDILDGRCVRLYQGNYQLAETYGEDPVAVACNWAKLGAPRLHVVDLDGARQGMPVHLDALEAIVTQVPCPVQFGGGLRSIEAVSAVLDRGVDRVILGTAAVENPALIRECCERFGGRIAVGLDARGGQVAVRGWRETSEVEVTELAGEMEKLGVSAIVYTDILKDGTLTGPNLVELQRLTDAVKVPIIASGGVGTLADVLYLLALEPRGLQGVIIGRALYTGDVDLAEALRAAGPSRWQDLPPDDVAFA

SEQ ID NO: 10188 - DNA, 738 bp, Methanosarcina acetivorans
  CDS (1)..(738)
atggcttttgaagtgattcctgcagtggacatgaggggaggaaaatgcgttcagctggtgcagggtgtgcctggcagtgagatcgtgtcccttaatgaccctcttgcagttgcccttgactggataggaaaaggagcgaagacccttcatctggtagaccttgacggagcgattgaaggggaaagaaaaaatgcccctattattgaaaagatagtccaggcgtgcagggagaaaggtgtgagtatccaggttggaggaggaatccggagctttgaagatgcggcttccctgcttgagcttggggtttcaagaataattctcggaactgctgccctccagaaccccgaacttgtaaaacagctttccgatgcctttggaagctcgtgtgtaaatgttgcactggatgcaaagaacgggaaaatctcgatcaaaggctggaccgaggagtgcgcgcaaacccctgtcgaaatgggcagagagtttgaagagcttggagccggaagccttcttttcacgaatatcgacaccgaaggactaatgcagggagtaaaccctggcccgacaagggaacttgtggaatcggtcagcatccctgtaattgcatccggaggggtaagttccctcgaagacctgaaggttttaaagcagaccggagcctcaggagttgtggtaggcagtgccctctacacaggcaggtttacccttgaggcagctatcgaaactattcgaaatgattga

SEQ ID NO: 10189 - protein, 245 aa, Methanosarcina acetivorans
MAFEVIPAVDMRGGKCVQLVQGVPGSEIVSLNDPLAVALDWIGKGAKTLHLVDLDGAIEGERKNAPIIEKIVQACREKGVSIQVGGGIRSFEDAASLLELGVSRIILGTAALQNPELVKQLSDAFGSSCVNVALDAKNGKISIKGWTEECAQTPVEMGREFEELGAGSLLFTNIDTEGLMQGVNPGPTRELVESVSIPVIASGGVSSLEDLKVLKQTGASGVVVGSALYTGRFTLEAAIETIRND

SEQ ID NO: 10190 - DNA, 726 bp, Methanococcus maripaludis
  CDS (1)..(726)
atgctagttattcctgcagttgatatgaaaaataaaaaatgtgtacagcttatccagggaaatcctgataaaaaacacgttgaattagataatcctcctgaaattgcaaaaaaatgggtaaatgaaggtgcagaaatgcttcacctcgtggaccttgatggtgcacttgacggaaaacgggtaaacgatgaatttatcgaagaaataattaaaaaatctggggtacctgttcaaattggtggcggaattcgatcaatcgaagatgcagaatacctcgttgaaaaaggggctaaaaaagtaattattggaactattgctgtagaaaatccagaaataataaaagaactttctaaacgtatcggcagtgaaaaaataatggtttcacttgatgcaaaagacggcaaagttgtaataaaaggctggaaagaaaaaacaaaatacactcctgttcaaattggaaaaatactcgaagaaatgggcgctggaagtattttatttacaaatgtagatagtgaaggtcttttgaatggaataaatatcgaaccaacaaaagaacttgtcgacaacttgaaaatacctattgtagcatcaggcggcgttacaacaatcgatgatcttttaaaattaaaagaaatcggggtatatggggtagttgtaggttctgcaatttacaaaaatatgataaatttaaaagatgcgattgaagcagtaaataaaagtaattaa

SEQ ID NO: 10191 - protein, 241 aa, Methanococcus maripaludis
MLVIPAVDMKNKKCVQLIQGNPDKKHVELDNPPEIAKKWVNEGAEMLHLVDLDGALDGKRVNDEFIEEIIKKSGVPVQIGGGIRSIEDAEYLVEKGAKKVIIGTIAVENPEIIKELSKRIGSEKIMVSLDAKDGKVVIKGWKEKTKYTPVQIGKILEEMGAGSILFTNVDSEGLLNGINIEPTKELVDNLKIPIVASGGVTTIDDLLKLKEIGVYGVVVGSAIYKNMINLKDAIEAVNKSN

SEQ ID NO: 10192 - DNA, 720 bp, Methanobacterium thermoautotrophicum
  CDS (1)..(720)
atgcttataataccggccgtggatataaaggatggaaaatgtgttcagcttgttcagggaaaacccggtacggagcaggtcgtgcttgatgatcctgccggagttgctggaaggtgggaatccctgggggctgaaacaatccatgttgtggaccttgatggggcccttggtcttgagaagaatacaggtatactgaaggagatcacagagagagtttcagtgcccctccagataggtggaggtataaggagtagagaatatgcagggaaactccttgatatgggctttgagagggttatactgggcaccatggccatagaaaatccggccatcgttgaggaacttgcaggtgaatacggatcggaacgcataatggtctcacttgatagcagggactcacgggttgttataaggggatggacagagaaggtccccttcacagcagaggagatggccaggaaattccaggagaggggagctggtagcatactctttaccaacgtggacttcgagggtcttctctcaggatttgacctgaaacccgtgagtgaacttgtggaggcagttgagatacctgtaatctactccgggggtgttagcagcctaaatgacctgaggatgctgcaggggaccggtgtaatgggggtcgttataggatcagccatctacaggggcctcatagacctcaccgaggccctcaaatatcaggaccttaaatga

SEQ ID NO: 10193 - protein, 239 aa, Methanobacterium thermoautotrophicum
MLIIPAVDIKDGKCVQLVQGKPGTEQVVLDDPAGVAGRWESLGAETIHVVDLDGALGLEKNTGILKEITERVSVPLQIGGGIRSREYAGKLLDMGFERVILGTMAIENPAIVEELAGEYGSERIMVSLDSRDSRVVIRGWTEKVPFTAEEMARKFQERGAGSILFTNVDFEGLLSGFDLKPVSELVEAVEIPVIYSGGVSSLNDLRMLQGTGVMGVVIGSAIYRGLIDLTEALKYQDLK

SEQ ID NO: 10194 - DNA, 748 bp, Methanococcus thermolithotrophicus
  CDS (22)..(738)
gtataatacctaggtgaaagaatgatcgttattccggcagttgatatgaaaaacggaaaatgtgtccagttaattcaaggtgatcccaataaaaagcatgttgaattggagaatccagttgaagttgcagaaaaatgggtgagcgaaggggcagaaatgcttcacttagttgatttagatggtgcaattgaaggagaaagcgttaatagagaactaataaaggaaataatccaaactgtaaatgtgccagttcagattggtggaggaatcagtgtaagatgcactgaatctaatctaatcgagataggggctaaaagaataattttaggcaccgttgcagttgaaaatccagatattgttgaagaaatatcaaaaaaggtaggtaaagaaaaggtaatggtggcgttagatgcaaaagatggcaaagttgtcataaaaggttggaaagaaaaaacaaaatatactcctgttgaaatgggaaagatattggaggaaaaaggtgcaggaagtatcttgtttacaaatgtcaatgtagaaggactattaactggaatgaatgtggagccagttgaaacgttggtggaagagttggaaataccagttattgcatcaggtggtgtgactacaattgaagacctgattaaactaaaagcagtcggtgttgaaggggtagttgtgggttctgcaatttataaaaaccttatagacttgaaagaagctattaaagcctgtaggtgatagaatggaa

SEQ ID NO: 10195 - protein, 238 aa, Methanococcus thermolithotrophicus
MIVIPAVDMKNGKCVQLIQGDPNKKHVELENPVEVAEKWVSEGAEMLHLVDLDGAIEGESVNRELIKEIIQTVNVPVQIGGGISVRCTESNLIEIGAKRIILGTVAVENPDIVEEISKKVGKEKVMVALDAKDGKVVIKGWKEKTKYTPVEMGKILEEKGAGSILFTNVNVEGLLTGMNVEPVETLVEELEIPVIASGGVTTIEDLIKLKAVGVEGVVVGSAIYKNLIDLKEAIKACR

SEQ ID NO: 10196 - DNA, 768 bp, Prochlorococcus marinus subsp
  CDS (1)..(768)
atgaaactaattccagccatagatttaatgaatggtaaatgtgtaagactttttaaaggtgactttaacaagaaaaaagacttctccagagaaccttatgagcaagcaaaatactgggagaatgagggagcaaaatgtattcatattgttgatctggatgctgctaagaccggtattccaacaaatgatcaatcaattcaaaagattgtcaaatcagttaatattcctattcaaattggaggaggtataagatcgctagaaaggattaaacaattattttcttacggcgtggataaggttattatgggaacttccgctatagaaaataaagaactagttaaaagcttatcaaccaaattcccaagcagaattattattggaatagatgcaaaggagggaaaagtaagcacaaggggatggctaaaacaatcagatgtattagccacagaattagtacaagaattttcctcttttaaaattgccagttttattgttacagatattaataccgatggaactctagaagggactaatgaagtttttataaaaaagattcttgaaattactgatattcctgttattgcatcaggcggtgtaggttcaatttcagacttgttatcattaactaaatttgaagattctggactatatggagtaatagtaggaaaagctctttatgaaaataaatttacaataagtgaagcaagtaatattttatctacagaaagaataaatgatattccaattaataaagactattacgcctga

SEQ ID NO: 10197 - protein, 255 aa, Prochlorococcus marinus subsp
MKLIPAIDLMNGKCVRLFKGDFNKKKDFSREPYEQAKYWENEGAKCIHIVDLDAAKTGIPTNDQSIQKIVKSVNIPIQIGGGIRSLERIKQLFSYGVDKVIMGTSAIENKELVKSLSTKFPSRIIIGIDAKEGKVSTRGWLKQSDVLATELVQEFSSFKIASFIVTDINTDGTLEGTNEVFIKKILEITDIPVIASGGVGSISDLLSLTKFEDSGLYGVIVGKALYENKFTISEASNILSTERINDIPINKDYYA

SEQ ID NO: 10198 - DNA, 738 bp, Pseudomonas putida
  CDS (1)..(738)
atgctgattatccccgctatcgatctgaaggacggtgcttgcgtgcgcctgcgccagggccgcatggaagactctacggtattttccgacgacccggtgagcatggccgccaagtgggtcgagggtggctgccgccgcctgcacctggtcgacctcaacggcgccttcgaaggccagccggtcaatggtgaagtggttaccgccatcgccaagcgctacccgaacctgccgatccagatcggcggcggtatccgttcgctggaaaccatcgaacactacgtcaaggctggcgtcagctacgtgatcatcggcaccaaggccgtcaagcagcccgagttcgtcgctgaagcgtgcaaagccttcccgggcaaggtcatcgtcggcctggacgccaaggacggtttcgtcgccaccgacggttgggccgaagtgagctcggtgcaggtcatcgacctggccaagcgtttcgaggccgatggcgtctcggcgatcgtctacaccgacattgccaaggacggcatgatgcagggctgcaacgtgcccttcaccaaggcactggctgaagccacccgtatcccggtgatcgcctcgggcggcattcacaacctgggtgacatcaaggccctgctggacgccaaggccccgggcatcatcggcgccatcaccggccgtgccatctacgaaggcaccctggatgtcgctgaggcccaggccttctgtgacaactaccaaggctga

SEQ ID NO: 10199 - protein, 245 aa, Pseudomonas putida
MLIIPAIDLKDGACVRLRQGRMEDSTVFSDDPVSMAAKWVEGGCRRLHLVDLNGAFEGQPVNGEVVTAIAKRYPNLPIQIGGGIRSLETIEHYVKAGVSYVIIGTKAVKQPEFVAEACKAFPGKVIVGLDAKDGFVATDGWAEVSSVQVIDLAKRFEADGVSAIVYTDIAKDGMMQGCNVPFTKALAEATRIPVIASGGIHNLGDIKALLDAKAPGIIGAITGRAIYEGTLDVAEAQAFCDNYQG

SEQ ID NO: 10200 - DNA, 720 bp, Streptococcus mutans
  CDS (1)..(720)
atgcaaattcttccagctatcgatattaaaaacggtcatgctgtccgccttgtcaagggggattttgagcaagagacggttgttaatgataatgttctcgaccaagctagtattttcatggaagcaggtatccaatacatccatgttgtcgatttggatggtgcacttgaaggtcgggctgctaatcgtgatttaattgctaagattaaagaaatgacaggcttggctattgaagtcggcggtggtattcgcaccattgaacaaattgaagattatttatctgtcggtattaatcgtgtgattattggttctatggcagttaagcatccccaatttgtcaaggaagctctggataaatttggcagcgataaaattgttgttggtattgatgctaaaaatgggatggtagctacagaaggttggctggagactagcaccgttgattacatcagcctagctttagagatggaaaagatgggtgtcagactccttatctataccgatgttgaccgtgatggcacattgacaggccccaattttgagcattatgagaaactaattgctcacttgacaagtgccaaggttattgcctcaggtggtatccatgccctgtcagatttgcaacaattagaaaagattggtgttgccggaaccattgtcggcaaagcttattataatggcgatattagtctaaaagaattaagagaatttgagggttag

SEQ ID NO: 10201 - protein, 239 aa, Streptococcus mutans
MQILPAIDIKNGHAVRLVKGDFEQETVVNDNVLDQASIFMEAGIQYIHVVDLDGALEGRAANRDLIAKIKEMTGLAIEVGGGIRTIEQIEDYLSVGINRVIIGSMAVKHPQFVKEALDKFGSDKIVVGIDAKNGMVATEGWLETSTVDYISLALEMEKMGVRLLIYTDVDRDGTLTGPNFEHYEKLIAHLTSAKVIASGGIHALSDLQQLEKIGVAGTIVGKAYYNGDISLKELREFEG

SEQ ID NO: 10202 - DNA, 765 bp, Synechococcus sp
  CDS (1)..(765)
atggacgtaatcccagccattgacctcctcggagggcagtgcgtacgccttttccaaggggattacgatcaggcggaagtctacggcaaagatcccgtgggaatggccttgcgctgggccgaagccggagcccagcgtctgcacttggtcgacctagatggtgccaaggagggttcacctgtcaatgcggaggcgatcgcaacgatcgcgcaacggctctcaattccggttcaagtggggggcggcctgcgcgatcgcgacaccgtggctcgcctgcttgacagcggggttgaacgggccattctcgggactgtggcggtcgaaaggccagcgctcgttgaagccttagctggggaatttccgggtcagattgccgtggggatcgatgcccgcagcggcaaagtcgccacaggggctgctggaagattctggctcacagccgttgcactgcacagcagatggcagacttggcgcttgcgcactgatctgcaccgacattgggcgagatggcacgcttcaggtccgaacctggaggaattgcgggcgatcgcggctgcagtctccattccggtcattgcgtcgggtggtgtcggatcgctaactgatctcctcagcttgctgcccctcgaggcccaaggggtgagcggcgtgatcgttggcaaagctttttataccggtgccgtcgatctccaagaggccctacgggcgatcggttcaggacgctggcaagatgtggccgtggatgattcctcccgcttggcttaa

SEQ ID NO: 10203 - protein, 254 aa, Synechococcus sp
MDVIPAIDLLGGQCVRLFQGDYDQAEVYGKDPVGMALRWAEAGAQRLHLVDLDGAKEGSPVNAEAIATIAQRLSIPVQVGGGLRDRDTVARLLDSGVERAILGTVAVERPALVEALAGEFPGQIAVGIDARSGKVATGAAGRFWLTAVALHSRWQTWRLRTDLHRHWARWHASGPNLEELRAIAAAVSIPVIASGGVGSLTDLLSLLPLEAQGVSGVIVGKAFYTGAVDLQEALRAIGSGRWQDVAVDDSSRLA

SEQ ID NO: 10204 - DNA, 768 bp, Synechococcus sp
  CDS (1)..(768)
atggagatccttcccgctattgatctgctggacggagcctgcgtgcgcctgcacaagggggattacgagcaggtcacccgctttagcgatgaccctgtcgctcaggccctcagttggcagcagcagggcgcaacccgactgcacctagtggatctcgatggtgccaagcggggagaaccggtgaatgattccgccgtccaggcgatcacatcagccctggatatcccggtgcagctcggtggcggcgtccgctccctggaacgggctgagcagttgctcgcctgcggtcttgatcgcgtgatcctcggcaccgtggcgatcgagcagcccgacctggttcgatccctcgccgagcggtaccccggtcggatcgtggtgggaatcgatgccaaggacgggcgggtggccacccgcggctggatcgagcagagcgatgtcctggcgacggacctggccagaaccttcagcagctctgggattgccgcgatcatcaccaccgatatcgccaccgatggcaccctggccgggccgaacctcgaggctctcaggaccatggcggcgagcagcagcgttccggtgatcgcctccggcggcattggctgcatggcggatctgctgtctctcctgcccctggaaccactcggtgtgagtggtgtgatcgtcggtcgtgccctgtacgacggtcgtgttgatctggcggaagcggtgcgggcgctggcggagccgaggctgcaggacatcacagctgttgcagcggacctggcttga

SEQ ID NO: 10205 - protein, 255 aa, Synechococcus sp
MEILPAIDLLDGACVRLHKGDYEQVTRFSDDPVAQALSWQQQGATRLHLVDLDGAKRGEPVNDSAVQAITSALDIPVQLGGGVRSLERAEQLLACGLDRVILGTVAIEQPDLVRSLAERYPGRIVVGIDAKDGRVATRGWIEQSDVLATDLARTFSSSGIAAIITTDIATDGTLAGPNLEALRTMAASSSVPVIASGGIGCMADLLSLLPLEPLGVSGVIVGRALYDGRVDLAEAVRALAEPRLQDITAVAADLA

SEQ ID NO: 10206 - DNA, 1662 bp, Emericella nidulans
  CDS (1)..(1662)
atgcccactgttcatctgcttgattatgtcgctggaaatgtgcgttccttggtgaatgccatcaacaaggttggatatgaagttgagtgggtgagatcgcccagcgatttgaaagatgtcgagaagctcatacttccaggagtcggccacttcggccattgcctttctcagctttcaagcggtggctatttgcagccgataagagagcatattgcttccgggaaaccgtttatgggaatatgtgttggtttacaatcccttttcgagagttccgaggaggatcccaacattcctggtttgggtacaatcccagcgcggttgcgcaaatttgacgcaaaaacgaagagcgtacctcatatcggttggaactcggcaacagatacccgcattgactcgactggaggccagaccttctatggattgagcccaagcagcaagtactactacgtacactcatacgccgcgccatatgagccgggaattcttgagaaagatggttggttggtcgccacggcgagttatggggaggagaaattcatcggcgcgatagcacgagataacatctttgcgacacaattccatcccgagaagagcggccaagcaggcctacgcacccttcgcgctttcttggacggagctcagctccattctgtcacattagaagactcgattttgacaggagagaaaaacggtcttacccgtaggatcatcgcctgtcttgatgttcgtacgaatgatgtcggcgatctcgttgtgactaagggcgatcaatatgatgttcgcgagaaggatggtgcggatgctggagggcaagtgaggaacctgggaaagccggttgatatggctaagaaatattacgaacagggggcagatgaggtgacgtttttaaacatcacctctttcagaaactgtccgttagccgacctccctatgctcgagattctccgaagaacgtcggagaccgtcttcgtacctttgactattggtggcggcattagggacactgtggatacagacggtactcacatcccagctctagacgtggcatcgatgtacttcaaatctggggctgacaaagtcagcattggttcggatgccgttgttgctgcggaagattattacgcagctggcaaagttctgtctggcaaaactgccattgaaactatttctaaggcgtatggaaaccaggctgtcgttgtaagcgttgacccgaagcgcgtttatgtcagccaaccagaagacacgaaacaccgtacgatagaaacgaaatttcctaacgccgccgggcaaaatttctgttggtaccagtgtactataaagggtggcagagagaccagagacttagatgtctgccagctggtgcaagccgtcgaggcaatgggtgctggggagattctgctgaattgcattgataaagacgggagcaacagtggtttcgatcttgaactgatcaaccacgtcaaagctgcagtaaaaatacccgtgattgcctctagcggagctggtatgccgaagcattttgaggaagtttttgatcaaacgacgacagatgctgctctgggtgctgggatgttccatcgtggtgagtatactgttggtgaagtcaagcaataccttgaggatagaggtttccttgttcgacgattcgagcctgatgtctga

SEQ ID NO: 10207 - protein, 553 aa, Emericella nidulans
MPTVHLLDYVAGNVRSLVNAINKVGYEVEWVRSPSDLKDVEKLILPGVGHFGHCLSQLSSGGYLQPIREHIASGKPFMGICVGLQSLFESSEEDPNIPGLGTIPARLRKFDAKTKSVPHIGWNSATDTRIDSTGGQTFYGLSPSSKYYYVHSYAAPYEPGILEKDGWLVATASYGEEKFIGAIARDNIFATQFHPEKSGQAGLRTLRAFLDGAQLHSVTLEDSILTGEKNGLTRRIIACLDVRTNDVGDLVVTKGDQYDVREKDGADAGGQVRNLGKPVDMAKKYYEQGADEVTFLNITSFRNCPLADLPMLEILRRTSETVFVPLTIGGGIRDTVDTDGTHIPALDVASMYFKSGADKVSIGSDAVVAAEDYYAAGKVLSGKTAIETISKAYGNQAVVVSVDPKRVYVSQPEDTKHRTIETKFPNAAGQNFCWYQCTIKGGRETRDLDVCQLVQAVEAMGAGEILLNCIDKDGSNSGFDLELINHVKAAVKIPVIASSGAGMPKHFEEVFDQTTTDAALGAGMFHRGEYTVGEVKQYLEDRGFLVRRFEPDV

SEQ ID NO: 10208 - DNA, 759 bp, Bacillus anthracis
  CDS (1)..(759)
atgttagcgaaacgcattattccatgtctagatgtgaaagaagggcgagtcgtaaagggggtaaattttatagggttacaagatgtcggtgatcctgttgaaatagcagctttatataatgatgcgggagcagatgaaatagtatttttagatattacggcaacgcatgaaggacgaaaaacaattatagatgttgtagaaaaaacggcttcaaaagtatttattcctcttacagttggcggaggaatttcaagtgtgaaagatatgtacaatttactaagagcgggagcagataaagtttcaattaactcagcagcagtgcgaaatccaaaattaatcgaagaaggggcacagcactttggttcacaatgtattgtcgtagcaattgatgctagaaaagtagcagaaggtaagtggaatgtatatgtgaacggcggaagagttgatacgggaatggatgcaattgggtgggcaaagcgcgttgttatgcttggtgccggcgaaattttgttaacgagtatggatgcagatggaacgaaaaacggatatgaccttcgtttaacagaagaaatttcaaaaagtgtttccataccagtcattgcgtcgggtggatgtggtcatgctgatcacattatagaagtgtttcaaaagacaacagtagatgcagcgttagcggcatcaatctttcattacggtgaggcgacaataggggacgtaaagagaaaattaagaaatgcaaacgtcgaggtgcggttatga

SEQ ID NO: 10209 - protein, 252 aa, Bacillus anthracis
MLAKRIIPCLDVKEGRVVKGVNFIGLQDVGDPVEIAALYNDAGADEIVFLDITATHEGRKTIIDVVEKTASKVFIPLTVGGGISSVKDMYNLLRAGADKVSINSAAVRNPKLIEEGAQHFGSQCIVVAIDARKVAEGKWNVYVNGGRVDTGMDAIGWAKRVVMLGAGEILLTSMDADGTKNGYDLRLTEEISKSVSIPVIASGGCGHADHIIEVFQKTTVDAALAASIFHYGEATIGDVKRKLRNANVEVRL

SEQ ID NO: 10210 - DNA, 759 bp, Bacillus cereus
  CDS (1)..(759)
atgttagcaaaacgcgttattccatgtctagatgtgaaagaagggcgagtcgtaaagggtgtaaattttataggactacaagatgtcggggatcctgttgaaatagcagctttatataatgatgcgggagcagatgaaatagtatttttagatattacggcaactcatgaaggacgaaaaacgattgtagatgttgtagaaaaaacggcttcaaaagtatttattcctcttacagttggcggaggaatttcaaatgtgaaagatatgtacaatttactaagagctggagcagataaagtttcaattaactcagcagcagtgcgaaatccaaaattaatcggagaaggggcagagcattttggctcacaatgtattgtcgtcgcaattgatgctagaaaagtagcagaagataagtggaatgtatatgtgaacggcggaagagttgatacgggaatggatgcaatcaggtgggcaaagcgcgttacagagctaggcgcaggcgaaattttattaacgagtatggatgcagacggaacgaaaaacggatatgaccttcgtttaacagaagaaatttcaaaaagtgtttccgtacctgtcatcgcgtcaggcgggtgcggtcatgctgatcacattatagaagtgtttcaaaagacagcagttgatgcagcattagcggcatcaatctttcattacggtgaggcgacaataggggacgtaaagagaaagttaagaaatgcaaatgttgaggtgcggctatga

SEQ ID NO: 10211 - protein, 252 aa, Bacillus cereus
MLAKRVIPCLDVKEGRVVKGVNFIGLQDVGDPVEIAALYNDAGADEIVFLDITATHEGRKTIVDVVEKTASKVFIPLTVGGGISNVKDMYNLLRAGADKVSINSAAVRNPKLIGEGAEHFGSQCIVVAIDARKVAEDKWNVYVNGGRVDTGMDAIRWAKRVTELGAGEILLTSMDADGTKNGYDLRLTEEISKSVSVPVIASGGCGHADHIIEVFQKTAVDAALAASIFHYGEATIGDVKRKLRNANVEVRL

SEQ ID NO: 10212 - DNA, 759 bp, Bacillus cereus
  CDS (1)..(759)
atgttagcgaaacgaattattccatgtctagatgtgaaagaagggcgagtcgtaaagggtgtaaattttataggattacaagatgtcggtgatccggttgaaatagctgaagcatataacgaggcaggggcagatgaaatcgtatttttagatattacggcgactcatgaaggaagaaaaacgattatagatgttgtagaaaaaacagcagcaaaagtatttattcctcttacggttggcggggggatatcaagtgtgaaagatatgtacaatttactaagagctggggcagacaaagtttcaataaactcagcggcagtgcgaaacccgaagttaatagaagaaggggcagaacactttggatcacaatgtattgtcgtggcaattgatgctagaaaagtagcagaaggtaaatggaacgtatatgtcaacggcggaagagttgacacaggaatggatgccatagaatgggcgaagcgtgttgttaaacttggggcaggtgaaattttgttaacgagtatggatgcagatggaacgaaaagcggatatgaccttcgtttaacagaagaaatttcaaaaagtgtttctattccagtcatcgcatcaggaggctgtggtcatacggatcatattatagaagtttttcaaaagacaacggttgatgcagcgttagcggcatccatctttcattatggtgaggcgacagtgcagagtgtaaagcgaaaattaagagatgcaaatattgaggtgcggttatga

SEQ ID NO: 10213 - protein, 252 aa, Bacillus cereus
MLAKRIIPCLDVKEGRVVKGVNFIGLQDVGDPVEIAEAYNEAGADEIVFLDITATHEGRKTIIDVVEKTAAKVFIPLTVGGGISSVKDMYNLLRAGADKVSINSAAVRNPKLIEEGAEHFGSQCIVVAIDARKVAEGKWNVYVNGGRVDTGMDAIEWAKRVVKLGAGEILLTSMDADGTKSGYDLRLTEEISKSVSIPVIASGGCGHTDHIIEVFQKTTVDAALAASIFHYGEATVQSVKRKLRDANIEVRL

SEQ ID NO: 10214 - DNA, 756 bp, Bacteroides thetaiotaomicron
  CDS (1)..(756)
atgttagcaaaaagaatcataccctgtctggatataaaagacggacagaccgtaaaaggaacgaactttgtcaatttgcgccaggccggtgatccggtagaactggggcgggcttacagcgaacaaggagcagatgaacttgtttttttggatattactgcaagtcacgaaggacgtaagactttcacggaactggtaaagcggattgctgccaatatcaatatcccgtttaccgtgggcggtggcatcaatgaattgagcgatgtagatcgcttgctgaatgccggagcggataagatctcaatcaattcttccgccattcgcaaccctcagctgattgatgatatagccaagaacttcggctctcaggtttgcgttctggcggtagatgccaagcaaacagaaaacggctggaagtgttatctgaacggcgggcgtatcgaaaccgataaagaattgctggcatggactaaagaggctcaggagcgtggagcaggcgaaatcctgtttacgagcatgaaccatgatggggtgaagaccggttatgcgaacgaggcgcttgcttccttggccgatcaactctctattcccgtgatcgcttcgggcggggcagggctgaaagaacacttccgtgatgcttttttagtaggaaaagcagatgcggcgttggctgccagcgtttttcatttcggagaaattaaaattcccgaattaaaatcgtatctttgcggcgaaggaataaccatcagagggtga

SEQ ID NO: 10215 - protein, 251 aa, Bacteroides thetaiotaomicron
MLAKRIIPCLDIKDGQTVKGTNFVNLRQAGDPVELGRAYSEQGADELVFLDITASHEGRKTFTELVKRIAANINIPFTVGGGINELSDVDRLLNAGADKISINSSAIRNPQLIDDIAKNFGSQVCVLAVDAKQTENGWKCYLNGGRIETDKELLAWTKEAQERGAGEILFTSMNHDGVKTGYANEALASLADQLSIPVIASGGAGLKEHFRDAFLVGKADAALAASVFHFGEIKIPELKSYLCGEGITIRG

SEQ ID NO: 10216 - DNA, 771 bp, Bifidobacterium longum
  CDS (1)..(771)
atgtcgttggcggtacgagtcatcccgtgcctggacgttgacgccggtcgcgtggtgaagggtgtgcatttcgagaacctcaaggacgcgggtgacccggtggagctggcggccgaatactaccgtcagagagccgacgagatcaccttcctggatgtgaccgcatccagctcccaccgcaacacgatgattgacgtggtctcccgcaccgccgaacaggtgttcatcccaatgactgtgggcggcggcgtacgcacgcccgaggacgtcgactcactgctgcgctgcggtgcagacaaggtcggtgtcaacacggcggccatcaacgacccgtcgcttatcagccgtgtggccgatcgtttcggcaaccaggtgctggtgctctccgtggatgcccgccgcgaaaagggtgagcagcatacgcagtccggttttgaggtcaccacgatgggtggccgcaaatccaccggtattgatgccatctggtgggtcaagcgcgccgagcagcttggcgccggcgagattctgcttaactcgatggacgccgacggcaccaaggaaggctttgacctcgagatgattcgcgccgtgcgcaaggaagtcaagattccgatcatcgcctccggcggtgccggcaaggtcgaggacttcccgcccgccatcgaagcaggtgccgacgcggtgctggctgcatccgtgttccattacggcatcctgactatcgccgatgtcaaggcggaactcaagaagcacggctacaccgttcgctaa

SEQ ID NO: 10217 - protein, 256 aa, Bifidobacterium longum
MSLAVRVIPCLDVDAGRVVKGVHFENLKDAGDPVELAAEYYRQRADEITFLDVTASSSHRNTMIDVVSRTAEQVFIPMTVGGGVRTPEDVDSLLRCGADKVGVNTAAINDPSLISRVADRFGNQVLVLSVDARREKGEQHTQSGFEVTTMGGRKSTGIDAIWWVKRAEQLGAGEILLNSMDADGTKEGFDLEMIRAVRKEVKIPIIASGGAGKVEDFPPAIEAGADAVLAASVFHYGILTIADVKAELKKHGYTVR

SEQ ID NO: 10218 - DNA, 810 bp, Bordetella bronchiseptica
  CDS (1)..(810)
atgaatgccagccgcattgccgccgccggcgccagcacgctgacgcgccgcatcatcccctgcctcgacgtgaccgccggccgcgtcgtcaagggcgtgaacttcgtcaacctcaccgatgccggcgatccggtcgagatcgcgcgccgctacaacgagcagggcgccgacgagctcaccttcctcgacatcaccgccaccagcgacgggcgcgacctcatcctgcccatcatcgagcaggtggcctcgcaggtcttcattcccctgacggtgggcggcggcgtgcgccaggtctccgatgtacagcgcctgctcaatgccggcgccgacaagatcagcatcaacagcgcggcggtcgccaaccccgagctggtgcgcgcggcggccgactaccatggctcgcaatgcatcgtggtcgccatcgacgcgcgccgcagctcggccgagggcgaaccggcccgctgggaagtcttcacgcacggcggccgcaaggccaccgggctggacgccgtggcctgggcgcgccgcatggccgcctatggcgccggcgaaatcctgctgaccagcatggaccgcgacggcaccaaatcgggcttcgacctggagctcacccgcgccgtctccgatgccgtacccgtgcccgtcatcgcctcgggcggcgtgggcaacctgcagcacctggccgatggcgtgaccaccggccgcgccagcgccgtgctggccgccagcatcttccacttcggccaacacaccgtgcgcgagtgcaagcagtacatggccgagcgcggcattgccgtgagactgacatga

SEQ ID NO: 10219 - protein, 269 aa, Bordetella bronchiseptica
MNASRIAAAGASTLTRRIIPCLDVTAGRVVKGVNFVNLTDAGDPVEIARRYNEQGADELTFLDITATSDGRDLILPIIEQVASQVFIPLTVGGGVRQVSDVQRLLNAGADKISINSAAVANPELVRAAADYHGSQCIVVAIDARRSSAEGEPARWEVFTHGGRKATGLDAVAWARRMAAYGAGEILLTSMDRDGTKSGFDLELTRAVSDAVPVPVIASGGVGNLQHLADGVTTGRASAVLAASIFHFGQHTVRECKQYMAERGIAVRLT

SEQ ID NO: 10220 - DNA, 774 bp, Bradyrhizobium japonicum
  CDS (1)..(774)
atgttcaaggtgcgcgtgatcccctgcctcgacgtcaaggacggaagagtcgtcaagggcgtcaatttcgtcgacctgcgcgatgccggcgaccccgtcgaagccgcgatcgcctatgacgccgccggcgccgatgagctcaccttcctcgacatcaccgcgacccatgagaaccgcggcatcatgctcgacgtggtccgccgcacggcggaggcctgcttcatgcctgtgaccgtcggcggcggcgtgcgcgaggttgacgatatcaagacgttgctgcgcgccggcgcggacaaggtctcgatcaacagcgccgcggtgtcgcggcgcgagttcgtcaaggaagcggccgaaaagttcggcgagcagtgcgtggtggtcgcgatcgacgccaagcgggtcaagcgcccgggtggtgaccgctgggagatcttcacccatggcggccgcaacgcgaccggcatcgacgccatcgaatatgcccaggaagtggtctcgctcggcgccggtgaaatcctgctgacctcgatggaccgcgacggcacaaggcaggggttcgatatcccgctgactcgggcgatcgccgacagtattcccgttcctgtaatcgcctcgggcggcgtcggcaatctcgaccacctcgtcgacggtatccgcgacggacacgccacggcggtgctggcggcctcgatcttccatttcggggaattcaccgtccgcgaggccaaggagcacatggcccggcgcggcctgcccatgcgcctggatgcctga

SEQ ID NO: 10221 - protein, 257 aa, Bradyrhizobium japonicum
MFKVRVIPCLDVKDGRVVKGVNFVDLRDAGDPVEAAIAYDAAGADELTFLDITATHENRGIMLDVVRRTAEACFMPVTVGGGVREVDDIKTLLRAGADKVSINSAAVSRREFVKEAAEKFGEQCVVVAIDAKRVKRPGGDRWEIFTHGGRNATGIDAIEYAQEVVSLGAGEILLTSMDRDGTRQGFDIPLTRAIADSIPVPVIASGGVGNLDHLVDGIRDGHATAVLAASIFHFGEFTVREAKEHMARRGLPMRLDA

SEQ ID NO: 10222 - DNA, 777 bp, Buchnera aphidicola
  CDS (1)..(777)
atgctggcaaagcgaataattgcatgtttagatgttaacaatggagttgtagtaaaaggcattcaatttaaaaaccatgaaattgtaggtgatattatatctttgtctaaacgttatacaaaagaaggtatagatgaattagtattttatgacataacagcttctactaataataagctagttgatagaagttggataaagaaagtagcagaaataattaatattccattttgcgtagccggaggtattaaaagtgtagaagatgcacagaatattctatcttttggtgcagataaaatatcaattaattcttcagcattaatagatcctgatttaataactaaaattgctaatcgttttggtgtacaatgtacagttgttggcattgattcttggttcgactcagacaagaaaaaatacatggtccaacaatatacaggtgacgctaatcgtacttatcaaactgattgggaaacaatagattgggttgaaaaagtgcaaaaaaaaggtgctggagaaattgttttaaacatgatgaatcaagatggattacaaaatggatatgatttatcacagttaaatgaaataagaaaaaaatgtaaagtacctttaattgcatcagggggggcagggtgcgcagatcatttttatcaagcattcgatcatgctaatgtagacggtgttttagctgcttccgtttttcataagaaaatcgttaacataaaagatttaaaatattttttaattcaaaaaggtttggaaattagaatatgttaa

SEQ ID NO: 10223 - protein, 258 aa, Buchnera aphidicola
MLAKRIIACLDVNNGVVVKGIQFKNHEIVGDIISLSKRYTKEGIDELVFYDITASTNNKLVDRSWIKKVAEIINIPFCVAGGIKSVEDAQNILSFGADKISINSSALIDPDLITKIANRFGVQCTVVGIDSWFDSDKKKYMVQQYTGDANRTYQTDWETIDWVEKVQKKGAGEIVLNMMNQDGLQNGYDLSQLNEIRKKCKVPLIASGGAGCADHFYQAFDHANVDGVLAASVFHKKIVNIKDLKYFLIQKGLEIRIC

SEQ ID NO: 10224 - DNA, 777 bp, Buchnera aphidicola
  CDS (1)..(777)
atgttagctaaacgaataattccatgtctagatgtgaaatctggaatagtagttaaaggagtacaatttagaaaccatgaaattgttggcggtattttatctttagcaaagcgttatactcaagaaggtgctgatgaattagtattttatgatattgaggcttcatctaataatagattgataaaaaaaaaatgggtttctcagatagcagagataattaatattccattttgtgtagctggtggtatacaaactattcaagatgtacaaagtattttatctagtggtgctgataaaatatctattaattctcctgctatatcagatccttatttaattagtcgtattgcagatcgttttggagttcaatgtgttgttgtaggtatagattcttggtttaataaagaagaatctcaatattatgtatatcaatacactggtgacaatacgaaaactattaaaacctcttggaagacgtgtgattgggtacaaaaagtacaggcattaggtgctggggaaatagtgttaaacgttatgaatcaagatggaatgaaaaatggatatgatttagttcaattaaaaaaaattcgtaaaatatgtaatgttcccttaattgcttcaggtggcgcaggagactattttcacttttatgatgtttttaatgaggcaaaagttgacggtgcgttagcagcgtctgtatttcataatcgtattataaaaattaatcagcttaaaaaatttttaatgaaaaagggtttagaaattagagtatgttaa

SEQ ID NO: 10225 - protein, 258 aa, Buchnera aphidicola
MLAKRIIPCLDVKSGIVVKGVQFRNHEIVGGILSLAKRYTQEGADELVFYDIEASSNNRLIKKKWVSQIAEIINIPFCVAGGIQTIQDVQSILSSGADKISINSPAISDPYLISRIADRFGVQCVVVGIDSWFNKEESQYYVYQYTGDNTKTIKTSWKTCDWVQKVQALGAGEIVLNVMNQDGMKNGYDLVQLKKIRKICNVPLIASGGAGDYFHFYDVFNEAKVDGALAASVFHNRIIKINQLKKFLMKKGLEIRVC

SEQ ID NO: 10226 - DNA, 774 bp, Burkholderia multivorans
  CDS (1)..(774)
atggctctagctaaacgcatcatcccctgcctggacgtgactgccgggcgtgtcgtcaagggcgtcaacttcgtcgaactgcgcgacgcgggcgaccccgtcgagatcgcccgccgctacgacgagcagggcgccgacgaactgacgttcctcgacatcaccgcgacgtccgaccagcgcgacctgatcctgccgatcatcgaggccgtcgcgtcgcaggtcttcatcccgctgacggtcggcggcggcgtgcgcgccgtcgaggacgtgcggcgcctgctcaacgcgggcgcggacaaggtcagcatgaattcgtcggcggtcgcgaatccgcagctcgtgcgcgacgcggccgacaagtacggttcgcagtgcatcgtcgtcgcgatcgacgcgaagcgcgtgtcggccgacggcgaagcgccgcgctgggaagtgttcacgcacggcggccgcaagggcacgggcctcgacgcgatcgaatgggcgcgcaagatggccgagttcggcgcgggcgagatcctgctcacgagcatggaccgcgacggcacgaagtcgggcttcgacctcgcgctcacgcgcggcgtctccgacgcggtgccggtgccggtgatcgcatcgggcggcgtcggctcgctgcaggatctggccgacggcatcaaggacggccgtgcggatgcggtgctcgccgcgagcatcttccactacggcgagcacacggtcggcgaagcgaagcgcttcatggccgagcagggcattccggtgaggctgtga

SEQ ID NO: 10227 - protein, 257 aa, Burkholderia multivorans
MALAKRIIPCLDVTAGRVVKGVNFVELRDAGDPVEIARRYDEQGADELTFLDITATSDQRDLILPIIEAVASQVFIPLTVGGGVRAVEDVRRLLNAGADKVSMNSSAVANPQLVRDAADKYGSQCIVVAIDAKRVSADGEAPRWEVFTHGGRKGTGLDAIEWARKMAEFGAGEILLTSMDRDGTKSGFDLALTRGVSDAVPVPVIASGGVGSLQDLADGIKDGRADAVLAASIFHYGEHTVGEAKRFMAEQGIPVRL

SEQ ID NO: 10228 - DNA, 777 bp, Candidatus Blochmannia floridanus
  CDS (1)..(777)
atgttggcaaaacgcatcatcccgtgtttagatgttatcaataatcaagttattaaaggtatacaatttcaaaatcatcaaataataggagatattgtatctttagctcaatattattcacaagaaggagcagatgaattagtcttttatgatattatggcatctcctaataaccaaacagttagtaaaaaatgggttgctaaaattgctgaagttattaatattccattttgtgttgctggtggaattagtacattgtatcaagctaaagaaattcttaaatttggagcagataaaatttccattaattctccagctttattaaatccatcattaattcaaaaattagcagatcacttaggtacacaatgtgttgttgtaggtattgatgcgtggtataacgctcaacttggtacttatcaaataaaatgctttagcggaaattcttctcgtatgcaatctacaacatgggaattattagattgggttatacaaatacaacagtatggagcaggagaaattgtattaaatatgatgaatcaagatggtatgcaaaatggttatgatttaaaacaactatcaaagattcgaaaacattgtacaatacctttaatagcttctggaggagcaggtaccgctcaacattttttggatgttttccaatatgccgatgtagatggcgcattagcagcttctgtttttcacaaaaaaatcattaaaattaatgaactaaaaaattttttaattaaacaaggagttgaaattagattatgttaa

SEQ ID NO: 10229 - protein, 258 aa, Candidatus Blochmannia floridanus
MLAKRIIPCLDVINNQVIKGIQFQNHQIIGDIVSLAQYYSQEGADELVFYDIMASPNNQTVSKKWVAKIAEVINIPFCVAGGISTLYQAKEILKFGADKISINSPALLNPSLIQKLADHLGTQCVVVGIDAWYNAQLGTYQIKCFSGNSSRMQSTTWELLDWVIQIQQYGAGEIVLNMMNQDGMQNGYDLKQLSKIRKHCTIPLIASGGAGTAQHFLDVFQYADVDGALAASVFHKKIIKINELKNFLIKQGVEIRLC

SEQ ID NO: 10230 - DNA, 756 bp, Chlorobium tepidum
  CDS (1)..(756)
atgttagccaaacgcatcataccctgccttgacgtccgcgacggacgggtggttaaaggcatcaacttcgaaggcctcagggatgccggttcgattctcgaacaggcccgcttttataacaatgaaatggccgacgagctggtctttctcgacatctccgcgtcgctggaatcaagaaggacaaccctcgaagaggtactgaaagtttcaggcgaggtgttcattccgctcacggtcggcggcggtatcagctcggtcgagcgggcgcacgacgcgttcctgcacggcgcggacaaggtgtcggtcaacaccgccgccgtcagcgagccggagttgatctcgcgcatcgccgaaaagttcggctcgcaggcggtggtggtggcgattgatgtgaaaaaggtcgatgggcggtacatcgttcatactcattcgggcaaaaagccgacggagtacgaagcggttgaatgggcacacaaggtgcaggaactcggcgcgggcgagattctcctgaccagcatggatcgcgacggcacgcaggagggctacgacaacgaaattctcaaaatgatctcgaccaccgtacacattccggtgatcgcctccggcggcgcaggcaacctcgaacatctctaccggggatttacggatggccacgccgacgctgcgctcgcggcctcgatcttccacttccgcacctactcgatccggcaggccaaggagtacctgcgcgaacggggaatcacggtcaggctctga

SEQ ID NO: 10231 - protein, 251 aa, Chlorobium tepidum
MLAKRIIPCLDVRDGRVVKGINFEGLRDAGSILEQARFYNNEMADELVFLDISASLESRRTTLEEVLKVSGEVFIPLTVGGGISSVERAHDAFLHGADKVSVNTAAVSEPELISRIAEKFGSQAVVVAIDVKKVDGRYIVHTHSGKKPTEYEAVEWAHKVQELGAGEILLTSMDRDGTQEGYDNEILKMISTTVHIPVIASGGAGNLEHLYRGFTDGHADAALAASIFHFRTYSIRQAKEYLRERGITVRL

SEQ ID NO: 10232 - DNA, 765 bp, Chromobacterium violaceum
  CDS (1)..(765)
atgcttgccaaacgcatcatcccttgcctggacgtgaccgccggccgcgtggtcaagggcgtcaactttctcggcctgcgcgacgccggcgatccggtcgagatcgcccgccgctacaacgagcagggcgccgacgagctgaccttcctcgacatcaccgccagttccgaccagcgcgacatcatcctgcacgtgatcgaggcggtggccgaccaggtgttcatcccgctgacggtcggcggcggcgtgcgcagcatcgccgacatccgccgcctgctgaacgccggcgccgacaaggtcagcatcaacaccgccgcggtgacccaccccgaattcgtccaacaggcgtccgagcacttcggcaaccagtgcatcgtcgtcgcgctggacgccaaggcggtgacgcccgagaacgaccgctgggagatcttcactcacggcggccgcaaccgcaccgggctggacgccgtcgaatgggcgcgcaagatgcagcaactgggcgccggcgaaatcctgctgaccagcatggaccgcgacggcaccaaggcaggcttcaacctgccgctgacccgcgcggtgtccgacgcggtgaacattccggtgatcgcctccggcggcgtcggcaaccttcagcacctggtcgacggcgtgaaggagggccacgccgacgcggtgctggccgccagcatcttccatttcggcgaatacacggtggatcaggccaagcaagcgatgcgcgccgccggcatcgaggtcaggctgtga

SEQ ID NO: 10233 - protein, 254 aa, Chromobacterium violaceum
MLAKRIIPCLDVTAGRVVKGVNFLGLRDAGDPVEIARRYNEQGADELTFLDITASSDQRDIILHVIEAVADQVFIPLTVGGGVRSIADIRRLLNAGADKVSINTAAVTHPEFVQQASEHFGNQCIVVALDAKAVTPENDRWEIFTHGGRNRTGLDAVEWARKMQQLGAGEILLTSMDRDGTKAGFNLPLTRAVSDAVNIPVIASGGVGNLQHLVDGVKEGHADAVLAASIFHFGEYTVDQAKQAMRAAGIEVRL

SEQ ID NO: 10234 - DNA, 777 bp, Corynebacterium diphtheriae
  CDS (1)..(777)
atgccagtcgcagttcgagtcattccatgtttggacgtgaaaaacggtcgcgtggttaaaggagttaactttgaagggcttaaagatgccggcgatccagtcgagttggctgctcgttatgatgccgagggtgccgacgaactaacatttctcgatgtttcagcatctcaagatggcagaggaaccatgcttgaagtggtgcggcgaacagcagaccaagtgtttattccgttaactgttggcggtggtgttcgcagcgccgaggacgtagaccaactactgcgtgcaggtgctgacaaagtcagtgtgaatacttctgcgatcgctcgtcctgagttacttcaagagctttctcagcgtttcggtgctcagtgtgtcgtcttaagcgtggatgctcgccgagtcccagaaggaggcaagccgcagccgtcgggctttgaagtaaccacacacggcggaactcgttccgctggaatcgatgctgttgagtgggcgcagaaaggcgaggcgctgggcgtgggcgaaatcttgttgaactctatggatggcgatggaacaaagcgtggatttgatctggaactgattgaaaaagtccgccatgcggtatctatccccgtgattgcttcaggtggtgcaggtaaacctgaggacttccccccagcaatagctagtggtgctgatgcagttcttgcagcttcaattttccatttcggtgaagtcacaatttctgaagtgaaaaagcaggtagtggctgctggctacgaagttcgaagctag

SEQ ID NO: 10235 - protein, 258 aa, Corynebacterium diphtheriae
MPVAVRVIPCLDVKNGRVVKGVNFEGLKDAGDPVELAARYDAEGADELTFLDVSASQDGRGTMLEVVRRTADQVFIPLTVGGGVRSAEDVDQLLRAGADKVSVNTSAIARPELLQELSQRFGAQCVVLSVDARRVPEGGKPQPSGFEVTTHGGTRSAGIDAVEWAQKGEALGVGEILLNSMDGDGTKRGFDLELIEKVRHAVSIPVIASGGAGKPEDFPPAIASGADAVLAASIFHFGEVTISEVKKQVVAAGYEVRS

SEQ ID NO: 10236 - DNA, 777 bp, Corynebacterium efficiens
  CDS (1)..(777)
atgggtgtggcaatcagggtgatcccctgcctggacgtggacaacggccgggtggtcaagggcgtcaactttgagaacctccgcgatgccggtgatccggtggaactggccaagcggtacggcgaggagggcgcggatgaactgaccttcctggatgtctccgcctcgaaggatgggcgtggaaccatgctcgatgtagtgcgtcgcaccgccgagcagatcttcatcccactcaccgtcggtggtggtgtgcgcagcgtggaggatgtggaccagctgctgcgcgccggtgcggacaaggtcagtgtgaacacctccgcgatcgcccgcccggagctgctgtcggagctgtcccagcgtttcggtgcacagtgcatcgtcctgtccgtcgacgcccgtcgtgtacccgccggggaggcaccgcagccctccggcttcgaggtcaccacccacggtggcacccgctccgcgggcctggatgccgtggaatgggcgatcacgggggagaagctcggcgtcggcgagatcctcctgaactccatggatggtgacggcaccaagaacggattcgacctggagctgctggagaaggtccgcgccgcggtgtcgatcccggtgatcgcctccggtggtgccggcaccgccgagcatttcccacccgcggtccgcgccggtgccaatgccgtcctggccgccaccatcttccacttcggtgaggtcaccatcaccgaggtcaaggacgccatcgagaaggccggtttcgaggtccgccggtga

SEQ ID NO: 10237 - protein, 258 aa, Corynebacterium efficiens
MGVAIRVIPCLDVDNGRVVKGVNFENLRDAGDPVELAKRYGEEGADELTFLDVSASKDGRGTMLDVVRRTAEQIFIPLTVGGGVRSVEDVDQLLRAGADKVSVNTSAIARPELLSELSQRFGAQCIVLSVDARRVPAGEAPQPSGFEVTTHGGTRSAGLDAVEWAITGEKLGVGEILLNSMDGDGTKNGFDLELLEKVRAAVSIPVIASGGAGTAEHFPPAVRAGANAVLAATIFHFGEVTITEVKDAIEKAGFEVRR

SEQ ID NO: 10238 - DNA, 777 bp, Corynebacterium glutamicum
  CDS (1)..(777)
atgggcgtggcaattcgagttattccttgcctggacgtggacaacggccgggttgttaaaggcgtgaactttgaaaacctccgcgatgctggcgatcctgtggagttggcaaagcgctatgacgaggaaggggcagatgagctgaccttcctggatgtcaccgcctcgaagcatggtcgcggcaccatgctggatgttgttcgacgcaccgctgatcaggtgttcatccctctgactgtcggtggcggcgtgcgcagcgaagaagatgttgatcaattgctgcgcgctggcgccgacaaggtttcggtgaacacgtctgcgattgcccgtccagaactgctgtcagagctgtccaagcgttttggtgctcagtgcatcgtgttgtctgtggatgccaggcgcgttcctgaaggtggaactcctcagccatctggttttgaagtcaccacccacggcggttccaagtccgcagaacttgatgcaatcgagtgggcaaagcgcggcgaagagctgggcgttggcgaaattctgctcaactccatggacggcgacggcaccaaaaacggctttgacctagagctgctggaaaaagttcgcgcagccgtatccattcctgtaatcgcctccggcggcgctggcaaggcggagcatttcccaccagctgttgcagctggcgccaacgcagtgcttgccgcgaccattttccacttccgcgaagtaaccatcgccgaagtaaagggagccattaaagatgcaggatttgaggtgcggaaatga

SEQ ID NO: 10239 - protein, 258 aa, Corynebacterium glutamicum
MGVAIRVIPCLDVDNGRVVKGVNFENLRDAGDPVELAKRYDEEGADELTFLDVTASKHGRGTMLDVVRRTADQVFIPLTVGGGVRSEEDVDQLLRAGADKVSVNTSAIARPELLSELSKRFGAQCIVLSVDARRVPEGGTPQPSGFEVTTHGGSKSAELDAIEWAKRGEELGVGEILLNSMDGDGTKNGFDLELLEKVRAAVSIPVIASGGAGKAEHFPPAVAAGANAVLAATIFHFREVTIAEVKGAIKDAGFEVRK

SEQ ID NO: 10240 - DNA, 780 bp, Desulfovibrio vulgaris
  CDS (1)..(780)
atgctcagtaagcgaatcatcccctgcctcgacgtgcgcgcgggcagactcaccaagggcgtgaagttcgagggcaacgtggacatcggcgacccggtggccactgcgcggcgctactatgaagagggcgcggacgaaatcgtcttctacgacatcaccgcctcgcacgaggacaggggcatcttcctcgatgtggtcgagcgcgtggcctcggagatattcatccccttctcggtgggtggtggcatcaacacggtggacgatatgcgggccgtgctcatggcaggtgccgagaaggtctctgtcaattcgggcgcggtgaagacccccgacatcatcagtcagggggctgcggccttcgggtcgcaagccatcgtggtgggcatggacgtgaagcaggtcgagaagtccgcaaccatcccatccggttatgagatcgtcatccacggcgggcgcaagtacatgggcatggacgccatcgagtgggcgaagacgtgcgagtcgctgggcgcaggtgaactgtgcgtgaactccatcgacgccgacggcaccaaggacggctacgaactgaccctcacccgcatgataagtgatgccgtgaccattcccgttatcgcctcgggcggcgcgggtagcccggaacacatgtacgatgcgctgaccagaggcggggcttcggctgcgctcatcgcctccatcgtgcattacggcacctacaccatccccgacctcaagcgccgtatctccggcatgggcgcgaagatgcgcatggtgtggtag

SEQ ID NO: 10241 - protein, 259 aa, Desulfovibrio vulgaris
MLSKRIIPCLDVRAGRLTKGVKFEGNVDIGDPVATARRYYEEGADEIVFYDITASHEDRGIFLDVVERVASEIFIPFSVGGGINTVDDMRAVLMAGAEKVSVNSGAVKTPDIISQGAAAFGSQAIVVGMDVKQVEKSATIPSGYEIVIHGGRKYMGMDAIEWAKTCESLGAGELCVNSIDADGTKDGYELTLTRMISDAVTIPVIASGGAGSPEHMYDALTRGGASAALIASIVHYGTYTIPDLKRRISGMGAKMRMVW

SEQ ID NO: 10242 - DNA, 762 bp, Geobacter sulfurreducens
  CDS (1)..(762)
atgctgaccaagcggatcatcccgtgtctggacgtgaagggcggccgggtcgtcaaaggggtccagttcctggagctgcgtgatgccggcgatccggttgagatcgccgagctctatgaccgccagggggccgacgagctcacgttcctcgacatcaccgcctcttccgacgagcggagcatcatcattgacgtggtgcgccgcaccgccgagcgggttttcatgcccctcaccgtgggtggcggggtgcggaccgtggacgatatccgcaatctcctcaacgccggggccgacaaggtgtccatcaacacggcggcggtccaccggcccgaattcgtacgggaagcggcggagcgcttcggttcccagtgcaccgtggtggctatcgacgcccggcaggttcccggcgagaaccgctgggaggtttacactcacggcggccgcaaccccaccggcatcgacgcggtggagtgggcccgtaggatggaggagtacggcgccggcgagatcctcctcaccagcatggaccgggatggcaccaaggacggctatgacatccccctgacccgcgccattgtcgacgcggtctccattccggtcatcgcctccggcggggtgggaaaccttgagcatctgtacgacggcttcgtcaaggcaggggcaagcgcctgtcttgctgcgtccatctttcactataaggagtacaccatcggcgaggccaaggagtatctccgtcaacggggggttccggtccggttatga

SEQ ID NO: 10243 - protein, 253 aa, Geobacter sulfurreducens
MLTKRIIPCLDVKGGRVVKGVQFLELRDAGDPVEIAELYDRQGADELTFLDITASSDERSIIIDVVRRTAERVFMPLTVGGGVRTVDDIRNLLNAGADKVSINTAAVHRPEFVREAAERFGSQCTVVAIDARQVPGENRWEVYTHGGRNPTGIDAVEWARRMEEYGAGEILLTSMDRDGTKDGYDIPLTRAIVDAVSIPVIASGGVGNLEHLYDGFVKAGASACLAASIFHYKEYTIGEAKEYLRQRGVPVRL

SEQ ID NO: 10244 - DNA, 756 bp, Helicobacter hepaticus
  CDS (1)..(756)
atgagccttgccaaaaggattatcccgtgccttgatattaatggtgggcgcgtagtaaaaggagtgaattttattggattacaagatgcgggcgacccagtagaaattgctcggcgctataatgatgaaggtgctgatgaaatagtgcttcttgatattactgcaagctatgagcagcgcggcataatgatagaggttgtaaaaaatattgcaaaagaggtttttattccttttagcgtaggaggagggataagatcactagaggatatgtctgcattattaaatgcaggttgtgataaaattagcattaatagtgcggcaattagaaatccacagcttattgatgaaagtgcaaagcgatttggttcacaatgtatagtggtagcggttgatgtgaaaaaggtatcccaaaattcttggaatgtttatattaatggtgggcgcgtagatagcggtaaggatatgttagagtggataaatgaagcgtgtgcaagaggtgcaggagagattctccttacaagtatagatactgatggcaccaaaggtggttatgacaaggcaatgatagaagcagttaaatctataaatgtgccaattattgcaagtggaggagctgggagtatggaagattttgctgatgtatttgttcacggagctgatgcagctttagctgcgagtgtgtttcattataaagaaattgaaataaaaatgctaaagacttatttgcaagataaaggcgtgcctgtaagaatttaa

SEQ ID NO: 10245 - protein, 251 aa, Helicobacter hepaticus
MSLAKRIIPCLDINGGRVVKGVNFIGLQDAGDPVEIARRYNDEGADEIVLLDITASYEQRGIMIEVVKNIAKEVFIPFSVGGGIRSLEDMSALLNAGCDKISINSAAIRNPQLIDESAKRFGSQCIVVAVDVKKVSQNSWNVYINGGRVDSGKDMLEWINEACARGAGEILLTSIDTDGTKGGYDKAMIEAVKSINVPIIASGGAGSMEDFADVFVHGADAALAASVFHYKEIEIKMLKTYLQDKGVPVRI

SEQ ID NO: 10246 - DNA, 786 bp, Heliobacillus mobilis
  CDS (1)..(786)
atgctagcgaaacgcatcatcccctgccttgacgtccatgggggacgcgtcgtgaaaggaacgaactttgtcaatttacgggacgccggcgaccccgtagaactggctgctgtatatgacaaagaaggcgctgatgaactggttttcttggatattaccgcttcttctgacggacgagccatcatgcttgacgtggtccggcggacggcggaagaggtcttcatcccctttaccgtcggcggcggtctgcgaacagtcgaagacattcgggagatgctgaaggcaggcgctgacaaaatctctctgaacacatcagcggtgcaaacgccgcaactgatcggagacagtgcctggaaattcggttcccaatgcatcgtcgtagctatcgatgcacgacgtcggcgggacgaagaaggacgcttgttggagggatgggaagtctacacccatggcggccggaaaccgaccggtatcgacgtgctggaatgggctcgtaaggtggaagaactaggttgcggtgaaatcctgttgaccagcatggacaaggatggaaccaaagatggttacgacatccccttgactcgggccgtaagcgaagctgtaaagataccggtcatcgcatcgggcggtgtggggaacttggagcacatctgcgaaggtttgacggctggcaaagccgatgccgccttggccgcctccatcttccattataaggagtacaccattcgcgaaaccaaagagtaccttcggggaaaaggagtgcacgtgcgaaaatggcgcgactag

SEQ ID NO: 10247 - protein, 261 aa, Heliobacillus mobilis
MLAKRIIPCLDVHGGRVVKGTNFVNLRDAGDPVELAAVYDKEGADELVFLDITASSDGRAIMLDVVRRTAEEVFIPFTVGGGLRTVEDIREMLKAGADKISLNTSAVQTPQLIGDSAWKFGSQCIVVAIDARRRRDEEGRLLEGWEVYTHGGRKPTGIDVLEWARKVEELGCGEILLTSMDKDGTKDGYDIPLTRAVSEAVKIPVIASGGVGNLEHICEGLTAGKADAALAASIFHYKEYTIRETKEYLRGKGVHVRKWRD

SEQ ID NO: 10248 - DNA, 759 bp, Lactobacillus plantarum
  CDS (1)..(759)
atgttagcaaagcggattattccgtgcttggatgtggcggatggtcgggtcaagaagggcgttaatttcgtcaacttgacggatgtcggagatccggtggcgattgcagctgcctatcagcaacagggcgcggatgaacttgtctttttagatattgcagccaccaatgagcaccgcgagacgatggccgccatggtcgaacaagtctcagctcaggtcttcatgccactgacgattggtggcggaattacaagcgttgctgatatgcaacgaatcttacgtgcgggtgctgataagacggctattaattcggctgcagttgccaaccctgaactgattcgtgccggtgctgaaaaatttggtaaccagtgcattgttgttgcgattgacgcggcgtgggatgcggcagctggtcaatatcgtgtctatacacatgggggtcagcaagcgaccgacctcgatgcagtggcgtgggccaagcaagcggtcgccttaggggctggcgagttattggtcactagcatggatcgcgatggcactaaggcggggtttgataccaagttatatcaggccctgggagcaacggtcaatgtgccaatcattgccagcggcggtgcgggtaacttacaagactttgtggatgtttttagcacaaccccggttgatggtgcattggcggcttccgtctttcactttggcgagttaacgattgcagatgtcaaagcgacattaagaaaacaaggagtggtcgtaagatga

SEQ ID NO: 10249 - protein, 252 aa, Lactobacillus plantarum
MLAKRIIPCLDVADGRVKKGVNFVNLTDVGDPVAIAAAYQQQGADELVFLDIAATNEHRETMAAMVEQVSAQVFMPLTIGGGITSVADMQRILRAGADKTAINSAAVANPELIRAGAEKFGNQCIVVAIDAAWDAAAGQYRVYTHGGQQATDLDAVAWAKQAVALGAGELLVTSMDRDGTKAGFDTKLYQALGATVNVPIIASGGAGNLQDFVDVFSTTPVDGALAASVFHFGELTIADVKATLRKQGVVVR

SEQ ID NO: 10250 - DNA, 639 bp, Legionella pneumophila
  CDS (1)..(639)
atgagtaatgtccgtctaattgcacgactagatattaaaggacctaacctaatcaaaggagtgcatctggagggattaagagtagtaggaaatcccaatgaatatgctatggcatattatgcacaaggtgcagatgaattgatttatatggatacagttgcatctttgtatgggcgtaataatttgtcagaaattgtaaagactactgctgaaaatgtatttatcccaattactgtaggtggcggaattcgcagtgttgatgatgccgagcaattattgcgttgcggtgccgataaggtagctattaatacagcggcaactaaaaaccctactctaatatctgatattgccagaagatttgggtctcaatgtgttgttttatctatcgaagcaaaacgcactgtgaatggaagatgggaggtcatgacagacaatggacgtgaacataccggaatggatgttgttgattgggctaggaatggcgaaaaatttggtgcaggtgaaattcttctgacctctattgatcaggaaggtacgcgtaagggatttgatctggaattagtgaaacaggtgtcttccatggtttctatcccggtgattgcaagtgggggtatgggtaagctggaagaatttaactga

SEQ ID NO: 10251 - protein, 212 aa, Legionella pneumophila
MSNVRLIARLDIKGPNLIKGVHLEGLRVVGNPNEYAMAYYAQGADELIYMDTVASLYGRNNLSEIVKTTAENVFIPITVGGGIRSVDDAEQLLRCGADKVAINTAATKNPTLISDIARRFGSQCVVLSIEAKRTVNGRWEVMTDNGREHTGMDVVDWARNGEKFGAGEILLTSIDQEGTRKGFDLELVKQVSSMVSIPVIASGGMGKLEEFN

SEQ ID NO: 10252 - DNA, 765 bp, Leptospira borgpetersenii
  CDS (1)..(765)
atgttaagacccagaatcatacctgtgttgttgttacaagaaaacggattggtcaaaacgatccaattcggcgacgaaagatatatcggtgacccattgaatgccgtaaggatttttaatgaaaaagaagcggatgaacttgcggttttagatatttccgccagcaaaaaaggaaaggaaccgaattatcgtctaatcgaacgtttggcgaatgaatgcagaatgcctttgtgttacggcggtgggattaaggatttggatcaggcgaatcgaattttgagttttggtgtggaaaaaataattgtaagttcactcgcaatcgaaaatccgaaaatgatttccactatggcctcctacttgggaagtcagagtgtggtcgtagcaattgattttaaaaaagcgatgttatcgagaagatatgaagtgatgattcataacgggactaaaaaaactggaaaacatctcgaggatttagtgaaagaagttatcgaattgggcgcgggtgaaatcatactcaattccattgatcgcgacggaactatggtcggttatgagatcgagatcatcaaaaagattcaaagcatctgtaagattcccattacggttttaggtggagcggggtcgctggatcacatcaaaaatctaattcaggaacttggaattatcggcgtagctgcgggaagtctttttgtttataaaggagtacataaggcggttttaatcaattatccgaacggcacggataaagaagcactatttccctga

SEQ ID NO: 10253 - protein, 254 aa, Leptospira borgpetersenii
MLRPRIIPVLLLQENGLVKTIQFGDERYIGDPLNAVRIFNEKEADELAVLDISASKKGKEPNYRLIERLANECRMPLCYGGGIKDLDQANRILSFGVEKIIVSSLAIENPKMISTMASYLGSQSVVVAIDFKKAMLSRRYEVMIHNGTKKTGKHLEDLVKEVIELGAGEIILNSIDRDGTMVGYEIEIIKKIQSICKIPITVLGGAGSLDHIKNLIQELGIIGVAAGSLFVYKGVHKAVLINYPNGTDKEALFP

SEQ ID NO: 10254 - DNA, 822 bp, Methanosarcina acetivorans
  CDS (1)..(822)
atgctcaccaaaagaataataccatgccttgatgtgacccttgacagggcaggcggctgtgtagtcaagggtgtggagtttgtggacctgaaagaggccggagaccctgtggagctcgccaagcgttataatgaagacggcgcagatgaacttgttttcctggatatcacagcttcagcccacggaagggaaacaatgatcgatgtaatcgaaaggactgcagatgaggttttcattcccctcacagtgggaggcgggatcagttcgatcgacgcaatccgccagatcctcagggcaggcgcggataaggtttcggtcaatacctcggcagtaaagaatcctgattttatcaaagagtcttcggatatattcggggcccagtgtatcgttactgcgattgactgcaggcgaaataccgatataaagaataatcccgacaaaaccgtcctggaacttgaagacgggaccccggcctggtacgaagtggtaatttacggaggcagggaagcgacagggattgatgccgtgcagtgggcaaaaaaagctgaagaactggggtccggcgaaatcctccttacaagcatggatcgggacgggacctgtgctggctacgacctaccgattacaagaaagctctccgaagagctcgacattcccatcatcgcctccggaggagtagggaacccgcagcacatctacgaaggattttccgaaggaaaagccgatgcagcccttgcagcaagcattttccacttcagtgaatattcgatatgggaagttaaagaatacctgagagagcgggaaatccctgtaaggctctga

SEQ ID NO: 10255 - protein, 273 aa, Methanosarcina acetivorans
MLTKRIIPCLDVTLDRAGGCVVKGVEFVDLKEAGDPVELAKRYNEDGADELVFLDITASAHGRETMIDVIERTADEVFIPLTVGGGISSIDAIRQILRAGADKVSVNTSAVKNPDFIKESSDIFGAQCIVTAIDCRRNTDIKNNPDKTVLELEDGTPAWYEVVIYGGREATGIDAVQWAKKAEELGSGEILLTSMDRDGTCAGYDLPITRKLSEELDIPIIASGGVGNPQHIYEGFSEGKADAALAASIFHFSEYSIWEVKEYLREREIPVRL

SEQ ID NO: 10256 - DNA, 819 bp, Methanopyrus kandleri
  CDS (1)..(819)
atggccttagccaaacgcatcataccctgcctcgacgtcaaggacggacgtgtcgtgaaaggcgtacggttccgcggactgcgcgacgctggcgatcccgctgagttggcccatcactactaccgtcacggtgccgacgagatcgtgttcctggatatctcggcctctcctgaaggtcgccggttaatggtggacgtggtgcgtcgcaccgcggagaaggtgttcattcccatgaccgtaggtggcgggatatccgacgtcgaggacttccgaagggcgctgaccgccggagccgataaagtttccgtgaacaccgcggcggtggagaacccggagttaatctccgaggccgccgatattttcgggtcgcagtgcgtggtagtggcgatcgacgcaaagcgggagcctctgaagccggagcatgaacacgtggcggatcatatcttctcgaacgacgatggagaatactggttccgggtctacgtccgtggaggtcgtgagcccgtagatctcgacgccataacctgggctaagagggtggaggagctgggcgcgggcgagatactcttgacgagcatcgacgccgacggtactcaagaaggttacgacatcgaactgacccgagaggtgtgtaacgcagtgagcattcccgtgatagcctccgggggttgcggtcacccgaagcatatggtggaggttttcaaggaggccgacgccgacgcagctctcgcggcttcgatcttccactatgggaaattcacgatcgaagaggtgaaggagcacctggccgaaaggggtgttcgggtcagacagtgctga

SEQ ID NO: 10257 - protein, 272 aa, Methanopyrus kandleri
MALAKRIIPCLDVKDGRVVKGVRFRGLRDAGDPAELAHHYYRHGADEIVFLDISASPEGRRLMVDVVRRTAEKVFIPMTVGGGISDVEDFRRALTAGADKVSVNTAAVENPELISEAADIFGSQCVVVAIDAKREPLKPEHEHVADHIFSNDDGEYWFRVYVRGGREPVDLDAITWAKRVEELGAGEILLTSIDADGTQEGYDIELTREVCNAVSIPVIASGGCGHPKHMVEVFKEADADAALAASIFHYGKFTIEEVKEHLAERGVRVRQC

SEQ ID NO: 10258 - DNA, 819 bp, Methanococcus maripaludis
  CDS (1)..(819)
atgcttactaaaagaatcattccctgccttgatatcaaagagggtagagttgttaaaggaacaaattttgtagagttaagagatgccggagatccggttgagctatctaaaatttacaacgaacagggtgctgacgaacttgtatttttggatattaccgcatcttttgaaaaaagagacattattattgacgttgtaaaaagaactgccgaacaagtattcattccattaactgttggtggaggcataaaaacagttgatgactttagaaaaatattgagagctggcgctgataaaatttcaataaatacatcagcagtaaaaactccagacttgataaaagaagcttctgaaatttttgggacgcagtgtgttgttgttgcaatggatgtaaaaagaaagtatataacagattctcaggatgaaaatttgaaaaataagaacatctttgaaacaaaacttggatcctgctggtttgaagtctatatctatggtggaagagaaggaactggtattgatgcaatagaatgggctaaaaaggttgaatatttaggtgctggagaaattcttttaactagtatggatgcagatggtacaaaagatgggtacgatttagtattgacgaaagcaatttctgaaaatacaaaacttccaataattgcaagcggaggttgtggaaatgcaaaccacgttgtcgatgcatttactgaaggaaaagctgatgctgcattaatggcaagcattttacactatagagaatgtactgttaatgatttgaaaaaagaagttgaaaaaaataatattcctgtaagattttaa

SEQ ID NO: 10259 - protein, 272 aa, Methanococcus maripaludis
MLTKRIIPCLDIKEGRVVKGTNFVELRDAGDPVELSKIYNEQGADELVFLDITASFEKRDIIIDVVKRTAEQVFIPLTVGGGIKTVDDFRKILRAGADKISINTSAVKTPDLIKEASEIFGTQCVVVAMDVKRKYITDSQDENLKNKNIFETKLGSCWFEVYIYGGREGTGIDAIEWAKKVEYLGAGEILLTSMDADGTKDGYDLVLTKAISENTKLPIIASGGCGNANHVVDAFTEGKADAALMASILHYRECTVNDLKKEVEKNNIPVRF

SEQ ID NO: 10260 - DNA, 825 bp, Methanobacterium thermoautotrophicum
  CDS (1)..(825)
atgcttgcaaagaggataataccatgtcttgactgtgacctccaggttccaaatggccgggtcgtgaagggagttgaattcaaacagataagatacgcaggggaccctgtagaacttgcaacaaggtactatgaggatggtgccgatgagatagtcttcctcgacataacagcatcacatgagagacgggagaccatgacccatgtgatagaggccaccacagagaacgtcttcgtacccatatgtgtcggtgggggtataaggaagccagaggactattttaagatgcttaaggcgggggcagacaagtgctccaccaatacggccgcaataaagaaccctgaactcatcaatgaggcatcagacctcgtcgggtcccaggcatgcgtagtggcaatagatgccaagaggagatacatcgaaaacccccgtgaatcagatgaaaggttcataatagaggttgatgatggatactgctggtacgagtgcagcatctatggtggaagagaattcacaggtattgacgcggtgaaatgggcaatggaatgccaggatagaggtgcaggtgaaattctcctcacatcaatggaccgtgacggtacaaagatgggctacgacattcccctcacaaggaccatgagcgagaaccttgacatacctgtgatcgcatcagggggtgtaggggaacctgaacacatctatgaggcattcacagatggtaaggcagacgctgcacttgctgcaagcatattccacttcaatgaataccctgtccctgcagtgaaggagtacctcagatcaaggggagttcccataagattgtag

SEQ ID NO: 10261 - protein, 274 aa, Methanobacterium thermoautotrophicum
MLAKRIIPCLDCDLQVPNGRVVKGVEFKQIRYAGDPVELATRYYEDGADEIVFLDITASHERRETMTHVIEATTENVFVPICVGGGIRKPEDYFKMLKAGADKCSTNTAAIKNPELINEASDLVGSQACVVAIDAKRRYIENPRESDERFIIEVDDGYCWYECSIYGGREFTGIDAVKWAMECQDRGAGEILLTSMDRDGTKMGYDIPLTRTMSENLDIPVIASGGVGEPEHIYEAFTDGKADAALAASIFHFNEYPVPAVKEYLRSRGVPIRL

SEQ ID NO: 10262 - DNA, 804 bp, Mycobacterium bovis
  CDS (1)..(804)
atgtatgccgaccgtgaccttccgggggctgggggcctcgcggtacgcgtgatcccgtgtctggatgtcgacgatgggcgggtggtcaagggagtcaacttcgagaacctccgcgacgccggtgatcccgtggaactcgccgccgtctatgacgcggagggcgcggacgagttgacctttctcgacgtgaccgcgtcgtcgtccggaagagccaccatgctggaggtggtgcgccgcaccgccgagcaggtgttcatcccgctgacggtgggcggtggggtacgcaccgtcgccgacgtcgattcgctgctacgggctggggctgacaaagtcgccgtcaacacggccgccatcgcttgcctggacttgctggcggacatggcgaggcagttcggctcgcagtgcatcgtgttgtccgtcgacgcgcgcacagttccggtgggatcagccccgacaccgtcgggttgggaggtcaccactcacggcggtcgtcgtggcaccggtatggacgccgtgcagtgggcggcccgtggcgccgacctcggtgtgggggagatcctgctcaactcgatggacgccgacggcaccaaagccggattcgacctggctttgctgcgtgcggtccgtgccgcggtcacggtgccggtaatcgccagcgggggcgccggtgctgtggagcacttcgcgccagcggttgccgcgggggccgatgcagtgttggcggccagcgtctttcacttccgggagctgacgatcggtcaggtgaaggcggccctggccgcggaaggaatcaccgtgcgatga

SEQ ID NO: 10263 - protein, 267 aa, Mycobacterium bovis
MYADRDLPGAGGLAVRVIPCLDVDDGRVVKGVNFENLRDAGDPVELAAVYDAEGADELTFLDVTASSSGRATMLEVVRRTAEQVFIPLTVGGGVRTVADVDSLLRAGADKVAVNTAAIACLDLLADMARQFGSQCIVLSVDARTVPVGSAPTPSGWEVTTHGGRRGTGMDAVQWAARGADLGVGEILLNSMDADGTKAGFDLALLRAVRAAVTVPVIASGGAGAVEHFAPAVAAGADAVLAASVFHFRELTIGQVKAALAAEGITVR

SEQ ID NO: 10264 - DNA, 798 bp, Mycobacterium paratuberculosis
  CDS (1)..(798)
atgagcccgaactccaccggcctggcggtacgcgtgatcccctgcctggacgtcgacgacgggcgggtggtcaagggcgtcaacttcgaaaaccttagggacgcaggcgatcccgtcgaacttgcggccgtctacgacgccgagggcgctgacgagctcaccttcctcgacgtgaccgcgtcgtcgtcgggccgcgccaccatgctggacgtggtgcgccgcaccgccgaacaggtcttcattccgctcaccgtcggcggcggggtgcgcacggtggccgacgtcgacgtgctgctgcgggccggagccgacaaggtctccgtcaacaccgccgcgatcgcgcgccccgagctgctcgaggagatggcgcggcagttcggctcccagtgcatcgtgttgtccgtggacgcccgcacggtgccgccgggcgcggtgcccaccccgtcgggctgggaggtcaccacccacggcgggcggcgtggcaccggcatcgatgccgtcgaatgggcttcccgcggagccgatttgggcgtgggggagatcctgctgaactcgatggacgccgacggcaccaaggccgggttcgacctggagatgctgcaggcggtgcggtccgcggtcaccgtgccggtgatcgccagcggcggcgccggggcggccgaacacttcgcgcccgcgatcgaggccggggccgacgcggtgttggcggccagcgttttccacttccgggagctgaccatcggacaggtcaaggccgccatggccgaggcgggcataccggtgaggatggtgcgatga

SEQ ID NO: 10265 - protein, 265 aa, Mycobacterium paratuberculosis
MSPNSTGLAVRVIPCLDVDDGRVVKGVNFENLRDAGDPVELAAVYDAEGADELTFLDVTASSSGRATMLDVVRRTAEQVFIPLTVGGGVRTVADVDVLLRAGADKVSVNTAAIARPELLEEMARQFGSQCIVLSVDARTVPPGAVPTPSGWEVTTHGGRRGTGIDAVEWASRGADLGVGEILLNSMDADGTKAGFDLEMLQAVRSAVTVPVIASGGAGAAEHFAPAIEAGADAVLAASVFHFRELTIGQVKAAMAEAGIPVRMVR

SEQ ID NO: 10266 - DNA, 777 bp, Nitrosomonas europaea
  CDS (1)..(777)
atgggattagccaaacgtatcatcccctgtcttgatatcaaagatgggcgcgtcgtcaaaggagtcaattttgtctcgttgcgggatgcgggagacccggtcgaaattgcccgcagctataatgaacagggcgctgacgagctcgttttcctcgatattaccgccagctcggaaaatcgcgacttaattctgcatatcgtcgaaaaagtcgccgcacaggtgttcatcccactgacagtaggcggaggcgtccgtaaggccgaagatgtacgcaggcttttgaacgcaggtgcagacaaagtcagcatcaacacctcagcggtattgaatccgatgctgatcaaggaatcagcagatcactacggctcccagtgtatcgtgatcgcaatcgatgccagacaaatacctgatgcaaatcctgaatctccacgctgggaagtatttacccatggcggacgcaaacccactggaatcgatgcaattgaatgggctcaaaaaatacaagccctgggcgccggagaaattctgctaaccagcatggatcgtgatggtacgcgttccggattcgatctcacactgacacgtgcaatctccgattcagtcgatttaccggtcattgcaagtggtggtgtcggtcatctggatcatctggtggaaggtattctggcaggccatgccgatgccgtactggcagcaagcattttccattatggcgagtacagtatcctacaagccaaacaatatctgtcatcgcacgggatagaagttcgcctgtaa

SEQ ID NO: 10267 - protein, 258 aa, Nitrosomonas europaea
MGLAKRIIPCLDIKDGRVVKGVNFVSLRDAGDPVEIARSYNEQGADELVFLDITASSENRDLILHIVEKVAAQVFIPLTVGGGVRKAEDVRRLLNAGADKVSINTSAVLNPMLIKESADHYGSQCIVIAIDARQIPDANPESPRWEVFTHGGRKPTGIDAIEWAQKIQALGAGEILLTSMDRDGTRSGFDLTLTRAISDSVDLPVIASGGVGHLDHLVEGILAGHADAVLAASIFHYGEYSILQAKQYLSSHGIEVRL

SEQ ID NO: 10268 - DNA, 765 bp, Oceanobacillus iheyensis
  CDS (1)..(765)
atgctcgctaaacgaattattccttgcctcgatgttgataacgggcgagtagttaagggaaagaaattcttagatatccaagatgttgctgatccggttgaattagcaaaacgctataatgatgaaggtgctgatgaacttgtcttctatgatattacggcttccaatgagcagcggggaatatttttagatgttgttgaaaaggtagcaaaagaaatcgctatcccttttatggtaggtggaggaatccgtacaactaaagatatccatcaagttcttcggtctggagctgataaagtatcaataaacagtgcggctgttcaacgtcctgagcttattttcgaatcagcacaaaaattcggaagccagtgtacggtcctatctattgatgcaaaagagatcgcagttggaaagtggaatgtttttatcaatggagggagaaaggatactggaattgatgctattgaatgggcgaaaaaaggtgaatcttatggtgctggtgaaatcgtggtaaatgctatggatgcagatggagaaaaaaatggctataatctccccttaacaacagctatagcaacagcagttaatataccagtaatcgctagtggcggagctggaaatatccaacatttcaaagatgtactttcacatgaaatagatgccgccctagcagcttctgtttttcactatgatgaaattaagatacctgcacttaaaacctatttgaacgaacaggaaatttcagtaaggaggaattcgaaatga

SEQ ID NO: 10269 - protein, 254 aa, Oceanobacillus iheyensis
MLAKRIIPCLDVDNGRVVKGKKFLDIQDVADPVELAKRYNDEGADELVFYDITASNEQRGIFLDVVEKVAKEIAIPFMVGGGIRTTKDIHQVLRSGADKVSINSAAVQRPELIFESAQKFGSQCTVLSIDAKEIAVGKWNVFINGGRKDTGIDAIEWAKKGESYGAGEIVVNAMDADGEKNGYNLPLTTAIATAVNIPVIASGGAGNIQHFKDVLSHEIDAALAASVFHYDEIKIPALKTYLNEQEISVRRNSK

SEQ ID NO: 10270 - DNA, 771 bp, Pasteurella multocida
  CDS (1)..(771)
atgttggcaaaacgcataattccttgcttagacgtacgtgatgggcaggtggtcaaaggtgtacaatttcgcaatcacgagattattggcgatattgtgccgctggcgcaacgctatgcggaagaaggcgcagatgaattagtgttctatgatattaccgcctcctctgacggcagaactattgataaaagctgggtggaacgtgtggcacaagtgattgatattccattctgtgtcgccggtgggattaaaagcgtggaagatgccgaaaaactattcgcctttggcgcagataaaatttccataaattcacccgcacttgctgatcccgatttaattaatcgcttagcggatcgttttggtgtgcaagccattgtggtggggatcgatagctggtttgaaaaagaaaccggcaaatattgggttaatcaatatactggcgatgaaagtcgcacacgccaaacccattggcaattactcgactgggtcaaggaagtacaacaacgtggcgcgggcgaaattgtgttaaatatgatgaaccaagacggtgttcgtcaaggttatgacatcgcccaattaaaactcgtgcgtaacctctgtcatattcccctgattgcctcaggcggtgcaggtgaaatggtgcatttccgtgatgcctttattgaagccaatgtggatggtgcgctcgctgccagcgtgttccataaacggattattgatattggggaattaaaggattatttgagaaaggaaaagattaagattagatag

SEQ ID NO: 10271 - protein, 256 aa, Pasteurella multocida
MLAKRIIPCLDVRDGQVVKGVQFRNHEIIGDIVPLAQRYAEEGADELVFYDITASSDGRTIDKSWVERVAQVIDIPFCVAGGIKSVEDAEKLFAFGADKISINSPALADPDLINRLADRFGVQAIVVGIDSWFEKETGKYWVNQYTGDESRTRQTHWQLLDWVKEVQQRGAGEIVLNMMNQDGVRQGYDIAQLKLVRNLCHIPLIASGGAGEMVHFRDAFIEANVDGALAASVFHKRIIDIGELKDYLRKEKIKIR

SEQ ID NO: 10272 - DNA, 777 bp, Photorhabdus luminescens
  CDS (1)..(777)
atgctggcaaaacgcataattccttgccttgatgttcgtgacgggcaagtggttaaaggcattcagtttcgtcatcacgaaattatcggcgatattgtgccacttgcccaacgttatgcaacagaaggtgcagatgaactggttttctacgatatcactgcctcatctgatggacgggtagtcgataaaagttggatcaccaaagttgcggaggtgattgatattcccttttgtgtcgctggtggtattaaaactgtcgaagatgcagggcaaatcctttcatttggggcagataaaatctctatcaactcccctgcactgactgatccaaccttaattactcgtttggccgatcgttatggtgttcaatgcattgtcgtagggattgacacctggtttgatgaaagtacaggtcgctatcaagtttatcagtttaccggcgacgaaaaacgcacaaaggccactcaatggcaaaccctcaattgggtaaaagaagcgcaacaccgtggtgcaggtgaaatcgtactcaatatgatgaatcaggatggtgtccgcaatggctacgatctgactcaactaaaacaggtgcgtgacgtttgtcatgttcctctcattgcctctggtggtgcaggcgcaccagaacactttcttgatgcctttaaacaggcaaatgtcgatggtgcactcgctgcatctgtattccataaacacattattaatatctgtgaattaaaacagtacctttcacaacaaggcgtggagataagaacttgctaa

SEQ ID NO: 10273 - protein, 258 aa, Photorhabdus luminescens
MLAKRIIPCLDVRDGQVVKGIQFRHHEIIGDIVPLAQRYATEGADELVFYDITASSDGRVVDKSWITKVAEVIDIPFCVAGGIKTVEDAGQILSFGADKISINSPALTDPTLITRLADRYGVQCIVVGIDTWFDESTGRYQVYQFTGDEKRTKATQWQTLNWVKEAQHRGAGEIVLNMMNQDGVRNGYDLTQLKQVRDVCHVPLIASGGAGAPEHFLDAFKQANVDGALAASVFHKHIINICELKQYLSQQGVEIRTC

SEQ ID NO: 10274 - DNA, 774 bp, Photobacterium profundum
  CDS (1)..(774)
atgttagctaaacgaatcgttccttgtttagacgttcgagacggtcaagtagtcaaaggggtacagtttcgtaatcacgaaattattggtgatattgttcctttagccaaacgctatgcagaagaaggcgctgacgagctggttttttatgatattaccgcatccagtgatgggcgcgtggttgataaaagctgggttgctcgtgttgctgaagttattgatattcctttctgtgttgccggcggcattaaatctgtcgaagacgcgagccgtatattgcaatttggtgcagataaggtctcgataaactcccctgcccttgccaaccctgcgcttatcacagaacttgctgataagtttggcgtgcaatgtatcgtggtgggtattgattcatactttgatgctgaaacaggtaaatatcaggtttaccaatttactggtgatgaatcacgtactaaagcaacccaatgggaaacccgagattgggttctggaagtacaaaaacgtggcgcaggggaaatcgtattaaacatgatgaaccaagatggcgttcgtaacggttacgatctaaagcaattgaatatggtacgtgaagtttgccatgttcctttaattgcttctggtggtgcaggtgaaatggttcactttgcagatgcttatcaaaaagccaatgtggacggtgcacttgccgcttccgtattccacaaacaaatcatcaatattggtgagcttaagcagtacttaaaagaacagaatgtggagatccgactatga

SEQ ID NO: 10275 - protein, 257 aa, Photobacterium profundum
MLAKRIVPCLDVRDGQVVKGVQFRNHEIIGDIVPLAKRYAEEGADELVFYDITASSDGRVVDKSWVARVAEVIDIPFCVAGGIKSVEDASRILQFGADKVSINSPALANPALITELADKFGVQCIVVGIDSYFDAETGKYQVYQFTGDESRTKATQWETRDWVLEVQKRGAGEIVLNMMNQDGVRNGYDLKQLNMVREVCHVPLIASGGAGEMVHFADAYQKANVDGALAASVFHKQIINIGELKQYLKEQNVEIRL

SEQ ID NO: 10276 - DNA, 774 bp, Prochlorococcus marinus
  CDS (1)..(774)
atggttgctcttcgtttaattccttgtcttgatgttgcaaatggacgggttgtaaaaggtgttaatttcgttggccttagagatgctggagaccctgtagaactggcctgtaggtatagcagagagggggctgatgaattggttttcttagatatagctgcaagtcatgaagcgagagcaacgttggtagagattgtccgtcgcactgctgaatctgtaactattccatttacagttgggggtggaattagctcaatagaaggtataactgaacttttacgtgcaggtgctgacaaaattagcttgaattcatctgcagttaaggatcctggcttggtgtctagaggggcatgccagtttggatctcagtgcatagttgttgcaatagatgctaaacgtcgtttggaagaatcatctggatgggatgtatttgtaaatggggggagaaaaaatacaggcttagatgcattgtcttgggcgagaaaagttgtggaattaggcgctggggaaatacttctaacttcaatggatggagatggaactcaaaaagggtatgacttggaattaacaaaaacaatttctcagtcagtacaagtaccagttatcgcttctggaggtgcaggctgtcttgaagatgtttttgaagcctttgaatatgggaatgcatctgctgctttattggcatctttattacatgatcaagatttaacaatagaggaaatcaagaattatttattaaaaaagaatttaataataagacctactaattattga

SEQ ID NO: 10277 - protein, 257 aa, Prochlorococcus marinus
MVALRLIPCLDVANGRVVKGVNFVGLRDAGDPVELACRYSREGADELVFLDIAASHEARATLVEIVRRTAESVTIPFTVGGGISSIEGITELLRAGADKISLNSSAVKDPGLVSRGACQFGSQCIVVAIDAKRRLEESSGWDVFVNGGRKNTGLDALSWARKVVELGAGEILLTSMDGDGTQKGYDLELTKTISQSVQVPVIASGGAGCLEDVFEAFEYGNASAALLASLLHDQDLTIEEIKNYLLKKNLIIRPTNY

SEQ ID NO: 10278 - DNA, 768 bp, Prochlorococcus marinus subsp
  CDS (1)..(768)
atggtagctcttcgtttaattccttgtttagatgtagctaatggaagggtagttaaaggtgttaattttgtaaaccttagagactctggtgaccctgtcgaattagcttgtaaatactcagaagcaggagcggatgaattagtatttttagatataagagctagtgtggaaaatagaaaaacattagttgatctggtctctagaacagcgaaatcagttaaaattccatttactgttggtggtggcataaattcgatcaactcaattaatgatcttttaagagcaggagcagataaagtaagtttaaattcttctgcagtaaaaaatccagacatcatttccaaaagctctacgaattttggaacacaatgtatagttattgctattgatgcaagaaaaaaaattactaaatataatgaatgggaagtttatgttaagggtggacgagagaatactggtttagatgtaataagttgggcaaaaaaagttgaggaattaggtgctggagaaattttattaacttcaatggatggtgatgggacacaaaatggatacgacttattattgactcaaacagttgcaaatgcagttaatattcctgtgattgcttctgggggtgcaggctcagtagaagatatttatgatgtttttaccaaaggtaaagcctctgcagcacttttagcatctttacttcatgataaaaaacttactatagatgaaataaaatcttttcttattgaaaagaaactaccaataagacctaattaa

SEQ ID NO: 10279 - protein, 255 aa, Prochlorococcus marinus subsp
MVALRLIPCLDVANGRVVKGVNFVNLRDSGDPVELACKYSEAGADELVFLDIRASVENRKTLVDLVSRTAKSVKIPFTVGGGINSINSINDLLRAGADKVSLNSSAVKNPDIISKSSTNFGTQCIVIAIDARKKITKYNEWEVYVKGGRENTGLDVISWAKKVEELGAGEILLTSMDGDGTQNGYDLLLTQTVANAVNIPVIASGGAGSVEDIYDVFTKGKASAALLASLLHDKKLTIDEIKSFLIEKKLPIRPN

SEQ ID NO: 10280 - DNA, 771 bp, Pseudomonas putida
  CDS (1)..(771)
atggcactggccaagcgcattatcccttgcctggacgtggacaacggccgggtggtcaagggcgtcaagttcgagaacatccgtgatgccggcgacccggtggaaatcgcccgtcgctacgacgagcaaggtgccgacgaaatcacctttctcgacatcaccgccagcgtcgatgggcgcgacaccacgctgcataccgtcgagcgcatggccagccaggtgttcatcccgctgacggttggtggtggcgtgcggaccgtgcaggacatccgcaacctgctcaacgccggtgccgacaaggtctcgatcaacaccgccgcggtgttcaacccagagtttgtcggtgaggcggcggaccgtttcggttcgcagtgcatcgttgtcgccatcgatgccaagaaagtgtccgggccaggtgaagcgccgcgctgggagattttcactcacggcgggcgcaagccgaccgggctggatgcagtcgagtgggcgaagaagatggaaggcctgggcgctggcgagatcctgctgaccagcatggaccaggacggcatgaagaacggcttcgacctgggcgttacccgggctatcagtgatgcgctggggattccggtgattgcctcggggggggtgggtaacctgcagcacctggcagacggcattctggaagggcatgccagcgcggtgctggcggccagcatcttccactttggcgagtacacagtgccggaggccaaggcctacatggcttcgcgcgggatcgtcgttcgctga

SEQ ID NO: 10281 - protein, 256 aa, Pseudomonas putida
MALAKRIIPCLDVDNGRVVKGVKFENIRDAGDPVEIARRYDEQGADEITFLDITASVDGRDTTLHTVERMASQVFIPLTVGGGVRTVQDIRNLLNAGADKVSINTAAVFNPEFVGEAADRFGSQCIVVAIDAKKVSGPGEAPRWEIFTHGGRKPTGLDAVEWAKKMEGLGAGEILLTSMDQDGMKNGFDLGVTRAISDALGIPVIASGGVGNLQHLADGILEGHASAVLAASIFHFGEYTVPEAKAYMASRGIVVR

SEQ ID NO: 10282 - DNA, 771 bp, Pseudomonas syringae
  CDS (1)..(771)
atggccctagccaaacgcatcattccttgcctggacgtcgacaacggtcgagtggtcaagggcgtcaagttcgagaacatccgtgatgctggcgacccggtggaaatcgcgcgtcgttacgatgagcagggtgccgacgaaatcacctttctcgacatcaccgccagcgtcgatggccgtgacaccacgctgcataccgtcgagcgcatggccagccaggtgttcattccactgaccgtgggcggcggcgtgcgcaccgtgcaggacatccgcaacctgctcaacgcaggtgctgacaaggtctcgatcaacaccgccgcagtcttcaacccggaatttgtcggtgaagccgccgcccgtttcggctcgcagtgcatcgtggttgctatcgacgccaagagggtttccggccctggcgaagccccgcgctgggaaatcttcacccacggcgggcgcaagcctaccgggctggatgcggtgctctgggcgaagaagatggaagatctgggcgctggcgaaatcctgctgaccagcatggatcaggacggtatgaaaaacggcttcgacctgggcgtcacccgcgccatcagcgatgcgctgggcatcccggtcatcgcctcgggcggtgtcggaaaccttgagcatctggctgcgggcgtgatcgaaggccatgccagtgcagtgctggcggcgagtattttccacttcggcgaatacaccgttcctgaggccaaggcgtacatggccagtcgcgggattgtggtgcgttaa

SEQ ID NO: 10283 - protein, 256 aa, Pseudomonas syringae
MALAKRIIPCLDVDNGRVVKGVKFENIRDAGDPVEIARRYDEQGADEITFLDITASVDGRDTTLHTVERMASQVFIPLTVGGGVRTVQDIRNLLNAGADKVSINTAAVFNPEFVGEAAARFGSQCIVVAIDAKRVSGPGEAPRWEIFTHGGRKPTGLDAVLWAKKMEDLGAGEILLTSMDQDGMKNGFDLGVTRAISDALGIPVIASGGVGNLEHLAAGVIEGHASAVLAASIFHFGEYTVPEAKAYMASRGIVVR

SEQ ID NO: 10284 - DNA, 762 bp, Pyrobaculum aerophilum
  CDS (1)..(762)
atggacgtggccttgaggataatcccgtgtctcgacatagacggaaaagccggcgtagtggtcaagggggttaatttccaggggattagagaggtgggggatccggtggaaatggccgtgagatatgaagaggagggtgccgacgagatagcaattctagacatcaccgcggcgccggaggggcgcgccacgtttatagactctgtgaaaagagttgcggaggccgtgtccatacctgtgttagtgggaggcggcgtgaggagcctcgaggacgcaacgacgttgtttagggcaggcgccgacaaggtgtctgtgaacacagctgccgtgcgcaacccccagctagtggctctgttggcgagagagttcggcagtcaatcaaccgtggtggcaatagacgcaaagtggaacggggagtattacgaggtatacgtcaagggagggagggaggcgacgggccttgacgcagtgaagtgggcgaaggaagttgaggagctaggcgcgggggagatactcctcacgtcaattgaccgagacgggacgggcttgggatatgacgtggagcttattaggcgggtggccgactctgtgagaattcccgtaatcgcgtccgggggcgcgggtcgggtggagcatttttacgaggcagcagccgcgggcgccgacgcagttctcgccgcgtctcttttccacttccgcgttttgtcaattgcgcaagtaaagcgctatttaaaagagaggggggttgaggttaggatatga

SEQ ID NO: 10285 - protein, 253 aa, Pyrobaculum aerophilum
MDVALRIIPCLDIDGKAGVVVKGVNFQGIREVGDPVEMAVRYEEEGADEIAILDITAAPEGRATFIDSVKRVAEAVSIPVLVGGGVRSLEDATTLFRAGADKVSVNTAAVRNPQLVALLAREFGSQSTVVAIDAKWNGEYYEVYVKGGREATGLDAVKWAKEVEELGAGEILLTSIDRDGTGLGYDVELIRRVADSVRIPVIASGGAGRVEHFYEAAAAGADAVLAASLFHFRVLSIAQVKRYLKERGVEVRI

SEQ ID NO: 10286 - DNA, 756 bp, Pyrococcus furiosus
  CDS (1)..(756)
atgttggcaagaagaattatagcagctcttgacataaaagatggtagggttgttaaaggaataaaattcaagaacattagagatgctggagatccaatagaactagctaaaaggtatgagagcgaaggaattgacgagatagtctttctagatattactgcctcctacgaaaaaaggaaaatccttctcgacttggtagaaagagtagcagaggaaatctacgttccttttacggtgggaggaggtataagaacagttgaagaggcaagagaaataattagacgaggggccgacaagatatttatcaatacagccgccgtggaaaatccctccttaattaaagagatcgctgacctcataggctcagcaaacttagttgttgctatagatgccaagtggaacggaaaattctgggaagtttatacacacgggggaagaaagcccaggggaatggacgctgttgagtgggccaaaagagtagaagaactgggagcaggtgaaattctcctcacgagcatggacaccgatggaacaaagcagggatttgacattccactaacaaaagcagttgttgatgccgtaaatattcccgttatagcctctggaggggctggaaaaccagaacactttttagaagtatttaggataggttctgatgctgcattagcggcatcaattttccactatggtgaatatacggtaagggaactgaagatgtttcttgccaaaaatggaattccagttagacttgattag

SEQ ID NO: 10287 - protein, 251 aa, Pyrococcus furiosus
MLARRIIAALDIKDGRVVKGIKFKNIRDAGDPIELAKRYESEGIDEIVFLDITASYEKRKILLDLVERVAEEIYVPFTVGGGIRTVEEAREIIRRGADKIFINTAAVENPSLIKEIADLIGSANLVVAIDAKWNGKFWEVYTHGGRKPRGMDAVEWAKRVEELGAGEILLTSMDTDGTKQGFDIPLTKAVVDAVNIPVIASGGAGKPEHFLEVFRIGSDAALAASIFHYGEYTVRELKMFLAKNGIPVRLD

SEQ ID NO: 10288 - DNA, 771 bp, Ralstonia solanacearum
  CDS (1)..(771)
atgctagccaaacgaatcatcccctgcctggacgtgaccaacggccgggtggtcaagggcgtcaatttcgtcgaattgcgcgacgcgggcgaccccgtcgagatcgcgcgccgttacgacgagcagggcgccgatgaaatcacctttctcgacatcaccgcgacgtccgacgggcgcgacctgatcctgcacatcatcgaagcggtggcgtcgcaggtgttcattccgctgaccgtcggcggcggcgtgcgcgcgctcgaagatgtgcgccggctgctgaacgcgggtgccgacaagatcagcatgaactcgtccgcggtggcgaatccgcagctggtgtcggacgccagcgctcgccacggcgcgcagtgcatcgtggtggccatcgatgccaagaaggtgtcggccgacggcgagccgccgcgctgggaagtcttcacgcacggcgggcgcaaggcgaccggcctcgatgccgtggcctgggcccgcgagatggcgcggcgcggcgctggcgagatcctgctgaccagcatggaccgcgacggcaccaagagtggcttcgatctggaactgacgcgcgcggtgtcggatgccgtgccggtgccggtcattgcctcgggcggggtcggcaacctgcagcatctggccgacggcatcaagctggggcatgccgacgcggtgctcgccgcgagcatcttccactacggcgaacacacggtcggcgaggccaagcggttcatggcgcaacaagatattccggtgcggatgtga

SEQ ID NO: 10289 - protein, 256 aa, Ralstonia solanacearum
MLAKRIIPCLDVTNGRVVKGVNFVELRDAGDPVEIARRYDEQGADEITFLDITATSDGRDLILHIIEAVASQVFIPLTVGGGVRALEDVRRLLNAGADKISMNSSAVANPQLVSDASARHGAQCIVVAIDAKKVSADGEPPRWEVFTHGGRKATGLDAVAWAREMARRGAGEILLTSMDRDGTKSGFDLELTRAVSDAVPVPVIASGGVGNLQHLADGIKLGHADAVLAASIFHYGEHTVGEAKRFMAQQDIPVRM

SEQ ID NO: 10290 - DNA, 792 bp, Rhizobium loti
  CDS (1)..(792)
atgctgaaagcccgtgtcatcccgtgcctcgacgtcaaggacggccgcgtcgtcaagggcgtcaacttcgtcgacctcatcgacgccggcgacccggtcgaagcggccaaggcctatgacgccgccggcgccgacgaactctgctttctcgacatcaccgcctcgtccgacaaccgtgaaaccatcttcgatgtcatcgcccgcaccgccgaacagtgcttcatgccgctgaccgtcggcggcggcgtgcgccaggtcgccgacatcaggaagctgcttctggccggcgccgacaaggtgtcgatcaacacggcggcggtgaagaatccggatttcgtcgccgaagccgccgacaagttcggcaatcaatgcatcgtcgtcgccatcgacgccaagaaggtctccggcgccggcgaggccgaccgctgggagatcttcacccatggcggacgcgagaagaccggcatcgacgccgtcgaattcgcccgcaaaatggtcgatcgcggcgccggcgagatcctgctgacatcgatggaccgcgacggcaccaaggccggctacgatatcgcgctgacgcgtgcgatcgccgatgcggtgcgcgcgccgatcatcgcttcgggcggcgtcggcacgctggatcacctggtcgaaggcattcgcgacggccacgccggcgcggtgctggctgcctccatcttccattttggcacctacaccatcgcgcaggccaaggcgcatatggccgccgcgggcctgccgatgcggctggactcctcgggcgatcggccctag

SEQ ID NO: 10291 - protein, 263 aa, Rhizobium loti
MLKARVIPCLDVKDGRVVKGVNFVDLIDAGDPVEAAKAYDAAGADELCFLDITASSDNRETIFDVIARTAEQCFMPLTVGGGVRQVADIRKLLLAGADKVSINTAAVKNPDFVAEAADKFGNQCIVVAIDAKKVSGAGEADRWEIFTHGGREKTGIDAVEFARKMVDRGAGEILLTSMDRDGTKAGYDIALTRAIADAVRAPIIASGGVGTLDHLVEGIRDGHAGAVLAASIFHFGTYTIAQAKAHMAAAGLPMRLDSSGDRP

SEQ ID NO: 10292 - DNA, 777 bp, Rhizobium meliloti
  CDS (1)..(777)
atgacccttaaagcccgtgtaatcccctgtctcgatgtgaaggacggccgcgtcgtaaagggcgtgaacttcgtcgatctgatcgacgccggggacccggtggaggcggcacgcgcctatgacgcggccggggccgacgagctctgcttcctcgacatcaccgcctcctccgacaatcgcgaaacgatcttcgacgtcgtcgcccgcaccgcggagcaatgcttcatgccgctcaccgtcggcggcggcgtgcgccaggtagcggacatccgcaagctcctgcttgccggcgccgacaaggtgtcgatcaacacggcggcggtgaaaaatccggaattcgtcgcggaagccgccgacaagttcggcgaccagtgcatcgtcgtcgcgatcgacgccaagaaagtctcggcgcaaggtgaggcggaccgttgggagatattcacccatggcgggcggcaaccgacaggcatcgacgcgatcgaatttgcgcggaaggtcgtcgatctcggcgccggcgaaatccttctcacctccatggaccgcgacggtacgaagagcggctacgacatcagcctgacacgggcgatcgccgatgcggtacgcgctcccgtcatcgcctccggcggcgtcggcacgctcgaccacatggtcgagggcatccgcgacggccatgcgactgccgtgctcgccgcctcgattttccacttcggcacctacagcatcggcgaggcgaagcgccacatggccaagcacggcatcgccatgcggcttgattga

SEQ ID NO: 10293 - protein, 258 aa, Rhizobium meliloti
MTLKARVIPCLDVKDGRVVKGVNFVDLIDAGDPVEAARAYDAAGADELCFLDITASSDNRETIFDVVARTAEQCFMPLTVGGGVRQVADIRKLLLAGADKVSINTAAVKNPEFVAEAADKFGDQCIVVAIDAKKVSAQGEADRWEIFTHGGRQPTGIDAIEFARKVVDLGAGEILLTSMDRDGTKSGYDISLTRAIADAVRAPVIASGGVGTLDHMVEGIRDGHATAVLAASIFHFGTYSIGEAKRHMAKHGIAMRLD

SEQ ID NO: 10294 - DNA, 789 bp, Rhodopirellula baltica
  CDS (1)..(789)
atgctttccgctcgcgtcattccctgcctcgatgtccatggcggacgcgtcgtcaaaggcaccaactttgtgaacttgcgagatgccggtgacccagtcgaagtggctcggcgatacgaagccgaaggggccgatgaattggtgttcttggacatcaccgccagccacgaagaacgagcgatcttgttggatgtcgttcgccgtaccgcagaacaggttttcatgccgctgaccgtgggcggtggcgtgcgaacggtcgaggatgttcgagcgttgttgtcggccggttgcgacaaggtgtccatcaactcgtcagccgtgaccaaccccgacttcatccgccaagccgccgatcgattcgggcgtcagtgcatcgtggtgaacatcgatcccaaacgagtccaaaaagacggcgaagaattctgggaggtgcacatcaacggcggtcgcaaaccgaccgggctgcaagcggtccagtgggccaaacgagtcgaggaactgggggccggcgagattgtgctgaccagtatggacgccgacggtacttgcgacggatatgacattccgatcacccgagcggtcagtgaagcggtgcggatcccagtggtcgccagtggaggagctggaaatccggaccacttggtcgaggccattcgcgatgggaaggcggacgcggttctggcggccagcattttccactttggcacccacccaatcggaccgaccaaacagcacatggccgaggctggaattcgggttcggatgcccgcagagcctttcgccacatga

SEQ ID NO: 10295 - protein, 262 aa, Rhodopirellula baltica
MLSARVIPCLDVHGGRVVKGTNFVNLRDAGDPVEVARRYEAEGADELVFLDITASHEERAILLDVVRRTAEQVFMPLTVGGGVRTVEDVRALLSAGCDKVSINSSAVTNPDFIRQAADRFGRQCIVVNIDPKRVQKDGEEFWEVHINGGRKPTGLQAVQWAKRVEELGAGEIVLTSMDADGTCDGYDIPITRAVSEAVRIPVVASGGAGNPDHLVEAIRDGKADAVLAASIFHFGTHPIGPTKQHMAEAGIRVRMPAEPFAT

SEQ ID NO: 10296 - DNA, 759 bp, Rhodobacter capsulatus
  CDS (1)..(759)
atgctcaagacgcgcatcattccctgcctcgacgtggccgatggccgcgtggtcaaaggcgtgaacttcgtcaatctgatcgacgcgggcgacccggtcgaggccgccaaggcctatgacgcggcgggcgcggacgagctgtgtttccttgacatccatgccacgcatgaaaaccgcggcacgatgttcgatctggtgacccgcaccgccgagcaatgcttcatgccgctgaccgtggggggcggcgtgcgcacgcaggaggatgtccgtgcgctgcttctggcgggggccgacaaggtcagcttcaattcggccgccgtcgccaatcccgatgtggtgcgaagccgccgatcgcttcggtcgcaatgcatcgtcgtcgccatcgatgcgaagacggtcgaaccggggcggtgggagatcttcacccatggcgggcgcaaatcgaccggcatcgacgcggtcgaatttgcccggcatgtcgaggcgaagggggcgggggaaatcctgctcacctcgatggaccgcgacggcaccaaggccgggttcaaccttcccctcacccgcgccattgccgatgcggtgaagatcccggtgatcgccagcggtggcgtcggcacgctcgatcacctcgtcgagggcgtgaccgagggccatgcctcggcggtccttgccgcctcgatcttccatttcggcacctacacgatcggcgaagcgaaagcccacatggcccccgccggcattccgatgaggcttgcatga

SEQ ID NO: 10297 - protein, 252 aa, Rhodobacter capsulatus
MLKTRIIPCLDVADGRVVKGVNFVNLIDAGDPVEAAKAYDAAGADELCFLDIHATHENRGTMFDLVTRTAEQCFMPLTVGGGVRTQEDVRALLLAGADKVSFNSAAVANPDVVRSRRSLRSQCIVVAIDAKTVEPGRWEIFTHGGRKSTGIDAVEFARHVEAKGAGEILLTSMDRDGTKAGFNLPLTRAIADAVKIPVIASGGVGTLDHLVEGVTEGHASAVLAASIFHFGTYTIGEAKAHMAPAGIPMRLA

SEQ ID NO: 10298 - DNA, 768 bp, Rhodopseudomonas palustris
  CDS (1)..(768)
atgttcaaggtccgcgtcatcccctgcctcgacgtcaaagacggccgagtcgtcaaaggcgtcaacttcgtcgacctgcgcgacgccggcgatccggtcgaggcggcgatcgcctatgacgccgctggcgcggacgaactctgcttcctcgacatcaccgccacccacgagaaccgcggcatcatgctcgacgtggtgcggcgcacggccgaagcctgcttcatgccggtgacggttggcggcggcgttcgcaccgtcgacgacatcaagaccctgctccgctccggcgccgacaaggtctcgattaattcggccgcggttgcgcggcgcgaattcgtcaaggaagcggccgagaagttcggcgaccagtgcatcgtggtggcgatcgacgccaagcgtgtgccgggccgcgaccgctgggagatcttcacccatggtggccgaaagggcaccgggatcgacgcgatcgaattcgcccaggaagtggtgtcgctcggcgccggcgaaatcctgctgacctcaatggaccgcgacggcaccaagtcgggcttcgacattccgctgacccgggcgatcgccgacagcgtcggcgtcccggtgatcgcgtcgggcggcgtcggcaatctcgatcacctggtcgacggcatccgcgaaggccacgccaccgcggtgctggcggcctcgatcttccatttcggtgagtacaccattcgtcaggccaaggatcatatggtccaggccgggctgccgatgcggctcgatccctag

SEQ ID NO: 10299 - protein, 255 aa, Rhodopseudomonas palustris
MFKVRVIPCLDVKDGRVVKGVNFVDLRDAGDPVEAAIAYDAAGADELCFLDITATHENRGIMLDVVRRTAEACFMPVTVGGGVRTVDDIKTLLRSGADKVSINSAAVARREFVKEAAEKFGDQCIVVAIDAKRVPGRDRWEIFTHGGRKGTGIDAIEFAQEVVSLGAGEILLTSMDRDGTKSGFDIPLTRAIADSVGVPVIASGGVGNLDHLVDGIREGHATAVLAASIFHFGEYTIRQAKDHMVQAGLPMRLDP

SEQ ID NO: 10300 - DNA, 774 bp, Shewanella oneidensis
  CDS (1)..(774)
atgctggccaaacgaatagtcccctgtttagatgtgaaagatggctgcgtggtcaaaggcgtacagtttcgcaaccatgaaattgttggcgacatagtgccactcgcagcgcgttacgccgcagaaggcgctgatgagctggtgttttacgatatcaccgccagtgcccacgaccgtgtagtcgataagtcttgggtgagccgagtggctgagcaaatagatatccccttttgcgtggcgggtggaattaaaaccattacccaagcccgcgagctactcgcctttggcgcagataaaatttcggttaactcacccgccctgagcgatccgagtttaatctcacgcctgcaggatgaatttggccgtcaatgtatcgtgattggcatagactctttttatgatgcggcaagcgacagttataaagtaaagcaatttaccggcgatgaagccgccaccaaagaaactgcttggtacacccaagattgggtcgaagaagtacaaaaacgcggctgcggtgaaatcgtgctcaatgtgatgaaccaagacggcgtgcgcggtggctatgatatcaaacagttaagcctagtacgccaattgtgcgatgtgccattaatcgcctcgggcggcgctggcacgatggcgcattttcgcgatgtgtttatcgatgcgaaggtggatgcagcactggcggccagcgtgttccataaagccattatcaatatcggcgagttaaaacagtatttagccgccgaaggtattgctattagacgctag

SEQ ID NO: 10301 - protein, 257 aa, Shewanella oneidensis
MLAKRIVPCLDVKDGCVVKGVQFRNHEIVGDIVPLAARYAAEGADELVFYDITASAHDRVVDKSWVSRVAEQIDIPFCVAGGIKTITQARELLAFGADKISVNSPALSDPSLISRLQDEFGRQCIVIGIDSFYDAASDSYKVKQFTGDEAATKETAWYTQDWVEEVQKRGCGEIVLNVMNQDGVRGGYDIKQLSLVRQLCDVPLIASGGAGTMAHFRDVFIDAKVDAALAASVFHKAIINIGELKQYLAAEGIAIRR

SEQ ID NO: 10302 - DNA, 759 bp, Staphylococcus aureus
  CDS (1)..(759)
atgattaaaaaacgtatcattccatgtttagatgtcaaagatggtcgtgtcgttaaagggattcaatttaaaggattaagggatattgggaatcctgttgatttagcaatgtattacaatgaagcgggtgctgatgaattagtatttttagacatctctaagacggaagagggtcatagcttaatgctagaagtgattgaacagacagcgtcacgcttgtttatccctcttactgtagggggtgggattcaaagtctcgatgatattacccaattgctaaatcatggtgcagataaagtatcattaaattcaagtgctttaaaaaatccacagctcattaaacaagcgagtgataaattcggtagacaatgcatctgcatagcaattgatagctattatgatcctgaaagaaaagcacattattgttgtacgactggtggtaaaaaaatgacaaatattaaagtatatgactgggtacagcaagtagaacagttaggtgcaggtgagctcctcgttacaagtatgggacatgatggtatgaaacaaggctttgatattgaacacctagcaaatattaagtctcttgtaaatattccaatcattgcttctggtggtggtggcaatgcacaacactttgtagaattatttgatcagacggatgtttctgcaggtttagctgcaagtatattacatgatcgagaaacgacggttcaatctattaaagaagtgatacggcaaggaggtatagcagtaagatga

SEQ ID NO: 10303 - protein, 252 aa, Staphylococcus aureus
MIKKRIIPCLDVKDGRVVKGIQFKGLRDIGNPVDLAMYYNEAGADELVFLDISKTEEGHSLMLEVIEQTASRLFIPLTVGGGIQSLDDITQLLNHGADKVSLNSSALKNPQLIKQASDKFGRQCICIAIDSYYDPERKAHYCCTTGGKKMTNIKVYDWVQQVEQLGAGELLVTSMGHDGMKQGFDIEHLANIKSLVNIPIIASGGGGNAQHFVELFDQTDVSAGLAASILHDRETTVQSIKEVIRQGGIAVR

SEQ ID NO: 10304 - DNA, 756 bp, Streptomyces avermitilis
  CDS (1)..(756)
atgaccctggccgtacgagtcatcccctgcctggacgtggacaacggccgggtggtcaagggtgtcaacttccagaacctgcgcgacgcgggcgaccccgtcgagatggcgaaggtgtacgacgccgagggcgccgacgagctgacgttcctggacatcaccgcgtcctccggcaaccgcgagaccacgtacgacgtcgtgcgccgcacggccgagcaggtgttcatcccgctgacggtgggcgggggcgtgcggacgcccgacgacgtggacaagctgctgcgggcgggcgcggacaaggtgggcgtgaacacggccgccatcgcccggcccgagctgatccgtgagatcgccgagcggttcggccggcaggtcctggtcctgtcggtggacgcgcgccggaccgagagcggcagcttcgaggtcaccacccacggcggccgcaagggcaccggcatcgacgccgtggagtgggcgcaccgggccgccgagctgggcgcgggagagatcctgctcaactcgatggacgcggacggcaccaaggacggctacgacctggagatgatcgcggcggtgcgggcgcacgtgaccgtgcccgtcatcgcctccggcggcgccggcaagctcgaccacttcccgccggccatcgcggcgggcgccgacgcggtgctggccgcgtccgtcttccacttcggtgatctgcggatcggcgaggtgaaggagacgctgcgggcggcggggcatcccgtgcggtga

SEQ ID NO: 10305 - protein, 251 aa, Streptomyces avermitilis
MTLAVRVIPCLDVDNGRVVKGVNFQNLRDAGDPVEMAKVYDAEGADELTFLDITASSGNRETTYDVVRRTAEQVFIPLTVGGGVRTPDDVDKLLRAGADKVGVNTAAIARPELIREIAERFGRQVLVLSVDARRTESGSFEVTTHGGRKGTGIDAVEWAHRAAELGAGEILLNSMDADGTKDGYDLEMIAAVRAHVTVPVIASGGAGKLDHFPPAIAAGADAVLAASVFHFGDLRIGEVKETLRAAGHPVR

SEQ ID NO: 10306 - DNA, 756 bp, Streptococcus mutans
  CDS (1)..(756)
atgttaaaaaaacggattattccttgcctagatgtcaaggatggacgcgtcgttaagggtgttaattttgttaatctgactgatgttggtgatcctgttgatgctgcgcgtgcttattatgaagcgggttgtgatgaactggtctttttagatattacagcaacctcggacaatcgagaaacgacagtggatatggtaaggcatgtagcggaccaagtctttattccctttactgttggcggtggtattcgttcagttgatgatatgaataaaatgctcaaggctggtgccgataaggtcgctgttaattcatcggctatcgccaatccccagttaatcaaggattgtgctgagaaatttggcagccaatgtgtggtcgttgccattgatgcgcgcaaagaagcagatgattcttggcatgtttacgttgcaggtggccgaaaagatacaggcattgatctcttggcttgggttaaagaagccgtccagctgggtgctggcgaaattctcctgacaagcatggataaggatggcaccaagtctggttttgacttggacatgttgaatgccgttgcccagttggctgatattcccatcattgcctcaggtggtgccggaaatatggagcatatggtggaaatttttgaaaagaccccagcaacaggtgccttagcagcatccattttccattatggcgaggtttctatcgcagatactaaaaaagccatgaaagagcatggaatcgaggtgagataa

SEQ ID NO: 10307 - protein, 251 aa, Streptococcus mutans
MLKKRIIPCLDVKDGRVVKGVNFVNLTDVGDPVDAARAYYEAGCDELVFLDITATSDNRETTVDMVRHVADQVFIPFTVGGGIRSVDDMNKMLKAGADKVAVNSSAIANPQLIKDCAEKFGSQCVVVAIDARKEADDSWHVYVAGGRKDTGIDLLAWVKEAVQLGAGEILLTSMDKDGTKSGFDLDMLNAVAQLADIPIIASGGAGNMEHMVEIFEKTPATGALAASIFHYGEVSIADTKKAMKEHGIEVR

SEQ ID NO: 10308 - DNA, 750 bp, Sulfolobus tokodaii
  CDS (1)..(750)
atgacagctaaaagaataattgcttgtttagatgtaaaaaacggtagagtagtcaagggtgtaaatttccttaacttaaaagacaagggagaccccgtagaattagcatctagatacgaagaagaaggagcggacgaaatagtatttttggatattacagctactatagaaggaagaaaagcattattagaagtagtaaaaaatacggctagcgtattatctataccactgacggtaggaggtggaataagaacaatagaagatgtttcaagaattctaggtaatggcgctgataaagtaagtataaatacagcagcagttgaaaacaaaaagataataactgaggcctctgaacaatttggtgctcaagcaattgttgtagcaattgatgtgaaaagggttaataattcgttcatagtttttactagatctggtacctataataccggtatagacgcaattcaatgggcaaaagaagtagaaaaattgggtgctggggaaattttgcttacaagtattgataaagatggtacaagagaaggatatgatatcgagcttacaaaagaggtaaataattctgtaaatattccagttattgctagtggtggtgcagggaaaatggaacatttttatgaggttttaaaagttgcggatgccgcgttggctgcaggtgtttttcatgatggcgttattaagatccctgaacttaaaaggtttttgttagagaagggtatagaggtgagagtatga

SEQ ID NO: 10309 - protein, 249 aa, Sulfolobus tokodaii
MTAKRIIACLDVKNGRVVKGVNFLNLKDKGDPVELASRYEEEGADEIVFLDITATIEGRKALLEVVKNTASVLSIPLTVGGGIRTIEDVSRILGNGADKVSINTAAVENKKIITEASEQFGAQAIVVAIDVKRVNNSFIVFTRSGTYNTGIDAIQWAKEVEKLGAGEILLTSIDKDGTREGYDIELTKEVNNSVNIPVIASGGAGKMEHFYEVLKVADAALAAGVFHDGVIKIPELKRFLLEKGIEVRV

SEQ ID NO: 10310 - DNA, 846 bp, Synechococcus elongatus
  CDS (1)..(846)
atgatgcttgcaaaacgaattttgccctgtctggatgtgaaggcgggtcgagttgtgaagggggtgaactttgtcaacctacgggatgccggagatcccgtagagctggctcaggcctacaatgcagcgggtgccgatgagcttgtatttttggatattacggccacccatgaagagcgcaacatcctcattgatgtggtctatcgcaccgcggatcaggtgtttattcccctcacggtggggggtggcattcagtccctgacgatgatcaaggatctattgcgggccggggcagataaagtcagcctgaattcggcagccgtgcggcaacccgatctcgtcaatcaggccagcgatcgctttggtgcccaatgtattgttgttgccattgatgctcgacgcgaacccgattgtgctcctgaccaaccccgttggcaagtctatgtgcgcggcggccgggaagccaccggtctcgatgccgtggcctgggcagtggaaatggctaaacggggtgcgggcgaactgctggtgaccagtatggatgccgatggaacccaggcaggctacgaccttgaattgacgcgggcgatcgccgagcgagtggagattcctgtgattgcctctgggggagcaggcacctgtgagcatattcgcgctgcccttgtggaagggaaagcagaggcggcacttttagcctcgctgctgcactacggccaactgacgatcgcccagatcaagggctatctacatcagcaccaagtgcccgtgcgccaagcagaacccctccctcaacccgccagggaggggctaggggattcagctagaagggccatgtccagtggctaa

SEQ ID NO: 10311 - protein, 281 aa, Synechococcus elongatus
MMLAKRILPCLDVKAGRVVKGVNFVNLRDAGDPVELAQAYNAAGADELVFLDITATHEERNILIDVVYRTADQVFIPLTVGGGIQSLTMIKDLLRAGADKVSLNSAAVRQPDLVNQASDRFGAQCIVVAIDARREPDCAPDQPRWQVYVRGGREATGLDAVAWAVEMAKRGAGELLVTSMDADGTQAGYDLELTRAIAERVEIPVIASGGAGTCEHIRAALVEGKAEAALLASLLHYGQLTIAQIKGYLHQHQVPVRQAEPLPQPAREGLGDSARRAMSSG

SEQ ID NO: 10312 - DNA, 765 bp, Thermoanaerobacter ethanolicus
  CDS (1)..(765)
atggtcacaaaaagaataattccctgcctggacgttcacaacggcagggtggtaaagggagtcaattttgtgaatataagagatgccggagatccggttgagattgcgtcctattatgacaaagccggcgctgacgaacttacttttcttgacataactgcttcggcggaactgagaaacatcatgattgatgtggtaagaagggttgcagagcaggtttttattcccttcactgtggggggtggaataagaaccgttgaggatttcagggagattttaaaagccggtgcggacaaagtatccattaattccgctgcggtaaaaaggcctgagctgatatcggaagccgcatcccgttttggaagtcagtgcgtggtggttgcgattgatgcgaaaaggcgcgacgacaattccggttgggatgtgtatattaacggaggaagaatcaataccggaaaagatgccgtggaatgggctgtggaggttgaaaaactcggtgccggggagattcttcttacgagcatggactgtgacggtacgaaaaaaggatatgacattgagcttaccagaaaggtgtcggaaagtgtaaggatgatccctgttattgcatcgggcggtgccggtaccatggagcatttccgtgaagcattagttgagggaaaggccgacgctgtgctggctgcatctctgtttcactacagagagatagaaataatggaactaaaaaaatatttgaaggagaacggaatagaaataagaatgtag

SEQ ID NO: 10313 - protein, 254 aa, Thermoanaerobacter ethanolicus
MVTKRIIPCLDVHNGRVVKGVNFVNIRDAGDPVEIASYYDKAGADELTFLDITASAELRNIMIDVVRRVAEQVFIPFTVGGGIRTVEDFREILKAGADKVSINSAAVKRPELISEAASRFGSQCVVVAIDAKRRDDNSGWDVYINGGRINTGKDAVEWAVEVEKLGAGEILLTSMDCDGTKKGYDIELTRKVSESVRMIPVIASGGAGTMEHFREALVEGKADAVLAASLFHYREIEIMELKKYLKENGIEIRM

SEQ ID NO: 10314 - DNA, 762 bp, Thermoanaerobacter tengcongensis
  CDS (1)..(762)
atgcttgcaaagagaataataccatgtctggatgttaaagatggaagagtagtaaaaggaataaattttgtaaatttaaaggatgctggagaccctgttgaaatagctgaaaggtacaatgaattaggagccgatgagcttgtatttctggatattacagcttcctatgaaaaaagaaaaattatgatagatgttgtaaagagaacatcagaaaaggtgtttatccctttgactgtagggggaggaatttctgatattgatgacataagagaagttttaaaagcaggagctgataaggtttctataaatacacaggcggtaaaacagccaacacttattcgtcaggcggctttgaggtttgggagccagtgtgttgttgtggcaattgacgctaaaaagagaccagatggcacaggctacaatgtgtatataaatggagggagaataaacacaggacttgatgctgttgagtgggctaaaaaggtgaaagatttgggtgcaggagaaatacttttaacaagtatggataaagacgggacaaaggatggatatgatattgaacttacaaggcttataagtgaagctgtgagtattccagttatagcatcaggaggagcagggaaacccgagcattttaaagaggtgtttacacaaggaaaagctgatgcagctttggctgcttctgtatttcactatggagagcttgatataaaagagttgaaaagatatttaaaggatgagggtataccggtaagattgtag

SEQ ID NO: 10315 - protein, 253 aa, Thermoanaerobacter tengcongensis
MLAKRIIPCLDVKDGRVVKGINFVNLKDAGDPVEIAERYNELGADELVFLDITASYEKRKIMIDVVKRTSEKVFIPLTVGGGISDIDDIREVLKAGADKVSINTQAVKQPTLIRQAALRFGSQCVVVAIDAKKRPDGTGYNVYINGGRINTGLDAVEWAKKVKDLGAGEILLTSMDKDGTKDGYDIELTRLISEAVSIPVIASGGAGKPEHFKEVFTQGKADAALAASVFHYGELDIKELKRYLKDEGIPVRL

SEQ ID NO: 10316 - DNA, 774 bp, Vibrio vulnificus
  CDS (1)..(774)
atgctggcaaagcgaataattccatgtcttgatgttcgtgatggacaagtggtgaagggcgttcagtttcgtaaccatgaaatcattggtgatatcgttcctcttgctaaacgctatgcggaagaaggcgctgacgagcttgtattctatgacattaccgcttcaagtgatggtcgtgtcgtcgataaaagttgggtttctcgcgttgcagaagtgattgatattccgttctgtgtcgctggtggcattaagtcagcagaagacgcagcgcgcattcttgagtttggcgcagacaaagtctctatcaactcgccagcgctggctaacccgcagctgattactgaccttgccgataagtttggtgtgcaatgtatcgtcgttggtatcgattcatactacgacaaagagaccggtaagtatcaggtttatcagtttactggtgacgaagaacgcaccaaagcgacccaatgggaaacacgtgattgggtgcaagaagtacaaaaacgcggcgctggtgaaattgtattgaacatgatgaaccaagacggcgtacgtaacggttacgatatcgaacaactgaatatggtacgcgaagtgtgtaaggtgccattgattgcctctggtggtgccggtgccatggagcacttcgcggaagcgtaccaaaaagccaatgtggacggtgcgctggcagcatcggtgtttcacaaacaagtcatcaatattggtgaattaaagcagtatttaaagcaacaaggcattgaggtacgactatga

SEQ ID NO: 10317 - protein, 257 aa, Vibrio vulnificus
MLAKRIIPCLDVRDGQVVKGVQFRNHEIIGDIVPLAKRYAEEGADELVFYDITASSDGRVVDKSWVSRVAEVIDIPFCVAGGIKSAEDAARILEFGADKVSINSPALANPQLITDLADKFGVQCIVVGIDSYYDKETGKYQVYQFTGDEERTKATQWETRDWVQEVQKRGAGEIVLNMMNQDGVRNGYDIEQLNMVREVCKVPLIASGGAGAMEHFAEAYQKANVDGALAASVFHKQVINIGELKQYLKQQGIEVRL

SEQ ID NO: 10318 - DNA, 765 bp, Wolinella succinogenes
  CDS (1)..(765)
atgaatccactcgccaaacgcatcattccctgtcttgatatcaaagagggtcgagtcgtgaaaggagtcaatttccttggattgagggatgcgggagacccagttgaagtggctaggcgatacaatgaagagggggcagacgagatcgccttcctcgacatcactgccactcacgagaggcgtgacacgatgtgtgatattgtaagggcggttgccaaagaggtctttatcccattgaccgttggaggaggcatccgcaaacttgaagatatgtacacacttcttaacgcgggttgcgacaaagtgagcattaactcctcggccatcaagaatccttcgcttattgacgaaggggcgaagcgttttgggagccaatgcattgttgtagccattgatgccaagtctagggcggataagagtggctggaatgtctatattaatggcggaagaatcgacacaggaatcgatcttcttgaatggactaaagaggtctatgagcgaggcgcaggagagattctcctcactagcatggatgccgatggaacaaaggcaggctatgactgtgaacagctccagacactctccaagctagtcgatatccccctgattgctagcggcggagcaggcacaatggagcatatcaaagaggcgtttttgagtggagccgatgccgcccttgctgcgaccatttttcactacaaagagattgatatcatggatctcaagcgctatcttcgctccgagggaatcgaggtgagactctaa

SEQ ID NO: 10319 - protein, 254 aa, Wolinella succinogenes
MNPLAKRIIPCLDIKEGRVVKGVNFLGLRDAGDPVEVARRYNEEGADEIAFLDITATHERRDTMCDIVRAVAKEVFIPLTVGGGIRKLEDMYTLLNAGCDKVSINSSAIKNPSLIDEGAKRFGSQCIVVAIDAKSRADKSGWNVYINGGRIDTGIDLLEWTKEVYERGAGEILLTSMDADGTKAGYDCEQLQTLSKLVDIPLIASGGAGTMEHIKEAFLSGADAALAATIFHYKEIDIMDLKRYLRSEGIEVRL

SEQ ID NO: 10320 - DNA, 777 bp, Xanthomonas campestris
  CDS (1)..(777)
atgctgagccgtcgcatcattccctgcctggacgtgcgcgatggccgcgtggtcaagggcgtcaagttccgcgaccacatcgacatgggcgacatcgtcgagttggcgatgcgctaccgcgaccagggcgcggacgagttggtgttctacgacattggcgccagcccggaagggcgttcggtggactatgcgtgggtcgagcgcgttgcgcgcctgatcgacatcccgttctgcgtggccggcggcatccgcgatgtagaaaccgcgcgtgcggtgctgcatgccggcgccgacaagatctccatcaactcgccggcattggggcggccgcagctgatctccgagctggccgacgcctttggcgtgcaatgcgtggtggtcggcatcgactcgatccgcgaagaggacgggcagtggcgcgtccgccgctacaccggcgacccaagcaagacccaggcgctgccgatgcgcacgctggactgggtggccgaggcgcagcgactgggtgcgggcgagatcgtgctcaattgcatggataacgacggggtccggcatggctacgatattgcgcagctgcgccaggtgcgcgcgttgtgccgggtaccgctgattgcctccggcggcgctggcgagatgcagcacttcgccgacgtgttcgaccaggccgacgccgatggtgcgctggcggccagtgtcttccatagcggcgcaattccgattccggaactcaagcgcttcctgcgtgcgcaacagatcgaggtacgtgatgggcagtga

SEQ ID NO: 10321 - protein, 258 aa, Xanthomonas campestris
MLSRRIIPCLDVRDGRVVKGVKFRDHIDMGDIVELAMRYRDQGADELVFYDIGASPEGRSVDYAWVERVARLIDIPFCVAGGIRDVETARAVLHAGADKISINSPALGRPQLISELADAFGVQCVVVGIDSIREEDGQWRVRRYTGDPSKTQALPMRTLDWVAEAQRLGAGEIVLNCMDNDGVRHGYDIAQLRQVRALCRVPLIASGGAGEMQHFADVFDQADADGALAASVFHSGAIPIPELKRFLRAQQIEVRDGQ

SEQ ID NO: 10322 - DNA, 22 bp, artificial sequence
  primer
atgctggcaaaacgcataatcc

SEQ ID NO: 10323 - DNA, 23 bp, artificial sequence
  primer
ttaacatatcctgatctccacgc

SEQ ID NO: 10324 - DNA, 1575 bp, Escherichia coli K12
  CDS (244)..(1575)
ggatcctgacatgcctctcccgagcaaaagaaatctaagctgtgtaacaagtaaacgactaatttgaccggtttcaaaagcgaaagacgcataatctgtcatctaataaacggtaaacattctttttatattcacggcattactgataaaaaagtcgctctcgcataaaatttacacttgcaccctgcgaaaaaacagaataaaaatacactaatttcgaataatcatgcaaagaggtgtgccatggtaaaggaacgtaaaaccgagttggtcgagggattccgccattcggttccctatatcaatacccaccggggaaaaacgtttgtcatcatgctcggcggtgaagccattgagcatgagaatttctccagtatcgttaatgatatcgggttgttgcacagcctcggcatccgtctggtggtggtctatggcgcacgtccgcagatcgacgcaaatctggctgcgcatcaccacgaaccgctgtatcacaagaatatacgtgtgaccgacgccaaaacactggaactggtgaagcaggctgcgggaacattgcaactggatattactgctcgcctgtcgatgagtctcaataacacgccgctgcagggcgcgcatatcaacgtcgtcagtggcaattttattattgcccagccgctgggcgtcgatgacggcgtggattactgccatagcgggcgtatccggcggattgatgaagacgcgatccatcgtcaactggacagcggtgcaatagtgctaatggggccggtcgctgtttcagtcactggcgagagctttaacctgacctcggaagagattgccactcaactggccatcaaactgaaagctgaaaagatgattggtttttgctcttcccagggcgtcactaatgacgacggtgatattgtctccgaacttttccctaacgaagcgcaagcgcgggtagaagcccaggaagagaaaggcgattacaactccggtacggtgcgctttttgcgtggcgcagtgaaagcctgccgcagcggcgtgcgtcgctgtcatttaatcagttatcaggaagatggcgcgctgttgcaagagttgttctcacgcgacggtatcggtacgcagattgtgatggaaagcgccgagcagattcgtcgcgcaacaatcaacgatattggcggtattctggagttgattcgcccactggagcagcaaggtattctggtacgccgttctcgcgagcagctggagatggaaatcgacaaattcaccattattcagcgcgataacacgactattgcctgcgccgcgctctatccgttcccggaagagaagattggggaaatggcctgtgtggcagttcacccggattaccgcagttcatcaaggggtgaagttctgctggaacgcattgccgctcaggctaagcagagcggcttaagcaaattgtttgtgctgaccacgcgcagtattcactggttccaggaacgtggatttaccccagtggatattgatttactgcccgagagcaaaaagcagttgtacaactaccagcgtaaatccaaagtgttgatggcggatttagggtaa

SEQ ID NO: 10325 - protein, 443 aa, Escherichia coli K12
MVKERKTELVEGFRHSVPYINTHRGKTFVIMLGGEAIEHENFSSIVNDIGLLHSLGIRLVVVYGARPQIDANLAAHHHEPLYHKNIRVTDAKTLELVKQAAGTLQLDITARLSMSLNNTPLQGAHINVVSGNFIIAQPLGVDDGVDYCHSGRIRRIDEDAIHRQLDSGAIVLMGPVAVSVTGESFNLTSEEIATQLAIKLKAEKMIGFCSSQGVTNDDGDIVSELFPNEAQARVEAQEEKGDYNSGTVRFLRGAVKACRSGVRRCHLISYQEDGALLQELFSRDGIGTQIVMESAEQIRRATINDIGGILELIRPLEQQGILVRRSREQLEMEIDKFTIIQRDNTTIACAALYPFPEEKIGEMACVAVHPDYRSSSRGEVLLERIAAQAKQSGLSKLFVLTTRSIHWFQERGFTPVDIDLLPESKKQLYNYQRKSKVLMADLG

SEQ ID NO: 10326 - DNA, 1326 bp, Yersinia pestis
  CDS (1)..(1326)
atgaaggaacgtagtactgaactggttcaaggatttcgccactcagttccctatatcaatgcgcaccgcggcaagacatttgttgtcatgctaggtggcgaagcgattgaacatgaaaacttctctagtatcgtcaacgatataggcttattacatagccttgggatcagattagtcgtggtatacggtgcccgaccacagattgacagtaatctggcagatcataactacgaacctatttatcataaacatacccgagtgactgacgcccggactctggagatggtcaagcaagcggccggtttattacaactggatatcacggccaggctttcaatgagtttgaacaacaccccactgcaaggtgctcatatcaacgtagttagcggtaactttatcattgctcaaccgctaggtgtggatgatggtgttgattattgccatagcgggcgtatccggcgcattgatgaagaagctattcatcgccaattggataatggcgctatcgttttgctggggccagttgcggtatcggtcacaggtgaaagctttaacctcacatcagaggaagttgcaactcagttagccatcaaactgaaagcggagaaaatgattggattctgctcatcacaaggggtgactgatagcgaaggtaatattatttcagaattgttcccaaacgatgcgcaaaagcggattgaagacctggaacaggatggggattacaattcgggcacagtacgtttcttgcgtggtgccgttaaagcctgccgcagcggtgtgcgccgtagccatttactcagctatcaggaagatggcgctctgattcaagaactcttctcccgtgacggtatcggtacccagattgtcatggaaagtgcggagcaagtccgccgagccaccatcaacgatatcggcggtatcttggaactgattcgcccattggaacaacaagggatcttggtgcgccgttcacgtgaacaattagagatggagatagataagtttactattattgaacgggataatttaactatcgcttgcgccgccctctatccgttccctgatgaacatattggtgaaatggcttgtgtcgcggtccatccagattatcgcagctcctcccggggagaaatgctgctgaataggataaccaatcaggcgcgacaaatgggccttaaaaagctgtttgtgctgaccacacgcagcattcactggttccaggaacgcggttttacacctgcagaggtagatgttttacctattcaaaaacaggaactgtataactatcagcgccgttcgaagatcttactggccgatctatag

SEQ ID NO: 10327 - protein, 441 aa, Yersinia pestis
MKERSTELVQGFRHSVPYINAHRGKTFVVMLGGEAIEHENFSSIVNDIGLLHSLGIRLVVVYGARPQIDSNLADHNYEPIYHKHTRVTDARTLEMVKQAAGLLQLDITARLSMSLNNTPLQGAHINVVSGNFIIAQPLGVDDGVDYCHSGRIRRIDEEAIHRQLDNGAIVLLGPVAVSVTGESFNLTSEEVATQLAIKLKAEKMIGFCSSQGVTDSEGNIISELFPNDAQKRIEDLEQDGDYNSGTVRFLRGAVKACRSGVRRSHLLSYQEDGALIQELFSRDGIGTQIVMESAEQVRRATINDIGGILELIRPLEQQGILVRRSREQLEMEIDKFTIIERDNLTIACAALYPFPDEHIGEMACVAVHPDYRSSSRGEMLLNRITNQARQMGLKKLFVLTTRSIHWFQERGFTPAEVDVLPIQKQELYNYQRRSKILLADL

SEQ ID NO: 10328 - DNA, 1332 bp, Salmonella enterica subsp. enterica serovar Typhi
  CDS (1)..(1332)
atgataaaggaacgtaaaaccgaactggtagaagggtttcgccattcagttccctatatcaatacccatcgcggaaaaacctttgtcattatgctcggcggcgaagccattgagcatgacaatttttccagcatcgttagcgatatcgggctactgcatagcctcggtattcgccttgtcgtggtgtatggcgcgcgaccgcaaatcgacgccaatctggccgcgcatcatcatgaaccgatttaccacaaaaacacacgggtgacggacgccaaaacactggagctggtgaaacaggccgccggtttactccagcttgatattaccgcccgtctgtcgatgagtctgaacaatacgccgttgcagggcgcgcacattaatgtcgtcagcggcaatttcaccattgcgcagccgctgggcgttgatgatggcgtggactactgtcatagcggccgtatccggcgcattgatgaagatgcgatcaaccgccagttggataacggcgcgatcgttctgatggggccggtcgccgtctcagtgaccggcgaaagttttaatctgacctcagaagagattgccactcaactcgccgttaaactgaaagcggaaaaaatgatcggtttctgttcttctcagggcgttaccaatagcgagggcggcatcatttctgaactcttcccgaatgaagcgcaggcgcgggtggaagagttggaagcgcagggcgattacaactccggaaccgtacgttttttgcgcggcgcggtaaaagcctgtcgtagcggcgttcgtcgttgccatctgatcagctatcaggaagatggctcgctattacaggaattgttctcgcgtgatggtatcggtacgcagatcgtcatggagagcgccgagcagatccgccgcgctaccatcaacgatattggcggtattctggagcttatccgcccactggaacagcagggcattctggtacgccgttcccgtgaacaactggagatggagatcgataaatttaccattattcagcgcgataatatgactatcgcttgcgcggcgctgtatccttttgtggaagagaaaataggcgaaatggcctgcgtagcggtacatccggattatcgcagctcatcgcgtggagaagtgcttctggagcgggttgccgcccaggcacggcaaatggggctgcgtaaattgtttgtgttgacgacgcgcagtattcactggttccaggagcgcggttttacgcctgtcgatattgagttactgcctgagagcaagaaaaaaatgtataactatcagcgacgttcaaaggtgctgatggcagatttaggataa

SEQ ID NO: 10329 - protein, 443 aa, Salmonella enterica subsp. enterica serovar Typhi
MIKERKTELVEGFRHSVPYINTHRGKTFVIMLGGEAIEHDNFSSIVSDIGLLHSLGIRLVVVYGARPQIDANLAAHHHEPIYHKNTRVTDAKTLELVKQAAGLLQLDITARLSMSLNNTPLQGAHINVVSGNFTIAQPLGVDDGVDYCHSGRIRRIDEDAINRQLDNGAIVLMGPVAVSVTGESFNLTSEEIATQLAVKLKAEKMIGFCSSQGVTNSEGGIISELFPNEAQARVEELEAQGDYNSGTVRFLRGAVKACRSGVRRCHLISYQEDGSLLQELFSRDGIGTQIVMESAEQIRRATINDIGGILELIRPLEQQGILVRRSREQLEMEIDKFTIIQRDNMTIACAALYPFVEEKIGEMACVAVHPDYRSSSRGEVLLERVAAQARQMGLRKLFVLTTRSIHWFQERGFTPVDIELLPESKKKMYNYQRRSKVLMADLG

SEQ ID NO: 10330 - DNA, 1311 bp, Neisseria meningitidis
  CDS (1)..(1311)
atgagcgcgcccgacctctttgtcgcccacttccgcgaagccgtcccctacatccgccaaatgcgcggcaaaacgctggtcgccggcatagacgaccgcctgctcgaaggtgataccttaaacaagctcgccgccgacatcgggctgttgtcgcaactgggcatcaggctcgtcctcatccacggcgcgcgccacttcctcgaccgccacgccgccgctcaaggccgcacgccgcattattgccggggcttgcgcgttaccgacgaaacctcgctcgaacaggcgcagcagtttgccggcaccgtccgcagccgttttgaagccgcattgtgcggcagcgtttccgggttcgcgcgcgcgccttccgtcccgctcgtatcgggcaacttcctgaccgcccgtccgataggtgtgattgacggaaccgatatggaatacgcgggcgttatccgcaaaaccgacaccgccgccctccgtttccaactcgacgcgggcaatatcgtctggctgccgccgctcggacattcctacagcggcaagaccttctatctcgatatgcttcaaaccgccgcctccgccgccgtctcgcttcaggccgaaaaactcgtttacctgaccctttcagacggcatttcccgccccgacggcacgctcgccgaaaccctctcggcacaggaagcgcaatcgctggcggaacacgccggcggcgaaacgcgacggctgatttcgtccgccgttgccgcgctcgaaggcggcgtgcatcgcgtccaaatcctcaacggagccgccgacggcagcctgctgcaagaactcttcacccgcaacggcatcggcacgtccattgccaaagaagccttcgtctccatccggcaggcgcacagcggcgacatcccgcacatcgccgccctcatccgcccgctggaagaacagggcatcctgctgcaccgcagccgcgaatacctcgaaaaccacatttccgaattttccatcctcgaacacgacggcaacctgtacggttgcgccgccctgaaaacctttgccgaagccgattgcggcgaaatcgcctgccttgccgtctcgccgcaggcacaggacggcggctacggcgaacgcctgcttgcccacattatcgataaggcgcgcggcataggcataagcaggctgttcgcactgtccacaaataccggcgaatggtttgccgaacgcggctttcagacggcatcggaagacgagttgcccgaaacgcggcgcaaagactaccgcagcaacggacggaactcgcatattctggtacgtcgcctgcaccgctga

SEQ ID NO: 10331 - protein, 436 aa, Neisseria meningitidis
MSAPDLFVAHFREAVPYIRQMRGKTLVAGIDDRLLEGDTLNKLAADIGLLSQLGIRLVLIHGARHFLDRHAAAQGRTPHYCRGLRVTDETSLEQAQQFAGTVRSRFEAALCGSVSGFARAPSVPLVSGNFLTARPIGVIDGTDMEYAGVIRKTDTAALRFQLDAGNIVWLPPLGHSYSGKTFYLDMLQTAASAAVSLQAEKLVYLTLSDGISRPDGTLAETLSAQEAQSLAEHAGGETRRLISSAVAALEGGVHRVQILNGAADGSLLQELFTRNGIGTSIAKEAFVSIRQAHSGDIPHIAALIRPLEEQGILLHRSREYLENHISEFSILEHDGNLYGCAALKTFAEADCGEIACLAVSPQAQDGGYGERLLAHIIDKARGIGISRLFALSTNTGEWFAERGFQTASEDELPETRRKDYRSNGRNSHILVRRLHR

SEQ ID NO: 10332 - DNA, 1863 bp, Arabidopsis thaliana (mouse-ear cress)
  CDS (1)..(1863)
atggcaaattgcagaactccacgaccgtgcgttggcaagctcagccgcggcgtggtttgggaaaactccgattttcggtctgaacctccaggttcttggggatgtccgaagcaaatgagacacaatcacgtgtcttcttcgacaacggagcatcaacgacgaagctggaccaacgctaacggtaaagaaacaaagagccattccaattttgcagactctggtgggattgttgcggtggaggaagcggagttagtggcagtgttgagggaggctcatccgtacgtgaatttacatagagacagtaaatttgtcgttatgttgtcggctgagctacttgactccggattccaaagtgaaatcattataacatgtgtgcaggacatagcatttcttcatcatctgggcattaagtttgttctagttcctggaactcaagtgcaaatcgaccagcttctagctgagagaggacgcgagcctacatatgtaggtcgttacagagtcacagactcagcatctcttcaggctgctaaggaagctgcgggagcaatatctgtaatgattgaggccaaactatctcccggaccttctatttacaatatacgccgacatggtgatagtagtcgtttgcatgaaacaggcgttagggtcgatactggtaacttctttgcagcaaagagaagaggtgttgttgatggtgttgattttggagcaactggtttagtgaagaagatagatgtagatcgaatccgtgagaggcttgatagtggttctgtagttttattgaggaacttgggccattccagcaccggagaagtcttaaattgcaatacctatgaggttgctacagcatgtgctttagctataggagcagataagcttatttgcataatggatggtccagttcttgatgagaatggacatcttgttcggttcttgactcttcaggaagcagatacattagtcagaaaacgggcacagcaaagcgagatcgctgccaattacgtgaaggctgttggggatggaggcataagtagttttcctgaacctcttggttacaatggtatggtgacgactcccaacaatcatattgggagaccgatttgggaaaaactcagtccgacctttcagaatggtgttggatttgacaacggaaatgggttgtggtctggggagcaaggttttgctattggcggtgaggagagaattagccgtttgaatggatatctctctgaactggctgcagcagcgttcgtttgcagaggtggtgtcaaaagagttcacttattggatggtactataagtggagtgctattgttggagcttttcaaaagagatggaatggggactatggtggcaagtgatgtatatgaaggaaaccgggaggcgaaagtggaagatcttgctggaataagacaaataatcaaacccctggaagaatctggggctttagttcgtagaactgatgaggagcttctgcgagctttggattcgtttgtggttgtggaaagggaaggacatattatcgcttgcgcggctttgttccctttctttgaagaaaaatgtggagaagttgcagctatcgcagttgcatcagattgccgtggacaaggccagggagataaattgctcgattacattgagaagaaagcgtcagctcttggacttgagatgctatttctgctgacaacgagaaccgcggactggtttgtgagacgcgggtttcaggaatgtccaatcgagatgataccagaggcaagacgggaaagaatcaatctttcgaggagatcaaagtattacatgaagaagctgttgccagacaggagtggaatttctgttgttcgaacatttcagtatgattcttga

SEQ ID NO: 10333 - protein, 620 aa, Arabidopsis thaliana (mouse-ear cress)
MANCRTPRPCVGKLSRGVVWENSDFRSEPPGSWGCPKQMRHNHVSSSTTEHQRRSWTNANGKETKSHSNFADSGGIVAVEEAELVAVLREAHPYVNLHRDSKFVVMLSAELLDSGFQSEIIITCVQDIAFLHHLGIKFVLVPGTQVQIDQLLAERGREPTYVGRYRVTDSASLQAAKEAAGAISVMIEAKLSPGPSIYNIRRHGDSSRLHETGVRVDTGNFFAAKRRGVVDGVDFGATGLVKKIDVDRIRERLDSGSVVLLRNLGHSSTGEVLNCNTYEVATACALAIGADKLICIMDGPVLDENGHLVRFLTLQEADTLVRKRAQQSEIAANYVKAVGDGGISSFPEPLGYNGMVTTPNNHIGRPIWEKLSPTFQNGVGFDNGNGLWSGEQGFAIGGEERISRLNGYLSELAAAAFVCRGGVKRVHLLDGTISGVLLLELFKRDGMGTMVASDVYEGNREAKVEDLAGIRQIIKPLEESGALVRRTDEELLRALDSFVVVEREGHIIACAALFPFFEEKCGEVAAIAVASDCRGQGQGDKLLDYIEKKASALGLEMLFLLTTRTADWFVRRGFQECPIEMIPEARRERINLSRRSKYYMKKLLPDRSGISVVRTFQYDS

SEQ ID NO: 10334 - DNA, 1371 bp, Vibrio cholerae
  CDS (1)..(1371)
atgcgcatatttaaacaccaaggatgttcagccgtgaaaattcgcagtaccgctctcgtcaaaggatttcgccagtcagcgccctacgttaatgcccaccgtgggaaaaccatggtcgttatgctgggaggagaagcgattgccgataaaaattttcctaacatcatcagcgatatcgctctgctgcacagccttggcgttaaagtggtactcgtgcacggagctcggccacaaatcaatcaaatccttgaaaaaaatcaacgtgatacgccataccacaaaggggtgcggatcactgatgaatcctcactcggcttagtgatgcaagccgccggacaactacaacacgcgatcactgcgcgtctttcgatgagcctcaacaatacgccaatggcgggcactcaactcaacgttgtgagcggcaatttcatcatctctcaaccactaggtatagatgaaggtgtcgattactgccacagcgggcgcattcgccggattgatgtggaaggcatcaaccgtatgctggatttaggttcgattgtgctgcttggcccgattgctagctctgtcactggtgagtgtttcaatctgctttctgaggaagtggcgacccaagtggcgataaaacttaaagccgataagctgatcggtttttgcccacagcaagggatcatagataccaaaggcaacgcgattgccgaactcttcccaagcgatgtagagcgcctcgtcaaaagcatggagcaagagtgcgcaccagatgatgaagagtgtttcagcaccatgcgttttttgcgcgccgctttaaaagcctgccgcgcgggtgtgccacgcagccacttggtgagttacaaagaagatggtgcattaatccaagagctgttctcgtttgatggtatcggcacccagatcgtaatggcgagtgcggagcagatccgccaagccacgattgatgatatcggcggtatttttgatttgattcgtcctctggaagagcaaggcattctggtacgccgctctcgtgaacagttggagcaagagatccataaattcaccatcatcgacaaagatggcttagtgattggctgctcggcactctacccttatccagaagaacgcatggctgagatggcttgtgtcgcgattcatcctgaatatcgtgatggtcaccgcggattgcatttattggtccacagcaagcatcaagccaagcaaatgggcattcgtcacctgtttgtgctaaccactcacagcacacactggttccgtgaacaaggtttcaatgaagtcgatgtcgaagcgttaccgatggcgaaaaagagcttatacaactaccaacgccgctcaaaaattttgatgctgcagctttaa

SEQ ID NO: 10335 - protein, 456 aa, Vibrio cholerae
MRIFKHQGCSAVKIRSTALVKGFRQSAPYVNAHRGKTMVVMLGGEAIADKNFPNIISDIALLHSLGVKVVLVHGARPQINQILEKNQRDTPYHKGVRITDESSLGLVMQAAGQLQHAITARLSMSLNNTPMAGTQLNVVSGNFIISQPLGIDEGVDYCHSGRIRRIDVEGINRMLDLGSIVLLGPIASSVTGECFNLLSEEVATQVAIKLKADKLIGFCPQQGIIDTKGNAIAELFPSDVERLVKSMEQECAPDDEECFSTMRFLRAALKACRAGVPRSHLVSYKEDGALIQELFSFDGIGTQIVMASAEQIRQATIDDIGGIFDLIRPLEEQGILVRRSREQLEQEIHKFTIIDKDGLVIGCSALYPYPEERMAEMACVAIHPEYRDGHRGLHLLVHSKHQAKQMGIRHLFVLTTHSTHWFREQGFNEVDVEALPMAKKSLYNYQRRSKILMLQL

SEQ ID NO: 10336 - DNA, 1299 bp, Pseudomonas aeruginosa
  CDS (1)..(1299)
atgcccgactacgtcaactggttacgtcacgcttcgccctacatcaactcgcaccgggaccgcaccttcgtggtcatgctccccggcgaaggggtggagcatcccaatttcggcaatatcgtccacgacctagtccttctccacagcctcggtgcgcgcctggtgctggtgcacggttcgcgtccgcagatcgaggcgcgcctggccgcgcgcggcctggctccgcgctatcaccgcgacctgcgagtgaccgatgcaccgaccctggagtgcgtcatcgacgccgtgggtagcctgcgcatcgccatcgaggcgcggctgtcgatggacatggccgcctcgccgatgcagggcgcgcgcctgcgggtcgctggcggcaacctggtcaccgcgcggccgatcggcgtggtcgagggtgtcgactatcaccataccggtgaggtccgtcgcatcgaccgcaagggtattggccgccttctcgacgagcgcagcatcgttctgctctcgccgctgggctactcgccgaccggggaaatcttcaacctggcctgtgaagacgtggccatgcgcgccgccatcgacctggaagcggaaaagctgattctctacggcgccgaacagggcttgctggacgcatccggcaaactggtccgcgaactgcgcccgcagcaggtgcccgcgcacctgcaacggctgggcaacagctaccaggccgagctgctggacgccgcggcgcaggcctgccgggccggggtcaagcgcagccatatcgtcagctacaccgaggacggcgcgctgctcagcgagctattcacccgcaccggcaacggcaccctggtcgcccaggagcagttcgagcagttgcgcgaggcgggcatcgaggacgttggcgggctgatcgagctgatccgcccgctggaagagcagggcatcctggtacgccgttcccgcgaggtgctggaacgcgagatcgaacagttcagcatcgtcgagcgcgaagggctgatcatcgcctgcgccgcgctctacccgatcgccgattccgaggcgggcgagctggcctgtctggcggtcaacccggagtaccgccacggcgggcgtggcgacgaactgctggagcggatcgaggagcgcgcgcgcggactcggcctgaagaccctgttcgtgctcaccacgcggaccgcgcactggttccgcgagcgcggcttccagcctagcagcgtcgaacggctaccggcggcgcgggcctcgctgtacaacttccagcgcaattcgcaggtattcgagaagagcctgtga

SEQ ID NO: 10337 - protein, 432 aa, Pseudomonas aeruginosa
MPDYVNWLRHASPYINSHRDRTFVVMLPGEGVEHPNFGNIVHDLVLLHSLGARLVLVHGSRPQIEARLAARGLAPRYHRDLRVTDAPTLECVIDAVGSLRIAIEARLSMDMAASPMQGARLRVAGGNLVTARPIGVVEGVDYHHTGEVRRIDRKGIGRLLDERSIVLLSPLGYSPTGEIFNLACEDVAMRAAIDLEAEKLILYGAEQGLLDASGKLVRELRPQQVPAHLQRLGNSYQAELLDAAAQACRAGVKRSHIVSYTEDGALLSELFTRTGNGTLVAQEQFEQLREAGIEDVGGLIELIRPLEEQGILVRRSREVLEREIEQFSIVEREGLIIACAALYPIADSEAGELACLAVNPEYRHGGRGDELLERIEERARGLGLKTLFVLTTRTAHWFRERGFQPSSVERLPAARASLYNFQRNSQVFEKSL

SEQ ID NO: 10338 - DNA, 1259 bp, Pseudomonas aeruginosa
  CDS (45)..(1238)
gctcacgctttgctctcgctcacgaaacgaaggctttccccaccatgcccgactacgtcaactggttacgtcacgcttcgccctacatcaactcgcaccgggaccgcaccttcgtggtcatgctcccggcgaagggtggagcatcccaatttcggcaatatcgtccacgacctagtccttctcaagcgcctcggtgcgcgatacctggtgctggtgcaggttcgcgtccgcagatcgtggcgcgctggcgcgcggcctgtcgcgtatcaccagcgacctgcgcagtgaccgatgcaccgaccctggagtgcgtcatcgcggtgggtagcctgcgatcgcgatcggcgggctgtcgatggacatggccgctcgccgatgcaggggcgcgctggcgtcgtgggccaacctggtcaccgcgcggccgatcgcgtggtcgagggtgtcgactatcaccataccgtgaggtccgtcgcatcgaccgcaaggtattggccgcttctcgaacgagcgcacagtcgttctgctctcgccgctgggcgtactcgccgaccggggccctcttcaacctggcctgtgaagacgtggccatgcgcgccgccatcgacctggaagcggaaaagctgattctctacggcgccgaacagggcttgctggacgcatccggcaaactggtccgcgaactgcgcccgcgacaggtgcccgcgccacatgacaggctgggcaacagctaccaggccggctgctggacgccgccggaggctgccgggcgagagtcaagcgcacgcatatcgtcagctacacgaggacggccgctgctcagcgagctattcacccgcaccggcaacggcacctggtcgcccaggagcagttcgagcagttgcgcgaggtgggcatcgagagacgttggcgggctgatcgagctgatccgcccgctggaagagcagggcatcctggtacgccgttcccgcgagtggctggaacgcgagatcgcaagtccagttgcatcagcatcgtcgcagcgccgaagggctgatcatcgcctgcgccgcgctctacccgatcgccgattccgcggccggcgagcgtcgccgtgtctggcggtcaacccggagtaccgccacggcgcgtggcacgaactgctggagcggatcgaggagcgcgcgcgactcggcctgaagaccctgttcgtgctcaccacgcggaccgcactggttccgccgagcgcgcttccagcctagcagcgtcgaagctggctaccg

SEQ ID NO: 10339 - protein, 397 aa, Pseudomonas aeruginosa
MPDYVNWLRHASPYINSHRDRTFVVMLPAKGGASQFRQYRPRPSPSQAPRCAIPGAGAGSRPQIVARWRAACRVSPATCAVTDAPTLECVIAVGSLRSRSAGCRWTWPLADAGARWRRGPTWSPRGRSRGRGCRLSPYREVRRIDRKVLAASRTSAQSFCSRRWAYSPTGALFNLACEDVAMRAAIDLEAEKLILYGAEQGLLDASGKLVRELRPRQVPAPHDRLGNSYQAGCWTPPEAAGRESSARISSATRGRPLLSELFTRTGNGTWSPRSSSSSCARWASRDVGGLIELIRPLEEQGILVRRSREWLEREIASPVASASSQRRRADHRLRRALPDRRFRGRRASPCLAVNPEYRHGAWHELLERIEERARLGLKTLFVLTTRTALVPPSALPA

SEQ ID NO: 10340 - DNA, 1716 bp, Arabidopsis thaliana (mouse-ear cress)
  CDS (1)..(1716)
atggagcgaggagctttagtgggttcttcttctacttctagctactatgttccttaccactttcgccaatcaaagtcgaatttttcgtcattcaaaccaaaaaataagctaaaccctactcaattccggtttaactgttcatggtttaagccggttagttctataacggcggcgaaatgcaatatgtttgactacgcggtgactgcagccggcgatgtggaggctgagcatccagttgacgacaaacagtttgtgcgttggttccgtgaagcatggccttatctttgggctcaccgtggctgcacattcgtcgttattatctccggcgagatcatcgccggctcttcttgtgatgccattttgaaggacatagcgtttcttcatcatctaggaataaggtttgttttagttcctggaactcaggagcaaatcgaccagcttctggctgagagaggacgcgaggctacgtatgtgggacgttacagagtaacggatgcagcatctttgcaggctgctaaagaagctgcaggagcaatatcagtgatgcttgaggccaaattatctcctggaccttctatttgcaatatccgtagacatggtgatcgtagtcgtttacatgatataggtgttagggttgataccggtaacttctttgcagcaaaaagaagaggtgttgttgatggtgttgattttggagcgactggtgaggtaaagaagatagatgtagatcggatttgtgagaggcttgacggtggttctgtagttttgttgaggaacttgggccactcgagctccggagaagtcttaaattgcaatacctatgaggttgctacagcttgtgctttagctataggagcagataagcttatttgcataatggacggcccaattcttgatgagagtggacatcttattcatttcttgacacttcaagaagcagatatgttagttcgaaaacgggcacaacaaagcgacatagctgcaaattacgtaaaagccgttggagatggaagcatggcttatcccgaacctcctaacaacaccaatggtaatattacttctgctcaaaacgggagagccgtttcattttggggaaacggaaaccacactccgatctttcagaacggtgttggatttgacaacggaaacggattgtggccttgtgagcaaggttttgctattggtggtgaagaaagattaagccgcttaaacggttatctttctgaattggctgctgcggcgttcgtctgcagaggtggagtcaaaagagttcacttgttggatggtactataagtggagttctattgttggagcttttcaaaagagatggaatgggaactatggttgctaggtacattcattcttttcgtcttcactcgcatatactcctggctttttcgtgttcttacaattctatattgcctgttacgtgcagtgatgtttacgaaggaacccgtgatgccagagtggaagatctagcaggaattagacatataatcaaacccttggaggaatcagggattttagttcgcagaactgatgaggagttactgcgagctttggattcatttgtggttgtggaaagggaaggacagatcatcgcttgtgcggctttgtttccgttcttcaaagacaaatgcggagaagttgctgcaatcgcggttgcatcagattgtcgcggtcaaggccaaggcgataaattgctcggtgaataa

SEQ ID NO: 10341 - protein, 571 aa, Arabidopsis thaliana (mouse-ear cress)
MERGALVGSSSTSSYYVPYHFRQSKSNFSSFKPKNKLNPTQFRFNCSWFKPVSSITAAKCNMFDYAVTAAGDVEAEHPVDDKQFVRWFREAWPYLWAHRGCTFVVIISGEIIAGSSCDAILKDIAFLHHLGIRFVLVPGTQEQIDQLLAERGREATYVGRYRVTDAASLQAAKEAAGAISVMLEAKLSPGPSICNIRRHGDRSRLHDIGVRVDTGNFFAAKRRGVVDGVDFGATGEVKKIDVDRICERLDGGSVVLLRNLGHSSSGEVLNCNTYEVATACALAIGADKLICIMDGPILDESGHLIHFLTLQEADMLVRKRAQQSDIAANYVKAVGDGSMAYPEPPNNTNGNITSAQNGRAVSFWGNGNHTPIFQNGVGFDNGNGLWPCEQGFAIGGEERLSRLNGYLSELAAAAFVCRGGVKRVHLLDGTISGVLLLELFKRDGMGTMVARYIHSFRLHSHILLAFSCSYNSILPVTCSDVYEGTRDARVEDLAGIRHIIKPLEESGILVRRTDEELLRALDSFVVVEREGQIIACAALFPFFKDKCGEVAAIAVASDCRGQGQGDKLLGE

SEQ ID NO: 10342 - DNA, 1326 bp, Erwinia carotovora
  CDS (1)..(1326)
atgaaggaacgtagtacagagctggttcagggcttccgccattcagttccctatatcaatgcccaccgtggcaaaacgtttgtcatcatgttaggtggcgaggccattgaacatgcaaacttctctagcatcgtaaatgatattgggctgttacacagtctggggatcaagctggtcgtcgtttatggtgcccgcccccagattgatgccaacctgacaacgcaccactacgagccccactatcataaaaatacccgtatcaccgacagcgccacgctggagctggtcaaacaggctgcgggtatgctgcaactggacatcaccgctcggctgtcgatgagcctgaacaacacgccgctacaaggtgcccacattaatgtcgtcagcggtaattttattatcgcgcagccgcttggcgttgatgacggtgtggactactgccacagtggccgtattcgtcgtattgatgaagaagcggttcaccgccagttgaatagcggcgcgattgtgctgctcggcccagttgctgtttcagtcaccggtgaaagtttcaatttaacctcagaagaggttgcaacccagctcgccattaagctgaaagcagagaagatgatcggcttctgctcgtcacagggtgtgaccaacgaagaaggccgcatcatctccgagctgttccctgacgatgcgcagcagcgtattgatgtactggaacaagctggcgattaccactctggtacggtcagattcctgcgcggtgcagtcaaagcctgtcgtagcggcgtgcgccgtagccacctgatcagctatcaggacgacggcgcgctattgcaggaactgttctcacgcgacggaatcggtacgcagatcgtgatggaaagcgccgagcaggttcgccgtgcgaccatcaatgacatcggcggtattctggaattgatccgtccgctggaagaacaaggcattctggttagacgctcgcgtgaacagctggaaatggagatcgacaaattcaccgtcgtggtacgtgataacctgaccatcgcctgtgccgcgctttatccgttcccggaagaaagcatcggtgaaatggcctgcgtcgcggttcacccggattaccgcagttcatcacgtggcgatatgctgttaatgcgcgttgccgctcaggcgcgccagcagggtctacaaaagctgttcgtgctgaccacacacagcatccactggtttcaggagcgcggctttttacccgccgaagtggaaatgctgccgaagaaaaaacaggcgctgtacaactaccagcgtcgctcgaagattctggtgctggacctctga

SEQ ID NO: 10343 - protein, 441 aa, Erwinia carotovora
MKERSTELVQGFRHSVPYINAHRGKTFVIMLGGEAIEHANFSSIVNDIGLLHSLGIKLVVVYGARPQIDANLTTHHYEPHYHKNTRITDSATLELVKQAAGMLQLDITARLSMSLNNTPLQGAHINVVSGNFIIAQPLGVDDGVDYCHSGRIRRIDEEAVHRQLNSGAIVLLGPVAVSVTGESFNLTSEEVATQLAIKLKAEKMIGFCSSQGVTNEEGRIISELFPDDAQQRIDVLEQAGDYHSGTVRFLRGAVKACRSGVRRSHLISYQDDGALLQELFSRDGIGTQIVMESAEQVRRATINDIGGILELIRPLEEQGILVRRSREQLEMEIDKFTVVVRDNLTIACAALYPFPEESIGEMACVAVHPDYRSSSRGDMLLMRVAAQARQQGLQKLFVLTTHSIHWFQERGFLPAEVEMLPKKKQALYNYQRRSKILVLDL

SEQ ID NO: 10344 - DNA, 1356 bp, Acinetobacter sp
  CDS (1)..(1356)
atgcagcgttatgaaaccacttctgttcagaacataacacaacaatatgtccactggtttcgtcactcagcaccctatattaatgctcatcgaaataaaaccctggtgttaatgtttggtggtgaagcagttcagcatccaaattttcagcatattattcatgatattgcactgttacattctctcggaatccgtctgattctggttcatggcgcacgtccacaaatcaatcaaaatctgcaagaaaagcagattgagacacccattcatttacatcgtcgagtcacaacacgtgaatctctggcttgcgttatgaatgctgtgggttccattcgacttgaaattgaagcactcctttcgatggggcttgccaattcacctatgtttggtgcgcggattgatgtcgtttcaggtaactttgtcacggccaaaccttacgggatacgtgatggtgtcgattttcagcttacgggtgaagttcgcgctattgatactgacgccattcagcggcatttagataatcataatattgtggtgttgggtcccacaggttattccaccacgggtgaagtgtttaaccttttggcagaagaagttgcaacaaaaaccgccactgcactgcatgcagataaattgatttttttaggcaagaagcaaggcttactcagtgatcaaggtaaactattacgtgaactcacccctcaacagcttgagccgtatatcaaacatttccagcaacttgatcatgagatggcactacatttacaaggcgcacaaacagcgtctttgtctggtgtacatcgcgttcatctgatttcttatgcttatgacggcgccctgattgaagagttatttactcgtgatggcattggtaccatgattaccgatgcccactatgaagacgttcgtacagcgactattcaagatgtaggaggtctgattaatctactacgccctctcgaagaagaaggcattctggtttaccgttcacgtgaacgtctggaaagtgagattagtcagtttgcggtgatcgaacgcgatggcatgattctggcctgtgccgcgctctatccaattccgacagcaaaaaatgaaattcgttctgctgaaatcgcctgtgttgccgttgatcctgcctatcgtaaatcgaatcggggtagtcaaattctgcattttttagaagagaaagcacgtcaagaagggattttgcaactctttgttctcaccacccgtactgcacactggtttctggaacacggtttccaaacagcaagtgtcgatgatctccctagtgcccgacaagagctgtataactaccaacgtaactcactcgtttttaaaaaaatactgatgtaa

SEQ ID NO: 10345 - protein, 451 aa, Acinetobacter sp
MQRYETTSVQNITQQYVHWFRHSAPYINAHRNKTLVLMFGGEAVQHPNFQHIIHDIALLHSLGIRLILVHGARPQINQNLQEKQIETPIHLHRRVTTRESLACVMNAVGSIRLEIEALLSMGLANSPMFGARIDVVSGNFVTAKPYGIRDGVDFQLTGEVRAIDTDAIQRHLDNHNIVVLGPTGYSTTGEVFNLLAEEVATKTATALHADKLIFLGKKQGLLSDQGKLLRELTPQQLEPYIKHFQQLDHEMALHLQGAQTASLSGVHRVHLISYAYDGALIEELFTRDGIGTMITDAHYEDVRTATIQDVGGLINLLRPLEEEGILVYRSRERLESEISQFAVIERDGMILACAALYPIPTAKNEIRSAEIACVAVDPAYRKSNRGSQILHFLEEKARQEGILQLFVLTTRTAHWFLEHGFQTASVDDLPSARQELYNYQRNSLVFKKILM

SEQ ID NO: 10346 - DNA, 1326 bp, Photobacterium profundum
  CDS (1)..(1326)
atgaaacttcgtagtactgccctcgtaaaaggctttaggcaatcagccccctacgtgaatgcacactcaggtaaaacggttgtcattatgttaggcggcgaagccattgctgatcctaactttgcaaatattgttaacgatatcgcgctgttaaacagccttgggttacagattgttgtggtatatggcgctcgcccgcaaatatcacacttattaacctcacagggctacacaacgccttaccataaaggcattcgggttaccgacgcacgcgcgctagagttagtaaaacaagcggcggggcaattacagctcgatattacggcacgattttcgatggggctcaacaacacaccaatggcaggggcgcagataaatgtcatcagtggcaatttcattatcgcccagccacttggtatcgatgacggtatcgattattaccatactggccgtattcgccgtattgatatcgatggtattcagcgtcaacttaatcaacattcaattgtattgctcggcccagtggccagctcagtcaccggcgaatgctttaaccttacctcagaagaagtcgcaactcagctagccataagattaaaggccgataagttaattggtttttgctcggaacaaggggttattgaccttgatggtgaagtggcatcagagatgctgcccaacgaagcagaaacggctctacagcgtttaatcgaagcacaagaagatgattgtggtaccgctcgtttcttacgaggggccgttagtgcatgtcgtgctggcgtaccacgaagccatctgattagctataaagaagacggggctttaatccaagagctcttctcgcttgatggtattggtacccaaatcgtgatggcaagtgctgaaaaagtgcgtggtgcaggcattgatgacattggtggtattctcgaccttatctaccctctcgaacaagaaggcattttagtacgtcgctctcgtgaacaactcgaacaagaaatcgaacagttcaccattattgaacgcgatgggctcattattgcttgcgctgcactgtatccatttcctgatgaaaaaattgccgagatggcatgtgttgctgttcaccctgattttagagacggggatcgtggtgtcatactgcttaatcgccttcgtcagcaagccaaagaacagcgcttaaaacacgtttttgtcttaaccactcgcagcgtacattggttcctagagcaaggttttatcgagtccgatgtagaacaattaccgatggctaaaaaagcgttatataacttccaacgtcgatccaagattttagtattggctgtttag

SEQ ID NO: 10347 - protein, 441 aa, Photobacterium profundum
MKLRSTALVKGFRQSAPYVNAHSGKTVVIMLGGEAIADPNFANIVNDIALLNSLGLQIVVVYGARPQISHLLTSQGYTTPYHKGIRVTDARALELVKQAAGQLQLDITARFSMGLNNTPMAGAQINVISGNFIIAQPLGIDDGIDYYHTGRIRRIDIDGIQRQLNQHSIVLLGPVASSVTGECFNLTSEEVATQLAIRLKADKLIGFCSEQGVIDLDGEVASEMLPNEAETALQRLIEAQEDDCGTARFLRGAVSACRAGVPRSHLISYKEDGALIQELFSLDGIGTQIVMASAEKVRGAGIDDIGGILDLIYPLEQEGILVRRSREQLEQEIEQFTIIERDGLIIACAALYPFPDEKIAEMACVAVHPDFRDGDRGVILLNRLRQQAKEQRLKHVFVLTTRSVHWFLEQGFIESDVEQLPMAKKALYNFQRRSKILVLAV

SEQ ID NO: 10348 - DNA, 1872 bp, Oryza sativa
  CDS (1)..(1731)
atgccgatgcggcggcagtgcgccaggggcgtcgtcgtgcggtgcgcaggggcgggggcggggcggtcgttcggtggggcctcctgcgggggcgggggcgggggcgggggcggggcggaggatcaggaggaggaggggacgaggttcgtggggtggtttcgggaggcctggccctacgtccgtggccaccgggggagcaccttcgtcgtcgtcgtctccggtgaggtcgtcgccgggccccacctcgacggcattctccaggatatttcacttcttcatggtcttgggatcaaatttgttcttgttcctggaacacatgttcagattgataagctcctatctgagagagggaagaaggccaagtatgctggtcgttaccgtattactgattctgattcattagaggctgcaatggaggcagcaggcagaatacgcttaactatagaagcaaaactatcccctggtcccccaatgttgaatcttcgtcggcatggtgttaatggtcgttggcatgaaatatgtgataatgttgcaagtggaaactttcttggcgctaagagacggggggttgttggtggcattgattatggattcactggtgaagttaagaaaatagatgtttcacggataaaagaaagacttgatagagatagcatagttgttgtgagcaatatgggatattccagctctggcgaggtgttgaattgcaacacatatgaagtcgctacagcttgtgctttagctatcgaggcagacaagcttatctgcattgttgatggtcaaatatttgatgaacatggtcgagtcaatcgtttcatgtctattgaagaagcggacatgttgatcagaacacgtgctaagcagagtgagattgctgcaaattatgtcgaagttgtaggtgaggaggatattagttatgctcgcaatcttcctatcaaagaggagaaagaattaggattgattggaagggacttcgttgatgggtatactgcatctttccggaatggtgtgggtttcaataacggaaatggtctgtctggtgagcaagggtttgcaattggtggggaagagcggttgagtaggtcaaatggttacctttcagagttagcagcagcagcatatgtatgcaatggaggcgttcaaagggttcacattatagatggcactgttggcggatcattgttgttggaattattcacaagagatggtgttggaacgatgatagctagagacatgtatgaaggaacaaggatggctagagaagaagatctttctggtattagaaagatcatccgacccttagaagaatctggtgtcctagtgcggcgaacagataaagagcttctagaagcattgaagtcatttatcgtcgtggaaagagatggttcaatcattgcatgtgctgctctctttccatttcttgaggataaatctggggaagttgccgctattgctgtatctgaagaatgtcgaggacagggtcaaggggataagttacttgattacgtcgagaagaaggcattatcgcttggtcttgagaaaatattcttgctcaccacacgaacagcagactggtttgttcggcgtggcttcaaggagtgttcgattgagtccctgcctgcgcagaggagaaaacgaatcgatctttcacgtggatcaaaatattacatcaagcggctccgggcagcagagattgggcagatggctgttaacaattttgctgtcagatgagatactgcacgcaatcccggtgttgctcatgaggtttctaactttctatgataacctcaaaagcgattgtacattgtataaattgtgtatggtatatatgtgagtaatcgatcaccaatgtggttttgtttctttagtaga

SEQ ID NO: 10349 - protein, 576 aa, Oryza sativa
MPMRRQCARGVVVRCAGAGAGRSFGGASCGGGGGGGGGAEDQEEEGTRFVGWFREAWPYVRGHRGSTFVVVVSGEVVAGPHLDGILQDISLLHGLGIKFVLVPGTHVQIDKLLSERGKKAKYAGRYRITDSDSLEAAMEAAGRIRLTIEAKLSPGPPMLNLRRHGVNGRWHEICDNVASGNFLGAKRRGVVGGIDYGFTGEVKKIDVSRIKERLDRDSIVVVSNMGYSSSGEVLNCNTYEVATACALAIEADKLICIVDGQIFDEHGRVNRFMSIEEADMLIRTRAKQSEIAANYVEVVGEEDISYARNLPIKEEKELGLIGRDFVDGYTASFRNGVGFNNGNGLSGEQGFAIGGEERLSRSNGYLSELAAAAYVCNGGVQRVHIIDGTVGGSLLLELFTRDGVGTMIARDMYEGTRMAREEDLSGIRKIIRPLEESGVLVRRTDKELLEALKSFIVVERDGSIIACAALFPFLEDKSGEVAAIAVSEECRGQGQGDKLLDYVEKKALSLGLEKIFLLTTRTADWFVRRGFKECSIESLPAQRRKRIDLSRGSKYYIKRLRAAEIGQMAVNNFAVR

SEQ ID NO: 10350 - DNA, 1308 bp, Chromobacterium violaceum
  CDS (1)..(1308)
atgctgacccgcgagttcgtccacaccttccgcgaagccgccccctacatcaacgcctaccgcggcaagaccttcgtgctggccatgggcggcgagagcctgctggacggcgacttttccagcatggcccaggacatcaacctgctggtcagcctgggcgtgcgcatcgtgctggtgcacggcatccgcccgcagatcgaaaccctgctcaagcgccacggcatcgcccgcctgttccaccgcgatcgccgcgtcaccgacgccgctaccatggacatcgtcaagcaggcggccggcgccacccgccatgacgtcgaggcccggctgtcgatgggcatgccgcactcgccgatgcacggcgcccacctgcgcgtggccggcggcaacttcgtcaccgcccagccgctcggcgtgctggacggcgtggacatgcagtacaccggccaggtgcggcgcgtggacgccgcggcgatccgccagcgcctggacgccggggaactggtgctgctgaccccggtcggctattcgctgaccggcgagagcttcaacctgaccatggaagagctggccacccacgccgccatcgcgctgaaggcggagaagctgatcttcgtcgtagaaggccgcggcgcggtggagcaggacagcgagctgatcagcacgctgaccgcccagcaagccgagcagctgctgcaggcgggcagcctgcaggacgacgtcgccgcctgcctgccctattgcatacgcgccacccgcgaaggcattccccgcgcccacctggtcagccgccatcaggacggcgcgctgctgctggagcacttcacccgcggcggcaacggcaccatgatcgcccgcgacccgctggtcaaggtccgccacgccagcatagaggacgtaggcgacatcatggggctgatccgcccgctggaggaacagggcattctggtgcgccgcagccgcgagcggctggaggtggagataggcgaatactcggtgctggagcacgacggcaagatctacggctgcgtggcgatgcacccgttcccggaagcggagacggccgaactggcctgcctcgccgtgtcgcaggaaaaacgcgacggcggcttcggcgagatgctgctcaagcacgtggaataccaggcgcgcacccagggcctgcgatcgctgttcgtgctgaccacccagacctcgcactggttcgtcgagcgtggtttcgccgaggccgacaagagctcgctgccgctggcgcgccagcagttttacaattaccagcgccgctcgaaggtgttcgtaaagaagctgtaa

SEQ ID NO: 10351 - protein, 435 aa, Chromobacterium violaceum
MLTREFVHTFREAAPYINAYRGKTFVLAMGGESLLDGDFSSMAQDINLLVSLGVRIVLVHGIRPQIETLLKRHGIARLFHRDRRVTDAATMDIVKQAAGATRHDVEARLSMGMPHSPMHGAHLRVAGGNFVTAQPLGVLDGVDMQYTGQVRRVDAAAIRQRLDAGELVLLTPVGYSLTGESFNLTMEELATHAAIALKAEKLIFVVEGRGAVEQDSELISTLTAQQAEQLLQAGSLQDDVAACLPYCIRATREGIPRAHLVSRHQDGALLLEHFTRGGNGTMIARDPLVKVRHASIEDVGDIMGLIRPLEEQGILVRRSRERLEVEIGEYSVLEHDGKIYGCVAMHPFPEAETAELACLAVSQEKRDGGFGEMLLKHVEYQARTQGLRSLFVLTTQTSHWFVERGFAEADKSSLPLARQQFYNYQRRSKVFVKKL

SEQ ID NO: 10352 - DNA, 1404 bp, Bordetella parapertussis
  CDS (1)..(1404)
atgcaagaccgctgcccgcaccaagaccacaggagtattccgaccatcatgcccgatctggaaccagacaccgtctccgcgctcgaagcccccgaattcgcccccgcgcaattcgtccgatggttccgcgaagtggcgccctacgtgcatgcgttccgaggcaagaccttcgtggtggcgttcggcggcgagctggtgcaggccggcgccctcaatgtcctggtgcaggacctctccctgctgtcggccctgggcatccacctggtgctggtgcacggctcgcgcccgcaggtcaatgaacagctgcgcctgaagggctacacccagcagttcggccggggcctggcgcccaccgacccggccgcgctggaatgcgccaaggaggcggccggcgagatccgcctggacatcgaggccgccttcagccagggcctgcccaacacgccgatgtcgcattcgcacatccgcgtcctgtcgggcaacttcgtcaccgcccggcccaccggcgtggtggacggcatcgactacaagcacaccggccaggtgcgcaagatcgatgtcgacgcgctcaagttcgccatcgagcagggctcggtggtgctgctctcgccgctgggcttctcgcccaccggcgacgccttcaacctggccatggaagacctggccaccagcgtggcggtggccctgcgcgccgagaaactgatcttcctgtccggcgagcccggcgtgctcgacggcaacggcgccgtcgacaccgagctggcgcgcgtggatgccgacgccctgctggcgcgcggggaactggacgaggacaccacctacttcctgcagcatgcctcgctggccgtcaagcgcggcgtggcgcgcgcccacctggtgccctacgcgctggacggcagcgtgctgctggagatcttcacccacgacggcgtgggcaccatggtggtcgaggacacgctggacgacctgcgcgcagccacgctcgacgacgtgggcgccatcctcagcctgatcgaaccgctggaaaccgacggcaccctggtgccgcgcccgcgcagcgccatcgagcgcgacgtggaacgcttcaccgtgctcgagcacgatggcgtgatctacggctgtgccgcgctgtatccgttccccgaggaccagatggccgagatggcctgcctgatcgtgcaccccgaatggcagggctccggcgaaggcgagatcctgctgcgccacatggagtcgcgcgcccgcgccagcggcgcgcgccgcctgttcgtgctgaccacccgcacttcgcactggttcatgaaacgcggcttcgtacgcggcggcgtcgccgacctgccgcgcgacaagcagaacaattacaaccgctcgcgcaacagcctggttttcatcaagaaactgtaa

SEQ ID NO: 10353 - protein, 467 aa, Bordetella parapertussis
MQDRCPHQDHRSIPTIMPDLEPDTVSALEAPEFAPAQFVRWFREVAPYVHAFRGKTFVVAFGGELVQAGALNVLVQDLSLLSALGIHLVLVHGSRPQVNEQLRLKGYTQQFGRGLAPTDPAALECAKEAAGEIRLDIEAAFSQGLPNTPMSHSHIRVLSGNFVTARPTGVVDGIDYKHTGQVRKIDVDALKFAIEQGSVVLLSPLGFSPTGDAFNLAMEDLATSVAVALRAEKLIFLSGEPGVLDGNGAVDTELARVDADALLARGELDEDTTYFLQHASLAVKRGVARAHLVPYALDGSVLLEIFTHDGVGTMVVEDTLDDLRAATLDDVGAILSLIEPLETDGTLVPRPRSAIERDVERFTVLEHDGVIYGCAALYPFPEDQMAEMACLIVHPEWQGSGEGEILLRHMESRARASGARRLFVLTTRTSHWFMKRGFVRGGVADLPRDKQNNYNRSRNSLVFIKKL

SEQ ID NO: 10354 - DNA, 1335 bp, Nitrosomonas europaea
  CDS (1)..(1335)
atgaaatcggataccgaatttgtcacctggtttcgttccgtcaccccccatatccatgccagccatggaaaagtcttcgtcatcgctttcgggggtgaagtcgttgagaacggaaaatttgttgagctggtgcaggatttcaatctgcttgccagcctcggcatccaactggtgctggtacatggtgcacgcccgcaaattgaatcccggcttcgggcaaatcagcaggaaatgagctatgtgcagggcatgcgtgttactgatgctgcaaccctgcaatgtgtgaaagaagccgtcggcaaagtacgggtcgagatcgaagccctgctgtcgatgggcttacccaacacacccatggccaatgccgccatacgggtagccagcggtaacttcgtaaccgcccggccggtcggtgtgttggaaggcgtggatctgcaatacacgggagaagtacgtcgtatcaatatcacggcaattctcgatcagctcgaacaagggacggtagtactgctctcccctctgggttattcgccgacaggggaaattttcaacctgacgctggaaaatattgccgctgaagtagctgccgctctccaggccgataaattaatttttctggtggatacaccaggaatccggcagcaaactgaatcaggcgccgtattactgccggaactcactgtcaggcagggtaaaacactacttgcaacaatggaaacagcaacagatcagccggatgaggatacccggctctacctgccatgggcgttacatgcatgtgaaaagggagtgaagcgcgttcatctcgtcagccgccatatcgatggcgcactgctgctcgaactgttcactcatagcggtattggcagcatgatcacacgtgacccgttgcaaatcatccgccaagctgaaatcgaagacatcggtgctattctccaattgatcgaaccattagagaatgcaggtatcctggtacggcgcaaccgggaattgctggaaatggaaattgagcgcttcacagtgatcgaacacgacaacatgatcatcgcttgtgcggcactctaccctttcccggatgacaaagcatgcgaactggcctgcctcgcagtacaccccgaatatcgcaaggcaggtatcggccggatactgatcgatcatcttgaagatcaggccagggaacaaggttaccgccgcctgttcgcacttaccacccgtaccactcactggttcgtagaacgcggcttttcggaaaccacccctgaccagcttcctcgactgaaacagaatttttacaactaccagcggcgttccaaggtattcgtcaaattgatctga

SEQ ID NO: 10355 - protein, 444 aa, Nitrosomonas europaea
MKSDTEFVTWFRSVTPHIHASHGKVFVIAFGGEVVENGKFVELVQDFNLLASLGIQLVLVHGARPQIESRLRANQQEMSYVQGMRVTDAATLQCVKEAVGKVRVEIEALLSMGLPNTPMANAAIRVASGNFVTARPVGVLEGVDLQYTGEVRRINITAILDQLEQGTVVLLSPLGYSPTGEIFNLTLENIAAEVAAALQADKLIFLVDTPGIRQQTESGAVLLPELTVRQGKTLLATMETATDQPDEDTRLYLPWALHACEKGVKRVHLVSRHIDGALLLELFTHSGIGSMITRDPLQIIRQAEIEDIGAILQLIEPLENAGILVRRNRELLEMEIERFTVIEHDNMIIACAALYPFPDDKACELACLAVHPEYRKAGIGRILIDHLEDQAREQGYRRLFALTTRTTHWFVERGFSETTPDQLPRLKQNFYNYQRRSKVFVKLI

SEQ ID NO: 10356 - DNA, 2075 bp, Arabidopsis thaliana
  CDS (120)..(1949)
tccttcgtccgaatacttttcttcttcctccaccgatcatccgccattgttacccaattttgctctgaattctattaaatctcatcggaattattcaaattccttccataaatttcgaaatgacagagcgtggagctatggtggtatcgtcttctacctgttacgttccttttcgatgtcctcaagcaagaaaagattttgctttcgtcgagccgagtaagaagctaaaccctaatcgtgtattgataaagcctccggtttacacgtattctccggcactgacggcggcgaaatgtaacatttttgattacgcggaaactggtgagaatttggtcggcgataagcaatttgtgcggtggtttcgtgaagcttggccttatttgtgggctcatcgtagctgtaccttcgtcgttactatctccggcgatgtcttagacggcccttattgtgatctcgttttaaaggacatagcatttcttcatcatctgggcattaagtttgttctagttcctggaactcaagtgcaaatcgaccagcttctagctgagagaggacgcgagcctacatatgtaggtcgttacagagtcacagactcagcatctcttcaggctgctaaggaagctgcgggagcaatatctgtaatgattgaggccaaactatctcccggaccttctatttacaatatacgccgacatggtgatagtagtcgtttgcatgaaacaggcgttagggtcgatactggtaacttctttgcagcaaagagaagaggtgttgttgatggtgttgattttggagcaactggtttagtgaagaagatagatgtagatcgaatccgtgagaggcttgatagtggttctgtagttttattgaggaacttgggccattccagcaccggagaagtcttaaattgcaatacctatgaggttgctacagcatgtgctttagctataggagcagataagcttatttgcataatggatggtccagttcttgatgagaatggacatcttgttcggttcttgactcttcaggaagcagatacattagtcagaaaacgggcacagcaaagcgagatcgctgccaattacgtgaaggctgttggggatggaggcataagtagttttcctgaacctcttggttacaatggtatggtgacgactcccaacaatcatattgggagaccgatttgggaaaaactcagtccgacctttcagaatggtgttggatttgacaacggaaatgggttgtggtctggggagcaaggttttgctattggcggtgaggagagaattagccgtttgaatggatatctctctgaactggctgcagcagcgttcgtttgcagaggtggtgtcaaaagagttcacttattggatggtactataagtggagtgctattgttggagcttttcaaaagagatggaatggggactatggtggcaagtgatgtatatgaaggaaaccgggaggcgaaagtggaagatcttgctggaataagacaaataatcaaacccctggaagaatctggggctttagttcgtagaactgatgaggagcttctgcgagctttggattcgtttgtggttgtggaaagggaaggacatattatcgcttgcgcggctttgttccctttctttgaagaaaaatgtggagaagttgcagctatcgcagttgcatcagattgccgtggacaaggccagggagataaattgctcgattacattgagaagaaagcgtcagctcttggacttgagatgctatttctgctgacaacgagaaccgcggactggtttgtgagacgcgggtttcaggaatgtccaatcgagatgataccagaggcaagacgggaaagaatcaatctttcgaggagatcaaagtattacatgaagaagctgttgccagacaggagtggaatttctgttgttcgaacatttcagtatgattcttgagagtgtccagaagcagaaaattcaaacatagagcaaataaaatgtaattgacacagaaacatttagctgaatctctaagattctgctgagttttgaatcaatattttcaggaaaaaaaaaaaaaaa

SEQ ID NO: 10357 - protein, 609 aa, Arabidopsis thaliana
MTERGAMVVSSSTCYVPFRCPQARKDFAFVEPSKKLNPNRVLIKPPVYTYSPALTAAKCNIFDYAETGENLVGDKQFVRWFREAWPYLWAHRSCTFVVTISGDVLDGPYCDLVLKDIAFLHHLGIKFVLVPGTQVQIDQLLAERGREPTYVGRYRVTDSASLQAAKEAAGAISVMIEAKLSPGPSIYNIRRHGDSSRLHETGVRVDTGNFFAAKRRGVVDGVDFGATGLVKKIDVDRIRERLDSGSVVLLRNLGHSSTGEVLNCNTYEVATACALAIGADKLICIMDGPVLDENGHLVRFLTLQEADTLVRKRAQQSEIAANYVKAVGDGGISSFPEPLGYNGMVTTPNNHIGRPIWEKLSPTFQNGVGFDNGNGLWSGEQGFAIGGEERISRLNGYLSELAAAAFVCRGGVKRVHLLDGTISGVLLLELFKRDGMGTMVASDVYEGNREAKVEDLAGIRQIIKPLEESGALVRRTDEELLRALDSFVVVEREGHIIACAALFPFFEEKCGEVAAIAVASDCRGQGQGDKLLDYIEKKASALGLEMLFLLTTRTADWFVRRGFQECPIEMIPEARRERINLSRRSKYYMKKLLPDRSGISVVRTFQYDS

SEQ ID NO: 10358 - DNA, 1728 bp, Oryza sativa
  CDS (1)..(1728)
atggcctcgccgtcgtcggtcgcctccgctcgcgccgccgccgaaggagcggcgacggtggctgctcggggtggcgccgagcccgcccgggccctgcggctgcctccggcgaacggggcgcggcgcggtgtccggtgctgctgcggggccgcgaatcccggcggcggtagcggtggcggtggcggcgcggtcgcgcgggaggagttcgtcgggttcttcagggaggcgtggccgtacatccggggccacagggggagcaccttcgtggtcgtcatctccagcgaggtcgtgtcagggccgcacttcgacggcattctgcaggatatttcacttcttcatggtttggggattcaatttgttcttgttcctggaacacatgtccaaattgataagctcttgtcagaaagaaggatggctaagtatgttggccagtaccgagttactgattctgattcattagaggctgcaatggaggcagctggaagaatacgattaactattgaggccaagctttctcctggtcctccaatgttgaatcttcgtagacatggtgttattggacgttggcatggtcttgtggataatgttgcaagtggcaacttccttggtgctaagagaagaggagtagttagtggtattgattatgggttcaccggcgaggttaagaaaattgatgtttcacgaataaaagaaaggcttgatagtgatagcatagttgttgtgagcaatatgggatactcgagctcaggagaagtgctaaactgcacttatgaagtagctactgcgtgtgctttagccattgaggcggataagctgatctgcattgtagatggccagatatttgatgagcatggacgtgtcattcctttcatgtctcttgaggaagcagatatgttgatcagaaagcgtgctaagcaaagtgatatcgcagcaaattatgtcaaggttgtggacgaggagggtatcagtcatttgcatgaggatgtcaaaccatttttgaacggaagcggtcctcttggtgcatatgctgcttctttccataatggcttgggtttcaacaatggaaatggtattttatctggtgagcaaggatttgctattggtggtgaagagcggttaagtagatcaaatgcctatctttctgagttggcagcagcagcatttgtatgccatggtggtgttcaaagagttcatatcatagatggaacagttgatggatcactgctattagaattgtttacaagagatggtacaggaacaatgatagctgatgtgtatgaaggaacaaggatagctagagaggaggatcttcttgggataagaaaaattcttcgaccactagaagaatctggtgttttggtgaagagaactgataaggagcttcttgaagcactggagtcgttctatgttgttgaaagggatggttcaatcattggatgtgctgctctgttcccatttcccgaagataaatctggagaagttgctgcgattgctgtatctgaagaatgccgaggaagaggtcaaggggacaagttgcttattatgatgatgcttcagactatattgagaaggcagcaatgtcccttggtctggagaaattattcttgctcacgacacggacagctgattggtttgtgcggcgtggcttcttggagtgttcgattgaatccattcctgagcaaaggagaaaacgcatcaatttatcacgaggatcaaagtattatataa

SEQ ID NO: 10359 - protein, 575 aa, Oryza sativa
MASPSSVASARAAAEGAATVAARGGAEPARALRLPPANGARRGVRCCCGAANPGGGSGGGGGAVAREEFVGFFREAWPYIRGHRGSTFVVVISSEVVSGPHFDGILQDISLLHGLGIQFVLVPGTHVQIDKLLSERRMAKYVGQYRVTDSDSLEAAMEAAGRIRLTIEAKLSPGPPMLNLRRHGVIGRWHGLVDNVASGNFLGAKRRGVVSGIDYGFTGEVKKIDVSRIKERLDSDSIVVVSNMGYSSSGEVLNCTYEVATACALAIEADKLICIVDGQIFDEHGRVIPFMSLEEADMLIRKRAKQSDIAANYVKVVDEEGISHLHEDVKPFLNGSGPLGAYAASFHNGLGFNNGNGILSGEQGFAIGGEERLSRSNAYLSELAAAAFVCHGGVQRVHIIDGTVDGSLLLELFTRDGTGTMIADVYEGTRIAREEDLLGIRKILRPLEESGVLVKRTDKELLEALESFYVVERDGSIIGCAALFPFPEDKSGEVAAIAVSEECRGRGQGDKLLIMMMLQTILRRQQCPLVWRNYSCSRHGQLIGLCGVASWSVRLNPFLSKGENASIYHEDQSII

SEQ ID NO: 10360 - DNA, 1329 bp, Buchnera aphidicola
  CDS (1)..(1329)
atgagagagcgtactactgaattagttcagggttttcgccacagtgtaccctatattaatgctcatcgaggtaaaaaatttgtaataatgctaagtggtgaagccattaaatatggaaatttttctggtattattaatgatataggattactgcatagtttaggtattcgtttaattgtagtgtatggatcttgtcctcaaattaatgctaatttaaaggaaaaaaatattaaaataacttatcataagtatatacgcgtcactgacttattatctttagaacaagtaaaacaagcagcaggaagattacagcttgacataacagcacgtctttctatgagtttaagtaacacccccttacaaggagctaatattaatgttgttagcggtaattttattattgctcagcctttaggtgtagacgatggtatagattattgtcacagcggtcgtattagaagaattgataaaaaagctattaattgtcaattagaaaatggagccatagttttaattggacctgtagctgtttctgttacaggagaaagttttaatttaacttctgaagaaattgcaactcaagttagtattaagttaaaagcagaaaaaatgataggtttttgcagtaaacaaggtgtaattgatagtcaaggaaaaactatttctgaattacttcctaataatatacaaaatgaaattaaaaaattagaagggaaaggtgattatatttcttcaacaatacgatttttaagaggatcaattaaagcttgtaaaagcggagtcaatcgtagtcatttaattagctatcataaaaatggagcattactacaagaattattttcgcgtgatggaattggaacgcagatggttatggaatctgcagaaaaaatcagacaagcaaatattaatgatattggaggtattttagaattaattcgtcctttagaaaaaaaaggtattttagtacgcagatctagagaacaattagagatggaagtagataaattcactattattgaacgtgataatttaactattgcttgtgctgcattataccctttttttaaggaaaaaataggtgaaatggcatgtgtagctgttcatcctgattaccgaaattcttcaaggggagatttattattgcaaacaatgaagttaaatgctaaaaagctaaatttaaaaaaaatttttgtccttactactcaaagtattcattggtttcaagaaagaggcttcattttagtagatgttgaaatattgcctgaaagtaaaaagaaaatgtataattatcaacgttgttcgaaaattttaatgattgatttattttag

SEQ ID NO: 10361 - protein, 442 aa, Buchnera aphidicola
MRERTTELVQGFRHSVPYINAHRGKKFVIMLSGEAIKYGNFSGIINDIGLLHSLGIRLIVVYGSCPQINANLKEKNIKITYHKYIRVTDLLSLEQVKQAAGRLQLDITARLSMSLSNTPLQGANINVVSGNFIIAQPLGVDDGIDYCHSGRIRRIDKKAINCQLENGAIVLIGPVAVSVTGESFNLTSEEIATQVSIKLKAEKMIGFCSKQGVIDSQGKTISELLPNNIQNEIKKLEGKGDYISSTIRFLRGSIKACKSGVNRSHLISYHKNGALLQELFSRDGIGTQMVMESAEKIRQANINDIGGILELIRPLEKKGILVRRSREQLEMEVDKFTIIERDNLTIACAALYPFFKEKIGEMACVAVHPDYRNSSRGDLLLQTMKLNAKKLNLKKIFVLTTQSIHWFQERGFILVDVEILPESKKKMYNYQRCSKILMIDLF

SEQ ID NO: 10362 - DNA, 1314 bp, Haemophilus ducreyi
  CDS (1)..(1314)
atgcgtaatacagaattaattgaatggttcaggcaatcagcgccatacgttaatatgcacagacataaaacttttgtcattatgcttgatggtaacgcaattgcacatccaaattttattaatattaccaacgatattagtttattacatagtttagggattaaattagtaattgtgtttggggcccgttgtcaaattgaaaacttgttaaagcaaaataatatttcttcaagttatcatcataatattcgtgttacagacagcaatatgcttgaaatcattaaacaagctgtgggtggcttacattatgatattttctcccgcttatcgcttaggttaccccattcaccggtgctgaatgtagtcagcagtaatgctattcttgcccaaccgcttggtgtgattgacggcgtagattatggcttgagtggtaaaattagacggattaatattgaggccattcaacagcaattagcgcaaaatgcaattgtcgtgattggtccaatagcgccatcagtaaccggaaaaatgtttaatttggcgtttgaagaaattgcgactcaattagccatcaaacttaaagtggataaattaatagccttttgcgaccgccaaggattactagacgaacagggtaaggtcatttcagatattcacccgcgtgaagccaaacaacatttaaaaaaatttattcagcaaggtgattatcaccattctgccgcgcgttttttacaagcggcgatagatgtttgccatgcaggcattaaacgctcacatttaatcagttatcaaacggatggttctttgttgcaagagttattttcacgtgatggcgttggtactcagctatccgaagcaagctcagaatgtattcgacttgccacatcatttgatattgctggtttattgaatttaattcgcccgttagaggatcaaggtcttttagtcaaacgttcacgtgaacaattagaaatggaaattagccaatatacgattattgaacgtgatggtattgtaattgcttgcgcagctttgatacattatcccgctgagaaaatggcagaaatggcttgtgttgccgtacatcctgattatcgtgattctgcgagaggcgatattttactagaagcgattaaacgacgcgcctataaattaaatattgaaaaattatttgtattaactacccaaacaatacaatggtttcaagaacgaggttttgtgcaaatacaaccaacggatttacccgttgaaaaacaacgccattataattatcaacgtatgtcaaaagtattaatgttggcattggataattag

SEQ ID NO: 10363 - protein, 437 aa, Haemophilus ducreyi
MRNTELIEWFRQSAPYVNMHRHKTFVIMLDGNAIAHPNFINITNDISLLHSLGIKLVIVFGARCQIENLLKQNNISSSYHHNIRVTDSNMLEIIKQAVGGLHYDIFSRLSLRLPHSPVLNVVSSNAILAQPLGVIDGVDYGLSGKIRRINIEAIQQQLAQNAIVVIGPIAPSVTGKMFNLAFEEIATQLAIKLKVDKLIAFCDRQGLLDEQGKVISDIHPREAKQHLKKFIQQGDYHHSAARFLQAAIDVCHAGIKRSHLISYQTDGSLLQELFSRDGVGTQLSEASSECIRLATSFDIAGLLNLIRPLEDQGLLVKRSREQLEMEISQYTIIERDGIVIACAALIHYPAEKMAEMACVAVHPDYRDSARGDILLEAIKRRAYKLNIEKLFVLTTQTIQWFQERGFVQIQPTDLPVEKQRHYNYQRMSKVLMLALDN

SEQ ID NO: 10364 - DNA, 1323 bp, Pasteurella multocida
  CDS (1)..(1323)
atgcgcagtacagaattagttcattggtttagacaatcaaccccttatgtcaatatgcatagaggcaaaacttttgtcattatgcttgatggggacactattgcttgtccaaattttgttaatattatcaatgatatcagcctgctacatagtttaggcattaagttagttttagtgtttggtgcacgttatcaaatcaatgagctgttacagcaacatcagattgaatcggtctatcataaaaatattcgtattactgacttaacaagtttagaactggtgaaacaagctgtgggtaagctcaattacgatattgcttcacgcttgtcactacgtctccctcattctcctttaattgatgtggtcagcggtaacttcgtattagcccaacctattggcgtagatgacggcatcgattatcaattaagtggcaaaattcgccgtattaatacagaaagtatccagcaacaattagatcgtgatgcgattgtcttaattggaccaattgcaccttctgttactggagaaagctttaatttgcctttcgaagaaattgcttcacagcttgccattaagttaaaagctgaaaaattgataggcttttccgcaacacaaggcatcttagatgaaaacaaccaaacaatcagtgatctgttgccgcaagatgccgagctttacttagctaaactgatacaacaaaaccaatatcacagctctcaagctcgctttttacaagcagctattgaggcttgccgatttggcataaagcgttcacatttgatcagttatgaagaagatggctcactgttgcaggaattatttacgcgtgacggggttggtactcagctatccatggaacattccgaaaccattcgcttagcgacggtcagtgatattcccgcgttactcgaattgattcgtccacttgaacagcaaggaattttagtcaaacgctcacgcgaacaattagaaatggaaattaaccaatatacgattatcgatcgcgatggtgtgattattgcttgtgctgccttaaattgctatgccgatgagaaaatggcagaaatggcttgtgtggcggttcacccagattaccgtaattcttcgcgtggcgatattttattagaagctatccaaaaacgcgctaaacaactgggaattgaaaagctgtttgttctcacaacgcgtacagtacattggttccaagaaagaggttttcaactcgcagagatcgcagatttaccagacaaaaaacgtcaacactataattatcaacgtcgttccaaaatcttgattcaagcgctacaaaataaaaaaggctaa

SEQ ID NO: 10365 - protein, 440 aa, Pasteurella multocida
MRSTELVHWFRQSTPYVNMHRGKTFVIMLDGDTIACPNFVNIINDISLLHSLGIKLVLVFGARYQINELLQQHQIESVYHKNIRITDLTSLELVKQAVGKLNYDIASRLSLRLPHSPLIDVVSGNFVLAQPIGVDDGIDYQLSGKIRRINTESIQQQLDRDAIVLIGPIAPSVTGESFNLPFEEIASQLAIKLKAEKLIGFSATQGILDENNQTISDLLPQDAELYLAKLIQQNQYHSSQARFLQAAIEACRFGIKRSHLISYEEDGSLLQELFTRDGVGTQLSMEHSETIRLATVSDIPALLELIRPLEQQGILVKRSREQLEMEINQYTIIDRDGVIIACAALNCYADEKMAEMACVAVHPDYRNSSRGDILLEAIQKRAKQLGIEKLFVLTTRTVHWFQERGFQLAEIADLPDKKRQHYNYQRRSKILIQALQNKKG

SEQ ID NO: 10366 - DNA, 1347 bp, Photorhabdus luminescens
  CDS (1)..(1347)
atgaaagaacgaagcaccgagttagttgaaggatttcgtcattctgttccgtacatcaatgcacaccgtggtaaaacttttgttatcatgcttggtggagaggctattgctcacgaaaattttaccaatattatcaacgatataggattactgcatagtttaggcatccgcctggtcgtcgtttatggtgccagacctcaaattgagcaaaaccttgcagaccatcattacgaaccggtttaccacaaacacacccgtgttaccgataataaaacattagaattagtcaaacaatctgctggcttgctgcaactggatatcactgcacgcctttctatgaatttgaataataccccgttacaaggtgccaacattaatgttgtcagtggtaacttcattattgctcaacctcttggcgttgatgatggtgtggattattgccacagcggaaaaattcgccgtatcgatgagcatgccataaatcgtcaattagacaatggcgcaatcgtgctaattggccctgtcgcagtttctgtcaccggagagagttttaatctggcatttgaagatgttgctactcaattagctatcaaactacaggctgaaaaactgattggattctgttctactcaaggtgtacaagacaaagacggaaaaattctatcggaagtttttcttaatcaagcaccggaactgattaaagagctagaagttaaaggtgactactattcaggcacagtctgttttttgcggagtgcaataaaagcttgccgtcgtggcgttcgtcgcagccatttattaagttatcaggcagatggttctctacttcaagaattattctcccgagatggtattggcactcaaatagtgatggaaagtgcggaacaaatacgccgagctaatatcaatgatattggtggtattctcgaacttattcgcccactggaacaacagggtattctggttcgccgttcaagagaacaacttgagagagaaattgataaattcatcattatcgaacgcgataacctaactatcgcctgtgccgcgctctacccttatcctgaagagaaaattggcgaaatggcttgtttagcggtgaatcctaaataccgcagctctttaagaggtgaagtattactgaatcgcattgcggaacacgccaaacagctcggactggaaaaactgtttgttctgactacccgcagcattcattggttccaagagcgaggttttgagcccgcagaactctcaatgctaccgattcagaaacaagtgttatataactatcagcgccgttctaaaattcttatgctgaatttggaaccacagcctggattcacataa

SEQ ID NO: 10367 - protein, 448 aa, Photorhabdus luminescens
MKERSTELVEGFRHSVPYINAHRGKTFVIMLGGEAIAHENFTNIINDIGLLHSLGIRLVVVYGARPQIEQNLADHHYEPVYHKHTRVTDNKTLELVKQSAGLLQLDITARLSMNLNNTPLQGANINVVSGNFIIAQPLGVDDGVDYCHSGKIRRIDEHAINRQLDNGAIVLIGPVAVSVTGESFNLAFEDVATQLAIKLQAEKLIGFCSTQGVQDKDGKILSEVFLNQAPELIKELEVKGDYYSGTVCFLRSAIKACRRGVRRSHLLSYQADGSLLQELFSRDGIGTQIVMESAEQIRRANINDIGGILELIRPLEQQGILVRRSREQLEREIDKFIIIERDNLTIACAALYPYPEEKIGEMACLAVNPKYRSSLRGEVLLNRIAEHAKQLGLEKLFVLTTRSIHWFQERGFEPAELSMLPIQKQVLYNYQRRSKILMLNLEPQPGFT

SEQ ID NO: 10368 - DNA, 1299 bp, Pseudomonas putida
  CDS (1)..(1299)
atgcccgattacgtcaactggctgcgtcatgcatccccctatatcaatgcccatcgcgactgcaccttcgtggtcatgctccctggcgatggggtggaacaccctaatttcggcaatatcgtccacgacctggtgctgctgcacagcctcggcgtgcggctggtgctggtgcatggctcgcgcccgcagatcgaaagccggctggccgatcgcggcctgaccccgcactaccaccggggcatgcgtattactgatgcggccaccctggactgcgtgatcgatgccgtcggcgccctgcgcctggccattgaagcgcggctgtcgatggacatcgccgcttcgccgatgcagggctcgcgcctgcgcgtggcctccggcaacctggtcaccgcgcggccgatcggcgtgctcgaaggcgtggactaccaccacactggcgaagtgcgccgggtcgaccgcaagggcatcagccgcctgctcgacgagcgttccatcgtgctgttgtcgcccttgggctactcgcctaccggggaaattttcaacctggcctgcgaagacgtggctacccgtgcggccatcgaactgggcgccgacaagttgctgctgttcggcgccgagccgggcctgttggacgctgacggtaggctggtgcgcgaactgcgcccgcagcaggttgctccgcatctgcagcgtctaggcagcgattaccagggcgaactgctggatgctgcggccgaggcttgcaaaggcggtgtggcgcgcagccatatcgtcagctatgccgaggacggcgcgctgctcaccgagctgttcacacggggcggtggcggtacgctggtgtcgcaggagcagttcgaagtggtgcgcgaggcgaccatcgaggacgtcggtggcctgctggaattgatcagcccgctggaagagcagggcatcctggtgcgccgctcgcgcgaagtgctggagcgagagatcgagcagttcagcgtggtcgagcgcgagggcatgatcatcgcctgtgcggcgctgtacccgattgccgattccgaagcaggggagctggcttgcctggctgtgaacccggagtaccgccatggcgggcgtggcgatgagctgctggaacgcatcgaaagccgggcacggcagatgggcttgagtactttgttcgtgctgactacgcgcactgcgcactggttccgcgagcgcggctttgcgccgagtggcgtggagcggctgccggcggcgcgggcttcgctgtacaactaccagcgcaattcgaagattttcgagaagcccctgtaa

SEQ ID NO: 10369 - protein, 432 aa, Pseudomonas putida
MPDYVNWLRHASPYINAHRDCTFVVMLPGDGVEHPNFGNIVHDLVLLHSLGVRLVLVHGSRPQIESRLADRGLTPHYHRGMRITDAATLDCVIDAVGALRLAIEARLSMDIAASPMQGSRLRVASGNLVTARPIGVLEGVDYHHTGEVRRVDRKGISRLLDERSIVLLSPLGYSPTGEIFNLACEDVATRAAIELGADKLLLFGAEPGLLDADGRLVRELRPQQVAPHLQRLGSDYQGELLDAAAEACKGGVARSHIVSYAEDGALLTELFTRGGGGTLVSQEQFEVVREATIEDVGGLLELISPLEEQGILVRRSREVLEREIEQFSVVEREGMIIACAALYPIADSEAGELACLAVNPEYRHGGRGDELLERIESRARQMGLSTLFVLTTRTAHWFRERGFAPSGVERLPAARASLYNYQRNSKIFEKPL

SEQ ID NO: 10370 - DNA, 1299 bp, Pseudomonas syringae
  CDS (1)..(1299)
atgcccgaatacgtcaactggcttcgccatgcgtctccctacatcaatgcccaccgcgattgcaccttcgtcgtcatgcttcccggcgacggcgttgcgcatcccaacttcggcaatatcgtccacgatctggtgctgctgcacagcctgggcgtgcggcttgtgctggtgcacggctcgcgtccacagattgaaagccgtctggcccagcgcggcattacaccgcgctaccatcgcgacatgcgtattaccgataccgagacgctggagtgcgtgatcgacgccgttggccagttgcgcatctcgatagaagcgcgcctgtcgatggacatggcagcctcgccgatgcagggctcgcggctgcgggtgaccagcggcaatgtggtcactgcccggcctatcggggtgctggaaggtattgattatcagcacaccggtgaggtgcgcagggtagaccgcaagggtatcaatcgcctgctggacgagcgtcatatcgtgctgctgtcgccgttgggttattcaccgaccggcgagattttcaatctggcctgcgaagacgtcgccacgcgcgctgcgattgatctggctgccgacaaactgctgttgttcggtgccgaaaccgggttgctggacgagcagggccgactggtgcgcgaactgcgcccgcaacaggtgcctgcgcatttgcagcggctgggtggcaactatcaggccgaattgctcgatgcagcggccgaggcctgccgcggtggtgtggctcgcagccatatcgtcagttatgccgaagacggcgcgctgctgaccgagctgtttacccgcgacggtggtggcacgctggtggcgcaggagcagtttgaactggttcgcgaggcggccatcgaggacgtcggcggtttgatggacctgatcaccccgctggaagagcagggcattctggtacgccgttctcgtgaggtgctggaacgcgagatcacccagttcagtgtggtcgagcgggaagggctgatcatcgcctgcgcggcgctgtacccgattgccgactcggagtctggtgagcttgcgtgtctggccgtcaacccggaataccgacacggcgggcgtggcgacgagctgctggagcgtatcgaaaaccgcgcgcgggcgctgggcatcaaaaccctgttcgtcctcaccacccgtaccgcacactggttccgcgagcgcggcttcgagcccagcagcgtcgaccgcctgccaagcgcccgtgcgtcgctgtacaacttccagcgtaattcgaagatctttgaaaaagcgatttaa

SEQ ID NO: 10371 - protein, 432 aa, Pseudomonas syringae
MPEYVNWLRHASPYINAHRDCTFVVMLPGDGVAHPNFGNIVHDLVLLHSLGVRLVLVHGSRPQIESRLAQRGITPRYHRDMRITDTETLECVIDAVGQLRISIEARLSMDMAASPMQGSRLRVTSGNVVTARPIGVLEGIDYQHTGEVRRVDRKGINRLLDERHIVLLSPLGYSPTGEIFNLACEDVATRAAIDLAADKLLLFGAETGLLDEQGRLVRELRPQQVPAHLQRLGGNYQAELLDAAAEACRGGVARSHIVSYAEDGALLTELFTRDGGGTLVAQEQFELVREAAIEDVGGLMDLITPLEEQGILVRRSREVLEREITQFSVVEREGLIIACAALYPIADSESGELACLAVNPEYRHGGRGDELLERIENRARALGIKTLFVLTTRTAHWFRERGFEPSSVDRLPSARASLYNFQRNSKIFEKAI

SEQ ID NO: 10372 - DNA, 1356 bp, Ralstonia solanacearum
  CDS (1)..(1356)
atggcgcacacgcccgccaccgccgacgtcgctccgatcccgcccacgcccgagcagcagcagttcgtggactggctgcgcgcggtggcgccctatatccacgccttccgcgacaagaccttcgtgatcggcttcggcggcgagctggtcaaggccggcatgctcggggcgctggtcaacgacatcgcgctgctgcacgccatgggcatgcacatcgtgctggtgcacggctcgcggccgcaggtggaagaacagctggcgctgcgccacgtgcagacccagttcgtcgacggcatccgcgtgaccgacaacgccgcgctggaatcggccaaggaggcctcgggcgaactgcggctcgacatcgaggccaccttcagccaggcgctgcccaatacgccgatggcgggggcccgcatttcggtggtgtcgggcaacttcgtgacggcgcggccggtgggcatcgtcaacggcgtcgatttccagcacacggggctggtgcgcaagatcgacgcggaatcgatccagcactcgctgtccaaccgcaagatcgtgctgctgtcgccgctgggcttctcgcccacggggcaggcgttcaacctgtcgatggaagacgtggccaccaacacggcgaccgcgctcaaggccgacaagctgatcttcatcaccgaggtgccgggcatcatggaccgggtcggcaagctacagcaggagctgtcgatggaatcggccatcgagcgcctgcgcgaagggcggctctccgccgacaccgcgtactacctgcagcacatcgtcaaggccatgcgcggcggcgtgcgccgggcgcacctgatcccgttcgcgctggacggcagcatcctgctggagctgttcctgcacgacggcgtcggcaccatggtctcgcacaccgacctggaatacctgcgcgaggccacgctggacgacgtgggcggcatcgtccagctgatcgagccgctggaagccgacggcacgctggtgccacgcgagcgccggctgctggagcgcgacatcgccaacttctccgtgatcgagcacgacggcatcatcttcggctgcgcggcgctctacccctacccgaaggaaggcgtgggcgagatggcctgcctgacggtggcgcccgatacccagggcaccggcgacggcgaacgcctgctcaagcacgtcgaggcccgcgcccgcgccgtggggctcaagcgcctgttcgtgctcaccacgcgcaccgagcactggttcctcaagcgcggcttcgtgcacgccaccgtggacgacctgccggaagaccgccgcaagctgtacaactggcagcggcggtcgatggtgctgatgaagaagctgtaa

SEQ ID NO: 10373 - protein, 451 aa, Ralstonia solanacearum
MAHTPATADVAPIPPTPEQQQFVDWLRAVAPYIHAFRDKTFVIGFGGELVKAGMLGALVNDIALLHAMGMHIVLVHGSRPQVEEQLALRHVQTQFVDGIRVTDNAALESAKEASGELRLDIEATFSQALPNTPMAGARISVVSGNFVTARPVGIVNGVDFQHTGLVRKIDAESIQHSLSNRKIVLLSPLGFSPTGQAFNLSMEDVATNTATALKADKLIFITEVPGIMDRVGKLQQELSMESAIERLREGRLSADTAYYLQHIVKAMRGGVRRAHLIPFALDGSILLELFLHDGVGTMVSHTDLEYLREATLDDVGGIVQLIEPLEADGTLVPRERRLLERDIANFSVIEHDGIIFGCAALYPYPKEGVGEMACLTVAPDTQGTGDGERLLKHVEARARAVGLKRLFVLTTRTEHWFLKRGFVHATVDDLPEDRRKLYNWQRRSMVLMKKL

SEQ ID NO: 10374 - DNA, 1338 bp, Shewanella oneidensis
  CDS (1)..(1338)
atgaggtgtaaacaacgcgtgcgtaccactgaactggttgatggatttcgtcattccgccccttacgtcaatgcccatagagggaaaacctttgtggtgatgctgggtggagaagctttggcacaaaatcaatttcgcggcattctgaatgacgtggcgttgttgcacagtttaggcattaaagtggtgttggtgtatggtgcgaggccgcaaatcgatgcagcgttagccgctaatgggattgaacccgcctaccatgatggtgtacgtatcaccgatgaagactcgctaaaagtgattaagcaagtggcgggtgcattgcagtttgatattacggcgcgtttatccatgagcttaagcaatacgcccatgcaaggcgcacaaatcaacttagtcagcggtaactttgtcattgcccagcccttaggggtcgataatggcgtggatttttgtttaagcggcaaggtgcgccggattgatgcgcaggggcttaagcgtcagctcgataatcactgtatcgtattgatggggccgattgcggcatccgttactggtgaaagttttaatcttaccgctgaagaaattgctactcaggtagcgataaaacttaaagcagacaagatgattggttttagttcgcaaaatggcattctcgatcgcaatggagatgtgattgccgagttaatgccaaatgatgcgcaaaagattcttaataagctcgcagagcagggttcagcctgtattggcactatggccttcctcaaggccagtattgatgcttgccgcaatggcgtgccccgctgccatttggttagctatctcgacgacggcgctttgctgcaggaactgttttcccgcgaggggattggtacgcagatcgtgaccgagagtgctgaacgtttacgccgtgcatcgattagcgatattggcggtattctcaatctgatccgtccgttagaggagcagggcattttggtgcgccgtagtcgtgagcagctcgagatcgaaattgagcagtttatgctgattgagcgtgatggcttagtgattggctgtgcggctttgtatccgttcgaagaagataatgccggggagtttgcttgccttgtggtgcatccagattatcgcgatgccgacagggggagcttgctgctgaagaatattattggtcaggcccgcagccgtggttattcacggttgtttgcattaacaacccgcagcattcactggtttttagagcatggctttgtgattgaagatgtggatgcattgccgcagaagaaaaagcagctgtataactatcagcgccgctccaaaattctcgcccttgatctataa

SEQ ID NO: 10375 - protein, 445 aa, Shewanella oneidensis
MRCKQRVRTTELVDGFRHSAPYVNAHRGKTFVVMLGGEALAQNQFRGILNDVALLHSLGIKVVLVYGARPQIDAALAANGIEPAYHDGVRITDEDSLKVIKQVAGALQFDITARLSMSLSNTPMQGAQINLVSGNFVIAQPLGVDNGVDFCLSGKVRRIDAQGLKRQLDNHCIVLMGPIAASVTGESFNLTAEEIATQVAIKLKADKMIGFSSQNGILDRNGDVIAELMPNDAQKILNKLAEQGSACIGTMAFLKASIDACRNGVPRCHLVSYLDDGALLQELFSREGIGTQIVTESAERLRRASISDIGGILNLIRPLEEQGILVRRSREQLEIEIEQFMLIERDGLVIGCAALYPFEEDNAGEFACLVVHPDYRDADRGSLLLKNIIGQARSRGYSRLFALTTRSIHWFLEHGFVIEDVDALPQKKKQLYNYQRRSKILALDL

SEQ ID NO: 10376 - DNA, 1338 bp, Vibrio parahaemolyticus
  CDS (1)..(1338)
atgaaaattcgtagtaccgctctcgtaaaaggattccgccaatcaaccccttacgtcaacgctcaccgtgggaaaaccatggtgatcatgctgggaggtgaagcggtcgcccataataattttggcaatataatcaatgatattgctttgatgcacagtttaggcatcaaagtcgttgtcgtttatggcgctcgtccacaaatcaatcaattacttgaaaaacaagaccttactacgccataccacaaaaacatccgaattaccgacgaagcggcactatcggtagttatgcaagctgctgggcagcttcaactagccattaccgcacgcctttcaatgagcttaaacaacaccccaatggctggcacacaactgaatgttgtcagtggtaactttgtcattgcacagccacttggcgtagatgacggtgtcgattactgccacagtggacgcattcgccgcattgacaccgacgcgattaatcgcacgctcgaccaaggctctattgtgctacttggccccattgcgagctccgtgactggtgagtgttttaacttactttctgaagaagtcgcgacgcaactggcgatcaaattaggcgcagacaaactgattggtttctgctcagaacaaggcgtgattgacgacaatggcaatgccgtcgcagagttgctgcctatcgaggcagagcacgttatcaaaacgctttcagaaaaccacgcttcagattccgattacaacacgggcactttgcgtttcctcaaaggttccatcgccgcttgtcgcgctggcgtcccacgtagccatctcatcagctacaaagtagatggggctttgattcaggagttgttctcgtttgacggtatcggaactcaagtcgtcatggcgagcgcagagcaagttcgtcaagctggtattgatgacatcggcggtattttggaattgattcatccattagaagaacaaggcattttggtcaggcgttcgagagaacagcttgagcaagagattggtaaattcaccatcattgaaaaagatggcttaatcatcggatgcgcggctttatacccatattctgaagaacgaaaagctgaaatggcctgtgttgccattcacccagactatcgggatggcaaccgaggtttgttgctgctgaattacatgaagcatcgttcaaaatcagaaaacatcaaccagatttttgtccttacaacccacagtctgcattggtttagagagcaaggattctacgaagttggagtcgattacttgccaggagccaaacaagggttgtacaactttcagcgtaagtccaaaatcttagcgttagacttataa

SEQ ID NO: 10377 - protein, 445 aa, Vibrio parahaemolyticus
MKIRSTALVKGFRQSTPYVNAHRGKTMVIMLGGEAVAHNNFGNIINDIALMHSLGIKVVVVYGARPQINQLLEKQDLTTPYHKNIRITDEAALSVVMQAAGQLQLAITARLSMSLNNTPMAGTQLNVVSGNFVIAQPLGVDDGVDYCHSGRIRRIDTDAINRTLDQGSIVLLGPIASSVTGECFNLLSEEVATQLAIKLGADKLIGFCSEQGVIDDNGNAVAELLPIEAEHVIKTLSENHASDSDYNTGTLRFLKGSIAACRAGVPRSHLISYKVDGALIQELFSFDGIGTQVVMASAEQVRQAGIDDIGGILELIHPLEEQGILVRRSREQLEQEIGKFTIIEKDGLIIGCAALYPYSEERKAEMACVAIHPDYRDGNRGLLLLNYMKHRSKSENINQIFVLTTHSLHWFREQGFYEVGVDYLPGAKQGLYNFQRKSKILALDL

SEQ ID NO: 10378 - DNA, 25 bp, artificial sequence
  primer
atggtaaaggaacgtaaaaccgagt

SEQ ID NO: 10379 - DNA, 24 bp, artificial sequence
  primer
ttaccctaaatccgccatcaacac

SEQ ID NO: 10380 - DNA, 1164 bp, Escherichia coli K12
  CDS (1)..(1164)
atgtctgtaattaagatgaccgatctggatcttgctgggaaacgtgtatttatccgtgcggatctgaacgtaccagtaaaagacgggaaagtaaccagcgacgcgcgtatccgtgcttctctgccgaccatcgaactggccctgaaacaaggcgcaaaagtgatggtaacttcccacctgggtcgtcctaccgaaggcgagtacaacgaagaattctctctgctgccggttgttaactacctgaaagacaaactgtctaacccggttcgtctggttaaagattacctcgacggcgttgacgttgctgaaggtgaactggttgttctggaaaacgttcgcttcaacaaaggcgagaagaaagacgacgaaaccctgtccaaaaaatacgctgcactgtgtgacgtgttcgtaatggacgcattcggtactgctcaccgcgcgcaggcttctactcacggtatcggtaaattcgctgacgttgcgtgcgcaggcccgctgctggcagctgaactggacgcgctgggtaaagcactgaaagaacctgctcgcccgatggtggctatcgttggtggttctaaagtatctaccaaactgaccgttctggactccctgtctaaaatcgctgaccagctgattgttggtggtggtatcgctaacacctttatcgcggcacaaggccacgatgtgggtaaatccctgtacgaagctgacctggttgacgaagctaaacgtctgctgaccacctgcaacatcccggttccgtctgatgttcgcgtagcaaccgagttctctgaaactgcaccggctaccctgaaatctgttaacgatgtgaaagctgacgagcagatcctggatatcggtgatgcttccgctcaggaactggctgaaatcctgaagaatgcgaaaaccattctgtggaacggtccggttggcgtgttcgaattcccgaacttccgcaaaggtactgaaatcgtggctaacgctatcgcagacagcgaagcgttctccatcgctggcggcggcgacactctggcagcaatcgacctgttcggcattgctgacaaaatctcctacatctccactggcggcggcgcattcctcgaattcgtggaaggtaaagtactgcctgcagtagcgatgctcgaagagcgcgctaagaagtaa

SEQ ID NO: 10381 - protein, 387 aa, Escherichia coli K12
MSVIKMTDLDLAGKRVFIRADLNVPVKDGKVTSDARIRASLPTIELALKQGAKVMVTSHLGRPTEGEYNEEFSLLPVVNYLKDKLSNPVRLVKDYLDGVDVAEGELVVLENVRFNKGEKKDDETLSKKYAALCDVFVMDAFGTAHRAQASTHGIGKFADVACAGPLLAAELDALGKALKEPARPMVAIVGGSKVSTKLTVLDSLSKIADQLIVGGGIANTFIAAQGHDVGKSLYEADLVDEAKRLLTTCNIPVPSDVRVATEFSETAPATLKSVNDVKADEQILDIGDASAQELAEILKNAKTILWNGPVGVFEFPNFRKGTEIVANAIADSEAFSIAGGGDTLAAIDLFGIADKISYISTGGGAFLEFVEGKVLPAVAMLEERAKK

SEQ ID NO: 10382 - DNA, 1266 bp, Emericella nidulans, Aspergillus nidulans
  CDS (1)..(1266)
atgtctctcaccagcaagctttccatcacagatgtggatctcaaggacaagcgtgtcctgatccgagttgacttcaatgtgcccctcgacaagaacgacaacaccacaatcaccaaccctcagcgtatcgtcggtgctctgcctaccatcaagtatgccatcgataacggcgccaaggccgtcatcctcatgtcccaccttggccgtcctgatggcaagaagaaccccaagtacagcttgaagcccgttgtgcccaagctcaaggaactgctcggccgcgacgtcatctttactgaggactgcgttggcccagaggtcgaggagactgttaacaaggcctccggtggccaggtcatccttcttgagaacctgcgcttccacgccgaggaggaaggaagctctaaggatgcagacggcaacaaggtcaaggccgacaaggacgcggttgcgcagttccgtaagggattgactgctttgggtgacatttacatcaacgatgcctttggtaccgcccaccgtgctcacagctccatggtcggtgtcgaccttccccagaaggcctccggattcctcgtcaagaaggagctcgaatacttcgcgaaggccctcgaggagccccagcggcccttcctcgccatccttggtggctctaaggtttccgacaagatccagctaattgacaacctccttcccaaggtcaacagcctcatcattaccggaggcatggctttcaccttcaagaagactctcgagaacgtcaagattggaagcagtctcttcgatgaggccggcagcaagatcgtcggtaacatcatcgaaaaggccaagaagcacaacgtcaaggttgttcttcccgtcgactacgtcactgccgataagtttgccgccgatgcgaagactggctacgccactgatgagcagggtatccctgatggttacatgggcttagacgttggcgagaagagtgtcgagtcctacaagcagaccattgccgagtccaagactattctgtggaacggaccccccggtgtctttgagatggagcccttcgctaaggctaccaaggctactcttgacgctgctgtggcggctgttcagaacggtgctaccgtcattattggtggtggtgacactgctaccgttgccgccaagtacggcgctgaggacaagattagccacgtttctaccggtggtggtgcctcgctggagctcctggagggcaaggaactgcctggtgttgctgctctctctgagaaaagtaagtaa

SEQ ID NO: 10383 - protein, 421 aa, Emericella nidulans, Aspergillus nidulans
MSLTSKLSITDVDLKDKRVLIRVDFNVPLDKNDNTTITNPQRIVGALPTIKYAIDNGAKAVILMSHLGRPDGKKNPKYSLKPVVPKLKELLGRDVIFTEDCVGPEVEETVNKASGGQVILLENLRFHAEEEGSSKDADGNKVKADKDAVAQFRKGLTALGDIYINDAFGTAHRAHSSMVGVDLPQKASGFLVKKELEYFAKALEEPQRPFLAILGGSKVSDKIQLIDNLLPKVNSLIITGGMAFTFKKTLENVKIGSSLFDEAGSKIVGNIIEKAKKHNVKVVLPVDYVTADKFAADAKTGYATDEQGIPDGYMGLDVGEKSVESYKQTIAESKTILWNGPPGVFEMEPFAKATKATLDAAVAAVQNGATVIIGGGDTATVAAKYGAEDKISHVSTGGGASLELLEGKELPGVAALSEKSK

SEQ ID NO: 10384 - DNA, 1257 bp, Neurospora crassa
  CDS (1)..(1257)
atgtctctctccaacaagctctccatcgaggacgtcgacctcaagggcaagcgcgtcctcatccgtgtcgacttcaacgtcccccttgacgccgagaagaaggtcaccaacccccagcgcatcgccggtgccattcccaccatcaagtatgcgctcgaccatggcgccaaggccgttgtcctcatgtctcaccttggccgtcccgaccggaagcccaaccccaagtactccctgaagcccgttgttcctgagctcgagaagctcctcggcaagaaggtcaccttcgcccccgactgcgttggtcccgaggttgaggagatcgtcaacaaggccgacaacggtgaagttattctccttgagaacctccgcttccacattgaggaggagggcaagggcaccgatgccgagggcaacaaggtcaaggccgacaaggccaaggttgaggagttccgcaagaacctcaccaagctcggtgatgtgtacatcaacgatgctttcggcactgcccaccgcgcccactcctccatggtcggcattgacctccccgtcaaggccgccggtttcctcatgaagaaggagctccagtactttgccaaggttctcgagtcgccccagcgccccttcctctccatcctcggcggtgccaaggtttccgacaagatccagctgatcgacaacctgctcgacaaggtcaacaccctcatcgtctgcggtggtatggccttcaccttcaagaagaccctccagaacatgcccatcggcaactcgctcttcgatgaggccggcgccaagattgtccctgaccttgtcaagaaggccgagaagaacaacgtcaagctcgtgctccccgtcgacttcaccattgccgacaagttcgacaaggacgccaacactggctacgccacagacaaggacggcattcccgacggctggatgggtctcgactgcggcgaggagtcggtcaagctcttcacccaggccatcaacgagtcccagaccatcctctggaacggccccgccggtgtcttcgagttcgacaagttcgccaagggcaccaaggccaccctcgacgcttgcgtcaaggctgccgaggaaggccgcaccgtcatcattggcggtggtgacaccgctaccgtcgctgccaagtacggcgttgaggacaagctcagccacgtctccactggcggtggtgcttctcttgagctccttgagggcaaggctctccctggtgttgttgctcttagcgagcgtcagtaa

SEQ ID NO: 10385 - protein, 418 aa, Neurospora crassa
MSLSNKLSIEDVDLKGKRVLIRVDFNVPLDAEKKVTNPQRIAGAIPTIKYALDHGAKAVVLMSHLGRPDRKPNPKYSLKPVVPELEKLLGKKVTFAPDCVGPEVEEIVNKADNGEVILLENLRFHIEEEGKGTDAEGNKVKADKAKVEEFRKNLTKLGDVYINDAFGTAHRAHSSMVGIDLPVKAAGFLMKKELQYFAKVLESPQRPFLSILGGAKVSDKIQLIDNLLDKVNTLIVCGGMAFTFKKTLQNMPIGNSLFDEAGAKIVPDLVKKAEKNNVKLVLPVDFTIADKFDKDANTGYATDKDGIPDGWMGLDCGEESVKLFTQAINESQTILWNGPAGVFEFDKFAKGTKATLDACVKAAEEGRTVIIGGGDTATVAAKYGVEDKLSHVSTGGGASLELLEGKALPGVVALSERQ

SEQ ID NO: 10386 - DNA, 1254 bp, Methanococcus jannaschii
  CDS (1)..(1254)
atgattatgtttttgacgttggatgactttaattttgaagataagagggtagttttgagagtagatataaactgtccaatagacccaaacactggagagattttagatgataagaggattagagaaataaaaagcacaattacagagcttataaacaaaggtgctaaggttgttatcttagctcaccaaagtaggccagggaagaaagattttactacattaaaaaaccatgcaaaggttttatcagatgttattggtaaagaagtagagtatattgatgaagttataggctctacagcaagagaggcaataatcaatatgaaatgtggagatgtcattttattggagaatgttaggttttattctgaggaggttttaagtgattggaaaaaatgggaaaatataactccaaaaaaacaggcagagacaaatttaattaaaagattagccccattatttgactattttgttaatgatgcctttgcagctgcacacagggctcagccatcattagttggtttctcttactatatgccaatgattgctggaagattgatggagagagaggttggggttttatcaaaggttttagaaaatccagaaaagccctgtgtttatgttttgggaggagctaaggcagatgattcaataagagttatgaaaaacgtcttagaaaatggaactgctgataaggttttaacttcaggaattgttgctaacatcttccttgtagctatgggatatgatttaggcgtaaatatggatattattgaaaatcttggattaaaaagccaaatagagattgctaaagagttgttaaataaatttgaagataaaatcgttgtccctgttgatgtagccctaaatattaatgaagagagggttgaagctgatttaaataaggatgaaaaagtagaacatttaattaatgatattggggagaaaactatcgaactttacagtgaaataattaatgaagcaaaaaccattgttgccaatggtccagcgggagtgtttgaaaaagaggcatttgcaaaaggaactgaagagctgttgaaagcgatagctaactcaaaagggttttcagttattggaggagggcatttatctgcagctgctgaattatttggaattgctgataagattgaccatgttagtacgggaggtggagcaaccttagatttcttagctggagaaaaattgccagtaatagagatgcttaaggaatcatataagaaatataagggacaataa

SEQ ID NO: 10387 - protein, 417 aa, Methanococcus jannaschii
MIMFLTLDDFNFEDKRVVLRVDINCPIDPNTGEILDDKRIREIKSTITELINKGAKVVILAHQSRPGKKDFTTLKNHAKVLSDVIGKEVEYIDEVIGSTAREAIINMKCGDVILLENVRFYSEEVLSDWKKWENITPKKQAETNLIKRLAPLFDYFVNDAFAAAHRAQPSLVGFSYYMPMIAGRLMEREVGVLSKVLENPEKPCVYVLGGAKADDSIRVMKNVLENGTADKVLTSGIVANIFLVAMGYDLGVNMDIIENLGLKSQIEIAKELLNKFEDKIVVPVDVALNINEERVEADLNKDEKVEHLINDIGEKTIELYSEIINEAKTIVANGPAGVFEKEAFAKGTEELLKAIANSKGFSVIGGGHLSAAAELFGIADKIDHVSTGGGATLDFLAGEKLPVIEMLKESYKKYKGQ

SEQ ID NO: 10388 - DNA, 1209 bp, Helicobacter pylori
  CDS (1)..(1209)
atgttagctaaaatgtcgtttatgcaaaatgttaaaaacattcaagaagtggaagtgagccataaaagggtgcttattagagtggattttaatgtgcctttagatgaaaatttgaatattaccgatgatacgcgcattagagagagcttgcccaccatccaatattgtattgacaacaaggctaaagatattattttagtgagccacttgggccgccctaaaggggttgaagaaaaattgagtttaaagccctttttgaaacgccttgaaagactcttaaaccatgaagtggttttttctcaaaatattgtgcaactcaagcaggctttaaacgaaaacgcgcccacaaggatttttcttttagaaaatatccgctttttaagaggcgaagaagaaaatgatgaaaatctggctaaagatttagcgagcttgtgcgatgtgtttgtgaatgacgcttttggcacgagccacagaaagcatgccagcacttatggcaccgccaaattcgcccctattaaagtgagcgggtttttactcaaaaaagaaattgattcgttttatcaagcgtttaaccaccctttacgccctctattgttgattgtagggggggctaaggtcagctccaaactcaccctattaaaaaacattttagatctcattgacaagctcatcattgccggggcgatgagcaacaccttcttaaaagctttaggctatgatgtgcaagattcttctgtagaagacgctctaatcaatgacgccctagaattattgcaaagcgcgaaagaaaaaaaagtcaaagtctatttacccatagacgctgtaaccactgatgatattctcaaccccaaacacattaaaatttcacccgtccaagacattgagcctaagcacaagatcgctgatatagggcctgcgagcttgaaattattttctgaagtcatagagagtgcacccaccattttatggaatggccccttaggcgtgcatgaaaaacaagaattcgctagaggcacaacctttttagcccacaaaatcgctgacacttacgctttctcgctcattggtgggggcgataccattgatgcgatcaatcgcgcgggcgaaaaggataacatgagctttatctctaccggtgggggagcgagtttggaattgttagagggcaaaattttaccttgttttgaggttttggacaaacgccattaa

SEQ ID NO: 10389 - protein, 402 aa, Helicobacter pylori
MLAKMSFMQNVKNIQEVEVSHKRVLIRVDFNVPLDENLNITDDTRIRESLPTIQYCIDNKAKDIILVSHLGRPKGVEEKLSLKPFLKRLERLLNHEVVFSQNIVQLKQALNENAPTRIFLLENIRFLRGEEENDENLAKDLASLCDVFVNDAFGTSHRKHASTYGTAKFAPIKVSGFLLKKEIDSFYQAFNHPLRPLLLIVGGAKVSSKLTLLKNILDLIDKLIIAGAMSNTFLKALGYDVQDSSVEDALINDALELLQSAKEKKVKVYLPIDAVTTDDILNPKHIKISPVQDIEPKHKIADIGPASLKLFSEVIESAPTILWNGPLGVHEKQEFARGTTFLAHKIADTYAFSLIGGGDTIDAINRAGEKDNMSFISTGGGASLELLEGKILPCFEVLDKRH

SEQ ID NO: 10390 - DNA, 1224 bp, Archaeoglobus fulgidus
  CDS (1)..(1224)
atgatgatagacggccttccaacactagacgatattccgtacagaggaaagcacgttctgctgagggttgacatcaacgctcctattgtgaactcaacgattctcgacacgagcagattcgagagccacattccgacaattgaggctcttgaagactcaaagctcgttttgctcgcacaccagagccgacccggaaagaaggacttcacgagtctcgaaagccacgcatccacactttccaaactgctcgggaagagagtcgagtacatagacgaaattttcagcaaaggcgttctgagaagaataaaggagatggagaacggtgaggtaattttgctcgagaacgtgaggttctactccgaggagcagttgaacagaagcgctgaggagcatgccgagtgccacatggtcaggaaactcagcacagcctttgacctctttgtcaacgacgccttctccgcatcccatcgaagccacgcatctttggtcggcttcgttccggttctgccatccgtcgtgggaaggctcgtcgaaaatgaggttaccgccctcagcaaacccctcaagggggaggggagaaagatatttgtcctgggcggagctaaaatcaaggactcggtgaaagttctaaaaaacgtgctggaaaacaacattgcggaaaaagtcgttctcacgggtgtagttgccaactactttctcatgctgaaaggttacgatataggtgaagtgaacagaaaggttgtggaggacaacaaggaagacgtgagcgacgaggagatgataaacatactcaagaagtactccgacaaaattatccttcccattgacctcggtatagagaaagacggtgtcagggtagatatcccattggagaagtttgatgggaaatacagaataatggatattgggcttgaaaccgttaaccagctttcggaaatcatcccgaagtacgattatgtggttctgaacggtcctgcgggagtttttgaggatgagcgtttctctctcggaacttacgagattctgagggccgcgacaagggctggttactcggttgttggcggggggcacatcgcctcagcagcacgcctcttcggcctttcggacaagttcagccacatatcaactgcaggaggggcgtgcataaggttcctgagcggtgaaaagctggtagctcttgaggttatcaaggaatactgggcgaagaagtggggcaaatcttaa

SEQ ID NO: 10391 - protein, 407 aa, Archaeoglobus fulgidus
MMIDGLPTLDDIPYRGKHVLLRVDINAPIVNSTILDTSRFESHIPTIEALEDSKLVLLAHQSRPGKKDFTSLESHASTLSKLLGKRVEYIDEIFSKGVLRRIKEMENGEVILLENVRFYSEEQLNRSAEEHAECHMVRKLSTAFDLFVNDAFSASHRSHASLVGFVPVLPSVVGRLVENEVTALSKPLKGEGRKIFVLGGAKIKDSVKVLKNVLENNIAEKVVLTGVVANYFLMLKGYDIGEVNRKVVEDNKEDVSDEEMINILKKYSDKIILPIDLGIEKDGVRVDIPLEKFDGKYRIMDIGLETVNQLSEIIPKYDYVVLNGPAGVFEDERFSLGTYEILRAATRAGYSVVGGGHIASAARLFGLSDKFSHISTAGGACIRFLSGEKLVALEVIKEYWAKKWGKS

SEQ ID NO: 10392 - DNA, 1212 bp, Chlamydia trachomatis
  CDS (1)..(1212)
atggataaattatcgataagagacctttctcttgaagggaaaaaggtactagttcgtgtagattttaatgttcctattaaagatggaaagattttagatgatgtgcgtattcatagcgcaatgcctacgatccattatcttttgaaacaagatgcagcagtcattttggtaagccatgtaggacgcccaaagggaggcgtatttgaagaggcatattcattagctcccattgttcctgtgctagaggggtatttagggcatcatgtgcctctttctccagattgtataggagaagtcgcgcgacaggcggtcgcgcaactttctcctggtagagttcttcttttagagaatgtacgtttccataagggggaagaacattctgacgaggatcctagttttgctattgagcttgctgcttatgcagatttttatgtgaatgatgctttcgggacatctcatcgtaagcatgcttctgtatatcgggtgccacaactattccctgaccgggcagccgcaggcttccttatggaaaaagaattagaatttttgggccagcatctattagttgagcctaaacgtcctttcactgctattttaggaggcgcgaaaatgtcttcgaaaataggagtaatcgaggcgctactttcgtgcgtggatcatctcgtattagctgggggtatggggtacacctttttaagggctatgaatcgccaggtagggaattcattagtggaagaatcagggatccctttagcgaaaaaagtattagagaaagctcaagctctgggggtgaagatccatcttccagtggatgcgaaggtcgctaaacagtgtgactctggagaggattggagggagctgtctatacaggaaggaatccctgaaggattagcaggttttgatattggggcacagacaatagaactattttctaaggtgattcaggagtcggcaacgatattttggaatggtcctgtcggggtatacgaagtccctccttttgatcaaggatcgaaggcaatagcacaatgtctcgcgagccattcttctgctgtgactgtggttgggggaggcgatgcggctgctgtagtagctcttgcagggtgtgcttcacagatctcccacgtatctacagggggaggcgcttccttagaattcttagaaaaaggtagtcttcctggtacggaaatactatctccagctcaaagctaa

SEQ ID NO: 10393 - protein, 403 aa, Chlamydia trachomatis
MDKLSIRDLSLEGKKVLVRVDFNVPIKDGKILDDVRIHSAMPTIHYLLKQDAAVILVSHVGRPKGGVFEEAYSLAPIVPVLEGYLGHHVPLSPDCIGEVARQAVAQLSPGRVLLLENVRFHKGEEHSDEDPSFAIELAAYADFYVNDAFGTSHRKHASVYRVPQLFPDRAAAGFLMEKELEFLGQHLLVEPKRPFTAILGGAKMSSKIGVIEALLSCVDHLVLAGGMGYTFLRAMNRQVGNSLVEESGIPLAKKVLEKAQALGVKIHLPVDAKVAKQCDSGEDWRELSIQEGIPEGLAGFDIGAQTIELFSKVIQESATIFWNGPVGVYEVPPFDQGSKAIAQCLASHSSAVTVVGGGDAAAVVALAGCASQISHVSTGGGASLEFLEKGSLPGTEILSPAQS

SEQ ID NO: 10394 - DNA, 1197 bp, Streptococcus pneumoniae
  CDS (1)..(1197)
atggcaaaacttactgttaaagacgttgacttgaaaggtaaaaaagtcctcgttcgtgttgacttcaacgtaccattgaaagatggcgtaatcactaacgataaccgtatcacagcagctcttccaactattaagtacatcatcgaacaaggtggacgtgcaattcttttctctcaccttggacgtgtgaaagaagaatctgataaagctggtaaatcacttgctcctgtagcagctgacttggcagcaaaacttggtcaagatgttgttttcccaggtgtcactcgtggtgctgaattggaagcggcaatcaacgctcttgaagatggacaagttctcttggttgaaaacactcgttacgaagatgttgacggcaagaaagaatctaaaaacgatcctgaacttggtaaatactgggcatcacttggagatggtatcttcgtaaacgatgcattcggtacagctcaccgtgcacacgcatctaacgttggtatctcagcaaacgttgaaaaagcagttgctggtttccttcttgaaaacgaaattgcctacatccaagaagcagttgaaactccagaacgtccattcgtggctatccttggtggttcaaaagtttcagacaagatcggtgttatcgaaaacttgcttgaaaaagctgataaagtccttatcggtggtgggatgacttacacattctacaaagcacaaggtatcgaaatcggtaactcacttgtagaagaagacaaattggatgttgcgaaagctcttcttgaaaaagcaaatggtaaattgatcttgccagttgactcaaaagaagctaacgcatttgctggttacactgaagtgcgtgacactgaaggtgaagcagtttctgaaggcttccttggtcttgacatcggtccaaaatctatcgccaaatttgacgaagctttgactggtgccaaaacagttgtatggaacggacctatgggtgtatttgaaaacccagatttccaagctggtacaatcggtgtgatggacgctatcgtgaaacaaccaggagttaaatcaatcatcggtggtggtgactcagctgccgcagcgattaaccttggccgtgcagacaagttctcatggattagtacgggtggtggagcatcaatggaacttcttgaaggtaaggttcttccaggacttgcagccttgacagaaaaataa

SEQ ID NO: 10395 - protein, 398 aa, Streptococcus pneumoniae
MAKLTVKDVDLKGKKVLVRVDFNVPLKDGVITNDNRITAALPTIKYIIEQGGRAILFSHLGRVKEESDKAGKSLAPVAADLAAKLGQDVVFPGVTRGAELEAAINALEDGQVLLVENTRYEDVDGKKESKNDPELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKALLEKANGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 10396 - DNA, 1164 bp, Yersinia pestis
  CDS (1)..(1164)
atgtctgtaattaagatgaccgatctggatctggctggcaaacgtgttttgatccgtgcggacctcaatgttccggtaaaagaaggcaaagtgacttctgatgcgcgtatccgtgcctctctgccaactatcgaagcggcattgaagcaaggcgctaaagtaatggttacctctcacttgggtcgcccgaccgaaggcgagtacaacgaagagttctccttactgcccgtcgttaactacctgaaagagaagttatcttctccggtacgtctggcgaaggactatctggacggcgttgaaattgcagctggcgagttggttgttctggaaaacgttcgctttaacaaaggcgagaaaaaagacgacgaagccctgtccaagaaatatgccgcactgtgcgatgtttatgtaatggatgcttttggtaccgctcaccgcgctcaggcatcgactcacggtgtgggtaaatttgcccctatcgcttgcgccggcccgctgttgtcagcagagctggaagcattgggtaaagcgctgggtaacccagcgcgtccaatggttgctatcgttggtggttctaaagtttcaactaaactgaccgtgctgggcgcgttgtctaaaatcgcggataaactgattgttggcggtggtatcgctaataccttcgttgcggctcaaggccacaatgtcggtaaatctctgtacgaagctgatctgatcccagaagcgaaaagactgctagagacctgtgatatccctgttcctactgatgttcgtgttgccactgagttctctgaaacggcagccgcgacgctgaaacccgcgaacgaaattaaagatgacgaacaaattttggatctgggcgacgaatctgcggagcgtctggctgagatcctgaaaaatgccaaaaccattctgtggaatggtccggttggtgtgttcgagttccctaacttccgtaaagggaccgagatcgtggctcgcgccattgcagaaagcgaagcattttctatcgcaggcggtggtgatactttggcagcaatcgatctcttcggtattgctgaccaaatctcctacatttctactggcggtggtgctttcctggagttcgtcgaagggaaaaaactgcctgccgtagtgatgctggaagagcgcgctaagcagtaa

SEQ ID NO: 10397 - protein, 387 aa, Yersinia pestis
MSVIKMTDLDLAGKRVLIRADLNVPVKEGKVTSDARIRASLPTIEAALKQGAKVMVTSHLGRPTEGEYNEEFSLLPVVNYLKEKLSSPVRLAKDYLDGVEIAAGELVVLENVRFNKGEKKDDEALSKKYAALCDVYVMDAFGTAHRAQASTHGVGKFAPIACAGPLLSAELEALGKALGNPARPMVAIVGGSKVSTKLTVLGALSKIADKLIVGGGIANTFVAAQGHNVGKSLYEADLIPEAKRLLETCDIPVPTDVRVATEFSETAAATLKPANEIKDDEQILDLGDESAERLAEILKNAKTILWNGPVGVFEFPNFRKGTEIVARAIAESEAFSIAGGGDTLAAIDLFGIADQISYISTGGGAFLEFVEGKKLPAVVMLEERAKQ

SEQ ID NO: 10398 - DNA, 1191 bp, Listeria innocua
  CDS (1)..(1191)
atggctaaaaaagttgtaactgatttagatttaaaaaacaaaaaagttttagttcgtgttgactttaacgtgccaatgaaagacggcaaaatcactaacgacaaccgtattgtagctgcacttccaacaattgagtacatcttagaacaaaacggtaaagcaattctattttctcaccttggaaaagtaaaaacagaagaagataaagaagggaaatctcttcgtccagtagccgctcgtttaagcgaattacttggaaaagaagtgaaattcgttcctactactcgtggtccagaacttgaaaaagcagttgatgagttaaaagacggcgaagtacttctttttgaaaatacacgttttgaagatattgatggtaaaaaagaaagcaaaaatgatccagaacttggaaaatactgggctagccttggcgacgttttcgtaaatgacgctttcggtactgctcaccgtgcgcacgcgtctaacgttggaatcgcttctaacttagaatcagcggccggatttttgatggaaaaagaaattaaattcatcggcggtgtagttgataatccagcacgcccactagtagcaatcctaggtggcgcaaaagtttctgacaaaatcggtgttatcgaaaacttacttacaaaagcagacaaagtacttgtcggtggcggaatgactttcactttcatggcagctcaaggtcaagaaattggtaaatctcttttagaagcagataaagttgaacttgctaaaggcttacttgaaaaagctggcgataaattagtattaccagttgatgcagttgtatctaaagaattcagtaacgatgctcctttccatacagtgagtgcagatagcattccagctgatgaaatgggactagatattggtcaagctacaattgacttattcacaaaagaacttcaaggcgctaaaacagttgtatggaatggtccaatgggcgtattcgaacttagcaacttcgctaaaggtacaattggcgtttgtgaagctattgcaaacttaactgatgcaacaacaatcatcggtggtggggattctgcagcagcagctatggacttaggttttgctgacaaattcacacatatttccactggtggcggcgcatctttagagtatcttgaaggtaaagagcttcctggtgttgcttctattagcgacaaataa

SEQ ID NO: 10399 - protein, 396 aa, Listeria innocua
MAKKVVTDLDLKNKKVLVRVDFNVPMKDGKITNDNRIVAALPTIEYILEQNGKAILFSHLGKVKTEEDKEGKSLRPVAARLSELLGKEVKFVPTTRGPELEKAVDELKDGEVLLFENTRFEDIDGKKESKNDPELGKYWASLGDVFVNDAFGTAHRAHASNVGIASNLESAAGFLMEKEIKFIGGVVDNPARPLVAILGGAKVSDKIGVIENLLTKADKVLVGGGMTFTFMAAQGQEIGKSLLEADKVELAKGLLEKAGDKLVLPVDAVVSKEFSNDAPFHTVSADSIPADEMGLDIGQATIDLFTKELQGAKTVVWNGPMGVFELSNFAKGTIGVCEAIANLTDATTIIGGGDSAAAAMDLGFADKFTHISTGGGASLEYLEGKELPGVASISDK

SEQ ID NO: 10400 - DNA, 1164 bp, Salmonella enterica subsp. enterica serovar Typhi
  CDS (1)..(1164)
atgtctgtaattaagatgaccgatctggatctggccgggaaacgcgtttttatccgtgcggatctgaacgtacctgttaaagaagggaaagtgaccagcgacgcgcgtatccgcgcttctctgccgaccatcgaactggctctgaaacagggcgcgaaagtgatggtaacttcccacctgggtcgtcctaccgaaggcgagtacaacgaagaattctctctgctgccggttgttaactacctgaaagacaaactgtctaacccggttcgcctggtcaaagattacctggacggcgttgacgtggccgaaggtgagctggtggttctggaaaacgttcgctttaacaaaggcgaaaagaaagacgacgaagcgctgtctaaaaaatatgccgccctgtgtgacgtatttgtgatggacgcctttggtactgcgcaccgcgcgcaggcttctacccacggtatcggcaaatttgctgacgtcgcgtgcgcaggcccgctgctggccgctgaactggatgcactgggtaaagcgctgaaagagccggctcgtccgatggtggctatcgttggtggttctaaagtatctaccaaactgactgttctggattccctgtctaaaatcgctgaccagctgattgtcggcggcggtatcgccaacaccttcgttgccgctcagggccacagcgtcggtaaatccctgtacgaagctgacctggttgacgaagcaaaacgtctgctgaccacttgcgatatcccggttccgaccgatgttcgcgttgccaccgagttctccgaaaccgcaccagcgactctgaaatccgttaacgacgtgaaagaagacgagcagatcctggatatcggcgatgcttccgctcagcagctggctgaaatcctcaagaatgccaaaaccattctgtggaacggcccggttggcgtgtttgagttcccgaacttccgtaaagggactgaaatcgtggcgaatgccatcgctgatagcgaagcgttttccatcgctggcggcggcgacaccctggcggcaatcgacctgttcggcattgctgacaaaatttcctacatttctactggcggcggcgcattcctcgaattcgtggaaggtaaagttctgccagccgtagcgatgctcgaagagcgcgctaagaagtaa

SEQ ID NO: 10401 - protein, 387 aa, Salmonella enterica subsp. enterica serovar Typhi
MSVIKMTDLDLAGKRVFIRADLNVPVKEGKVTSDARIRASLPTIELALKQGAKVMVTSHLGRPTEGEYNEEFSLLPVVNYLKDKLSNPVRLVKDYLDGVDVAEGELVVLENVRFNKGEKKDDEALSKKYAALCDVFVMDAFGTAHRAQASTHGIGKFADVACAGPLLAAELDALGKALKEPARPMVAIVGGSKVSTKLTVLDSLSKIADQLIVGGGIANTFVAAQGHSVGKSLYEADLVDEAKRLLTTCDIPVPTDVRVATEFSETAPATLKSVNDVKEDEQILDIGDASAQQLAEILKNAKTILWNGPVGVFEFPNFRKGTEIVANAIADSEAFSIAGGGDTLAAIDLFGIADKISYISTGGGAFLEFVEGKVLPAVAMLEERAKK

SEQ ID NO: 10402 - DNA, 1203 bp, Nostoc sp. PCC 7120
  CDS (1)..(1203)
atgtctaaaaaaactgtggctagtttatctgctgctgatatctctggtaaacgcgctttagtgcgtgttgactttaacgtgcctttagacgatcaaggcaacatcacagacgatactcgcattcgtgcggctctgccaaccatccaagatttgacgcaaaagggcgctaaggttattctagcaagccatttcggtcgtcccaagggtgtagatgagaagttgcgtcttaccccagtagccaagcggctatctgagttgttgggacaagaagttatcaaaaccgatgactcaattggtgatgaagttgcggctaaggtggctactttgcaaaatggccaagttcttttattagaaaacgtccgtttttataaagaagaagagaaaaacgatcctgaatttgctaaaaaattagcggctaatgctgatttctacgtaaacgatgcttttggtactgcacaccgcgctcatgcgtctacggaaggcgtgactaaattcctcagcccatctgtggctggatatttggttgagaaagaattgcagtacttacaaagtgcgatcgaaaatccccaacgtcctttagcagccattatcggtggttctaaggtttccagcaaaatcggtgtgattgaaacactactagagaagtgcgacaagctgatcattggtggtgggatgattttcaccttctacaaggctcgtggtttgaatgtgggtaaatctctggtggaagaagacaagctggaactggcgaagtctttggaagctaaagccaaggaacgcggcgttagcttgttgttacctacagatgtggtattagcagataactttgcacctgatgccaattctcaaactgtcagcattgaaaacatccccgatggttggatgggtttggatatcggccctgattctgtcaaagtcttccaagcagcccttgcagataccaaaactgtcatctggaacgggcctatgggtgtgtttgagtttgataagtttgctgctggtacagaagcgatcgctcatacactagcagagattggcaaaactggcacaactaccatcatcggcggtggtgactcggtagcggctgttgagaaggtaggtttggctgatcaaatgagccacatctccaccggcggcggcgctagcttagagttactcgaaggcaaagtactgcccggtatcgctgctttagatgaagcgtaa

SEQ ID NO: 10403 - protein, 400 aa, Nostoc sp. PCC 7120
MSKKTVASLSAADISGKRALVRVDFNVPLDDQGNITDDTRIRAALPTIQDLTQKGAKVILASHFGRPKGVDEKLRLTPVAKRLSELLGQEVIKTDDSIGDEVAAKVATLQNGQVLLLENVRFYKEEEKNDPEFAKKLAANADFYVNDAFGTAHRAHASTEGVTKFLSPSVAGYLVEKELQYLQSAIENPQRPLAAIIGGSKVSSKIGVIETLLEKCDKLIIGGGMIFTFYKARGLNVGKSLVEEDKLELAKSLEAKAKERGVSLLLPTDVVLADNFAPDANSQTVSIENIPDGWMGLDIGPDSVKVFQAALADTKTVIWNGPMGVFEFDKFAAGTEAIAHTLAEIGKTGTTTIIGGGDSVAAVEKVGLADQMSHISTGGGASLELLEGKVLPGIAALDEA

SEQ ID NO: 10404 - DNA, 1203 bp, Agrobacterium tumefaciens
  CDS (1)..(1203)
atgcccgctttcaagaccatcgacgaccttaacgacattgccggaaagcgcgttctcgtccgcgttgatctcaacgtgccggtcgcggatggcaaggtgacggacgcaacccgtatcgaacgcgttgcgccgaccattctggaactctcttcaaagggcgcaaaagtcattctgctcgcccatttcggccgcccaaagggtgaacccgtcgctgagatgtcgctttcccagattgtccccacggtcgaggacgtgctggatcacgccatttccttcgcaacggactgcatcggtgcccctgcagcggatgcggtcgcaaaaatgaatgatggcgatattctgctgctggaaaacacccgcttccacaagggcgaggaaaagaacgatcccgccttcgtcgaagaactggccgcgaatggcgatatctatgtgaacgacgccttctccgccgctcaccgtgcccacgcctccaccgagggcctggcgcggcatctgcccgcttatgccggccgcaccatgcaggccgagcttgaggcgctggaaaaaggcctcggccagcccgttcgcccggtcgtcgccatcgtcggcggtgccaaggtttcgagcaagatcgatctcttgatgaacctcgtcaagaaggtcgatgccctcgtcattggcggcggcatggccaacaccttcctcgccgcccgcggcaccaatgtcggcaagtcgctctgcgagcacgatctggcagagaccgcaaagcagatcatgatcgaggcagcgacatccggttgcgctatcgtcctgccggaagacggcgtcgtcgcccgcgaattcacggccggcgcggccaatgaaattgtcgatatcaacgccattcccgccgacgccatggttctcgatgtcggtccgaaatcggttgaaagcatcaaggcctggatttcgcgggcggaaacgctggtctggaacggcccgctcggcgccttcgaaatcgaacccttcgatgcggcaaccgtggcggcggcaaaacacgctgcggaatgcaccaaggccggcaagctcgtttccgttgccggtggcggcgacaccgtcgctgcactcaaccatgccggtgtttcggacgatttcacctatatttcgacggcgggcggcgccttccttgaatggatggaaggcaaggaattgccaggcgttgccatcctgaccactgccaagtaa

SEQ ID NO: 10405 - protein, 400 aa, Agrobacterium tumefaciens
MPAFKTIDDLNDIAGKRVLVRVDLNVPVADGKVTDATRIERVAPTILELSSKGAKVILLAHFGRPKGEPVAEMSLSQIVPTVEDVLDHAISFATDCIGAPAADAVAKMNDGDILLLENTRFHKGEEKNDPAFVEELAANGDIYVNDAFSAAHRAHASTEGLARHLPAYAGRTMQAELEALEKGLGQPVRPVVAIVGGAKVSSKIDLLMNLVKKVDALVIGGGMANTFLAARGTNVGKSLCEHDLAETAKQIMIEAATSGCAIVLPEDGVVAREFTAGAANEIVDINAIPADAMVLDVGPKSVESIKAWISRAETLVWNGPLGAFEIEPFDAATVAAAKHAAECTKAGKLVSVAGGGDTVAALNHAGVSDDFTYISTAGGAFLEWMEGKELPGVAILTTAK

SEQ ID NO: 10406 - DNA, 1212 bp, Corynebacterium glutamicum
  CDS (1)..(1212)
atggctgttaagaccctcaaggacttgctcgacgaaggcgtagacggacgccacgtcatcgttcgatctgacttcaatgtccccctcaacgatgaccgcgagatcaccgataagggccgaatcattgcctccctaccaacccttaaagcactgagcgaaggtggcgcaaaggtcatcgtcatggctcaccttggccgccaaggcgaggtcaacgagaagtactccctcgcacctgtcgctgaggcactctccgatgagcttggccagtacgttgcacttgccgcagacgttgttggcgaagacgcacacgagcgcgcaaacggcctgaccgagggcgacatcctgctcctggagaacgtgcgcttcgacccacgcgaaacctccaaggacgaggcagagcgcaaccgtttcgctcaggagctcgcagctcttgcagcagacaacggcgcattcgtttctgacggcttcggtgttgtccaccgcgcacagacctccgtctacgacattgcaaagttgctgccacactacgctggcggactggtagagaccgagatttccgttctggaaaagatcgcagaatcaccagaggcaccatacgtagtggttctcggtggatccaaggtctctgacaagatcggtgttattgaggcgctggctgccaaggctgacaagatcatcgtcggtggcggcatgtgctacaccttcctcgcagctcagggacacaacgttcagcagtccctcctgcaggaagaaatgaaggctacctgcaccgacctgctcgcttcggtggacaagatcgttctcccagttgacctggttgcagcatccgaatttaacaaggacgcagagaagcagatcgttgacctggactccatcccagaaggctggatgtctcttgacatcggaccagagtccgtcaagaacttcggtgaggttctcagcaccgctaagaccatcttctggaacggcccaatgggcgtgttcgagttcgcagcattctctgaaggcacccgcgcatcgcccaggccatcatcgatgcaacatgcaggcaacgacgcattctccgttgttggcggtggcgactccgcagcatccgttcgcgtgctcggcctgaacgaagacggcttctcccacatctccaccggtggtggcgcatccctcgagtaccttgaaggcaaggaactcccaggcgttgcaattctcgctcagtaa

SEQ ID NO: 10407 - protein, 403 aa, Corynebacterium glutamicum
MAVKTLKDLLDEGVDGRHVIVRSDFNVPLNDDREITDKGRIIASLPTLKALSEGGAKVIVMAHLGRQGEVNEKYSLAPVAEALSDELGQYVALAADVVGEDAHERANGLTEGDILLLENVRFDPRETSKDEAERNRFAQELAALAADNGAFVSDGFGVVHRAQTSVYDIAKLLPHYAGGLVETEISVLEKIAESPEAPYVVVLGGSKVSDKIGVIEALAAKADKIIVGGGMCYTFLAAQGHNVQQSLLQEEMKATCTDLLASVDKIVLPVDLVAASEFNKDAEKQIVDLDSIPEGWMSLDIGPESVKNFGEVLSTAKTIFWNGPMGVFEFAAFSEGTRASPRPSSMQHAGNDAFSVVGGGDSAASVRVLGLNEDGFSHISTGGGASLEYLEGKELPGVAILAQ

SEQ ID NO: 10408 - DNA, 1236 bp, Methanobacterium thermoautotrophicum
  CDS (1)..(1236)
atgatggtgatcccggtgtcctttaaatttaaaaccatggatgacattgaagtcacaggaaagacagtccttgtccgcgtggacataaattcgcctgtggaccccaatgatgggacaatactcgatgatacaaggatgaggctccatgcagagaccataagggaactctcagataggggtgccaggacagttgtgatggcccaccagagcagacccgggaagaatgacttcacaacactggagcagcatgccagggcgctctccgggatactcaggaggcccgttaagtacgttgaggatatattcggatccgctgcaagggagaacatctcaggactgggtgatggtgagataatcctccttgagaacgtccgcttctactccgaggaggtgctcaagcgagaccctgaggaacaggcggagacacaccttgttaggaagctggcgcccctcctggactacttcatcaacgacgccttcgcggcagcccacaggtcccagccctcccttgttggcttcgccctgagggtaccgtcagctgcgggtcgtgtgatggagagggaacttcgaacacttcagggtgcccttgagaatgttgaaaggccctgtgtctatgttctcggcggggtgaaggttgatgactccatcatggtcatgaagaacgtccttgaaaacggtagcgcagaccttgtactgacaacgggccttgttgccaacatattcctggcgggatgcggggttaagatcggtaaggtgaacatggacttcatcaagagcaggggatactgtgacttcatcaaggtggcgaagaaactgaagaagcgcttccctgaaaggatagttgtacccgttgatgttgcagtatgcagggacggcaagagggttgatgttcctgtgaaaaagatacccaaccatccgatacaggatatcggaatggaaaccataaagctctacgccaggaggatacgtgaggcaaggaccctctttgccaatggaccggcaggcgtatttgagaaccctgatttcagcataggaaccgaggacatactgaatgcaatatcctcttcagaaggtttctcaataatcggcgggggtcaccttgctgctgcagcagtgaagatgggctttgaggacagcataaaccatatcagcagtggaggcggtgccagcataagcctccttgcaggtgaggagcttcccgcagtcagggtgcttgaggaatccaggcacccataa

SEQ ID NO: 10409 - protein, 411 aa, Methanobacterium thermoautotrophicum
MMVIPVSFKFKTMDDIEVTGKTVLVRVDINSPVDPNDGTILDDTRMRLHAETIRELSDRGARTVVMAHQSRPGKNDFTTLEQHARALSGILRRPVKYVEDIFGSAARENISGLGDGEIILLENVRFYSEEVLKRDPEEQAETHLVRKLAPLLDYFINDAFAAAHRSQPSLVGFALRVPSAAGRVMERELRTLQGALENVERPCVYVLGGVKVDDSIMVMKNVLENGSADLVLTTGLVANIFLAGCGVKIGKVNMDFIKSRGYCDFIKVAKKLKKRFPERIVVPVDVAVCRDGKRVDVPVKKIPNHPIQDIGMETIKLYARRIREARTLFANGPAGVFENPDFSIGTEDILNAISSSEGFSIIGGGHLAAAAVKMGFEDSINHISSGGGASISLLAGEELPAVRVLEESRHP

SEQ ID NO: 10410 - DNA, 1233 bp, Aeropyrum pernix
  CDS (1)..(1233)
atggggggcaggctcgctactctggacgacgttgatgttaggggtaagaaggttatagtccgtttcgaccttaatagccctgtaggtaatggaggcgaaatactggacgactcccgtatagctgaggctgcaggaaccctaagggaactctgcgataggggtgcagcggtggtcgctctcagccaccagggcaggcctcttgaaagcgatttcgtcagcctggagagacatgcatcattactgtcaagatattcgggcgttgaagtgagatttgtgatggatgtaattgggcctgaggctctaaggacagttgcatcgctgagaccgggagaggcagtgctgcttgacaatactaggataattagcgaggactttattgaggctgagggcactgtccatgctagaggtattatggtcaccaggctctccaagctagctaacatgtatgttaacgaggctttctccgcttctcacaggagccaggcaagcattgtcggctttccctacgtcctcccctctgcgggcgggcgagtcttggagaaggagatccgctcgctaaaccgagcagtatcctcgggtgagagacccaaggtcgtcgtgctggggggcgcgaagctgaaggatgccgtcaggatagtggactacctatcctcatctggagttgcagacgaagtgctgaccacgggcctcgttggcctcctcttcctctatgcccgtggctacaggcttccgagagacgtgacaaagctcctggaaaagaaggggggtgaggaggctatagcgaaggctaggagaatcgttgaggaggggagaagggttaggacccctatagacttcgttgtggaggttggcgataagatctacataaagcctgcggacgagctgacagagggtgtgccaaaggacatagggccgtcgacggtagagtattttagagcgaagatgaggggtgccagggtaatagtgatgaggggtcctgccggggttatagaggaccccaggttcaggaggggcactgtcgagctggtcaaggccgccctgtcttcaggcgcctacactgtattcgggggcgggcatttcagggctatacttagagatctccccgaacatcttagtagtaaggtgggccacttgagcaccgggggcggggcactcttgtattatctgtcgggacggcccctccccggggttaaagccttagtagactcggcgaggatatttaatctggtttag

SEQ ID NO: 10411 - protein, 410 aa, Aeropyrum pernix
MGGRLATLDDVDVRGKKVIVRFDLNSPVGNGGEILDDSRIAEAAGTLRELCDRGAAVVALSHQGRPLESDFVSLERHASLLSRYSGVEVRFVMDVIGPEALRTVASLRPGEAVLLDNTRIISEDFIEAEGTVHARGIMVTRLSKLANMYVNEAFSASHRSQASIVGFPYVLPSAGGRVLEKEIRSLNRAVSSGERPKVVVLGGAKLKDAVRIVDYLSSSGVADEVLTTGLVGLLFLYARGYRLPRDVTKLLEKKGGEEAIAKARRIVEEGRRVRTPIDFVVEVGDKIYIKPADELTEGVPKDIGPSTVEYFRAKMRGARVIVMRGPAGVIEDPRFRRGTVELVKAALSSGAYTVFGGGHFRAILRDLPEHLSSKVGHLSTGGGALLYYLSGRPLPGVKALVDSARIFNLV

SEQ ID NO: 10412 - DNA, 1203 bp, Campylobacter jejuni
  CDS (1)..(1203)
atgagtgatattatttctataaaagacattgatttagctaagaaaaaagtttttataagatgtgattttaatgttcctcaagatgattttttaaatatcactgatgatagacgcataagatcagctattcctacgataagatattgtttggataatggttgtagtgtgattttagcctctcatttagggcgtccaaaagaaattagctctaaatattctttagaacctgtggctaagcgtcttgctagacttttagataaagaaattgttatggcaaaagatgttatcggcgaagatgcaaaaaccaaagctatgaatttaaaagcgggtgaaattttacttcttgaaaatttgcgttttgaaaaaggcgaaactaaaaatgatgaaaatttagccaaagaacttgcttctatggttcaagtttatatcaatgatgcttttggagtatgccatagagcacattctagtgtagaggcgattactaaattttttgatgaaaaacacaaaggcgcaggatttttactccaaaaagaaattgattttgcaagcaatcttatcaaacatccagcacgtccttttgtcgctgttgttggaggttcaaaggtaagtggaaaacttcaagcattgacaaatttattaccaaaggtagataaattaatcataggcggaggtatggcatttacttttttaaaagctttaggttatgatataggaaattcacttttagaagaagaacttttagaagaagctaataaaattcttaccaagggtaaaaatttaggagtgaaaatttatcttccagtagatgttgtagccgctcctgcgtgctcacaagatgtgccgatgaaatttgttccagcgcaagaaattccaaatggttggatgggtttagatataggacctgcgagtgtgagactttttaaggaggtgatttctgatgcgcaaacgatttggtggaatggacctatgggtgtttttgaaattgataaattttcaaaaggtagcattaaaatgagtcattatatcagcgaaggacatgcaacttctgttgttggaggcggtgatacggctgatgtggttgcgcgtgcaggtgatgcagatgaaatgacttttatttctactggaggtggtgcttctcttgaacttatagaaggcaaagaacttccaggtgtaaaagctttaagatctaaggaaaatgaatga

SEQ ID NO: 10413 - protein, 400 aa, Campylobacter jejuni
MSDIISIKDIDLAKKKVFIRCDFNVPQDDFLNITDDRRIRSAIPTIRYCLDNGCSVILASHLGRPKEISSKYSLEPVAKRLARLLDKEIVMAKDVIGEDAKTKAMNLKAGEILLLENLRFEKGETKNDENLAKELASMVQVYINDAFGVCHRAHSSVEAITKFFDEKHKGAGFLLQKEIDFASNLIKHPARPFVAVVGGSKVSGKLQALTNLLPKVDKLIIGGGMAFTFLKALGYDIGNSLLEEELLEEANKILTKGKNLGVKIYLPVDVVAAPACSQDVPMKFVPAQEIPNGWMGLDIGPASVRLFKEVISDAQTIWWNGPMGVFEIDKFSKGSIKMSHYISEGHATSVVGGGDTADVVARAGDADEMTFISTGGGASLELIEGKELPGVKALRSKENE

SEQ ID NO: 10414 - DNA, 1185 bp, Bacillus subtilis
  CDS (1)..(1185)
atgaataaaaaaactctcaaagacatcgacgtaaaaggcaaagttgtattctgccgcgttgactttaacgttccaatgaaagacggggaagtaacagacgatacacgtatccgtgctgcgcttccaacaatcaaacaccttgcagaccaaggcgcaaaagtccttcttgcgagccacttaggccgcccgaaaggcgaagtggttgaggagcttcgtttaactcctgtcgctgcacgtctcggcgaactgcttggcaaagaagtgaaaaaagcggatgaagcatacggcgatgctgtaaaagcacaaatttctgagatgaaggacggagacgttcttgtattggaaaacgtacgtttctatcctggtgaagagaaaaatgatcctgagcttgcaaaagcatttgctgagcttgcagatgtatatgtaaatgacgcattcggtgctgcccaccgtgctcacgcatctacagctggaattgccgagcatctgccagcagttgcaggtttcttaatggaaaaagagcttgatgtacttggaaaagcggtttccaatcctgaccgcccgttcacagcgatcatcggcggagcgaaagtaaaagacaaaatcggtgtaatcgaaagtcttcttgataaagtagacaacctgatcatcggcggaggtcttgcttatactttcgtaaaagcgcttggctatgaagtcgggaaatctcttcttgaagaggataaaatcgagcttgcgaaatcatttatggaccgcgctaaagaaaaaggcgttaacttctacatgcctgaagatgtactcgttgcagatgatttctctaacgatgcaaacgtgaaaattgtgccgatctctgaaatccctagtgatttagaagcaatcgacattggtacgaaaacacgcgaaacgtatgctgacgtcatcaaaaacagcaaacttgtcgtgtggaacggaccaatgggcgtattcgaaatcgacttgttcgctcaaggaacaaaagcggttgcggaagcattggcagaggcgaaagatacatactctgtcatcggcggaggagactctgcggcagcggttgaaaaattcggccttgctgacaaaatgagccacatctcaacaggcggcggcgcatcccttgagtttatggaaggcaaagagcttccaggggtagctgcactgaacgataaataa

SEQ ID NO: 10415 - protein, 394 aa, Bacillus subtilis
MNKKTLKDIDVKGKVVFCRVDFNVPMKDGEVTDDTRIRAALPTIKHLADQGAKVLLASHLGRPKGEVVEELRLTPVAARLGELLGKEVKKADEAYGDAVKAQISEMKDGDVLVLENVRFYPGEEKNDPELAKAFAELADVYVNDAFGAAHRAHASTAGIAEHLPAVAGFLMEKELDVLGKAVSNPDRPFTAIIGGAKVKDKIGVIESLLDKVDNLIIGGGLAYTFVKALGYEVGKSLLEEDKIELAKSFMDRAKEKGVNFYMPEDVLVADDFSNDANVKIVPISEIPSDLEAIDIGTKTRETYADVIKNSKLVVWNGPMGVFEIDLFAQGTKAVAEALAEAKDTYSVIGGGDSAAAVEKFGLADKMSHISTGGGASLEFMEGKELPGVAALNDK

SEQ ID NO: 10416 - DNA, 1269 bp, Ureaplasma urealyticum
  CDS (1)..(1269): transl_table=4
atgaatagtttaaataaaaaaagtataaaagatcttgatgtaaatggtaaaacaatagttttacatttagatttaaatgttgttgttgattatgaaaataaacgcatattaaatgatcgtaaattacgagcatcactaccaactattaattatttaattaatcataacgctaaaattgttattttaagtcatttaggtcgaattaaaaccttagcagataaacaaagtggtaaatatagtttagaaattattgttgatgaactccgtaatcgtgtatccaagaatgttaatcgtgttgtattttcacctttaaattatggagaaacggtcgtacaaatggttaatgatttagaagaaagagacattttaattttagaaaatacgcgttattgtgatattagtgatgaaggtgaatatgttgggcttgaatgagatggttcagagattttaggacagttttggggaatgctaggggatatttttattgatgatgcatatggagttgctcatcgacaattatcatcaaattatcaaacagctaaatttgctaaaaaaagtgcattaggttttttaattgttaatgaaattaaccatctagatattgctttagaagttcctaaaagtccgtatttagctttaataggtggtaaccgtgttgctgataaaattgcagcaattgaagtattatgtgaacgggctgatcaagttattattgggggaggattagtctatacatttttatatgctcaagggtataacgttggtttaaatttagtagaacgcaatatgattgatgattgcaataatatattagaaaaatacggtaaaaaaattttaatttgttttgattttttatgtaacaatgattttagtgatacaagaccgatttatcgtaaaatagatgaaggtcttgaagggttatatggtttagatattggtaaaagaagtttaaaatttattaaacatgaaatttatcgttctaaaactattttactaaatggtccctttggtgttattgaaaatattaagaattatgcacaaggtactactgaaatatgtaaatcaatggcaaaacaaacaacacgtggcgcttatacaattatatgtgatatcgatacttcgagtcatgctgaatacctaggattagataaatatattaattttatatctactggtgggggcgctagcttatcatatattgaagaaggagttcttgatggtcttgaaaccattgataatgttcctttaaatgttttaaagaaggagtaa

SEQ ID NO: 10417 - protein, 422 aa, Ureaplasma urealyticum
MNSLNKKSIKDLDVNGKTIVLHLDLNVVVDYENKRILNDRKLRASLPTINYLINHNAKIVILSHLGRIKTLADKQSGKYSLEIIVDELRNRVSKNVNRVVFSPLNYGETVVQMVNDLEERDILILENTRYCDISDEGEYVGLEWDGSEILGQFWGMLGDIFIDDAYGVAHRQLSSNYQTAKFAKKSALGFLIVNEINHLDIALEVPKSPYLALIGGNRVADKIAAIEVLCERADQVIIGGGLVYTFLYAQGYNVGLNLVERNMIDDCNNILEKYGKKILICFDFLCNNDFSDTRPIYRKIDEGLEGLYGLDIGKRSLKFIKHEIYRSKTILLNGPFGVIENIKNYAQGTTEICKSMAKQTTRGAYTIICDIDTSSHAEYLGLDKYINFISTGGGASLSYIEEGVLDGLETIDNVPLNVLKKE

SEQ ID NO: 10418 - DNA, 1161 bp, Haemophilus influenzae
  CDS (1)..(1161)
atgtcagtaatcaaaatgaccgatttagatttagccggtaaacgtgtatttatccgtgcagatcttaatgtgccagtaaaagatggcaaagtgacctcagatgcgcgtattcgtgcgaccattcctactttaaaattagccttagaaaaaggtgcgaaagtgatggtaacttctcacttaggtcgtccaactgaaggagaattcaaaccagaagattctttacaaccagttgttgattacttaaaaaacgcaggctttaatgtgcgtttagaacaagattatttaaatggtgtggatgttaaagatggcgaaatcgttgttttagaaaacgtacgcgtaaacaaaggcgaaaagaaaaatgatccagaattaggtaaaaaatatgccgcactttgcgacgtatttgtaatggatgcctttggtacagcgcaccgcgcgcaagcatcaacttatggcgttgcagaatttgcgccgatcgcttgtgcaggcccattattagccgctgagttagatgcattaggtaaagcattaaaagaacctgctcgtccaatggtggctattgttggtggttctaaagtttccactaaattagaagtattaaattctctttcaaaaatcgctgaccaaattattgtgggcggtggcattgcgaatactttcatcgcggcagctggtcacaatgtaggtaaatctttatatgaagctgatttaattccagttgcgaaagaattagccgcaaatacagatattccagttccagttgatgtgcgtgtaggtttagagttctctgaaacggcagctgcaacagaaaaagtggtaaatgaagtgaaagatgatgaatctatttttgatattggcgataaatcagcagaacaattggctgaaattatcaaaaatgcaaaaaccgttttatggaatggcccagttggcgtgtttgagttccctcacttccgtaaagggactgaaatcatttctcacgccattgcaaacagcgatgcattctctatcgctggtggcggcgataccttagcggctatcgatttatttggtattgctgataagatttcttacatttcaacgggtggtggtgcattcttagagtttgtagaaggcaaagtattacctgcagtagaaattcttgaaaaacgtgcgaaaaactaa

SEQ ID NO: 10419 - protein, 386 aa, Haemophilus influenzae
MSVIKMTDLDLAGKRVFIRADLNVPVKDGKVTSDARIRATIPTLKLALEKGAKVMVTSHLGRPTEGEFKPEDSLQPVVDYLKNAGFNVRLEQDYLNGVDVKDGEIVVLENVRVNKGEKKNDPELGKKYAALCDVFVMDAFGTAHRAQASTYGVAEFAPIACAGPLLAAELDALGKALKEPARPMVAIVGGSKVSTKLEVLNSLSKIADQIIVGGGIANTFIAAAGHNVGKSLYEADLIPVAKELAANTDIPVPVDVRVGLEFSETAAATEKVVNEVKDDESIFDIGDKSAEQLAEIIKNAKTVLWNGPVGVFEFPHFRKGTEIISHAIANSDAFSIAGGGDTLAAIDLFGIADKISYISTGGGAFLEFVEGKVLPAVEILEKRAKN

SEQ ID NO: 10420 - DNA, 1194 bp, Aquifex aeolicus
  CDS (1)..(1194)
atgcttagaaaaaagaccttaagggacgttgacgtaaaggggaagagagttctcgtaagggttgattacaacgttccactagacgaacagggaaacatagtagacgacacgcgtataagggcttcccttcccacagttgagtacctccttgacgcaaacgcaaaggtaattttgatgtcccatctaggaagacctaaaaacagggatccaaagtacagtttggcaccggtagccaaaagactttcaaggtatataaacaaggaggtaaaactcgccccggactgcgtgggagaagaagtaaagcgaattgtaaactccatgaaagagggagacgtagttctccttgaaaaccttaggttccataaagaagaaacggagtgcgatgagaactttgcgagagagcttgcgagtctgggagaagtttacgttgcggacgccttcggaacctgtcacagaaagcacgcaagcgtgtacctcgttcccaagtttttaaaacccgccgtaatgggatttttactggaaaaggaaatcacttactttgaaaaggcgatggtagcaccccagagacccgtggtcgctatcctgggaggtgctaaagtttcctccaaactcgaagtgataaagaacctaataaggagggtagacaaactatttataggcggcgctatggcctttaccttcctcaaagctatgggctacaaggttggaaattccctcgtggaggacgacctacaggacgttgcaagggatttaatagatgttgcaaaaaagctagagattaaactctaccttcccgttgactttgtgatagggcaggaagtctcggaaaacactcccacgaaagtagtaccctggcaggagataccagacgggtggatggggcttgatatcggacccgtttccgttgaactcgtaaaggaaataatttccgatgcccagacaattgtgtggaacgggcccatgggagtgtttgaaatagacaagttcaaacatggaacaatagaggtcgcgaaattactcgcccaatcttcagccctcacgatagcgggcggaggagatacggaccacgccattcacaaggcgggagtttatcacgcctttgacttcgtctccacaggaggaggagctttcctggaacttctcgcggggaaagaactgccctgtctcgttaaccttgacgacaaggaggcttaa

SEQ ID NO: 10421 - protein, 397 aa, Aquifex aeolicus
MLRKKTLRDVDVKGKRVLVRVDYNVPLDEQGNIVDDTRIRASLPTVEYLLDANAKVILMSHLGRPKNRDPKYSLAPVAKRLSRYINKEVKLAPDCVGEEVKRIVNSMKEGDVVLLENLRFHKEETECDENFARELASLGEVYVADAFGTCHRKHASVYLVPKFLKPAVMGFLLEKEITYFEKAMVAPQRPVVAILGGAKVSSKLEVIKNLIRRVDKLFIGGAMAFTFLKAMGYKVGNSLVEDDLQDVARDLIDVAKKLEIKLYLPVDFVIGQEVSENTPTKVVPWQEIPDGWMGLDIGPVSVELVKEIISDAQTIVWNGPMGVFEIDKFKHGTIEVAKLLAQSSALTIAGGGDTDHAIHKAGVYHAFDFVSTGGGAFLELLAGKELPCLVNLDDKEA

SEQ ID NO: 10422 - DNA, 1236 bp, Deinococcus radiodurans
  CDS (1)..(1236)
atgacgggtttgtgcccgctccatcaaccatcacctcttgaccatccacattccggaggaacacccatgcaaaacctcagtcaattggatgtcaagggcaagcgcgtcctggtgcgcgtggactacaacgtgccggttggggacggcgtggtacaggacgacacccgcatcacggcgagcgtgccgaccatcaagaagctgcttgacggcggcgccagcgtcgtgctgatgagccacttcggacggcccaagaatggccccgaggacaagtacagcctgaagccggtggctgaggccgtcagccgcgcactcgggcaggacgtgaagttcattcccagcctgccaggcagcgacgaaaccctccaggccgtgcaggcgctcaggcccggtgaagtcgcgctgctggaaaacgtgcgcttcgaggcgggcgaggaaaagaacgatgcggcgctgaacgacaagctggccaagctgggtgacgccttcgtcctcgacgcgtttggctcggcgcaccgggcgcactcgtcggtcagcggcgtggccggcaagctaccgcacgcggcgggcgggctgctccagagcgaagtggacgcgctcggcaagttgctgcacgcgccggagcatccctacgtggtcatcatcggcggggcgaaagtcagcgacaagatcaaggtgatcgagaacctgctgcccaaagtggaccgcatgctgatcggcggcggaatgatgttcaccttcatcaaggcgcgcggcgggcagatcggcaacagtctggtggaagacgaccagcttgacctggcgaaggggttgctggagaagtacggtgacaagctgctgcttccgaccgacgcggtggccgccgacaaattcgccgccgatgctcagagcaaagtcgtccctgccgaccagattcctgacggctggatgggcctcgatatcgggcctgacacgcagcgggcgtatgccgacgccttgcagggcgccaaaactgtcttctggaacggtccgatgggcgtgttcgagttcgaccagttcgcggcaggcaccaacgcggtggcggcggcggtggggagcctgaaagaccaggcctacaccgtggtcggcggcggcgactcggtgagcgccatcaacaagagcggcaaggccgaccagatcgaccacatctccaccggcggcggtgcgagcctggaactgctggaaggcaaggagctgcccggcgtcgtggcgatggcgtga

SEQ ID NO: 10423 - protein, 411 aa, Deinococcus radiodurans
MTGLCPLHQPSPLDHPHSGGTPMQNLSQLDVKGKRVLVRVDYNVPVGDGVVQDDTRITASVPTIKKLLDGGASVVLMSHFGRPKNGPEDKYSLKPVAEAVSRALGQDVKFIPSLPGSDETLQAVQALRPGEVALLENVRFEAGEEKNDAALNDKLAKLGDAFVLDAFGSAHRAHSSVSGVAGKLPHAAGGLLQSEVDALGKLLHAPEHPYVVIIGGAKVSDKIKVIENLLPKVDRMLIGGGMMFTFIKARGGQIGNSLVEDDQLDLAKGLLEKYGDKLLLPTDAVAADKFAADAQSKVVPADQIPDGWMGLDIGPDTQRAYADALQGAKTVFWNGPMGVFEFDQFAAGTNAVAAAVGSLKDQAYTVVGGGDSVSAINKSGKADQIDHISTGGGASLELLEGKELPGVVAMA

SEQ ID NO: 10424 - DNA, 1197 bp, Halobacterium sp. NRC-1
  CDS (1)..(1197)
atggcgatacggaccctcgacgacctggcggcggccaaccgcgcgatcggggtgcgcgtcgacatcaacagcccgctgacggccgccggcgggctggccgacgacgctcgcctgcgcgcgcacgtcgacacgctcgccgaactgctggctgcggacgcgcgcgtcgccgtgctcgcccaccagggccgaccgggcggcgacgagttcgcgcgcctcgaacgccatgccgaccgcctcgacgcgcttctcgatgcgcccgtctcctactgcgacgcgacgttctccacgggggcacgcgacgccgtcgccgacctcgcacccggcgaggcggtcgtgcttgagaacacccgcttctacagcgaggagtacatggcgttcgcccccgagcgcgcggccgacaccgcgctcgtcgatggcctcgcgccggcgctggacgcgtacgtgaacgacgcgttcgccgccgcccaccgctcacaaccctccctggtcgggttcccggaagtcctcccgtcctacgcggggcgcgtgatggaggccgaactggacgcactcagcggcgtcgccgacacgccaacgccacgcacgtacgtcgtcggtggcgcgaaagtgccggactccgtggaagtcgcggcacacgccctctcccacgggctcgccgacaacgtactcgtgaccggcgtggtggcgaacgtcttcctggcggccaccggtgtcgatctcggccgggcgtcgaccgacttcatccacgagcgcgactacgggacggagatcgcgcgcgcagccgacctgctcgcggcgcacaacgacgccctccacctgcccgtcgacgtggccgtcgagcgcgacggcgcgcggtgtgaactctccaccgacgccttgcccccggccggcgacgaagccgtctgtgacatcggcagtgacaccgtcgacgcgtacgccgacgtgctggcggactccgaaaccgtcgtggtaaacgggccggccggcgtcttcgaggacgacctgttcgccgacgggacgcgtggcgtcttcgacgcggcgtcggaagtcgagcacagcatcgtgggtggcggcgacaccgcggccgcgatccggcgcttcgacatcaccggcttcgaccacgtgagcacgggcggcggtgccgcgatcaacctcctgaccgacgccgacctgcccgcggtggcggcgctgcgatga

SEQ ID NO: 10425 - protein, 398 aa, Halobacterium sp. NRC-1
MAIRTLDDLAAANRAIGVRVDINSPLTAAGGLADDARLRAHVDTLAELLAADARVAVLAHQGRPGGDEFARLERHADRLDALLDAPVSYCDATFSTGARDAVADLAPGEAVVLENTRFYSEEYMAFAPERAADTALVDGLAPALDAYVNDAFAAAHRSQPSLVGFPEVLPSYAGRVMEAELDALSGVADTPTPRTYVVGGAKVPDSVEVAAHALSHGLADNVLVTGVVANVFLAATGVDLGRASTDFIHERDYGTEIARAADLLAAHNDALHLPVDVAVERDGARCELSTDALPPAGDEAVCDIGSDTVDAYADVLADSETVVVNGPAGVFEDDLFADGTRGVFDAASEVEHSIVGGGDTAAAIRRFDITGFDHVSTGGGAAINLLTDADLPAVAALR

SEQ ID NO: 10426 - DNA, 1173 bp, Buchnera sp
  CDS (1)..(1173)
atgactataagaaaaatgactgaactaaatataacagagaaaagaattttaataagaagtgatttaaatgtccctatagaaaatggaattatccaatctgatgctagaatactagctgcactacctaccattgaattggctcttcagaaaaaagctaaagtcattattatgtctcatttaggaagaccaaaagaaggatattatacaaaaaaatattccttatttcctatatttgaatattttaaaaaaaaatttaataatacaaaaatatatttttccaataattttttagatggtattaaactgaatccaggagaaatcgcacttttagaaaacactcgattcaataaaggtgagttaaacaatgacgaacaattatctaaaaaatattctgatctttgcgatatatttgtaatggacgcatttggaagtgcacatagaatgcaatcatctacctatgggattggaaaatttgttaaaattgcatgtgctggacttcttttaataagtgaaattgatgctttaaaaaaagcattaaaaaaaccaaaacgaccaatggttgctatagttggaggctcaaaagtatcaactaaatttaatgtattaaataaattgtctaaaattgcagatacaataatagttggaggtggtatagcaaatacatttttagctattgattacaaaataggaaaatcattatatgaaccagattttgtatttgaagctaaaaaattacgtgataaatacaatattattgtgccaattgactctcgtgttggaaaaaatttttgtaagaacgaacaggctataatcaaatcacctgataatatcaaagaagatgaagaaataatggattttggtgatgaaagtattaaaaaaattattagtattattacacaatctcaaacaattatgtggaacggaccagttggggtatttgaatttccaaactttagaaaaggtactgagatgattgcaaagacaattgcaaatagcaatgcattttctatagcaggaggaggagatacattatctgttatcgatatgtttaatataaaaaataatatctcttatatttcaaccggaggaggagcttttttagaatttatagaaggaaaaaaactacctgcaatacaaatgttagaagaaaattttaaaaataaatcaaaataa

SEQ ID NO: 10427 - protein, 390 aa, Buchnera sp
MTIRKMTELNITEKRILIRSDLNVPIENGIIQSDARILAALPTIELALQKKAKVIIMSHLGRPKEGYYTKKYSLFPIFEYFKKKFNNTKIYFSNNFLDGIKLNPGEIALLENTRFNKGELNNDEQLSKKYSDLCDIFVMDAFGSAHRMQSSTYGIGKFVKIACAGLLLISEIDALKKALKKPKRPMVAIVGGSKVSTKFNVLNKLSKIADTIIVGGGIANTFLAIDYKIGKSLYEPDFVFEAKKLRDKYNIIVPIDSRVGKNFCKNEQAIIKSPDNIKEDEEIMDFGDESIKKIISIITQSQTIMWNGPVGVFEFPNFRKGTEMIAKTIANSNAFSIAGGGDTLSVIDMFNIKNNISYISTGGGAFLEFIEGKKLPAIQMLEENFKNKSK

SEQ ID NO: 10428 - DNA, 1209 bp, Chlamydophila pneumoniae, Chlamydia pneumoniae
  CDS (1)..(1209)
atggataagctaacagtacaagatctttctccagaagaaaaaaaagtcctcgtacgtgtagatttcaatgtccccatgcaagatggcaagatactcgatgacattcgtattcgcagtgcgatgcctacaatcaactatctacttaagaaacatgctgcagtgattttaatgagtcatttagggcgacctaaaggacaggggttccaagaggaatattctctgcaacccgttgtggatgttctcgaaggatacttaggacatcatgtgcctctagctccagattgtgtgggtgaggttgcacgtcaagctgtagctcagctttctcctggtcgcgttttgcttcttgagaacttgcgtttccatataggagaagaacatccagaaaaagacccgacgttcgccgcagaactctcttcctacggggatttctatgtcaacgatgctttcggaacttcgcatagaaaacatgcttcagtctatgtagtgccgcaggctttcccaggtagagccgcagcaggcctgcttatggaaaaagaattggaatttttaggaagacatctattgacctcccctaagaggcctttcactgccatccttggaggagctaagatttcttctaaaattggagttatagaggctctactgaatcaagtagactacctcttattagctggaggtatgggatttactttcctacaagccttgggaaaatccctagggaactctcttgtggagaaatctgccttggatcttgctagaaatgtattgaaaattgctaaaagtcgtaatgttaccatagttttgcctagcgatgtgaaagcagccgaaaatctccaatctaaggaatattctgtgatttctatagatcaaggcattcctccgcatcttcaaggctttgatattggacctagaacaaccgaagaatttatccgtattataaaccaatcagcgactgtgttttggaatggtcctgtgggtgtttatgaggtccctccttttgactctggatctattgctatagcgaatgccttaggcaatcacccttcagctgttactgtcgtgggtggaggagatgcggcagctgtggttgctttggcaggctgctctacaaaagtttcccatgtttctactggaggaggggcttctttagagtttctagagcagggcttcctcccaggtacagaagttttatctccatccaaaagctaa

SEQ ID NO: 10429 - protein, 402 aa, Chlamydophila pneumoniae, Chlamydia pneumoniae
MDKLTVQDLSPEEKKVLVRVDFNVPMQDGKILDDIRIRSAMPTINYLLKKHAAVILMSHLGRPKGQGFQEEYSLQPVVDVLEGYLGHHVPLAPDCVGEVARQAVAQLSPGRVLLLENLRFHIGEEHPEKDPTFAAELSSYGDFYVNDAFGTSHRKHASVYVVPQAFPGRAAAGLLMEKELEFLGRHLLTSPKRPFTAILGGAKISSKIGVIEALLNQVDYLLLAGGMGFTFLQALGKSLGNSLVEKSALDLARNVLKIAKSRNVTIVLPSDVKAAENLQSKEYSVISIDQGIPPHLQGFDIGPRTTEEFIRIINQSATVFWNGPVGVYEVPPFDSGSIAIANALGNHPSAVTVVGGGDAAAVVALAGCSTKVSHVSTGGGASLEFLEQGFLPGTEVLSPSKS

SEQ ID NO: 10430 - DNA, 1670 bp, Arabidopsis thaliana (mouse-ear cress)
  CDS (39)..(1475)
attccctcactttcactctcactatctgttgacttcacatggcttccaccgccgcaactgcagctctttcgatcatcaaatccaccggtggcgccgccgttacacgctcctcccgcgcctcctttggacacattccctccacatctgtctccgcacgtcgccttggcttctccgccgtcgttgactctcgtttctcggtccacgtggcgtccaaggtccactccgtgcgcggaaagggcgccaggggagtgattacgatggcgaagaagagtgttggagatctgaattctgtagatttgaaggggaagaaggtgtttgttagagctgatctcaatgtacctctcgatgacaaccagaatatcactgacgacactagaatcagagccgccattcccaccatcaagtttttgattgagaatggtgctaaggtcatcctctccactcatttgggaaggccaaagggtgtcactccaaagttcagcttggctcctcttgttcccagattatcagagctccttggtattgaggtcgtgaaagctgatgattgtattggtccagaagtggaaaccttggtggcttcccttcctgaaggtggagttttgcttcttgagaacgtgaggttttacaaggaggaagagaagaacgaacctgattttgctaagaagcttgcttctctagctgacctttatgtcaacgatgcgttcgggactgctcacagagcccatgcttcaacagagggagtcactaagttcttgaagccatcagttgctggtttccttttgcaaaaggagttggactaccttgttggtgcggtttcaaacccaaagagaccatttgctgccattgtgggaggttccaaggtctcatctaagattggagttatcgaatcgcttcttgagaaatgtgacatccttctgcttggtggtggaatgatctttacattctacaaggcgcaaggtctttccgttggctcctcccttgttgaagaagacaagcttgaattggctacaacactccttgccaaggctaaggccagaggagtctctctgttgttaccaacagatgttgtgattgctgacaagttcgctcctgatgccaacagcaagattgtgccagcatcagccattcctgatgggtggatgggattggacatcggtccagactcggtgaaaacattcaacgaagctctggataccacgcagacagtcatttggaatggaccaatgggagttttcgagtttgaaaagtttgcaaaaggaactgaggcggtagcgaataaactagcagagctaagcaaaaagggagtgacaacgataataggaggaggagactcggtggcagcagtggagaaagtgggagtagcaggagtcatgagtcacatctccacaggtggtggtgccagtttggagctcttggaaggcaaagtgcttcccggtgtcgtcgctcttgatgaagcaacgccagtcactgtttaacaacatctctttattacacctgaagggacccccctaaatgagtttcttcttcttattctgttgtaaatcaaagtctttgttgtaccatcaaatccatagagaggagggactctttttgtctcaaataaaatcaaatacagtgacattcgttattttgagcaaaacatcaatcaactgctcgaaatcattttaacc

SEQ ID NO: 10431 - protein, 478 aa, Arabidopsis thaliana (mouse-ear cress)
MASTAATAALSIIKSTGGAAVTRSSRASFGHIPSTSVSARRLGFSAVVDSRFSVHVASKVHSVRGKGARGVITMAKKSVGDLNSVDLKGKKVFVRADLNVPLDDNQNITDDTRIRAAIPTIKFLIENGAKVILSTHLGRPKGVTPKFSLAPLVPRLSELLGIEVVKADDCIGPEVETLVASLPEGGVLLLENVRFYKEEEKNEPDFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATTLLAKAKARGVSLLLPTDVVIADKFAPDANSKIVPASAIPDGWMGLDIGPDSVKTFNEALDTTQTVIWNGPMGVFEFEKFAKGTEAVANKLAELSKKGVTTIIGGGDSVAAVEKVGVAGVMSHISTGGGASLELLEGKVLPGVVALDEATPVTV

SEQ ID NO: 10432 - DNA, 1194 bp, Clostridium acetobutylicum
  CDS (1)..(1194)
atgaaattcaataaaaagactattgaagatgtagatgttaaaggtaaaagagtattagttagatgcgattttaatgtacctttaaaggacggagtaataactgacgaaaacagacttaatggagcacttccaactataaaatacctttcagagcacggtggaaaagttattctttgttcacatcttggaaaagcaaagggaccagatccttcaaaaactttagctccagttgctaaaagattaagtgaattacttggacgcgaagttaaatttgctgctgatgatacagttgttggcgagaatgctaagaaggctgtagctgaacttaaagaaggagaaatagttcttcttgagaacacaagattcagaccagaagaaggaaaaaatgatgatgcattctcaaaagatttagcttcacttgcagatgtatatgtaaatgatgcatttggaactgctcacagagcacactgctcaacagttggagtaactaaattcgtagatactgctgtatgtggatatttaattcaaaaagaattaaaattcttaggatcagctgttgaaaatccagttagaccttttgttgcaattcttggaggagcaaaagtttctgataaaatcaatgttataaacaatttacttgaaaaagttgatacattaatcatcggaggcggaatggcatacacattcttaaaagctcaaggatatacaataggaacttcacttcttgaagcagacaaagttgattatgcaaaagaaatgatagaaaaagcagaagctaaaggagtaaaattacttcttcctatagataatatagttggagcagaatttaaagcagatacaaaagcagttacaactgaagatgcaaatataccagaaggatacatgggattagatattggaccaaagactcaaaagctttatgctgatgctgttaaagaagctaaaacagttgtttggaatggacctatgggagtatttgaatttgaaaacttcgctaaaggaacaaaagatgttgcaaaagctatggctgaatcagatgcaacaacagttataggtggaggagacagtgctgctgctgttaatcagttaggatttggagacaaaatgactcatatctcaactggaggcggagcttcacttgaattcttagaaggaaaagaacttccaggaatagtagctcttaatgataaataa

SEQ ID NO: 10433 - protein, 397 aa, Clostridium acetobutylicum
MKFNKKTIEDVDVKGKRVLVRCDFNVPLKDGVITDENRLNGALPTIKYLSEHGGKVILCSHLGKAKGPDPSKTLAPVAKRLSELLGREVKFAADDTVVGENAKKAVAELKEGEIVLLENTRFRPEEGKNDDAFSKDLASLADVYVNDAFGTAHRAHCSTVGVTKFVDTAVCGYLIQKELKFLGSAVENPVRPFVAILGGAKVSDKINVINNLLEKVDTLIIGGGMAYTFLKAQGYTIGTSLLEADKVDYAKEMIEKAEAKGVKLLLPIDNIVGAEFKADTKAVTTEDANIPEGYMGLDIGPKTQKLYADAVKEAKTVVWNGPMGVFEFENFAKGTKDVAKAMAESDATTVIGGGDSAAAVNQLGFGDKMTHISTGGGASLEFLEGKELPGIVALNDK

SEQ ID NO: 10434 - DNA, 1233 bp, Pyrococcus abyssi
  CDS (1)..(1233)
atgttcaggttgggggattttaattatcataacaaggtagtttttctcagggttgatcttaattcaccgatgaaagatggcaagataatcagcgatgccaggtttagagcggtgttgccaacgataaagtacctcctcgagaacggagcgagggtcgtcgttggaacgcatcaaggaaagccttacagcgaggactacgcaactacagaagaacacgctagaatactctccaatctcttaaaccagcacgttgagtacgtagaggacatctttggcaggtacgctagagagaagattcaggagcttaagccaggggaaatagcgatgctcgaaaacctaaggttctcggccgaggaagttaaaaacaagccaatagaggagtgcgaaaaaactttcttcgtcaagaagctttcaaaggttatagattacgttgttaacgatgcatttgccgcagctcatagaagtcagccctccttagttggttttgcaaggataaagccgatgataatgggttttctaatggagagggagattgaagccctaatgaaggcctactacagcaaagagagtccaagggtttacgtgcttgggggggctaaagttgacgactcgctaaaggtggcagagaacgttcttagaagaggattcgcagatgttatcctaactggtggactcgttgctaacgtcttcacgttggccaagggatttgatcttggaaggaagaacatcgaattcatgaagaagaaaggattgttggagttggtcaagcatgctgaaaagatactagacgagttttatccgtacgttagaactcccgtggactttgcgatcgactacaagggagatagggaggaaatttatctgttaagcgagaagagggagttactcaacgactaccagataatggacattggaagtagaacgatagagaagtacagagatataataatgaaggccaaagtagttgttgcgaacggccccatgggggtgttcgagagggaagaatttgccctgggaaccgttgaggtgtttaaggcgatagctgaaagcgaagcattcagcgttttaggcgggggccattccatagcgagcatccagaagtacggcatcgagggcataacccacatctcgacgggaggaggtgccatgctaaccttcttcgcaggtgaagaattgccagttcttagggcccttcagataagttacgagaagtttaaggaggtgaaggcgtga

SEQ ID NO: 10435 - protein, 410 aa, Pyrococcus abyssi
MFRLGDFNYHNKVVFLRVDLNSPMKDGKIISDARFRAVLPTIKYLLENGARVVVGTHQGKPYSEDYATTEEHARILSNLLNQHVEYVEDIFGRYAREKIQELKPGEIAMLENLRFSAEEVKNKPIEECEKTFFVKKLSKVIDYVVNDAFAAAHRSQPSLVGFARIKPMIMGFLMEREIEALMKAYYSKESPRVYVLGGAKVDDSLKVAENVLRRGFADVILTGGLVANVFTLAKGFDLGRKNIEFMKKKGLLELVKHAEKILDEFYPYVRTPVDFAIDYKGDREEIYLLSEKRELLNDYQIMDIGSRTIEKYRDIIMKAKVVVANGPMGVFEREEFALGTVEVFKAIAESEAFSVLGGGHSIASIQKYGIEGITHISTGGGAMLTFFAGEELPVLRALQISYEKFKEVKA

SEQ ID NO: 10436 - DNA, 1197 bp, Lactococcus lactis subsp. lactis
  CDS (1)..(1197)
atggcaaaattgactgtaaaagacgttgaacttaaaggcaaaaaagtcctcgtacgtgttgactttaatgttccaattaaagatggcgtaatcacaaatgataaccgtatcactgctgcgcttccaacaattaaatacatccttgaacaaggtggacgtgcagtcctcttctctcacttgggacgtgttaaagaagaagctgacaaagctggtaaatcacttgcaccagtagctaaagctctttctgaaaaacttggtcaagatgttgttttcccaggaactactcgtggcgcagaacttgaagcagcaatcaacgaacttaaagatggagaaatccttctcgttgaaaacactcgttttgaagacatcgacggtaaaaaagaatctaaaaacgacccagaacttggtaaatactgggcttcacttggtgacggaatcttcgttaatgacgcatttggtacagctcaccgtgctcatgcatcaaacgttggtatctcagcaaacgttgataaagccgttgctggtttccttcttgaaaacgaaattgcttatatccaagaagcagttgaagctccagaacgtccattcgtagcaatccttggtggttcaaaagtttcagataaaatcggtgttatcgaaaaccttctttcaaaagctgataaagttatcatcggtggtgggatggcttacacattcttgaaagctcaaggttacgaaatcggaacttcactcgttgaagatgacaaacttgatcttgctaaagaattgcttgaaaaagcagctggaaaattgattttgccacttgaccacaaagttgctaacgcatttgctggttacacagaagttaaagaaactgctgaccaaaatattcctgcaggcttcatgggacttgacgtagcaagcaaaacaattgctgactacaacacacaacttgaaggtgctaaaacagttgtttggaatggtccagttggtgtatttgaaaacacagacttccaagcaggtactgttggattgatggaagctatcgttaaacaaccaggtgttaaatcaatcatcggtggtggtgactcagcagcagcagcaatcaaccttggttatgcagataaattctcatggatttcaactggtggtggagcttcaatggaactcctcgaaggtaaagtacttccaggacttgcagctttgactgaaaaataa

SEQ ID NO: 10437 - protein, 398 aa, Lactococcus lactis subsp. lactis
MAKLTVKDVELKGKKVLVRVDFNVPIKDGVITNDNRITAALPTIKYILEQGGRAVLFSHLGRVKEEADKAGKSLAPVAKALSEKLGQDVVFPGTTRGAELEAAINELKDGEILLVENTRFEDIDGKKESKNDPELGKYWASLGDGIFVNDAFGTAHRAHASNVGISANVDKAVAGFLLENEIAYIQEAVEAPERPFVAILGGSKVSDKIGVIENLLSKADKVIIGGGMAYTFLKAQGYEIGTSLVEDDKLDLAKELLEKAAGKLILPLDHKVANAFAGYTEVKETADQNIPAGFMGLDVASKTIADYNTQLEGAKTVVWNGPVGVFENTDFQAGTVGLMEAIVKQPGVKSIIGGGDSAAAAINLGYADKFSWISTGGGASMELLEGKVLPGLAALTEK

SEQ ID NO: 10438 - DNA, 1191 bp, Staphylococcus aureus
  CDS (1)..(1191)
atggctaaaaaaattgtttctgatttagatcttaaaggtaaaacagtcctagtacgtgctgattttaacgtacctttaaaagacggtgaaattactaatgacaaccgtatcgttcaagctttacctacaattcaatacatcatcgaacaaggtggtaaaatcgtactattttcacatttaggtaaagtaaaagaagaaagtgataaagcaaaattaactttacgtccagttgctgaagacttatctaagaaattagataaagaagttgttttcgtaccagaaacacgcggcgaaaaacttgaagcagctattaaagaccttaaagaaggcgacgtattattagttgaaaatacacgttatgaagatttagacggtaaaaaagaatctaaaaatgatccagaattaggtaaatactgggcatctttaggtgatgtgtttgtaaatgatgcttttggtactgcgcatcgtgagcatgcatctaatgttggtatttctacacacttagaaactgcagctggattcttaatggataaagaaattaagtttatcggtggcgtagttaacgatccacataaaccagttgttgctattttaggtggagcaaaagtatctgacaaaattaatgtcatcaaaaacttagttaacatcgctgataaaattatcatcggcggaggtatggcttatactttcttaaaagcgcaaggtaaagaaattggtatttcattattagaagaagataaaatcgacttcgcaaaagatttattagaaaaacatggtgataaaattgtattaccagtagacactaaagttgctaaagaattttctaatgatgccaaaattactgtagtaccatctgattcaattccagcagaccaagaaggtatggatattggaccaaacactgtaaaattatttgcagatgaattagaaggtgcgcacactgttgtatggaatggacctatgggtgtattcgagttcagtaactttgcacaaggtacaattggtgtatgtaaagcaattgcaaaccttaaagatgcaattacgattatcggtggcggtgattcagctgcagcagcaatctctttaggttttgaaaatgacttcactcatatttcaactggtggcggagcgtcattagagtacctagaaggtaaagaattgcctggtatcaaagcaatcaataataaataa

SEQ ID NO: 10439 - protein, 396 aa, Staphylococcus aureus
MAKKIVSDLDLKGKTVLVRADFNVPLKDGEITNDNRIVQALPTIQYIIEQGGKIVLFSHLGKVKEESDKAKLTLRPVAEDLSKKLDKEVVFVPETRGEKLEAAIKDLKEGDVLLVENTRYEDLDGKKESKNDPELGKYWASLGDVFVNDAFGTAHREHASNVGISTHLETAAGFLMDKEIKFIGGVVNDPHKPVVAILGGAKVSDKINVIKNLVNIADKIIIGGGMAYTFLKAQGKEIGISLLEEDKIDFAKDLLEKHGDKIVLPVDTKVAKEFSNDAKITVVPSDSIPADQEGMDIGPNTVKLFADELEGAHTVVWNGPMGVFEFSNFAQGTIGVCKAIANLKDAITIIGGGDSAAAAISLGFENDFTHISTGGGASLEYLEGKELPGIKAINNK

SEQ ID NO: 10440 - DNA, 2316 bp, Mycoplasma pulmonis
  CDS (1)..(2316): transl_table=4
atgaaaaaacttataactgacttgaacttaaatgataaaaaggttttgattagactagacttaaatgttcctttaaaaggtaaaaaaataacttctttaaagagaattgaagaatctattccaacaattaaatatgttcaagagcgcggtggaaaaattatattattatctcacttaggtagagtaaaaacaaaagaagacaaagagaaaaaatcattatctattgttgtagaagctctagcttcacttttaaactcacctgtaaaatttgtagatcaaacaagaggaaaaaaattagaaagtgcaattgaaaaattaaaacctggagatgtattattaattgaaaatacaagatttgaagatctaaataataacgctgagtctaacaacgatcctgagcttggaaaatattgagcttctctaggtgatgtttttattaatgatgcttttggaactgctcatagagcacatgcttcaaatgttggtattgcaagtaacattaaagaatcagctcttggtattttggtacaaaaagaagttaatgccttatggaaattaatggaacaacaagaaaaaccatttgtggctattttaggtggatcaaaagtttcagacaaaataaatgttttagaaaaaataattgataaagttgatagattaattattggtggagctatggcttatacattcctaaaagctcaaggtattggaattggtgattctatttatgaacaagataaaattgaatttgccacagaatttctaaaaaaatacaaccacaaaattattttacctattgaccatgctcttgctaaaaaattcaaaaatgcaaaaccaattttcaacaatgaaaacccactagaaatacctcaaacatttattggtatggatgttggacctaaaacaattgaactaattcacaaatacatcaaaggtgatactaaactaggaataagccctgctaaaacaattttttgaaatggacctatgggtgtaactgaatttgaagaattccaaagtggtagtttagctgttgttgaagctatttctcaattagtaggagcttactcagttgttggtggaggagactcaattgctattattgaaaaattaaatgcacaaatgcttttctcacacatttcaacaggtggtggagctagcttagaatttattgaatcaaaagttcttccaggtattgatgcaattcaaaactatgaacaaacatatgagcaatatgactcacaagttcaaagccaagattttagccaaaactttgactcaccattggttgaagaaacattttcacaaagcacatctgaaaactttagtgattttgcaagttctactcaagaacactttgctacaagcgaaaatcaaaatactttaatcaataattacgaaaatccgggatttgattctcaagatatgtttaaaacagaagaacaaaatgattcaactagttcatttttaacttcaacaaatccattttcttctgagttttcaaatgaatttaaaacaagtgattttcaagatttaaaacaaactcaagaaacagaaactcaagaaactttaattccacatacttttgaatatacaactgatgatctaagacatactttagagcaatatgttagagaaactagttttcaaacaagagaatctactttcccaacagaagaggctagcttcgaaacattagaagaaactagttttcaaacactagaagagagcttccctactcaaagttttgaacaagtagaacaaactagtgaaaaaaatatggaagtttcaacagaaaattttgaaaatgcttcttctcaaaccaatagctttacagtttctgatattcctaaaacaacaagcacttttgaagatttagaaactccagaaactcaaaacacaactttagaagaagtagctttagaaacatcaaattttgaagctcaaaacttggaaactccaaacttgcaaacatcaaattttgagacttcaaatttagaaacatcgaattttgaaacttcaaactttgaaacgtcaacttttgaaagtttcaacacaggaaattttagtactccaagttcaacttttgaagatttagatttacaaagcgcaactttccagacaaacgacgaaagtgaaagatcaactcaagaaaattttgaaccaacagaagttattgaaagtgatttattagctatgaaaacaactgaattagaacaagaaatcacaaataacacttcaagagatatcttaagcgaagatgaagttgctgcacctcacaaaaaaagattttgattctttggtagaaaaagataa

SEQ ID NO: 10441 - protein, 771 aa, Mycoplasma pulmonis
MKKLITDLNLNDKKVLIRLDLNVPLKGKKITSLKRIEESIPTIKYVQERGGKIILLSHLGRVKTKEDKEKKSLSIVVEALASLLNSPVKFVDQTRGKKLESAIEKLKPGDVLLIENTRFEDLNNNAESNNDPELGKYWASLGDVFINDAFGTAHRAHASNVGIASNIKESALGILVQKEVNALWKLMEQQEKPFVAILGGSKVSDKINVLEKIIDKVDRLIIGGAMAYTFLKAQGIGIGDSIYEQDKIEFATEFLKKYNHKIILPIDHALAKKFKNAKPIFNNENPLEIPQTFIGMDVGPKTIELIHKYIKGDTKLGISPAKTIFWNGPMGVTEFEEFQSGSLAVVEAISQLVGAYSVVGGGDSIAIIEKLNAQMLFSHISTGGGASLEFIESKVLPGIDAIQNYEQTYEQYDSQVQSQDFSQNFDSPLVEETFSQSTSENFSDFASSTQEHFATSENQNTLINNYENPGFDSQDMFKTEEQNDSTSSFLTSTNPFSSEFSNEFKTSDFQDLKQTQETETQETLIPHTFEYTTDDLRHTLEQYVRETSFQTRESTFPTEEASFETLEETSFQTLEESFPTQSFEQVEQTSEKNMEVSTENFENASSQTNSFTVSDIPKTTSTFEDLETPETQNTTLEEVALETSNFEAQNLETPNLQTSNFETSNLETSNFETSNFETSTFESFNTGNFSTPSSTFEDLDLQSATFQTNDESERSTQENFEPTEVIESDLLAMKTTELEQEITNNTSRDILSEDEVAAPHKKRFWFFGRKR

SEQ ID NO: 10442 - DNA, 1260 bp, Treponema pallidum subsp. pallidum (syphilis spirochete)
  CDS (1)..(1260)
atgatgctgagaacttgtaaagatgtcacaatgcgaggtgagcgtgttgtcgtgcgtgttgattttaacgtaccgatgcgtgatggtatggtgcaagacgacacgcgcgtcactgcagcagttcctactctgcggtacatcatcgagcaggggccgcgacacgtagtgctcattagccatcttggagaccctacccgtgatgcggataaagcagaggggaacgctaagaaagatggttgtccctttgaccgccacgcattcattaacggcaaacaccggcttaagccggttgcggactgccttgcaaagaagttgggggtgccggtgcattttgcgccttcctgcgtcgggcagcgtgaatttattgaagggctgcccgacggttcggtagtgcttttggagaatgtgcgctttcaccccgaggaaacatctggtgatgcgaaggtgcaggagcaatttgcgcgggagcttgcccagtatggggacatttttgttaatgatgcgttcggcactgcgcaccgtgaacatgcatctacggtggtactcccgagacttatgcgtcgcagagtggccggtcttttgatagagcgggaagtgaggtacctggaacctatggtatgcaacccgaaggtgccaatggtggcggttgtcggtggtgccaaggtatcttctaagatagcagtcttggagagtctgcttcgaacatcgacggcgcttatcatcgggggagggatggcatacacctttttgaaagcgcaaggtgtgggtgtaggtacctccctagtggaggatgactttatcgacactgcacgtatgctgttgcaaaaggctcaaagcggtggtgtgtcggtggtattgccggtcgatcacgtatgtgcgtccacgttctgtgcggatgcgcagccggttgcggtggacgatgtgcatattcctatgcacttgatgggtatggatgttggtccgcgtacgcttgagcagtatcgtgcgcatttaaagggagtgagctccgtgttgtggaatggtccggtaggggtttttgagttcgatgcctttgcacacggtacacgggtgcttgcgcagttgatagcagaggcgacggatgcgggtgctacgtcggtagttggtggaggagactctattgcagcagtcagcaagtttgggcttgcaagtcgcatgagccatgtatctacggggggtggcgcatcgctgaagctctttgagggtaaagttttaccgggcatttcgtgtcttgaaacatag

SEQ ID NO: 10443 - protein, 419 aa, Treponema pallidum subsp. pallidum (syphilis spirochete)
MMLRTCKDVTMRGERVVVRVDFNVPMRDGMVQDDTRVTAAVPTLRYIIEQGPRHVVLISHLGDPTRDADKAEGNAKKDGCPFDRHAFINGKHRLKPVADCLAKKLGVPVHFAPSCVGQREFIEGLPDGSVVLLENVRFHPEETSGDAKVQEQFARELAQYGDIFVNDAFGTAHREHASTVVLPRLMRRRVAGLLIEREVRYLEPMVCNPKVPMVAVVGGAKVSSKIAVLESLLRTSTALIIGGGMAYTFLKAQGVGVGTSLVEDDFIDTARMLLQKAQSGGVSVVLPVDHVCASTFCADAQPVAVDDVHIPMHLMGMDVGPRTLEQYRAHLKGVSSVLWNGPVGVFEFDAFAHGTRVLAQLIAEATDAGATSVVGGGDSIAAVSKFGLASRMSHVSTGGGASLKLFEGKVLPGISCLET

SEQ ID NO: 10444 - DNA, 1965 bp, Thermotoga maritima
  CDS (1)..(1965)
atggaaaaaatgaccataagagatgttgatctgaaaggcaagagagtcataatgagagtggacttcaacgttccagtgaaggatggggtcgttcaggacgacacgagaataagagccgcccttccaacgataaagtacgctcttgaacagggtgcaaaggtgatactcctgtcccatcttggaaggcccaagggagaaccttcaccagagttcagcctcgcacctgtcgccaaaagactctctgagcttcttggaaaagaagtgaagtttgttcccgctgttgtcggtgatgaggtgaaaaaggccgttgaggagctcaaagagggagaggttctcctccttgaaaacaccagattccacccgggagagaccaagaacgatcctgaactcgcgaagttctgggctagcctcgccgatattcacgtgaacgatgccttcggaacggcgcacagggcacacgcttccaacgttggaatcgcacagtttattcccagcgtagcgggattcctcatggaaaaagagataaagttcctttccaaggtgacttataatccagaaaaaccgtacgttgtggttcttggaggagcaaaggtatctgacaaaatcggcgtcatcacgaacctcatggagaaagccgacagaattctcataggtggagccatgatgttcaccttcctgaaggctcttggcaaagaggttggatcgtccagggttgaagaagacaagatcgacctcgcaaaagaactcctcgaaaaagcgaaagaaaagggtgttgagatcgttcttcccgttgatgccgttatcgctcagaagatcgaacccggtgtggaaaagaaggttgtcagaatcgacgacgggatacccgaaggatggatgggcctcgacataggacccgagacaattgagctcttcaagcagaagctctccgatgcaaaaaccgttgtctggaacgggccaatgggagtcttcgaaatagacgatttcgctgaaggcacgaagcaggtcgcacttgcgatcgcagcgctcacggaaaagggagcgatcaccgttgtgggtggaggagacagcgccgcggcggtgaacaagttcggtctggaagacaaattctcccacgtttcaacgggcggaggggcttctctcgaattccttgaaggaaaagaacttcctggtattgccagcatcgcggataaaaaaaaaataactcgtaaactgatcctcgctgggaactggaagatgcataaaacgatctcggaagcgaaaaagtttgtgtcgctgctcgtgaacgaacttcacgacgtgaaagagttcgaaatagtggtctgtcctccgttcacagctctatctgaagtgggggaaatactctctggtagaaacatcaaattgggagctcaaaacgttttctacgaagaccagggagcgttcaccggggagatttctcctctcatgctgcaagagatcggcgttgaatacgtgatcgtgggacattccgagagaaggcgtattttcaaagaagacgacgagttcataaacaggaaagtgaaagcggtgcttgaaaaaggtatgactcctattctctgcgttggagaaacactcgaggaaagagagaaagggctcactttctgcgttgtggaaaaacaggtgagagaaggtttctacggtctcgacaaagaggaagcaaagagagtggtaatagcttacgagccagtctgggcaatcgggacaggaagggtggcgacaccacagcaggcacaggaagtacacgcgttcataagaaagctgctctcagagatgtacgacgaggaaacagcgggatcgataaggattctctacggtggaagcataaagccggacaatttcctcggtctcatcgttcagaaggatatagatggtggtctcgttggaggagcgagtctcaaagagtctttcatagaacttgcacgaataatgagaggtgtgatttcctga

SEQ ID NO: 10445 - protein, 654 aa, Thermotoga maritima
MEKMTIRDVDLKGKRVIMRVDFNVPVKDGVVQDDTRIRAALPTIKYALEQGAKVILLSHLGRPKGEPSPEFSLAPVAKRLSELLGKEVKFVPAVVGDEVKKAVEELKEGEVLLLENTRFHPGETKNDPELAKFWASLADIHVNDAFGTAHRAHASNVGIAQFIPSVAGFLMEKEIKFLSKVTYNPEKPYVVVLGGAKVSDKIGVITNLMEKADRILIGGAMMFTFLKALGKEVGSSRVEEDKIDLAKELLEKAKEKGVEIVLPVDAVIAQKIEPGVEKKVVRIDDGIPEGWMGLDIGPETIELFKQKLSDAKTVVWNGPMGVFEIDDFAEGTKQVALAIAALTEKGAITVVGGGDSAAAVNKFGLEDKFSHVSTGGGASLEFLEGKELPGIASIADKKKITRKLILAGNWKMHKTISEAKKFVSLLVNELHDVKEFEIVVCPPFTALSEVGEILSGRNIKLGAQNVFYEDQGAFTGEISPLMLQEIGVEYVIVGHSERRRIFKEDDEFINRKVKAVLEKGMTPILCVGETLEEREKGLTFCVVEKQVREGFYGLDKEEAKRVVIAYEPVWAIGTGRVATPQQAQEVHAFIRKLLSEMYDEETAGSIRILYGGSIKPDNFLGLIVQKDIDGGLVGGASLKESFIELARIMRGVIS

SEQ ID NO: 10446 - DNA, 1185 bp, Bacillus halodurans
  CDS (1)..(1185)
atgaacaaacaatctgttcgtgatgtggaattacaagggaaaaaagtgttttgtcgcgttgattttaacgtgccgatgaaagatggggtcgtgacagatgatacgagaattcgtgccgcgttaccaacgattcaattgttagcagaaaaaggcgcacgcatcattctcgcaagccatctcggtcgtccgaaaggagaagttgtagaggaacttagactcgatccagttgctgctagactgcaagagcttcttggaaagcctgtagcgaaagtcaatgtcgcccacggaccagaggcagagcaagcggcgaacgaactgaaagatggcgatgtgcttttacttgaaaatgttcgtttttaccctggggaagaaaaaaatgatccagagctagcaaaagcttttgcgtctttagcggatgtctatgtgaacgacgccttcggtgcagcacaccgtgcccacgcgtcaacggaaggtattgcacaccatgttacggctgttgcaggcttgctcatggaaaaggagcttgaggtgcttggcaaggcactttccaaccctgagcgcccatttacagcgatcattggtggagcaaaagtgaaagataaaattggtgtcattgaaaaccttttagataaagttgataacttaattattggcggcggacttgcgtacacattcatcaaagcgcaaggacatgagatcggcaaatctcttttagaagcagacaaaatggatttggctctttccttcatggaaaaggcgaaagaaaaaggagtcaacttctacgtaccacaagatgcgattgtagccgatgatttctcgaatgatgcgaatacgaaagcggtggacattgatcaaatcccagccgattgggaagcgctcgatatcggtccaaaaacgcgcgagacctaccgcaatgtcattcaatcctcaaagctcgtcatttggaacgggccaatgggtgtatttgagctcgatgcttttgctggtggcacgaaagctgttgctgaagcgcttgctgatgcaaacgatacgtattctgtcatcggcggtggagattcggcggccgctgtagaaaagttcggtttagctaaccagatgagccatatctcaacaggtggtggagcatctcttgagtttatggaagggaaagctttacctggcgttgtagcgttaaacgataaataa

SEQ ID NO: 10447 - protein, 394 aa, Bacillus halodurans
MNKQSVRDVELQGKKVFCRVDFNVPMKDGVVTDDTRIRAALPTIQLLAEKGARIILASHLGRPKGEVVEELRLDPVAARLQELLGKPVAKVNVAHGPEAEQAANELKDGDVLLLENVRFYPGEEKNDPELAKAFASLADVYVNDAFGAAHRAHASTEGIAHHVTAVAGLLMEKELEVLGKALSNPERPFTAIIGGAKVKDKIGVIENLLDKVDNLIIGGGLAYTFIKAQGHEIGKSLLEADKMDLALSFMEKAKEKGVNFYVPQDAIVADDFSNDANTKAVDIDQIPADWEALDIGPKTRETYRNVIQSSKLVIWNGPMGVFELDAFAGGTKAVAEALADANDTYSVIGGGDSAAAVEKFGLANQMSHISTGGGASLEFMEGKALPGVVALNDK

SEQ ID NO: 10448 - DNA, 1191 bp, Caulobacter crescentus
  CDS (1)..(1191)
atgaccttccgcaccctcgacaccgccgatctcgccggcaagcgcgctctggtccgcgtggacttcaacgtcccggtcgacggtggcaaggtcgccgacgacacccggctgaaggcggccctgccgaccatccgcttcctggccgacaagggcgccaaggtcgtgctgctggcccacttcgaccgtcccaagggcaaggtcgtgccggagatgagtctcgccttcgtggccgagccgctggcggccctgctgggcgcgccggtcgccttcgtcggtgactgcgtcggcccggccgccgctgaggtcgtgaacggcctcgccgatggcggcgtcgccttgctggagaacgtccgcttccacgccggcgaagagaagaacgacgccgagttcgccaaggccctggccgccaatggcgacgtttatgtcaacgacgccttcagcgccgcccaccgcgcccacgcctcgaccgaaggcctggccaagctgctgcccgcctatccgggcgtgtcgatgcagcgcgagctggaagccctggacgcggcgctgggcaatccgaagaagccggtgatcggcatcgtcggcggctccaaggtctcgaccaagctcgacctcttgaacaacctggtcgccaagctggatcgcctggcgatcggcggcggcatggccaacaccttcctgttcgcccagggccacgatgtcggcggctcgctgtgcgaaaaggacctggccgacaccgcccgcgagatcatggaaaaggccaaggccgccggctgcgaactgctgctgccggtcgacgtcgtggtcgccaagaaggtcgcgccgggcgttgagacggcggttcgttcgctgagcgaagtccaggctgacgacctgatcctggacgcgggcccggaaagcgccaagcgtctgctggccgccatggaccagagcctgaccttgatctggaacggccctctgggtgttttcgaggtgcctccgttcgatgaagcgaccgtttccgcagcgaaacatgccgcttcgctcgccaaatcgggtaaaatcgtagccgtggccggtggtggtgatacagtcgccgctctgaaccacgcaggcgtgtcggccgacttcaccttcgtttcgacggcgggcggcgcgttcctggaatggatggagggcaagacgctcccgggcgtcgcggcgctcgaatcctga

SEQ ID NO: 10449 - protein, 396 aa, Caulobacter crescentus
MTFRTLDTADLAGKRALVRVDFNVPVDGGKVADDTRLKAALPTIRFLADKGAKVVLLAHFDRPKGKVVPEMSLAFVAEPLAALLGAPVAFVGDCVGPAAAEVVNGLADGGVALLENVRFHAGEEKNDAEFAKALAANGDVYVNDAFSAAHRAHASTEGLAKLLPAYPGVSMQRELEALDAALGNPKKPVIGIVGGSKVSTKLDLLNNLVAKLDRLAIGGGMANTFLFAQGHDVGGSLCEKDLADTAREIMEKAKAAGCELLLPVDVVVAKKVAPGVETAVRSLSEVQADDLILDAGPESAKRLLAAMDQSLTLIWNGPLGVFEVPPFDEATVSAAKHAASLAKSGKIVAVAGGGDTVAALNHAGVSADFTFVSTAGGAFLEWMEGKTLPGVAALES

SEQ ID NO: 10450 - DNA, 1182 bp, Borrelia burgdorferi (Lyme disease spirochete)
  CDS (1)..(1182)
atgtcaataaaaacagtaaaagactttagtagctttgcgggcaagcgagctttagtaagatgtgattttaatgttcccctaaaagaggggagcattagcgatgatactagaattagggcagcattgtctacaatagagtatctaaaagaaagaggagctaggattgtgcttgtaagtcatttgggtagaccagatggaaagaaaaatcctaaatattctcttaagccggttgccaataggttgtcagagcttttaggccaagatgtcaagatgctttctgattgtattggaagtgaggttgtaaatagtaccttgcaaatgaaggatggggatgttgtattgcttgaaaatgtaaggttttatgcagaagaagagaaaaacgataaaaattttgcaaaaaaactttctgaaaatggagatgtttttgtaaatgatgcttttggcgcagctcatagagctcatgcttcaactgtgggagttgctgattatttgccgtctgttggtggatttttaatggaaaaagaagataaatttcttggtggaatattaaaaaatcccgaaaggccatttgtttcaattattggtggttctaaggtttcttcaaagattgcggtactagaatcacttttgtcaaagtctaatgtagttgtgattggcggtggaatggcttatacttttttgcattccgaaggatattctataggcaaatctcttttagaggacgaatatattggtatagcatcttcttttttaaagaaagcaaaagagctgggcgttaaagtaattttaccacttgatcatattgtagctgatgattttaacaaaaattcaattcctgagtatattgactcctttaatattcctgaaaacaagattggcatggatattggagctaatactttaaaagaaattgaaaatgttgtgaaaactgccaaaactataatttggaatggtcctcttggtgtatttgaatttgattcattttcaaaagggactgctaaggttgccgaaatggtagcatcttgctcaggtttaaccgttgttggtggtggagattctgttgcagctgttaataaatttaatttatctgataagattactcatgtttcaacgggcggtggtgcatcgcttgaatatcttgaagggagaattttgccgggtattaaggttttggagaattaa

SEQ ID NO: 10451 - protein, 393 aa, Borrelia burgdorferi (Lyme disease spirochete)
MSIKTVKDFSSFAGKRALVRCDFNVPLKEGSISDDTRIRAALSTIEYLKERGARIVLVSHLGRPDGKKNPKYSLKPVANRLSELLGQDVKMLSDCIGSEVVNSTLQMKDGDVVLLENVRFYAEEEKNDKNFAKKLSENGDVFVNDAFGAAHRAHASTVGVADYLPSVGGFLMEKEDKFLGGILKNPERPFVSIIGGSKVSSKIAVLESLLSKSNVVVIGGGMAYTFLHSEGYSIGKSLLEDEYIGIASSFLKKAKELGVKVILPLDHIVADDFNKNSIPEYIDSFNIPENKIGMDIGANTLKEIENVVKTAKTIIWNGPLGVFEFDSFSKGTAKVAEMVASCSGLTVVGGGDSVAAVNKFNLSDKITHVSTGGGASLEYLEGRILPGIKVLEN

SEQ ID NO: 10452 - DNA, 1239 bp, Mycobacterium tuberculosis
  CDS (1)..(1239)
atgagcgttgcaaacctcaaggatctactcgccgaaggtgtttcggggcgtggagtgctggtgcgctccgatctcaacgttccgctcgacgaggacggcaccattaccgatgcgggccgcatcatcgcgtcggcgccgacgttgaaggcgttgctcgacgccgacgccaaggtggtggttgccgcgcacttgggacgtcccaaggacgggccggacccgacactgtcgctggcgccggtcgccgtggcgctgggtgagcaactcggccggcacgtccagctggctggagacgttgtcggcgccgatgcgctggcccgcgccgaggggctcaccggcggcgacatcctgctgctggagaacatccgcttcgacaaacgcgaaaccagcaagaacgatgacgaccggcgggcactggccaagcagctggtcgaactggtcggaacgggaggcgttttcgtctccgacggctttggggtggtgcaccgcaagcaagcctcggtctatgacatcgcaaccctgttgccgcactacgccggcacgctggtcgccgacgagatgcgggtactggagcagttgaccagctcgacccagcggccctatgcggtagtgctcggcggatcaaaggtgtccgacaagctgggtgtcatcgagtcgctggcgaccaaggcggacagcattgtgattggcggcggaatgtgcttcacattccttgctgcacagggattttcggttggcacatcgctgctggaagacgacatgatcgaagtctgtcgcgggctgctggaaacctatcacgacgtgttgcggctgcccgtggatctagtggtcacggagaagttcgccgccgactcgccgccccagacggtcgacgtcggcgctgtgcccaatggcttgatgggcctggatatcgggccgggatcgatcaaacggttcagcacgctgctgtccaacgccgggaccatcttctggaacgggccgatgggagtattcgagttcccggcttatgcggccggcaccagaggcgtcgccgaggcgatcgtcgccgccaccggcaaaggggcgtttagtgtggtcggcggcggtgactccgcggccgcagtgcgcgcgatgaacatccccgagggcgccttctcacacatatccaccggcggcggtgcctcgctggaataccttgagggcaagacgcttcccggcatcgaggtactgagccgtgagcagccaaccggaggagttttgtga

SEQ ID NO: 10453 - protein, 412 aa, Mycobacterium tuberculosis
MSVANLKDLLAEGVSGRGVLVRSDLNVPLDEDGTITDAGRIIASAPTLKALLDADAKVVVAAHLGRPKDGPDPTLSLAPVAVALGEQLGRHVQLAGDVVGADALARAEGLTGGDILLLENIRFDKRETSKNDDDRRALAKQLVELVGTGGVFVSDGFGVVHRKQASVYDIATLLPHYAGTLVADEMRVLEQLTSSTQRPYAVVLGGSKVSDKLGVIESLATKADSIVIGGGMCFTFLAAQGFSVGTSLLEDDMIEVCRGLLETYHDVLRLPVDLVVTEKFAADSPPQTVDVGAVPNGLMGLDIGPGSIKRFSTLLSNAGTIFWNGPMGVFEFPAYAAGTRGVAEAIVAATGKGAFSVVGGGDSAAAVRAMNIPEGAFSHISTGGGASLEYLEGKTLPGIEVLSREQPTGGVL

SEQ ID NO: 10454 - DNA, 1242 bp, Alcaligenes eutrophus
  CDS (1)..(1242)
atgatgagcctatcccatgctacgaacccgcaaccgaaacccgcggcggcgccgcacacgctggccgcactgcttgcagccggtggactggctggcaagcgggtcttcatccgcgccgacctcaacgtcccgcaggatgcagcgggcgctatcaccgacgatacccgcatccgggcttccgtgcccgccatcgcggcctgcctgcaggcgggcgccgcggtgatggtcacctcgcacctgggccggccgcaggagggggcgcccgacccgcgccacagcctggcgccggtgggccgccgcctgtccgaactgctgggccgccaggtgccgctcttgtccggctggaccgagggcggcttccaggtgccgcccgggcaggtggtgctgctggaaaactgccgcatgaacacgggcgagaagaagaacagcgacgaactggcgcagaaaatggcggcgctgtgcgatgtctacgtcaacgacgcgttcggcaccgcccaccgcgccgaggcgaccacgcatggcatcgccaggtacgcccccattgcctgcgccggcccgctgctggccgccgagatcgacgcgctgggcaaggcgctgggccagccggcgcgtccgctggtggcgatcgtggccggctccaaggtctcgaccaagctgaccatcctgaagtcgctggccgacaaggtcgacaacctgatcgtcggcggcggcattgccaataccttcatgctggccgccggcctgaagatcggcaagtcgctggccgagcctgacctgctggccgatgccagggccatcatcgacatcatggccaggcgtggcgcctcggtgccgattccggtcgacgtggtgtgcgccaaggaattcagcgccactgccgcggccaccgtcaaggacgtcaaggacgtggccgacgacgacatgatcctggacatcggccccaagaccgccgcgatgctggccgagcagctcaaggccgccggcaccatcgtctggaacggcccggtgggcgtgttcgagttcgaccagttcggcaacggcaccagggtgctggcccaggccatcgctgaatcgaaggcgttctcgatcgccggcggcggcgacacgctggccgcgatcgccaagcacggcattgccgaccgcgtgggctatatctcgaccggcggcggcgcgttcctggaattcctggagggcaagacgctgcccgcgctggccgtgctggcacagcgcgccgctgcctga

SEQ ID NO: 10455 - protein, 413 aa, Alcaligenes eutrophus
MMSLSHATNPQPKPAAAPHTLAALLAAGGLAGKRVFIRADLNVPQDAAGAITDDTRIRASVPAIAACLQAGAAVMVTSHLGRPQEGAPDPRHSLAPVGRRLSELLGRQVPLLSGWTEGGFQVPPGQVVLLENCRMNTGEKKNSDELAQKMAALCDVYVNDAFGTAHRAEATTHGIARYAPIACAGPLLAAEIDALGKALGQPARPLVAIVAGSKVSTKLTILKSLADKVDNLIVGGGIANTFMLAAGLKIGKSLAEPDLLADARAIIDIMARRGASVPIPVDVVCAKEFSATAAATVKDVKDVADDDMILDIGPKTAAMLAEQLKAAGTIVWNGPVGVFEFDQFGNGTRVLAQAIAESKAFSIAGGGDTLAAIAKHGIADRVGYISTGGGAFLEFLEGKTLPALAVLAQRAAA

SEQ ID NO: 10456 - DNA, 1453 bp, Gallus gallus (chicken)
  CDS (96)..(1349)
accaaaacctccccagttcacgagcagcatcgccaagcgtcagagcgcgggcggcggcggtagggaacggacggcagcggtgacttgcggtaaccatgtctctctccaacaagctcaccctggataaggtggatgtgaagggcaagcgggtcgtcatgagggttgacttcaatgttccaatgaaggatcacaaaataaccaacaaccaaagaatcaaggcagctgtccctaccatcaagcactgcttggaccatggagccaagtcagtggttttgatgagtcacctgggccgcccggatggagttcccatgcctgacaagttctccttttctccagtagctgtggagcttaaagctctcctgggcagggaggtctcattcctgaaggattgtgttggtcctgaggtggagaaggcctgtgctaatcctgcaaacggctccgtcatcctgctagagaacctccgattccatgtagaagaagaagggaaagggaaggatgcttcagggaacaagatcaaagctgatgctgcaaaagtggaggctttcagagcctctctttctaaattgggagatgtttatgtcaatgatgcttttggaactgcccatcgtgctcacagctccatggtaggtgttcatcttcctcagaaggctgctggcttcctgatgaagaaagaactggattattttgcaaaggcccttgagagtccagagagacccttcttagcaattcttggaggagctaaagttcaggataagatccagctgatcagtaacatgttagataaggtcaacgagatgatcattggtggtggaatggcattcacctttctcaaagtgttaaacaacatgcagattggcaactcgctgtttgatgaagagggatcaaaaattgtcaaggacctgatggccaaggcagagaagaacggtgtgaagattaccttgccagttgacttcatcactgcagacaaatttgatgagcatgcacagactggggaagccacagtggcttcaggcattcctgctggctggatgggcttggactgcggccctgaaagtgttaagaagtttgttgaagttgtgggaagggccaaacaaatagtgtggaacggtccagttggagtctttgaatgggacaagttctccaaaggaaccaaagccctgatggacaaagtggtggaagtaactggaaagggctgcatcaccattattggtggtggagatactgctacatgctgtgcgaagtggaatactgaagataaagttagccacgttagcactggaggtggtgccagcctggaactgctagagggtaaggttcttcctggcgtggatgccttgagcagtgtgtagagaacagcgtatcaccccagttcctgttcctgtgcacagcccctgagattcaacacttcaacacttctatgcttctgtatttcaactctgcgataggcagaccg

SEQ ID NO: 10457 - protein, 417 aa, Gallus gallus (chicken)
MSLSNKLTLDKVDVKGKRVVMRVDFNVPMKDHKITNNQRIKAAVPTIKHCLDHGAKSVVLMSHLGRPDGVPMPDKFSFSPVAVELKALLGREVSFLKDCVGPEVEKACANPANGSVILLENLRFHVEEEGKGKDASGNKIKADAAKVEAFRASLSKLGDVYVNDAFGTAHRAHSSMVGVHLPQKAAGFLMKKELDYFAKALESPERPFLAILGGAKVQDKIQLISNMLDKVNEMIIGGGMAFTFLKVLNNMQIGNSLFDEEGSKIVKDLMAKAEKNGVKITLPVDFITADKFDEHAQTGEATVASGIPAGWMGLDCGPESVKKFVEVVGRAKQIVWNGPVGVFEWDKFSKGTKALMDKVVEVTGKGCITIIGGGDTATCCAKWNTEDKVSHVSTGGGASLELLEGKVLPGVDALSSV

SEQ ID NO: 10458 - DNA, 1431 bp, Bacillus stearothermophilus
  CDS (188)..(1372)
aacgaaacgggctattcgcaccgcgtcgtcgacttagctgcctacatcgcctcgaaagggctgtaaaaccagcttggtgctgagttttccgcctgttcaagtctataataggaaaatggaggggagcggggaaatgatccccactccttttccttgtccaaactgtagccaaaagggggcacgaacgatgaacaagaagacgatccgcgacgttgatgtgaggggaaagcgcgtcttttgccgcgtcgatttcaacgttccgatggagcaaggcgctatcaccgatgacacgcgcattcgcgccgcactcccgacgatccgctatttgatcgagcacggggcgaaagtcattttggcgagccacctcggccgcccgaaaggaaaagtggtcgaagaattgcgtttggatgccgttgcgaagcggctcggcgagctgcttgaacggccggttgccaaaacgaatgaagcggtcggcgatgaggtgaaagcggcggtcgaccgtttgaacgaaggcgatgtgctcttgcttgagaacgtccgtttttaccctggcgaagagaaaaatgatcccgagctcgccaaagcgtttgcggagcttgcggatctatatgtcaacgatgcgttcggcgccgcccatcgcgctcatgcgtcgacggaaggcatcgcccattacttgccggcggtggccggatttttgatggaaaaagaacttgaagtgcttggcaaggcgctttcgaatccggaccgcccgtttacagcgatcatcggcggggcgaaagtgaaagacaaaatcggcgtcatcgacaatttgcttgaaaaagtcgacaacttgatcatcggcggcggactggcgtatacgttcgtcaaagcgctcggccatgacgtcggcaagtcgctgcttgaggaggacaaaatcgaactcgccaaatcgtttatggaaaaggcgaaagaaaaaggcgtccgtttttatatgccggtggacgtggtcgtcgccgaccggtttgcgaacgacgccaacacgaaagtcgtgccgattgacgcgattccagccgattggtcggcgcttgacatcggcccgaaaacgcgcgaattgtaccgcgatgtcattcgcgagtcgaagctcgttgtctggaacggcccgatgggcgtctttgaaatggacgcgttcgcccacgggacaaaagcgatcgccgaagcactggcggaagcgctcgacacctattcggtcatcggcggcggggattcggcggcggcggttgagaaattcggcttggccgacaaaatggatcatatctccaccggcggcggcgcttcgctcgagtttatggaaggaaaacagctgccgggtgtcgtcgcactcgaagacaaatgacccacggcgccggatttggcgcatggcggctgactccgcccattgaaaggaagggtgaa

SEQ ID NO: 10459 - protein, 394 aa, Bacillus stearothermophilus
MNKKTIRDVDVRGKRVFCRVDFNVPMEQGAITDDTRIRAALPTIRYLIEHGAKVILASHLGRPKGKVVEELRLDAVAKRLGELLERPVAKTNEAVGDEVKAAVDRLNEGDVLLLENVRFYPGEEKNDPELAKAFAELADLYVNDAFGAAHRAHASTEGIAHYLPAVAGFLMEKELEVLGKALSNPDRPFTAIIGGAKVKDKIGVIDNLLEKVDNLIIGGGLAYTFVKALGHDVGKSLLEEDKIELAKSFMEKAKEKGVRFYMPVDVVVADRFANDANTKVVPIDAIPADWSALDIGPKTRELYRDVIRESKLVVWNGPMGVFEMDAFAHGTKAIAEALAEALDTYSVIGGGDSAAAVEKFGLADKMDHISTGGGASLEFMEGKQLPGVVALEDK

SEQ ID NO: 10460 - DNA, 1254 bp, Candida maltosa
  CDS (1)..(1254)
atgtcattatccaacaaattatctgtcaaagacttaaacgtcactggtaaaagagtttttatcagagttgatttcaacgttccattggacggtaaaaccatcaccaacaaccaaagaattgttgctgctttaccaactatcaaatatgttgaagaacaaaaaccaaaatgtatcattttagcttctcacttgggtagaccaaacggtgaaagaaatgaaaaatactctttggccccagttgctgctgaattggaaaaattattgggtcaaaaagtcaccttcttggatgactgtgttggtccagaagtcaccaaagctgttgactctgctactgaaggtcaaatcttcttgttggaaaacttgagattccacattgaagaagaaggttctgctaaagacaaggatggtaaaaaaactaaagctgacccagaagctgtcaagaaattcagagaacaattgacttctttagctgatgtttacgtcaatgatgctttcggtactgcccacagagcccactcttctatggttggtttggaagttccagaaagagctgctggtttcttgatgtccaaagaattggaatactttgctaaagctttggaaaacccacaaagaccattcttggctatcttgggtggtgctaaagtttctgacaaaatccaattgattgacaacttgttggacaaagttgatatgttgattgttggtggtggtatggctttcaccttcaaaaaagtcttgaacaacatgccaattggtgactctcttttcgacgaagctggtgctaaaaacgttgaaaacttggttgctaaagccaagaagaacaatgttgaattgatcttgccagttgatttcgtcactgccgacaaattcgacaaagatgctgaagtctctactgccgatgatgttactggtatcccagacaaatggatgggtttagactgtggtccaaaatccagaaaattatttgctgatgccgttgctaaagctaaaaccattgtttggaacggtccaccaggtgttttcgaatttgacaaattcgctgaaggtactaaatctttattggatgacgctgtcaaatccgctgaagttggtaacattgtcatcattggtggtggtgataccgctactgttgctaagaaatacggtgttgttgacaaattatcccacgtttctactggtggtggtgcttctttggaattattagaaggtaaagaattaccaggtgtaactgctctttctaacaaagcctaa

SEQ ID NO: 10461 - protein, 417 aa, Candida maltosa
MSLSNKLSVKDLNVTGKRVFIRVDFNVPLDGKTITNNQRIVAALPTIKYVEEQKPKCIILASHLGRPNGERNEKYSLAPVAAELEKLLGQKVTFLDDCVGPEVTKAVDSATEGQIFLLENLRFHIEEEGSAKDKDGKKTKADPEAVKKFREQLTSLADVYVNDAFGTAHRAHSSMVGLEVPERAAGFLMSKELEYFAKALENPQRPFLAILGGAKVSDKIQLIDNLLDKVDMLIVGGGMAFTFKKVLNNMPIGDSLFDEAGAKNVENLVAKAKKNNVELILPVDFVTADKFDKDAEVSTADDVTGIPDKWMGLDCGPKSRKLFADAVAKAKTIVWNGPPGVFEFDKFAEGTKSLLDDAVKSAEVGNIVIIGGGDTATVAKKYGVVDKLSHVSTGGGASLELLEGKELPGVTALSNKA

SEQ ID NO: 10462 - DNA, 1377 bp, Plasmodium falciparum
  CDS (15)..(1265)
gaagcttccataaaatgttaggcaacaaattaagcattagtgacctaaaggatattaagaacaagaaggttttagtaagagttgattttaatgtacctattgaaaatggaataattaaagatacgaacagaattactgctacattacccacaattaaccatttaaagaaagaaggagcttcaaaaattatattaatatcccattgtggtagaccagatggtttaagaaatgagaaatataccttaaagccagtagctgaaactttaaaaggattattaggagaagaagtattatttttaaatgattgtgtaggtaaagaagttgaagataaaataaatgctgctaaagaaaattcagtaattctcttagaaaatttaagatttcatattgaagaagaaggtaaaggtgttgatgctaatggaaacaaagtaaaagcaaataaagaagatgttgagaagttccaaaatgatttaacaaaattagctgatgtttttattaatgatgctttcggtactgctcatcgtgctcatagtagtatggtaggtgttaaattaaatgttaaagcttcaggattcttaatgaaaaaagaattagaatattttagtaaagccttagaaaacccacaaagaccactactagccattttaggtggtgctaaagtatcagataaaattcagttaatcaaaaatttattagataaagttgatcgtatgattattggaggtggtatggcttatacttttaaaaaagtcttaaacaatatgaaaattggtacctctctttttgatgaagcaggtagtaaaattgttggagaaattatggaaaaggcaaaagctaaaaatgttcaaatatttttacctgtagattttaaaattgcagataattttgataataatgctaataccaaattcgttactgatgaagaaggtatcccagataattggatgggtcttgatgctggtccaaaaagtattgaaaattataaagatgttattttaacatcaaaaactgttatttggaacggaccacaaggtgttttcgaaatgccaaactttgcaaaaggtagtatcgaatgtctcaatttagttgttgaagttaccaaaaaaggagctatcaccattgttggaggtggagatacagcttcattagttgaacaacaaaataagaaaaacgaaattagtcatgtatctacaggtggaggagcctcacttgaacttttagaaggaaaagaattaccaggtgtattagcactttcaaacaaataaaaccaaggcacaataattaaataaataaaatcatgtaaaataaaaataatatgatatatacaatataatatatattttataatagtgctttatttatttatttatttttttt

SEQ ID NO: 10463 - protein, 416 aa, Plasmodium falciparum
MLGNKLSISDLKDIKNKKVLVRVDFNVPIENGIIKDTNRITATLPTINHLKKEGASKIILISHCGRPDGLRNEKYTLKPVAETLKGLLGEEVLFLNDCVGKEVEDKINAAKENSVILLENLRFHIEEEGKGVDANGNKVKANKEDVEKFQNDLTKLADVFINDAFGTAHRAHSSMVGVKLNVKASGFLMKKELEYFSKALENPQRPLLAILGGAKVSDKIQLIKNLLDKVDRMIIGGGMAYTFKKVLNNMKIGTSLFDEAGSKIVGEIMEKAKAKNVQIFLPVDFKIADNFDNNANTKFVTDEEGIPDNWMGLDAGPKSIENYKDVILTSKTVIWNGPQGVFEMPNFAKGSIECLNLVVEVTKKGAITIVGGGDTASLVEQQNKKNEISHVSTGGGASLELLEGKELPGVLALSNK

SEQ ID NO: 10464 - DNA, 1185 bp, Bacillus megaterium
  CDS (1)..(1185)
atgaacaaaaaaacgttgaaagacatcgatgtaaaaggaaagcgagtattttgtcgcgtagactttaacgtaccaatgaaagacggaaaagtaacagacgaaactcgtattcgtgcagctattcctactattcaatatttagtagaacaaggtgcaaaagtaattttagctagccatcttggacgtccaaaaggcgaagttgttgaagagttacgtctaaatgctgttgcagaacgtttacaagctcttcttggtaaagacgttgcaaaagctgacgaagcttttggcgaagaagtaaagaaaacaatcgacggcatgagcgaaggcgatgttttagtacttgaaaacgtacgtttttacccaggtgaagagaaaaacgatcctgaattagcaaaagcatttgctgaattagcagacgtgtacgtaaacgatgcattcggtgcagctcaccgtgcgcatgcttcaacagaaggaattgcacaacatattccagcagtagcaggtttcttaatggaaaaagagcttgatgtgctttcaaaagcattatcaaacccagaacgtccatttactgcaatcgttggtggagcaaaagttaaagacaaaatcggtgtaattgaccacttgcttgataaagtagataacttaatcatcggtggaggactttcttacacatttattaaggcactaggccatgaagtaggtaaatcacttcttgaagaagacaagattgaacttgcaaaatctttcatggaaaaagctaagaaaaacggagtaaacttctacatgccagtggacgtggtagtagcagatgacttctcaaatgatgctaatattcaagttgtatcaattgaagatattccaagcgattgggaaggcttagacgcaggaccgaaaacgcgtgaaatctatgctgacgtaatcaaaaactctaagttagttatttggaacggaccaatgggtgtatttgaattagacgcatttgctaacggaacaaaagcagtagctgaagctttagcagaagcaactgacacatattcagtaatcggcggaggagactctgcagcagctgttgaaaaattcaacttagctgataaaatgagccatatttctacaggtggcggtgcgtcactagagtttatggaaggtaaagaacttccaggcgtagttgcattaaacgataagtaa

SEQ ID NO: 10465 - protein, 394 aa, Bacillus megaterium
MNKKTLKDIDVKGKRVFCRVDFNVPMKDGKVTDETRIRAAIPTIQYLVEQGAKVILASHLGRPKGEVVEELRLNAVAERLQALLGKDVAKADEAFGEEVKKTIDGMSEGDVLVLENVRFYPGEEKNDPELAKAFAELADVYVNDAFGAAHRAHASTEGIAQHIPAVAGFLMEKELDVLSKALSNPERPFTAIVGGAKVKDKIGVIDHLLDKVDNLIIGGGLSYTFIKALGHEVGKSLLEEDKIELAKSFMEKAKKNGVNFYMPVDVVVADDFSNDANIQVVSIEDIPSDWEGLDAGPKTREIYADVIKNSKLVIWNGPMGVFELDAFANGTKAVAEALAEATDTYSVIGGGDSAAAVEKFNLADKMSHISTGGGASLEFMEGKELPGVVALNDK

SEQ ID NO: 10466 - DNA, 1831 bp, Crithidia fasciculata
  CDS (131)..(1648)
aaagcggcagcaccaactgcgctcactatattttatcttgtttctttgcttccccgtcgtccgtcatcgtgcgcgggctgctttgagctcctgcacaagtttattttattttcttattgtgtccgccgtgatgctcctctccacgcaatcgattcccataaaaaagagcgtcgacgacatctggccggtggcaggcaaacgcgttctcattcgggtggacttcaacgtgcccaccagctctggcggcatcgacgacgacttccgcattcgctctgctatccccactattcgccgcatcgttgaccagggtggcatctgcatcctcatcagccacctcggccgccccaccggtgtggactacgacaccgcccatgcagagcaggaaaagcgccagacaccggtgcagctgcccaattcgcgtggcaagaccgccttcttctctgggctgcgtggcgatgcgaaggcgacgatcttggcgtggtcgagtcagcgagagaaggctgcaacgctctccaacccgtacggcagtggcaagacggccgtctttgcgcgcctgccagaggaagagaagcggcgcctgctgctgcgcttcatgagtgagcacaaggaggagctcttcccccagctcggctccgcgggctacgagaaggagttcagcttggagccggtggcggtgaagctggcggagctgctggatcagcacgtgtactttggccacgactgcctcggcgcgcaagcggatattgcaaagctgcggtgtggggaggtgatgctgctggagaaccttcgcttctacacgaacgagaactcatctgacgagcgcaagcgcatgctgatggcgcgtattctcgcctcgtatgccgatgtgtacatcaacgacgccttcggcacggcgcaccgcgacagcgcgagtttgacgggcatcccccgcgtgctgcagcagggtgcggccggctacctgatggagaaggagatctcgtacttctccaaggtgctgaacaacccaccccggccgctcttggcgattatcggcggcgcgaagctcagcgacaagatgcaggtgctggagaacctgctggactgcgtcgacagcctcttcatcggtggtggcttggcgtacacgtttctccggtctcagggctactcgatcggcacgtcccacttcgaggaggcttttgtgcccttcgcccaagcgcttcctctcgctggcagcggacggcaggtgcgggtggtgctgccagaggaccacgtctgccacgcccacacgcggccggccgaagcgccgctcacgacgacgagtgccaatataccggacggctacgcagggctggacattggcccgctcaccatccaatccatcacgcacctcgtgcggcagtgcagcagcgtgatctggaacggaccacttggcatgttcgagatgccatactacgccttcggcacgttttccattgcgcgagtggtgagtcagtcttcggctgcgaagggcactaccagcatcgtcggcggtggcgacacggcgagcgcgatgatgaagtccggcgaggcggctcacatttcgcacatctccacaggcggcaacgcatcgctggagctgctggaggggaaggtgctagccgccgtggcggtgctggacaacaaggagtgagagcgactccgtatgtatttttttttttctgcccggcgtgtattacgccgttttaagagctccatcgacgcctttttgtccttcagctgctccagctgctccacggtgactcgcttctttctctttctagagtgtctttttttttcttttcactctctatacatatgtgagcgacctctttgc

SEQ ID NO: 10467 - protein, 505 aa, Crithidia fasciculata
MLLSTQSIPIKKSVDDIWPVAGKRVLIRVDFNVPTSSGGIDDDFRIRSAIPTIRRIVDQGGICILISHLGRPTGVDYDTAHAEQEKRQTPVQLPNSRGKTAFFSGLRGDAKATILAWSSQREKAATLSNPYGSGKTAVFARLPEEEKRRLLLRFMSEHKEELFPQLGSAGYEKEFSLEPVAVKLAELLDQHVYFGHDCLGAQADIAKLRCGEVMLLENLRFYTNENSSDERKRMLMARILASYADVYINDAFGTAHRDSASLTGIPRVLQQGAAGYLMEKEISYFSKVLNNPPRPLLAIIGGAKLSDKMQVLENLLDCVDSLFIGGGLAYTFLRSQGYSIGTSHFEEAFVPFAQALPLAGSGRQVRVVLPEDHVCHAHTRPAEAPLTTTSANIPDGYAGLDIGPLTIQSITHLVRQCSSVIWNGPLGMFEMPYYAFGTFSIARVVSQSSAAKGTTSIVGGGDTASAMMKSGEAAHISHISTGGNASLELLEGKVLAAVAVLDNKE

SEQ ID NO: 10468 - DNA, 1248 bp, Drosophila melanogaster
  CDS (1)..(1248)
atggccttcaataagctgagcatcgaaaacctggacttggcgggcaagcgggtgttgatgcgcgtcgacttcaatgtgcccatcaaggagggcaagatcaccagcaaccagagaattgtcgctgccttggatagtatcaagttggccctttccaagaaagccaagtcggtggtgctgatgtcccacttgggtcgtcccgatggcaacaagaacatcaagtacaccctggcacccgtggccgctgagctgaagaccctgcttggccaggatgtgatcttcctaagtgactgcgtcggcagcgaagtggaggccgcttgcaaggatcccgcaccgggatccgtcattctgctggagaacgtccgcttctacgtggaggaggagggcaagggcttggatgccagcggcggcaaggtcaaggccgatcctgccaaggtcaaggagttccgtgccagcctggccaagctgggcgatgtctatgtcaacgacgccttcggcactgcccatcgcgcccacagttccatgatgggcgatggcttcgagcagcgcgcagctggtctgttgctgaacaaggagctgaagtacttctcgcaggccctggacaagccaccaaatcccttcctggcaattctcggtggcgccaaggtggccgacaagatccagctgattgagaaccttctggacaaggtcaacgagatgatcatcggtggcggcatggccttcaccttcctgaaggtcctcaacaacatgaagatcggcggttccctgttcgacgaggagggctccaagatcgtcgagaaactggtggagaaggccaagaagaataacgtgcagttgcatctgccagtggactttgtctgcggcgacaagttcgccgagaacgctgccgtcagcgaggccaccgtggaggccggaattcccgatggacacatgggtctggatgtgggtcccaagacccgtgagctcttcgcggcacccatcgcacgcgccaagctcatcgtgtggaacggaccccccggtgtctttgagttccccaacttcgccaacggcaccaagtccatcatggacggcgtggtggccgccaccaagaacggcaccgtctccatcatcggcggcggcgacactgcctcttgctgcgccaagtggaacacggaggcactcgtctcgcacgtctccaccggaggcggcgcttcgctggagctcctggagggcaagacactgccaggcgtgcgtgcattgaccagcgcctaa

SEQ ID NO: 10469 - protein, 415 aa, Drosophila melanogaster
MAFNKLSIENLDLAGKRVLMRVDFNVPIKEGKITSNQRIVAALDSIKLALSKKAKSVVLMSHLGRPDGNKNIKYTLAPVAAELKTLLGQDVIFLSDCVGSEVEAACKDPAPGSVILLENVRFYVEEEGKGLDASGGKVKADPAKVKEFRASLAKLGDVYVNDAFGTAHRAHSSMMGDGFEQRAAGLLLNKELKYFSQALDKPPNPFLAILGGAKVADKIQLIENLLDKVNEMIIGGGMAFTFLKVLNNMKIGGSLFDEEGSKIVEKLVEKAKKNNVQLHLPVDFVCGDKFAENAAVSEATVEAGIPDGHMGLDVGPKTRELFAAPIARAKLIVWNGPPGVFEFPNFANGTKSIMDGVVAATKNGTVSIIGGGDTASCCAKWNTEALVSHVSTGGGASLELLEGKTLPGVRALTSA

SEQ ID NO: 10470 - DNA, 1251 bp, Kluyveromyces marxianus var. lactis, Candida sphaerica
  CDS (1)..(1251)
atgtctttgagttcaaaattgactgtcaaggatttggatgtcactggtaaaagagtgttcatcagagttgatttcaacgtcccattggacggtaagaagatcacttccaaccaaagaattgtagcagctctgcctactattcaatacgttttggaaaagaagccaaaggccattgtcttggcctctcatttgggtagaccaaacggtgaagttaacgacaaatactcattggctccagttgccgatgaattgtctagactattgcaaaagccagttactttcttgcatgactgtgttggtgaagaagtcaccaatgccgttaacaacgctaaggacggtgaagttttcctattggaaaacttgagattccacatcgaagaagaaggttccagaaaggtggatggtaacaaggttaaggctgacaaggctgctgttaccaaattcagagaacaattgagttctttggccgatgtttacgttaacgatgccttcggtaccgctcacagagctcactcttccattgtcggtttcgacttgccaaacagagctgccggtttcttgttgtccaaggaattgcaatactttgctaaggctttggaaaacccaaccagaccattcttggctatcttgggtggtgctaaggttgcagacaagattcaattgatcgacaatttgttggacaaggtcgattctttgatcattggtggtggtatggctttcaccttcaagaaggtcttggaaaacactgaaatcggtgactccatctacgatgctgctggtgccgaattggttccaaagttggtcgaaaaggctaagaagaacaacgtcaagatcgtcttgccaactgacttcgtcattggtgacaagttctctgctgatgctaacacaaaggttgtcaccgacaaggaaggtattccaagcggctggcaagggttggacaacggtccagaatctagaaaggctttcgctgccactgttgctgaagctaagactattgtctggaacggtccaccaggtgtcttcgaatttgctcctttcgctaagggtaccgaagctctattggacgccgttgtcgcctcctctcaagctggtaacaacgtcatcatcggtggtggtgacaccgctaccgtcgccaagaagtacggtgtcgtcgacaagatctctcacgtctccactggtggtggtgcttctttggaattgttggaaggtaaagaattgcctggtgtcactttcttgtccaacaagcaataa

SEQ ID NO: 10471 - protein, 416 aa, Kluyveromyces marxianus var. lactis, Candida sphaerica
MSLSSKLTVKDLDVTGKRVFIRVDFNVPLDGKKITSNQRIVAALPTIQYVLEKKPKAIVLASHLGRPNGEVNDKYSLAPVADELSRLLQKPVTFLHDCVGEEVTNAVNNAKDGEVFLLENLRFHIEEEGSRKVDGNKVKADKAAVTKFREQLSSLADVYVNDAFGTAHRAHSSIVGFDLPNRAAGFLLSKELQYFAKALENPTRPFLAILGGAKVADKIQLIDNLLDKVDSLIIGGGMAFTFKKVLENTEIGDSIYDAAGAELVPKLVEKAKKNNVKIVLPTDFVIGDKFSADANTKVVTDKEGIPSGWQGLDNGPESRKAFAATVAEAKTIVWNGPPGVFEFAPFAKGTEALLDAVVASSQAGNNVIIGGGDTATVAKKYGVVDKISHVSTGGGASLELLEGKELPGVTFLSNKQ

SEQ ID NO: 10472 - DNA, 1449 bp, Zymomonas mobilis
  CDS (148)..(1341)
ctgcagttagttattaagctgattgcagcattaacctcctgatacaggcccgttatgggatatatccgttatagctgggtctcgtaaggaggctgtctccgttatcagatccgctttatgatataaggcggccaaaaggaggatataatggcttttcgtacattagatgatattggtgacgtcaaaggtaagcgcgttcttgttcgcgaagatctgaacgttcctatggatggcgatcgcgttacggatgatactcgtctgcgcgctgcaatcccgaccgttaatgaattggctgaaaagggcgccaaagtccttattctggctcacttcggtcgtccaaaaggtcagccgaatcctgaaatgtccttggctcgcatcaaagatgcgctggctggcgttctgggtcgtccggttcacttcatcaatgacatcaaaggtgaagctgcagcaaaagccgttgatgccctgaatcctggtgccgttgctcttcttgaaaacacccgcttttatgctggtgaagaaaagaatgatccggctctggcagcagaagtagctaagctcggcgatttctatgtcaatgatgctttctcggctgctcaccgcgcccatgtttcgaccgaaggtctggctcacaagctgcctgctttcgctggtcgtgccatgcagaaagaattagaagctcttgaagctgcccttggtaagccgacccacccggtcgcagccgttgtcggtggtgctaaagtttctaccaagctcgacgttctgaccaaccttgtttccaaggttgaccatctgatcatcggtggtggtatggctaataccttcctcgctgctcagggtgttgatgttggtaaatcgctttgtgagcatgagctgaaagataccgttaaaggtattttcgctgctgctgaaaaaacgggctgcaaaatccatcttccgagcgatgtcgttgtcgccaaggaattcaaagccaatccgccgatccgtaccattccggtcagcgacgttgctgctgacgaaatgatccttgacgttggcccgaaagccgtcgctgctttgaccgaagttctgaaagcttccaagaccttggtctggaatggcccgttgggcgctttcgaaattgaacctttcgataaagctacggttgctctcgctaaggaagccgctgctttgaccaaagccggttctttgatctctgttgctggtggtggtgacacggttgccgctcttaaccatgctggtgtggcaaaagactttagctttgtctcaacggctggtggtgctttcctcgaatggatggaaggtaaagagctgccgggtgttaaagccctcgaagcttaattttccagaagaagggggcggcttttttaagtcgccctttttttgtctttatttagataaaagaggctttttaggcttgcctcttctttttaaaaaattaacctgcga

SEQ ID NO: 10473 - protein, 397 aa, Zymomonas mobilis
MAFRTLDDIGDVKGKRVLVREDLNVPMDGDRVTDDTRLRAAIPTVNELAEKGAKVLILAHFGRPKGQPNPEMSLARIKDALAGVLGRPVHFINDIKGEAAAKAVDALNPGAVALLENTRFYAGEEKNDPALAAEVAKLGDFYVNDAFSAAHRAHVSTEGLAHKLPAFAGRAMQKELEALEAALGKPTHPVAAVVGGAKVSTKLDVLTNLVSKVDHLIIGGGMANTFLAAQGVDVGKSLCEHELKDTVKGIFAAAEKTGCKIHLPSDVVVAKEFKANPPIRTIPVSDVAADEMILDVGPKAVAALTEVLKASKTLVWNGPLGAFEIEPFDKATVALAKEAAALTKAGSLISVAGGGDTVAALNHAGVAKDFSFVSTAGGAFLEWMEGKELPGVKALEA

SEQ ID NO: 10474 - DNA, 1254 bp, Penicillium citrinum
  CDS (1)..(1254)
atgtctctctccaacaagctccccgttactgatgtcgacctcaagggcaagcgtgtcttgatccgggttgacttcaatgtccccctcgatgagaacaagaacgttaccaacccccagcgtatcgttggtgctctgcccaccatcaagtatgctatcgacaacggtgccaaggctgttgtgctcatgtcccacctcggccgccccgatggcaaggtcaaccccaagtacagcctgaagcccgttgttcccgtgcttgagaagcttctcggcaagagcgtcaccttcgctgaggactgcgttggtccccagaccgaggagaccgtgaacaaggcttccgatggccaggtcattctgcttgagaacctgcgtttccacgctgaggaggagggcagctccaaggatgctgagggcaagaaggtcaaggccgacaaggccgatgttgatgcgttccgcaagggcctcactgccctcggtgacgtttacgttaacgatgctttcggtaccgcacaccgcgctcacagctccatggtcggcgtggacctcccccagaaggccgccggtttcctcgtgaagaaggagctggagtacttcgccaaggctcttgagagccctgcccgtcccttcctcgccatcctcggtggtgccaaggtgtccgacaagatccagctgatcgataacctcctgcccaaggttaacagcctcatcatcaccggtggaatggctttcaccttcaagaagactcttgagaacgtcaagatcggtaacagtctcttcgacgaggccggcagcaagatcgtcggcgagatcgtcgagaaggccaagaagtacaacgtcgagatcgtcctccccgttgactacgtcaccgccgataagttctccgccgatgctaccgttggtgccgctaccgacgccaccggtatccccgacggctacatgggtctggatgttggccccgagagtgtcaagctctaccagaagaccatcgccgaggccaagaccatcctctggaacggtccccccggtgtcttcgagcttaagcccttcgccagcgccaccgaggctaccctcgatgccgctgtcaaggctgccgagtccggctccatcgtcatcatcggtggtggtgataccgctaccgtggccgctaagtacaaggtcgaggacaagatctcccacgtctcaactggtggcggtgcttcgctcgagcttctcgagggcaaggagcttcccggtgttgctgctctgtccagtaagtaa

SEQ ID NO: 10475 - protein, 417 aa, Penicillium citrinum
MSLSNKLPVTDVDLKGKRVLIRVDFNVPLDENKNVTNPQRIVGALPTIKYAIDNGAKAVVLMSHLGRPDGKVNPKYSLKPVVPVLEKLLGKSVTFAEDCVGPQTEETVNKASDGQVILLENLRFHAEEEGSSKDAEGKKVKADKADVDAFRKGLTALGDVYVNDAFGTAHRAHSSMVGVDLPQKAAGFLVKKELEYFAKALESPARPFLAILGGAKVSDKIQLIDNLLPKVNSLIITGGMAFTFKKTLENVKIGNSLFDEAGSKIVGEIVEKAKKYNVEIVLPVDYVTADKFSADATVGAATDATGIPDGYMGLDVGPESVKLYQKTIAEAKTILWNGPPGVFELKPFASATEATLDAAVKAAESGSIVIIGGGDTATVAAKYKVEDKISHVSTGGGASLELLEGKELPGVAALSSK

SEQ ID NO: 10476 - DNA, 1227 bp, Sulfolobus solfataricus
  CDS (1)..(1227)
atgggagacttaactatacccacaatggatgatatagatatccaatcaaaaaaagttctgttacgaatagacataaattcccccgtagatgagaacggcaaaataattgatgattctagaataaaggcacatattggaacaattaaggaattgattaataagggcaattctgttgtgttaatttcacatcaaggtaggcctggagacaaggatttcacaagtttagaggaacatgctaaattaatttcaaagtatttagatcgagaagtaattttcgtagatgatgtaataggcccatatgcaagggaaatgattaaaaaattagaaaataatgggattttactcttagataatataagattaatttcagaggagttaatagaggctccaccacaacaacacgtaaaaagctttttagtaaagaaattagctccgcttttcgacatttatatcaatgatgcgttcgctactgcacacagaagtcagcctagtatcgtaggctttcctttagctttaccatcagcagctggaagagtaatggaaagggaagtttcagcgttagccaagatttttaatgccgaagacacaccaaagatatttacgttaggtggtggtaaggttcacgatactattaggataattgaaaatctagtgagaaaaaggatagctgacagaatacttactgggggtttagttgcagaattattttctgtcgctaaaggaatgaatttaaatccaaagaatatggaaattctggaaaaattaggtatactgagtctaattcctagagctagaaaactacttctaagtggagctcctatcgaaataccagttgactataaggtagaaataaacggaaacgtaatcgaggaaccagctagtaaggtcactggcattataaaggatatcggatccactactgcagaaatatactcatcatttataaaagatgctaaagtagtagttttaaggggaccaatgggagtaatcgaagatgaaagatttaagagtggaagtaaaagcgtcttaaaagcatcattagagggacaaggttacgttataataggaggtggacacatgataagtgctttagatgaggatatgaagatagatagtagtaaagttcatatctctactggtggaggagctctcctcttattcttatctggagaacgattaccagcattagaggcattatcaatgtcggtggtgaatagcggtgattaa

SEQ ID NO: 10477 - protein, 408 aa, Sulfolobus solfataricus
MGDLTIPTMDDIDIQSKKVLLRIDINSPVDENGKIIDDSRIKAHIGTIKELINKGNSVVLISHQGRPGDKDFTSLEEHAKLISKYLDREVIFVDDVIGPYAREMIKKLENNGILLLDNIRLISEELIEAPPQQHVKSFLVKKLAPLFDIYINDAFATAHRSQPSIVGFPLALPSAAGRVMEREVSALAKIFNAEDTPKIFTLGGGKVHDTIRIIENLVRKRIADRILTGGLVAELFSVAKGMNLNPKNMEILEKLGILSLIPRARKLLLSGAPIEIPVDYKVEINGNVIEEPASKVTGIIKDIGSTTAEIYSSFIKDAKVVVLRGPMGVIEDERFKSGSKSVLKASLEGQGYVIIGGGHMISALDEDMKIDSSKVHISTGGGALLLFLSGERLPALEALSMSVVNSGD

SEQ ID NO: 10478 - DNA, 1206 bp, Haloarcula vallismortis
  CDS (1)..(1206)
atgatgactttccagacgctcgatgacctcgacgatggacagcgcgtcctcgtccgactcgacctcaactcaccggtcgaggacggcacagtacaggacaatcgacggttcgaccgccacgcggagactgtcaaggaactcgctgaccgggggttcgaggtcgcagtgctggcccatcagggccgcccgggccgcgacgacttcgtctcgctcgaccagcacgccgacatcctcgccgaccacatcgaccgcgacgtggatttcgtcgacgagacctacgggccacaggcgattcacgatatcgccgacctcgatagtggcgacgtgctcgttctggagaacacgcggatgtgtgacgacgaactgcccgaggaagaccccgaagtgaaggcccagacggagttcgtcaagacgctggccggggagttcgacgcctacatcaacgacgcctactccgcggcccaccgctcgcacgcctcgctcgtgggcttcccgctcgtgatggatgcctacgccggtcgcgtgatggagaccgagtacgaggccaacaccgccatcgccgagaaggagttcgacgggcaggtgacgatggtcgtcggcgggacgaaggccaccgacgtcatcgacgtgatgacccacttagacgagaaggtcgacgacttcttgcttggcggtatcgcgggaactgttcctgcggcagccggccacccagtcggctacgacatcgacgacgcgaacctctacgacgagcagtgggaggcaaacagtgagaagatcgagtccatgctcgaagaccaccgggaccagattaccctcgcggtcgacctggcctacgaggacgagaacgacgaccgcgccgagcaggccgtcgacgacatcgacgagaaaaggctctcgtacctcgacgtgggcagcgagaccctcatggagtactcgccgatcatccgcgagtccgaggccgtcttcggtgaagggcgcgctgggatgttcgaagacgaacggttctcggtcgggactgccggtgtgctcgaagccatcgccgacaccgactgtttctccgtcgtcggcggcggcgacacctcacgcgctatcgagatgtacgggatggaagaagacgagttcggccacgtctccatcgctggcggggcctacatccgggcgttgacgcgcgcacaactggtcggcgtcgaagtcctccagcgctaa

SEQ ID NO: 10479 - protein, 401 aa, Haloarcula vallismortis
MMTFQTLDDLDDGQRVLVRLDLNSPVEDGTVQDNRRFDRHAETVKELADRGFEVAVLAHQGRPGRDDFVSLDQHADILADHIDRDVDFVDETYGPQAIHDIADLDSGDVLVLENTRMCDDELPEEDPEVKAQTEFVKTLAGEFDAYINDAYSAAHRSHASLVGFPLVMDAYAGRVMETEYEANTAIAEKEFDGQVTMVVGGTKATDVIDVMTHLDEKVDDFLLGGIAGTVPAAAGHPVGYDIDDANLYDEQWEANSEKIESMLEDHRDQITLAVDLAYEDENDDRAEQAVDDIDEKRLSYLDVGSETLMEYSPIIRESEAVFGEGRAGMFEDERFSVGTAGVLEAIADTDCFSVVGGGDTSRAIEMYGMEEDEFGHVSIAGGAYIRALTRAQLVGVEVLQR

SEQ ID NO: 10480 - DNA, 1448 bp, Pyrococcus woesei
  CDS (85)..(1317)
caacatgttttaggctatacaatcttttcttccccttccccacaactttcttaaatctccatccaactattttatggtggtgaaatgttcaggttgagagattttgaatactacaacagaaccgtgtttcttcgagttgacttaaactcaccaatgagtaatggaaaaataataagtgacgcgagatttcgagcagtccttccaacgataaagtacctaatagagagtggagcaaaagtagttgttggcactcatcaaggaaaaccctacagcgaagagtattcgactactgaagagcatgcgagaattctctctgagctcctaaatatgcatgttgaatacgttgaagacatttttggaaagtatgcaagggagagaataaaggctatgaaacctggggaagttatagtcctcgaaaacctcaggttctctgcagaagaagtaaaaaacgcaactattgaggaatgcgaaaagacgttttttgttaggaagctctcccaggtaatagacctcgttgttaacgatgcctttgctgccgctcatagaagtcagccatctctcgttggttttgcaagaataaagcctatgataatgggattccttatggaaaaagaagttgatgctttaacaaaagcttatgaaagtgaagaaaagccgagagtttatgttcttggtggtgcaaaagttgatgactcattaaaagttgccgaaaacgttcttaggaaagaaaaggctgatctcatactgacagggggattggttggccaattattcactctagctaagggctttgacctgggaagagaaaacattaaattcttagaaaagaagggaattttaaaatacgtagactgggcagaaaagattcttgacgaattttatccctacgttagaactcccgtagactttgccattgacttcaagggagaaagagtagagatagatttgctcagcgacgagaaaaggctctttgacgaatatccaatccttgacatcggttctagaacagttgaaaagtatagggagatactcttaaaggccaggataatagtagccaacggtcctatgggagtgttcgaaagggaagaatttgccgtgggaacaattggggtattcaaggccatcggagagagtccagcctttagcgtcattggtggtggtcattcaatagcaagcatatacaagtacaacataactgggataagccatatctctaccggtgggggagctatgctaacattttttgctggagaaaagttgccagttcttgaagcgctaaagattagttacgaaaagttctctaacttactttcttaatttttaaccagacatttaaaagtagaatcctgtgaatatccttggaggtgaggaagtgaaaggggttattctagctgctggatatgggagtagaatgggagagaaccaaagggactactaaagatcgcagg

SEQ ID NO: 10481 - protein, 410 aa, Pyrococcus woesei
MFRLRDFEYYNRTVFLRVDLNSPMSNGKIISDARFRAVLPTIKYLIESGAKVVVGTHQGKPYSEEYSTTEEHARILSELLNMHVEYVEDIFGKYARERIKAMKPGEVIVLENLRFSAEEVKNATIEECEKTFFVRKLSQVIDLVVNDAFAAAHRSQPSLVGFARIKPMIMGFLMEKEVDALTKAYESEEKPRVYVLGGAKVDDSLKVAENVLRKEKADLILTGGLVGQLFTLAKGFDLGRENIKFLEKKGILKYVDWAEKILDEFYPYVRTPVDFAIDFKGERVEIDLLSDEKRLFDEYPILDIGSRTVEKYREILLKARIIVANGPMGVFEREEFAVGTIGVFKAIGESPAFSVIGGGHSIASIYKYNITGISHISTGGGAMLTFFAGEKLPVLEALKISYEKFSNLLS

SEQ ID NO: 10482 - DNA, 1251 bp, Mycobacterium leprae
  CDS (1)..(1251)
atgcgcattcctaatcttaaagatcttcttgaggaaggtgtttctggtcgctgcgtgttggtgcgctgcgatctgaacgtcccgctgggggatgatggcgccatcaccgacctcggtcgggtcaccgcgtcggtgcctacgttgaaagcgctgcttgaggccggagccaagattgtggttgccgcccatctgggccgccccaagaacgggccagacccaaagctgtcactggagccggtcgccgcggcgctcggtgagcagctgggccaaaacgtccagttggtctgcagcaccgatcgttcccctgtcgggggtgatgcgctcgcctgtgttgagaggctgaccgacggcgacctcctactgctgcagaacatccgcttcgatccgcgcgagaccagcaaagtcgacgacgaacgactcgctctggccaagcaattggttgaattggtcgggtcagcaggagcttttgtttcggatggattcggtgtggtgcatcgcaggcaggcttcggtgtatgacgtcgctacgctattgccgcactacgccggcatactggttgctgacgagataaggatactcgagcaattgactagttcggccaaacgcccctacgcagtggtgctcggcgggtcgaaggtatccgacaagctcggcgtcatcgagtcgctggcgacaaaagccgatagcatcgtactcggaggtggaatgtgctttacatttcttgctgcacaaggattttcagtaggtaaatcgttattggaaaccgagatgatcgagacctgtcgtagtctgttggacacctacgctgacgtgcttcggcttcctatggacattgtggtgacagagaagttcgtcgctgattcgccgccgcagaccgtcgccgccgacgctatcccagatggattgatgggactggatatcgggccggaatcggtcaagcggttcgctacgttgttatccaacgcctcgaccattttctggaacggaccgatgggcgtgttcgaattccctgcgtacgccgcgggcaccagaggtgttgctgaagcaatcgtggctgttactggcaagggagctttcagcgtggtcggcggcggtgactctgcggctgcgatgcgggcgctcagcctacccgaaggcagtgtctcgcacctttccaccggtggcggcgcgtcgttggaataccttgagggcaagacgctacccgggatcgaggtactaggtcgtgagcagccaaggggaggagactcgtga

SEQ ID NO: 10483 - protein, 416 aa, Mycobacterium leprae
MRIPNLKDLLEEGVSGRCVLVRCDLNVPLGDDGAITDLGRVTASVPTLKALLEAGAKIVVAAHLGRPKNGPDPKLSLEPVAAALGEQLGQNVQLVCSTDRSPVGGDALACVERLTDGDLLLLQNIRFDPRETSKVDDERLALAKQLVELVGSAGAFVSDGFGVVHRRQASVYDVATLLPHYAGILVADEIRILEQLTSSAKRPYAVVLGGSKVSDKLGVIESLATKADSIVLGGGMCFTFLAAQGFSVGKSLLETEMIETCRSLLDTYADVLRLPMDIVVTEKFVADSPPQTVAADAIPDGLMGLDIGPESVKRFATLLSNASTIFWNGPMGVFEFPAYAAGTRGVAEAIVAVTGKGAFSVVGGGDSAAAMRALSLPEGSVSHLSTGGGASLEYLEGKTLPGIEVLGREQPRGGDS

SEQ ID NO: 10484 - DNA, 1230 bp, Mycoplasma pneumoniae
  CDS (1)..(441)
atggttgactttaaaacagtccaagcgtttgactttcagggtaaaaccgtagtcttacgtgctgacctcaatgtgccgatgaaggacggggtcattaccgacaacgaacgcatactagctagcttagacacgattaagtacctcttgggtcacaattgcaaaattgtgttactgtcccatttgtcacgagtcaaatcgctcgatgacaaaaagggtaagaagtcactccaaccagtagctagtgctttacaaaatttattaaagaacaccaaggttcacttttgtccggaaaacacgggtgacaaggtcaaagtcgcagtcaatcaactcccattaggggaaattttggtgttggaaaacacgcgttactgtgatgtgaatgaggctggtgaagtggttaaacacgaaagcaagaataacgctgagttagcacagttctgagcatcattgggtgacatctttgtcaatgacgcctttggcaccgcccaccgccgtcacgcttccaacgctggcattgccaagtacatcaaaaactcctgcattggtcttttaatggagcgggaattgatcaacctctaccgcttaattaataacccacccaaaccgtttgtggttgtgttgggtggcgctaaggtttctgataagttacaggtagtaaataacctgttcaagattgcggatcatattttaataggtgggggcatggtcaacaccttcctcaaagctctgggtaacgaagttggcacttccttagtggaggaagacttagtccaaaccgccaagcaaatccttgacagtgacaaggacaagaaaattgtcttgggggtagaccaaatgcttcatgctagctttaaggatgaaccaggcgtggagtgtgttgtagccccccaatgaccagcagaacttcagggctttatgtccttggatgttggtagcaaaacagtggccctgtttagcagttacctcgccaaggccaaaacaatcttttggaatggtcccatgggcgtatttgaatttagcaactatgctcagggtaccttagcaattggtaaagcgattgcgcaaaaccaacaagcctttagtgtcattggcggtggtgattctgcagccgctgctaaacaactccagattgctgatcaatttagttttatttccactggtggtggtgcatctttagcactaataggtggggaagagctagtgggaattagcgatattcaaaaaaagtaa

SEQ ID NO: 10485 - protein, 146 aa, Mycoplasma pneumoniae
MVDFKTVQAFDFQGKTVVLRADLNVPMKDGVITDNERILASLDTIKYLLGHNCKIVLLSHLSRVKSLDDKKGKKSLQPVASALQNLLKNTKVHFCPENTGDKVKVAVNQLPLGEILVLENTRYCDVNEAGEVVKHESKNNAELAQF

SEQ ID NO: 10486 - DNA, 1722 bp, Nicotiana tabacum (common tobacco)
  CDS (52)..(1497)
gcacgaggctttttgccgtaagacagaaccgagaagagaagagtgtaaacaatggcatcagctacagcttcccacactttgtgcggcatccccgccacctcatcctctactaccaacaaggctattgccccttcatccgctcgcttcctcgccaaaactcctctccgccgcctcggcttcgctggcgccgccgctgattctctcttcaccaaccacgtggctaccaagctccgatccctcaagagctcctccaagcctattaggggcgttgcttctatggccaagaagagcgttggagacctcaccgctgccgagttgaagggcaagaaagtcttcgtcagggccgatttgaatgtcccacttgatgataaccagaacattactgatgacactagaattagagctgccgtccctactatcaagcacttgatggccaatggtgctaaagttattctctccagtcacctgggacggccaaaaggagtcactcctaaatacagcttggcaccactggtccccaggctatccgaactgcttggaatccaggttgtgaaggttgaggactgcattggtccagaagttgagaagttggttgcttcacttcccgagggtggtgttcttcttctcgagaacgtgagattctacaaggaggaagagaagaacgaacctgagtttgcaaagaaacttgcatcattggcagatctttatgtgaatgatgcattcggtacagctcacagagcacatgcctctacagagggagttactaaatttttgaagccttctgttgcaggtttcctcttacaaaaggaattggactatttagtcggggcggtttcaaatccaaagaggccatttgctgctattgtgggtggttcaaaggtttcatccaagattggagtgatcgaatcacttttagagaaatgtgatatattgcttttgggtggaggaatgatctttaccttctacaaggctcagggtctttcagttggttcctccttggttgaggaagacaaactagaactcgctacatcactcctagagaaggccaaggcgaaaggagtcagtctcttgttaccatctgatgttgtgattgcagataaatttgctcctgatgcaaacagcaagattgtgcctgcatctgctatcccagacggttggatggggttggacattggaccagactctgttaagactttcaacgatgccttggataccacaaaaacagtgatctggaatggacctatgggggtgtttgaatttgacaagtttgctgttggaacagaggcaattgcaaagaagctcgcggacttaagtgggaaaggagtgacgactatcattggaggtggagattctgttgcagctgttgagaaagttggagttgctagcgtgatgagccacatatccactggtggtggtgccagtttggagctactggaaggcaaggtgctccccggtgtcattgctcttgatgaagcagacgcccccgttgctgtgtaaaacaatttgtactaattcttttttctccggggtcaacataatcagtggtaatttccagttaggaagcattgagtcgatgttgtagatttgtcgggttatattgttatataatgtcctttttttaacccatattatttttgtctaaataaagggcgagtatatcagttatagatagctatccttttgatgtctttcaacaaactctatccttgatttggttcagtt

SEQ ID NO: 10487 - protein, 481 aa, Nicotiana tabacum (common tobacco)
MASATASHTLCGIPATSSSTTNKAIAPSSARFLAKTPLRRLGFAGAAADSLFTNHVATKLRSLKSSSKPIRGVASMAKKSVGDLTAAELKGKKVFVRADLNVPLDDNQNITDDTRIRAAVPTIKHLMANGAKVILSSHLGRPKGVTPKYSLAPLVPRLSELLGIQVVKVEDCIGPEVEKLVASLPEGGVLLLENVRFYKEEEKNEPEFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATSLLEKAKAKGVSLLLPSDVVIADKFAPDANSKIVPASAIPDGWMGLDIGPDSVKTFNDALDTTKTVIWNGPMGVFEFDKFAVGTEAIAKKLADLSGKGVTTIIGGGDSVAAVEKVGVASVMSHISTGGGASLELLEGKVLPGVIALDEADAPVAV

SEQ ID NO: 10488 - DNA, 1517 bp, Nicotiana tabacum (common tobacco)
  CDS (34)..(1239)
ggcacgagttccgacgtcaaaaactatagagaaatggcggtgaagaagagcgtgggatcactgaaagaagcagatctgaaggggaagagagtattcgtgagagttgatctgaacgttccattggatgaaaactttaacatcactgatgacaccagaatcagagccgctgtacctaccatcaagtacttgatgcaacacggttctcatgtcattcttgcctctcatcttggtcgccctaaaggtgttaccccaaagtacagcttaaagccgcttgtgcctagactttcagaactattgggagttgaggtcaagatagcaaatgattcaattggtccagaagttgagaaattggtcgctgaaataccggaaggaggagttctgctgctagagaatgtcagattctataaagaagaggagaagaatgagcccgaatttgccaagaaattggcatctcttgcagatttgtacgtcaatgatgcatttgggactgctcatagagcccatgcttccacagaaggggttgctaagtacttgaaaccagctgttgctggattccttatgcaaaaggaacttgactatttagttggagctgtggcaaatccccagaagccatttgctgcaattgttggtggttcaaaagtatcatctaagattggtgttatagagtctctcttggagaaggttgacgtgttattacttggcggaggaatgatctttactttctacaaggcgcaagggtacgctgttggatcatcactagtggaggaggacaagcttgatttggcaacatctctcatggagaaggcaaaggcaaaaggggtatctctattgcttcccactgatgtagtgattgccgacaagtttgctgctgatgcgaacagcaaggttgttccagcatctgaaattcctgatggctggatgggattagatattggacccgatgcaatcaagtcatttggcagcgccttggataccaccaagactgtcatttggaatggaccaatgggtgtgtttgagtttgacaagtttgctgctggaacagaggctattgcaaagaaactggcagagcttagtggaaagggagtgacaaccatcatagggggtggtgattctgtagctgcagttgagaaggtaggacttgcagagaagatgagccacatatcaactggagggggtgctagcttggagcttctcgaggggaaaccactccccggagtgcttgccctagatgatgcctgagcaatataatgctcatgcttttctccctttttttttgtgcacattttgttagctcttatgtctggattttagtccagagcggatttggatctatagagtcttgtaggttggtggataaaactgtaataagtattttctgggcctccattatgtgcactgctgcagttggcagggtactgaggcacttcctcttgtgacaagagaatcttccatggttgataacttgaaattactaatgaactatgtataagttatcaaatccttttattggattggag

SEQ ID NO: 10489 - protein, 401 aa, Nicotiana tabacum (common tobacco)
MAVKKSVGSLKEADLKGKRVFVRVDLNVPLDENFNITDDTRIRAAVPTIKYLMQHGSHVILASHLGRPKGVTPKYSLKPLVPRLSELLGVEVKIANDSIGPEVEKLVAEIPEGGVLLLENVRFYKEEEKNEPEFAKKLASLADLYVNDAFGTAHRAHASTEGVAKYLKPAVAGFLMQKELDYLVGAVANPQKPFAAIVGGSKVSSKIGVIESLLEKVDVLLLGGGMIFTFYKAQGYAVGSSLVEEDKLDLATSLMEKAKAKGVSLLLPTDVVIADKFAADANSKVVPASEIPDGWMGLDIGPDAIKSFGSALDTTKTVIWNGPMGVFEFDKFAAGTEAIAKKLAELSGKGVTTIIGGGDSVAAVEKVGLAEKMSHISTGGGASLELLEGKPLPGVLALDDA

SEQ ID NO: 10490 - DNA, 1730 bp, Solanum tuberosum (potato)
  CDS (209)..(1657)
atgattacgccaagcttggtaccgagctcggatccactagtaacggccgccagtgtggtggaattcggaaattaaacctcaaccccaaacgcaacgataagaaaaatccttttgacgcccatttccaacctcttgtattactacttataatacatctctctcttcgccactctctgtctgcggccacaaacacaaaagagaaagagatatggcatcagctactgcttcccacactttctgcggcattcccaccacatcatcatcctctaccaccaacaggtctaccacccattcctctgctcgcttcctcctcaaaactcctctccgccgcctcggtttcgccggcgctgtcgctgatcctctcttcaccaaccacgtcgcaacaaagctccgatctctcaaggcctcctccaaccctgttagggccgttgtctccatggccaagaagagcgttggagaccttagctcttccgatttgaagggcaagaaagtcttcgtcagggctgatttgaatgtcccacttgatgatgctcagaacattactgatgacactaggattagagctgccatccctaccatcaaacacttgattgccaatggggctaaagttattctctccagtcacttgggaaggccaaagggagtcactcctaaatacagcttagcaccgcttgtccccaggctatctgaactacttggaatccaggttgtaaaggctgatgattgcattggtccagaagttgagaagttggttgattcacttccagagggcggcgttcttcttcttgagaatgtaagattctacaaggaggaagagaagaacgaacctgagtttgcaaagaaacttgcatcattggcagatctttttgtgaatgatgcctttggtacagctcacagagcacatgcctctacggagggagttactaaatttttgaagccttctgttgcaggtttccttttacaaaaggaattggactatttagttggggcagtttcaactccaaagaggccatttgctgctattgtgggtggttcaaaggtttcatccaagattggagtgattgaatcacttctggagaaatgtgatatattgcttttgggtggaggaatgatctttaccttctacaaggctcagggtctttcagttggttcctccttggttgaggaagacaaactagagcttgcaacatcactcctggaaaaggccaaggcaaaaggagtcagtctcttgttaccatctgatgttgtgattgcagataaatttgctcctgatgccaacagcaagattgtgccggcatctgctatcccagatggttggatggggctagacattggacctgactctatcaagactttcaacgatgctttggataccacaaaaacagtgatctggaatggacctatgggggtgtttgaatttgacaagtttgctactggaacggaggcaattgcaaagaagctagcagacttaagtgggaaaggagtgaccactatcattggaggtggagactctgttgcagcggttgagaaagttggagtggctagcgtgatgagccacatatccactggtggtggtgccagtttggagctacttgaaggaaaggtgctccctggtgtcatagctctagatgaagctgacgcccctgttgcagtgtaaaacaatttgtactaaattcttttttcggtcaacttaacttaatcagttgggaaacattgagttgatgttgtag

SEQ ID NO: 10491 - protein, 482 aa, Solanum tuberosum (potato)
MASATASHTFCGIPTTSSSSTTNRSTTHSSARFLLKTPLRRLGFAGAVADPLFTNHVATKLRSLKASSNPVRAVVSMAKKSVGDLSSSDLKGKKVFVRADLNVPLDDAQNITDDTRIRAAIPTIKHLIANGAKVILSSHLGRPKGVTPKYSLAPLVPRLSELLGIQVVKADDCIGPEVEKLVDSLPEGGVLLLENVRFYKEEEKNEPEFAKKLASLADLFVNDAFGTAHRAHASTEGVTKFLKPSVAGFLLQKELDYLVGAVSTPKRPFAAIVGGSKVSSKIGVIESLLEKCDILLLGGGMIFTFYKAQGLSVGSSLVEEDKLELATSLLEKAKAKGVSLLLPSDVVIADKFAPDANSKIVPASAIPDGWMGLDIGPDSIKTFNDALDTTKTVIWNGPMGVFEFDKFATGTEAIAKKLADLSGKGVTTIIGGGDSVAAVEKVGVASVMSHISTGGGASLELLEGKVLPGVIALDEADAPVAV

SEQ ID NO: 10492 - DNA, 1778 bp, Chlamydomonas reinhardtii
  CDS (7)..(1392)
ccaatcatggccctctctatgaagatgcgcgccaacgcgcgcgtgtccggtcgccgcgtcgccgctgtggccccccgcgtggtgcccttctcgtcggcctccagctccgtgctgcgctctggcttcgcgctgaggtgtctgtggacatccgccgcgtgggccgctctcgcatccgtcgtcgaggcggtgaagaagtcggttggcgacctgcacaaggctgacctggagggcaagcgcgtgttcgtccgcgcggacctgaacgtgcctcttgacaaggccaccctggccatcaccgacgacacccgcattcgcgcggccgtccccaccctgaagtacctgctggacaacggtgctaaggtcctgctgacctcgcacctgggtcgcccgaagggcggtcccgaggacaagtaccgcctgacccccgtggtggcccgcctgtcggagctgctgggcaagcccgtgaccaaggtcgatgactgcatcggccccgaggtggagaaggcggtgggcgccatgaagaacggcgagctgctgctgctggagaactgccgcttctacaaggaggaggagaagaacgagcccgagttcgccaagaagctggccgccaacgccgacctgtacgtgaacgacgcgttcggcactgcccaccgcgcccacgcctccaccgagggtgtgaccaagttcctgaagccctccgtggccggcttcctgctgcagaaggagctggactaccttgatggcgccgtgtccaaccccaagcgccccttcgtggccattgtgggcggctccaaggtgtcctccaagatcaccgtcattgaggcgctgatggagaagtgcgacaagatcatcatcggcggtggcatgatcttcaccttctacaaggcccgcgcgctgaaggtgggctcctcgctggttgaggacgacaagatcgagctggccaagaagctggaggagatggccaaggccaagggtgtgcagctgctgctgcccaccgacgtggtggtggccgacaagttcgacgccaacgccaacacccagaccgtgcccatcaccgccatccccgatggctggatgggtctggacattggcccggactccgtcaagaccttcaacgacgccctggccgacgccaagaccgttgtgtggaacggccccatgggtgtgttcgagtttccccaagttcgccaacgcaccgtgtcgatcgccaacaccctggccggcctgacgcccaagggctgcatcaccatcattggtggcggtgactccgtggctgccgtcgagcaggccggcgttgccgagaagatgagccacatctccaccggcggcggtgcctccctggagctgctggagggcaaggtcctgcccggcgtggccgccctggacgagaagtaaattgctcgcaattgaataagaacagttgccgtgtagtttacgtgtggacagaggttgagatggctctcgggtctggttgttcgggagttgcggagtgtgtttcgggttgttggttttggtcatgacgacttgagtgattgcagaaaggggagtgttccggatccgggggcctcttgtatggggtcatgatttggtgccgacagcgaaacgctgggagccctgggcgtctgggccccggtgctgaatgcgggctgacgccgggggagtgaaagaactcctttaaccgagcgtatcgtgtacatgagagaagagacaagagctttcgctgaggcactctggctccgtagcagggatttgcgctccctgagttttcacggattgccggg

SEQ ID NO: 10493 - protein, 461 aa, Chlamydomonas reinhardtii
MALSMKMRANARVSGRRVAAVAPRVVPFSSASSSVLRSGFALRCLWTSAAWAALASVVEAVKKSVGDLHKADLEGKRVFVRADLNVPLDKATLAITDDTRIRAAVPTLKYLLDNGAKVLLTSHLGRPKGGPEDKYRLTPVVARLSELLGKPVTKVDDCIGPEVEKAVGAMKNGELLLLENCRFYKEEEKNEPEFAKKLAANADLYVNDAFGTAHRAHASTEGVTKFLKPSVAGFLLQKELDYLDGAVSNPKRPFVAIVGGSKVSSKITVIEALMEKCDKIIIGGGMIFTFYKARALKVGSSLVEDDKIELAKKLEEMAKAKGVQLLLPTDVVVADKFDANANTQTVPITAIPDGWMGLDIGPDSVKTFNDALADAKTVVWNGPMGVFEFPQVRQRTVSIANTLAGLTPKGCITIIGGGDSVAAVEQAGVAEKMSHISTGGGASLELLEGKVLPGVAALDEK

SEQ ID NO: 10494 - DNA, 1254 bp, Caenorhabditis elegans
  CDS (1)..(1254)
atgagctccctcaacaagttggctatcgaccagttgaacctcgccggaaagcgagttttgatccgtgttgacttcaatgtcccactcaaggatggcaaaatcaccaacaatcaacgtattgctgccgctgttccaaccattcagcatgctcttagcaacggagccaaatctgtcgttttaatgtcacatttgggacgtccagatggcagacgccaagacaagtacaccttgaaaccagttgctgaagagttgaaggctctcttgaaaaaagatgttctcttcctcgacgactgtgtcggatcagaagtggaggctgcatgcgccgatccagctcctggatcagtcattctccttgaaaatcttcgttatcatctggaagaggagggcaaaggagtcgatgcatccggtgccaaggttaaggctgattcagcagccgtaaagaaattccgcgagtctctcaccaagcttggcgatatttatgtcaatgatgctttcggaaccgctcacagagcccatagctccatggttggagtcgagcactcacaacgtgcaagtggattcttgctcaagaacgagctctcctactttagcaaggccctcgacaacccagctcgtccattcctggccatccttggaggagctaaggtcgctgacaagattcagttgatcaagaacttgttagacaaggttaatgagatgatcatcggcggaggaatggcctataccttcttgaaagttgcccagggagtcaagatcggaaactctttgtacgacgaagaaggagcgaaaattgtgaacgagcttcttgaggctgccaaggcaaagggagttcaaatccatctcccagtggatttcgtcattgctgacaagttcgccgaggacgcaacctcgaagaccgtcaccgccgaggaaggtgttccagatggccacatgggacttgatgttgggccggaatcttctaagatcttcgccgctgccattcaacgcgccaaaacgattgtctggaacggtccagcaggagtattcgagtttgataaattcgccacaggcaccaagtcattgatggatgaagttgtcaaggccaccgctgccggagccatcacaatcattggaggaggtgacactgcgaccgccgccaagaagtataacacggaagataaggtgtctcacgtctcaactggaggtggagccagtttggaattgctcgaaggaaaagttctgccaggagttgatgctctttcgccagctcaataa

SEQ ID NO: 10495 - protein, 417 aa, Caenorhabditis elegans
MSSLNKLAIDQLNLAGKRVLIRVDFNVPLKDGKITNNQRIAAAVPTIQHALSNGAKSVVLMSHLGRPDGRRQDKYTLKPVAEELKALLKKDVLFLDDCVGSEVEAACADPAPGSVILLENLRYHLEEEGKGVDASGAKVKADSAAVKKFRESLTKLGDIYVNDAFGTAHRAHSSMVGVEHSQRASGFLLKNELSYFSKALDNPARPFLAILGGAKVADKIQLIKNLLDKVNEMIIGGGMAYTFLKVAQGVKIGNSLYDEEGAKIVNELLEAAKAKGVQIHLPVDFVIADKFAEDATSKTVTAEEGVPDGHMGLDVGPESSKIFAAAIQRAKTIVWNGPAGVFEFDKFATGTKSLMDEVVKATAAGAITIIGGGDTATAAKKYNTEDKVSHVSTGGGASLELLEGKVLPGVDALSPAQ

SEQ ID NO: 10496 - DNA, 1212 bp, Streptomyces coelicolor
  CDS (1)..(1212)
atgaagacgatcgacgaactgctctccgaaggcgtcgcgggcaagcgcgtcttcgtccgcgccgacctgaacgtcccgctggacggcaccaccatcaccgacgacggccgcatccgcgcggtagtgcccaccgtcaaggcgctggccgacgcgggcgcccgcgtgatcgtcgcctcgcacctgggccgccccaagggcgccccggaccccgccttctccctcgccccggccgccgcccgcctcggtgagctgctcggcgccgacgtcgccttcgccgaggacacggtcggcagctccgccgaggccgtcgttaccggcctcgccgacggtggtgtcgccgtcatcgagaacctgcgcttcaacgccggcgagaccagcaaggacgacgccgagcgcgccgccttcgccgacaagctggccggcctcgcggacgtctacgtcggcgacggcttcggcgcggtgcaccggaagcacgcgtccgtcttcgacctgccgaagcggctcccgcactatgccggatacctcatcgccaccgaggtcggcgtgctcaagaagctcaccgacgaggtgaagcgcccgtacgtggtcgcgctcggcggcgccaaggtctccgacaagctcgccgtcatcgaccagctgctcggcaaggccgaccggctgctcatcggcggaggcatggcgtacaccttcctcaaggccaaggggtacgaggtcggcatctcgctgctccaggaggaccagatcccggcggtcaaggagtacatcgagcgcgccgagaagaacggcgtcgagctggtgctgcccgtcgacgtcctggtcgcgcccgagttcccggacctgaagacgaaggccccggccaaccccaccaccgtcgccgcggacgccatcccggccgaccaggagggtctggacatcggtcccgagacccgcaagctgtacgcatcgaagctcgccgacgccggcaccgtcttctggaacggtcccatgggcgtcttcgagcaccccgactacgccgagggcaccaaagcggtcgcccaggccctcgtcgacgccccgggcttcaccgtggtcggcggcggcgactccgccgcggccgtgcgcacgctcggcttcgacgagaacgcattcggccacatctcgaccggcggcggcgcctccctcgaatacctcgagggcaagacgctccccggcctcgccgcactggaggactga

SEQ ID NO: 10497 - protein, 403 aa, Streptomyces coelicolor
MKTIDELLSEGVAGKRVFVRADLNVPLDGTTITDDGRIRAVVPTVKALADAGARVIVASHLGRPKGAPDPAFSLAPAAARLGELLGADVAFAEDTVGSSAEAVVTGLADGGVAVIENLRFNAGETSKDDAERAAFADKLAGLADVYVGDGFGAVHRKHASVFDLPKRLPHYAGYLIATEVGVLKKLTDEVKRPYVVALGGAKVSDKLAVIDQLLGKADRLLIGGGMAYTFLKAKGYEVGISLLQEDQIPAVKEYIERAEKNGVELVLPVDVLVAPEFPDLKTKAPANPTTVAADAIPADQEGLDIGPETRKLYASKLADAGTVFWNGPMGVFEHPDYAEGTKAVAQALVDAPGFTVVGGGDSAAAVRTLGFDENAFGHISTGGGASLEYLEGKTLPGLAALED

SEQ ID NO: 10498 - DNA, 1245 bp, Schizosaccharomyces pombe
  CDS (1)..(1245)
atgtctttgtctactaagctcgctatcaccgacgtcgacttgaagggcaagaacgtcttgatccgtgtcgacttcaacgtccctttggacggtgaccgtatcaccaacaatgcccgtatcgttggtgctctccccaccatcaagtacgctcttgagcaacaacccaaggctgtcatcttgatgtctcacttgggccgtcccaacggtgctcgtgttgccaagtactccttgaagcctgttgctgctgagctcagcaagcttttgggcaagcccgtcaagttccttgacgactgtgttggccctgaggtcgaaaaggcctgcaaggaagccaagggtggtgaggtcatccttttggagaacttgcgtttccacatcgaggaggagggttccgccaaggttgacggtaagaaggttaaggctgacgcttctgccgtcgaggctttccgtaagtctttgacttctctcggtgacatctttgtcaacgatgctttcggtaccgctcaccgtgctcactcctctatggtcggtgtcgatctcccccgtgtctccggtttccttatgaagaaggagctcgactacttctccaaggctttggagaaccccgctcgtcccttccttgccatcttgggtggtgccaaggttgctgacaagatccaacttattgacaaccttcttgacaaggtcaaccgccttatcatctgcggtggtatggctttcaccttcttgaaggtccttaacggtatgaagattggtgactctcttttcgatgaggctggttccaagaacgtcgaatccatgatggccaaggccaagaagaacaacgtcgaggtcttcctccccgttgacttcgtcactgccgacaagttcgacaaggacgccaaggttggctctgccaccgccgaggagggtatccccgacggatggatgggtttggactgtggacccaagtcctctgctaagtttgccgaggttatcaccacctccaagaccattgtctggaatggtcccgctggtgtctttgagtttgacaactttgccaagggtaccaagtctatgcttgatgcttgtgtcaagacctgtgaagctggtaacgttgttattgttggtggtggtgacactgctactgttgccaagaagtacggtaaggaggatgctctttcccacgtctctaccggtggtggtgcttctcttgaactcttggagggtaaggctcttcccggtgtcgttgctctttcttccaagtaa

SEQ ID NO: 10499 - protein, 414 aa, Schizosaccharomyces pombe
MSLSTKLAITDVDLKGKNVLIRVDFNVPLDGDRITNNARIVGALPTIKYALEQQPKAVILMSHLGRPNGARVAKYSLKPVAAELSKLLGKPVKFLDDCVGPEVEKACKEAKGGEVILLENLRFHIEEEGSAKVDGKKVKADASAVEAFRKSLTSLGDIFVNDAFGTAHRAHSSMVGVDLPRVSGFLMKKELDYFSKALENPARPFLAILGGAKVADKIQLIDNLLDKVNRLIICGGMAFTFLKVLNGMKIGDSLFDEAGSKNVESMMAKAKKNNVEVFLPVDFVTADKFDKDAKVGSATAEEGIPDGWMGLDCGPKSSAKFAEVITTSKTIVWNGPAGVFEFDNFAKGTKSMLDACVKTCEAGNVVIVGGGDTATVAKKYGKEDALSHVSTGGGASLELLEGKALPGVVALSSK

SEQ ID NO: 10500 - DNA, 1533 bp, Crithidia fasciculata
  CDS (139)..(1506)
aattattactctctcatcagaggaccgcaacttgttataccctcaagtcgagtctctccacctgtcaccgtcaattattagcttgcccgcaacctgcattctttcttttctctcgcacaacacccgaagacttcacaaatgtctctcgttccgaagaagagcatcgatgatgccgtggtgaagggcaagaaggtcctcatccgtgtggacttcaacgtgccggtgaagaacggcgagatcacgaacgacttccgcatccgctccgccctgccgacgatccagaaggtgctgaaggagggcggctcctgcatcctgatgagccacctcggccgcccgaagggtgcgaagatgagcgacccgaagccggccaagagcgtgcgcgggtacgaggaggctgcgacgctgcggccggtggctgcgcggctgtcggagctgctggggcagaaggtggagttcgcgccggactgcctggacgctgcgtcgtacgctgctaagctgaagggcggcgacgtgctgctgctggagaacgtgcgcttctacgcggaggagggcagcaagaaggaggaggagcgcgacgcgatggcgaaggtgcttgcggcgtacggcgacgtgtacgtgagcgacgccttcggcactgcgcaccgcgacagcgcggacatgacgggcatcccgaaggtgctgggtgcgggctacgccggctacctgatggagaaggagatcaactacttcgcgcaggtgctgaacaacccgccgcgtccgctggtggccatcgtgggcggtgcgaaggttagcgacaagatccagctgctggacaacatgctgggccgcatcaactacctggtgattggcggcgcgatggcgtacacgttccagaaggcgcagggccacgcgatcggcatctcgatgtgcgaggaggacaagctggaccttgccaagtcgctgctgaagaaggcgcaggagcgcaacgtggaggtgcttctgccggtggaccacgtgtgcaacaaggagttccaaggcgtggacgcgccgctggtgacgaaggacgtggagatcccggaggggtacatggcgctggacattggcccgaagacgatcaagatctacgaggacgtgattgccaagtgcaagagcacgatctggaacggcccgatgggtgtgttcgagatgccgtgctactcgaagggcacgttcgctgtggccaaggcgatgggcaacgggacgcagaagaacgggctgatgagcatcatcggcggcggcgacacggcgagcgctgcggagctgagcggggaggcgaagaacatgtcgcacgtgtcgactggcggcggtgcctcgctggagctgctggagggcaagtcgctgccgggcgtcaccgttctcaccaacaaggacgcgaaggcgcctgctgctgctgccgctgccggtggtgactgcccgtgcggttccggctgcgctgcggttcccgccgcagccacggcaacggtttcgatggtgctcgcctcgccatgaagattctgaagctgctcgccgcggtgc

SEQ ID NO: 10501 - protein, 455 aa, Crithidia fasciculata
MSLVPKKSIDDAVVKGKKVLIRVDFNVPVKNGEITNDFRIRSALPTIQKVLKEGGSCILMSHLGRPKGAKMSDPKPAKSVRGYEEAATLRPVAARLSELLGQKVEFAPDCLDAASYAAKLKGGDVLLLENVRFYAEEGSKKEEERDAMAKVLAAYGDVYVSDAFGTAHRDSADMTGIPKVLGAGYAGYLMEKEINYFAQVLNNPPRPLVAIVGGAKVSDKIQLLDNMLGRINYLVIGGAMAYTFQKAQGHAIGISMCEEDKLDLAKSLLKKAQERNVEVLLPVDHVCNKEFQGVDAPLVTKDVEIPEGYMALDIGPKTIKIYEDVIAKCKSTIWNGPMGVFEMPCYSKGTFAVAKAMGNGTQKNGLMSIIGGGDTASAAELSGEAKNMSHVSTGGGASLELLEGKSLPGVTVLTNKDAKAPAAAAAAGGDCPCGSGCAAVPAAATATVSMVLASP

SEQ ID NO: 10502 - DNA, 1248 bp, Penicillium chrysogenum
  CDS (1)..(1248)
atgtctctctccaacaagctccccgttactgatgtcgacctcaagggcaagcgtgtcttgatccgggttgacttcaatgtccccctcgatgagaacgagaacgttaccaacccccagcgtatcgtcggtgccctgcccaccatcaagtatgccatcgacaacggtcgcaaggccgttgtgctcatgtcccacctgggtcgccccgatggcaaggtcaaccccaagtacagcttgaagcccgttgttcccgtgcttgaggagctcctcggcaagagcgtcactttcaccgaggactgcattggcccccagaccgaggagaccgtgaacaaggcttccgatggccaggtcattctgctcgagaacctgcgtttccacgccgaggaggagggcagctccaaggatgccgagggcaagaaggtcaaggccgacaaggccgatgttgatcgttccgcaagcctcactgccctcggtgacgtttacgtcaacgatgctttcggtaccgcacagcgcgctcacagctccatggtcggcgtggacctcccccagaaggctgccggtttcctcgtgaagaaggagctggagtacttcgccaaggctcttgagagccctgcccgccccttcctcgccatcctcggcggtgctaaggtgtctgacaagattccagtgattgacaacctcctgcccaaggtcaacagcctcatcatcatcggcggcatggctttgaccttcaagaagactcttgagaacgtcaagatcggcaacagtctcttcgacgaggccggcagcaagatcctcggcgagatcgtcgagaaggccaagaagcacaacgtcgagatcgttctccccgttgactacgtcaccgccgacaagttctccgccgatgccaccgttgggtccgccacgacgcagcgtatccctgacggctacatgggttcggatgtcggccccgagagtgtcaagctctaccagaagaccatcgccgaggccaagaccatcctctggaacggtccccctggtgtcttcgaactcaagccttcgccaaggcccaccgaggctaccctcgatgccgctgtcaaggctgctgaatccggttccattgtcatcattggtggtggtgataccgctaccgtggccgccaagtacaaggccgaggacaagatctcccacgtctcgaccggtggcggtgcctcgctcgagcttctcgagggcaaggagctgcccggtgttgctgctctgtccagtaagtaa

SEQ ID NO: 10503 - protein, 415 aa, Penicillium chrysogenum
MSLSNKLPVTDVDLKGKRVLIRVDFNVPLDENENVTNPQRIVGALPTIKYAIDNGRKAVVLMSHLGRPDGKVNPKYSLKPVVPVLEELLGKSVTFTEDCIGPQTEETVNKASDGQVILLENLRFHAEEEGSSKDAEGKKVKADKADVDRSASLTALGDVYVNDAFGTAQRAHSSMVGVDLPQKAAGFLVKKELEYFAKALESPARPFLAILGGAKVSDKIPVIDNLLPKVNSLIIIGGMALTFKKTLENVKIGNSLFDEAGSKILGEIVEKAKKHNVEIVLPVDYVTADKFSADATVGSATTQRIPDGYMGSDVGPESVKLYQKTIAEAKTILWNGPPGVFELKPSPRPTEATLDAAVKAAESGSIVIIGGGDTATVAAKYKAEDKISHVSTGGGASLELLEGKELPGVAALSSK

SEQ ID NO: 10504 - DNA, 1251 bp, Trichoderma reesei
  CDS (1)..(1251)
atgtctctgtctaacaagctgtccatcaccgatgtcgacctcaagggcaagagggtcctgattcgggtcgacttcaacgtccccctcgacgagaacaagaaaatcacaaacaaccagcgcatcgtcggcgccatcccgaccatcaagcacgccctcgacaatggcgccaaggccgtcgtcctcatgtcccacctcggccgccccaacggcgccgtcaaccccaagtactccctcaagcccgtcgtccccgagctcgagcgcctgctgggcaagcccgtcacctttgcccgcgactgcgtcggccccgaggtcgagtccattgtcaacgacgccgacaacggtgccgtcatcctgctggagaacctccgcttccacattgaggaggagggcagcgccaaggacaaggacggcaacaagaccaaggctgacaaggccaaggttgaggagttccgcaagggcctgactgctctgggcgacatctacatcaacgatgctttcggcactgcccaccgtgctcactcttccatggtcggcgttgacctgccccaaaaggccgctggcttcctcatgaagaaggagctcgactacttcgccaaggccctcgagtctcctcagcgccccttcctcgccatcctcggcggcgccaaggtctctgacaagatccagctcatcgacaacctgctcgacaaggtcgacaccctcattgtctgcggcggcatggccttcaccttcaagaaggtcctcaacaacatccccatcggcacctccctcttcgacgaggccggcgccaagacgtgccccagctgtcgagaagccaaggccaagaacgtcaagctggtcctgcccgtcgactacatcaccgccgacaagttcgacaaggacgccaacaccggcaccgccaccgacgagagcggcatccccgacggctggatgggcctcgactgcggcgagaagtcgattgagctgtacaaggaggccattgccgacgccaagaccatcctctggaacggccccgccggcgtctttgagtttgacaagttcgccaacggcaccaaggccacgctcgacgccgtcgtcgagggctgcaagaacggcaagattgtcattatcggcggtggtgacacggccaccgttgccgccaagtacggcgtcgaggacaagctgagccacgtctccaccggcggtggtgccagcttggagctgctggagggcaaggagctgcctggtgttgttgctctgtctagtaagtaa

SEQ ID NO: 10505 - protein, 416 aa, Trichoderma reesei
MSLSNKLSITDVDLKGKRVLIRVDFNVPLDENKKITNNQRIVGAIPTIKHALDNGAKAVVLMSHLGRPNGAVNPKYSLKPVVPELERLLGKPVTFARDCVGPEVESIVNDADNGAVILLENLRFHIEEEGSAKDKDGNKTKADKAKVEEFRKGLTALGDIYINDAFGTAHRAHSSMVGVDLPQKAAGFLMKKELDYFAKALESPQRPFLAILGGAKVSDKIQLIDNLLDKVDTLIVCGGMAFTFKKVLNNIPIGTSLFDEAGAKTCPSCREAKAKNVKLVLPVDYITADKFDKDANTGTATDESGIPDGWMGLDCGEKSIELYKEAIADAKTILWNGPAGVFEFDKFANGTKATLDAVVEGCKNGKIVIIGGGDTATVAAKYGVEDKLSHVSTGGGASLELLEGKELPGVVALSSK

SEQ ID NO: 10506 - DNA, 1271 bp, Thermus aquaticus
  CDS (28)..(1200)
gagctcgtcctgaagaagggggtctagatgcggacccttttggacctggaccccaagggcaagcgggtcctggtgcgggtggactacaacgtccccgtccaagacgggaaggtccaggacgagacccggatcctggaaagcctccccaccctccgccacctcctcgccgggggggcttccctcgtcctcctctcccacctgggccgccccaagggcccggaccccaagtactccctggccccggtgggggaggccttgagggcccacctcccagaggcccgcttcgcccccttccctccgggctcggaggaggcgaggcgggaggcggaggccctgaggcccggggaggtcctcctcctggagaacgtccgctttgagccgggagaggagaagaacgaccccgagctttccgcccgctacgccaggctcggggaggccttcgtcctggacgccttcgggagcgcccaccgggcccacgccagcgtggtgggggtggcgaggctcctccccgcctacgccggcttcctcatggagaaggaggtgagggccctttcccgcctcctcaaggacccggaaaggccctacgccgtggtgctgggcggggccaaggtctcggacaagatcggggtcattgagagcctccttccccgcatagaccgcctcctcattggcggggccatggccttcaccttcctcaaggccctagggggagaggtggggaggagcctggtggaggaggaccggctggacctggccaaggacctcttggggcgggccgaggccttgggggtcagggtctacctccccgaagacgtggtggcggcggagcgcatagaggcgggggtggagacccgggtcttcccggcccgggccatccccgtcccctacatgggcctggacatcggccccaagacccgggaggccttcgcccgggccctggaaggggcgaggacggtcttctggaacgggcccatgggggtctttgaggtgcctccctttgacgaggggaccttggccgtggggcaggccatcgccgccctcgagggcgccttcaccgtggtgggcgggggcgactcggtggcggcggtgaaccgcctgggccttaaagagcgcttcggccacgtctccaccgggggcggggcgagcctggagttcctggaaaagggcaccctgcccggcctcgaggtcctggaaggctaaggcgcgggcgtttagaatgggcctggggcgtggagccccaggccatggcttacggcaaggcccacctcgag

SEQ ID NO: 10507 - protein, 390 aa, Thermus aquaticus
MRTLLDLDPKGKRVLVRVDYNVPVQDGKVQDETRILESLPTLRHLLAGGASLVLLSHLGRPKGPDPKYSLAPVGEALRAHLPEARFAPFPPGSEEARREAEALRPGEVLLLENVRFEPGEEKNDPELSARYARLGEAFVLDAFGSAHRAHASVVGVARLLPAYAGFLMEKEVRALSRLLKDPERPYAVVLGGAKVSDKIGVIESLLPRIDRLLIGGAMAFTFLKALGGEVGRSLVEEDRLDLAKDLLGRAEALGVRVYLPEDVVAAERIEAGVETRVFPARAIPVPYMGLDIGPKTREAFARALEGARTVFWNGPMGVFEVPPFDEGTLAVGQAIAALEGAFTVVGGGDSVAAVNRLGLKERFGHVSTGGGASLEFLEKGTLPGLEVLEG

SEQ ID NO: 10508 - DNA, 1527 bp, Trypanosoma brucei
  CDS (1)..(1527)
atgtccactgcaccgaatgcgaagaacaacataagcctgaagaagtctgtgggcgatgtttttcggttaacggcgaagcgagtgcttatgcgtgtcgatttcaacgttcctatgcaaaatggccatattactaacgattatcgaatccgtgcggcgattccaacgatacggcgggttattgatcagggtggtatttgtattctcctgagccatcttggacggcccagaggcgtttcaatggttgcgggtgtgcgagatataagacggcgatatcacgaggctcagtttcacgacaacaaaggtaaaacagcgttttttagtgttctaccgggagaggagaaagttaaaatattagcgaaatccagtgcacgggaagaggcaacgcacatatcacctgaggtgaaatctggaaaaacaatgctgtttgcgcgccttcctgaggacgagaagaaatctttgcttatgcagtacttaaacgaaaacaaagacagtgcgttaccgcagatgagtgttagtgcaggctacgaagagcaatacagtcttcgtccagttgctgtaaggcttgccgaattactcggccaacatgtatattttgctcacgactgcttggatgccagagtagaggtttcgcggttaaagcgtggaaatgttatgttacttgaaaatgtacggttctacagcgaagaaaacggtgaaaatgctgaggaacgtgaagccatggccaagatccttgcgtcatatggtgatgtttacatcagtgatgcttttggtgcagctcaccgtgacagtgctaccatgaccggaattccaaagattttgggtcacggtgctgccggttatttgatggagaaggagatttcatacttcgctaaggtacttggtaacccgccgcgtccgctggttgctatcgttggtggagcgaaagtgagcgaaaagatccaacttctggataacatgttgcagcgcatcgattatctcttaattggtggtgcaatggcatacacatttctgaaggctcagggttacagcattggaaaatcgaagtgcgaggaaagtaaacttgaatttgctcgatccctgctgaagaaggcggaggaccgcaaggtgcagattattcttccaattgatcatgtttgccacacggaattcaaagctgtggattctccattgataactgaggatcaaaacatccctgaaggacatatggctctggatattggtcccaagactattgaaaaatatgttcagacgattgggaagtgtaagagcgccatttggaacggtcccatgggtgtatttgaaatggttccttattccaaaggtacatttgcaattgcgaaagccatgggtcgaggaactcagaaacgtggactcatgagtatcatcggtggtggtgagagtgcgggtgcggctgaactctgtggtaagctcagtatttctcatgtttcaactggtggtggtgcgtctttggaactcctcgagggcaaaacgcttcccggtgttgcagtattggatgataaggagtaa

SEQ ID NO: 10509 - protein, 508 aa, Trypanosoma brucei
MSTAPNAKNNISLKKSVGDVFRLTAKRVLMRVDFNVPMQNGHITNDYRIRAAIPTIRRVIDQGGICILLSHLGRPRGVSMVAGVRDIRRRYHEAQFHDNKGKTAFFSVLPGEEKVKILAKSSAREEATHISPEVKSGKTMLFARLPEDEKKSLLMQYLNENKDSALPQMSVSAGYEEQYSLRPVAVRLAELLGQHVYFAHDCLDARVEVSRLKRGNVMLLENVRFYSEENGENAEEREAMAKILASYGDVYISDAFGAAHRDSATMTGIPKILGHGAAGYLMEKEISYFAKVLGNPPRPLVAIVGGAKVSEKIQLLDNMLQRIDYLLIGGAMAYTFLKAQGYSIGKSKCEESKLEFARSLLKKAEDRKVQIILPIDHVCHTEFKAVDSPLITEDQNIPEGHMALDIGPKTIEKYVQTIGKCKSAIWNGPMGVFEMVPYSKGTFAIAKAMGRGTQKRGLMSIIGGGESAGAAELCGKLSISHVSTGGGASLELLEGKTLPGVAVLDDKE

SEQ ID NO: 10510 - DNA, 1263 bp, Trypanosoma brucei
  CDS (1)..(1263)
atgtcactaaaagagaggaagagcattaatgaatgcgatcttaagggaaagaaggttcttatccgtgttgactttaatgttcctctggatgatggtaatattaccaacgactaccgaatccgatcagctcttccagccgtccaaaaagttctcacagaaggcggcagttgtgttctcatgagccacctcgggaggccgaaaggcgtttctatggctgaaggcaaagaactgcggagcactggcggtattcccgggttcgagcagaaggcaacactcaaaccggtagccaaggccctcagcgaattgttatcgagacccgtcacattcgcacctgactgtctgaacgctgcagatgtcgtctctaagatgtctccgggcgatgttgttctgcttgaaaatgtacgcttctacaaagaagagggcagcaagagcactgaggaacgtgaagccatggccaagatccttgcgtcatatggtgatgtttacatcagtgatgcttttggtacagctcaccgtgacagtgctaccatgaccggaattccaaagattttgggtcacggtgctgccggttatttgatggagaaggagatttcatacttcgctaaggtacttggtaacccgccgcgtccgctggttgctatcgttggtggagcgaaagtgagcgacaagatccaacttctggataacatgttgcagcgcatcgattatctcttaattggtggtgcaatggcatacacatttctgaaggctcagggttacagcattggaatatccatgtgcgaggaaagtaaacttgaatttgctcgatccctgctgaagaaggcggaggaccgcaaggtgcaggttattcttccaattgatcatgtttgccacacggaattcaaagctgtggattctccattgataactgaggatcaaaacatccctgaaggacatatggctctggatattggtcccaagactattgaaaaatatgttcagacgattgggaagtgtaagagcgccatttggaacggtcccatgggtgtatttgaaatggttccttattccaaaggtacatttgcaattgcgaaagccatgggtcgaggaactcacgagcatggactcatgagtatcatcggtggtggtgagagtgcgggtgcggctgaactctgtggtgaagctgcacgtatttctcatgtttcaactggtggtggtgcgtctttggaactcctcgagggcaaaacgcttcccggcgttacagtattggacgaaaaggagtaa

SEQ ID NO: 10511 - protein, 420 aa, Trypanosoma brucei
MSLKERKSINECDLKGKKVLIRVDFNVPLDDGNITNDYRIRSALPAVQKVLTEGGSCVLMSHLGRPKGVSMAEGKELRSTGGIPGFEQKATLKPVAKALSELLSRPVTFAPDCLNAADVVSKMSPGDVVLLENVRFYKEEGSKSTEEREAMAKILASYGDVYISDAFGTAHRDSATMTGIPKILGHGAAGYLMEKEISYFAKVLGNPPRPLVAIVGGAKVSDKIQLLDNMLQRIDYLLIGGAMAYTFLKAQGYSIGISMCEESKLEFARSLLKKAEDRKVQVILPIDHVCHTEFKAVDSPLITEDQNIPEGHMALDIGPKTIEKYVQTIGKCKSAIWNGPMGVFEMVPYSKGTFAIAKAMGRGTHEHGLMSIIGGGESAGAAELCGEAARISHVSTGGGASLELLEGKTLPGVTVLDEKE

SEQ ID NO: 10512 - DNA, 1323 bp, Trypanosoma brucei
  CDS (1)..(1323)
atgacccttaacgagaagaagagcattaatgaatgcgatcttaagggaaagaaggttcttatccgtgttgactttaatgttcccgtgaaaaacggtaagatcaccaacgactaccgaatccgatcagctctgccaacgctcaagaaggttctcacagaaggcggcagttgtgttctcatgagccacctcgggaggccgaaaggtattcccatggcgcaagctgacaaaatacggagcactggcggtgttcccgggttccaacagaaggcaacactcaaaccggtagccaaggccctcagcgaactgctattgaggcccgtcacattcgcacctgactgcctgaatgctgcagatgtcgtctctaagatgtctccgggcgatgttgttctgcttgaaaatgtacgcttttacaaagaagagggcagcaagaaggcaaaagaccgtgaagccatggccaagatccttgcgtcatatggtgatgtttacatcagtgatgcttttggtacagctcaccgtgacagtgctaccatgaccggaattccaaagattttgggcaacggtgctgccggttatttgatggagaaggagatttcatacttcgctaaggtacttggtaacccgccgcgtccgctggttgctatcgttggtggagcgaaagtgagcgacaagatccaacttctggataacatgttgcagcgcatcgattatctcttaattggtggtgcaatggcatacacatttctgaaggctcagggttacagcattggaaaatcgaagtgcgaggaaagtaaacttgaatttgctcgatccctgctgaagaaggcggaggaccgcaaggtgcaggttattcttccaattgatcatgtttgccacacggaattcaaagctgtggattctccattgataactgaggatcaaaacatccctgaaggacatatggctctggatattggtcccaagactattgaaaaatatgttcagacgattgggaagtgtaagagcgccatttggaacggtcccatgggtgtatttgaaatggttccttattccaaaggtacatttgcaattgcgaaagccatgggtcgaggaactcacgagcatggactcatgagtatcatcggtggtggtgacagcgcaagtgcagctgagttgagcggtgaggcgaagcgcatgtctcatgtttcaactggtggtggtgcgtctttggaactcctcgagggcaaaacgcttcccggcgttacagtattggacgaaaagtcggcggttgtgtcgtatgcctctgcaggtactggaactctttctaaccggtggagctctctttaa

SEQ ID NO: 10513 - protein, 440 aa, Trypanosoma brucei
MTLNEKKSINECDLKGKKVLIRVDFNVPVKNGKITNDYRIRSALPTLKKVLTEGGSCVLMSHLGRPKGIPMAQADKIRSTGGVPGFQQKATLKPVAKALSELLLRPVTFAPDCLNAADVVSKMSPGDVVLLENVRFYKEEGSKKAKDREAMAKILASYGDVYISDAFGTAHRDSATMTGIPKILGNGAAGYLMEKEISYFAKVLGNPPRPLVAIVGGAKVSDKIQLLDNMLQRIDYLLIGGAMAYTFLKAQGYSIGKSKCEESKLEFARSLLKKAEDRKVQVILPIDHVCHTEFKAVDSPLITEDQNIPEGHMALDIGPKTIEKYVQTIGKCKSAIWNGPMGVFEMVPYSKGTFAIAKAMGRGTHEHGLMSIIGGGDSASAAELSGEAKRMSHVSTGGGASLELLEGKTLPGVTVLDEKSAVVSYASAGTGTLSNRWSSL

SEQ ID NO: 10514 - DNA, 1605 bp, Triticum aestivum (common wheat)
  CDS (19)..(1461)
gggccagccccagccccaatggcgtccaccgccgcgccgcccgccgccctcgtcgcccgccgcgccgcgtccgcgtccgtcgccgcgccgctccggggcgcggggctcgcggccgggtgccagccggcgcgctcgctggcgttcgcggccggcgccgacccgcgcctcgcggtccacgtcgcgtcgcgctgccgggcggcgtccgccgcgcgcgggacacgcgccgtcgccaccatggccaagaagagcgtgggcgacctcaccgccgccgacctcgagggcaagcgcgtgctcgtgcgggccgacctcaacgtgccgctcgacgacaaccagaacatcaccgacgacacccgcatccgcgccgccatccccaccatcaagtacctcctcagcaacggcgccaaggtcatcctcaccagccacctgggtcgtcctaagggtgttactcctaagtttagcttggctccccttgtgccccgattatccgagcttcttggcattgaggtgaaaaaagcagaagatgttatcggcccagaagttgagaaattggtggctgacctggcaaatggtgctgttttgctcctggaaaacgtaagattttacaaggaagaggagaagaatgacccagagtttgcaaagaagcttgcgtcactggcagatctgtttgtaaacgatgcattcggaacagcccacagagcacatgcctcgactgagggagttaccaagttcttgaagccttctgttgctggattccttttgcagaaggaacttgactacctggatggagctgtttcaaaccctaagcgcccatttgctgccattgtgggtggctcaaaggtgtcatccaagattggggttatcgaatccctgttggagaagtgtgacatccttcttttgggtggtggtatgatcttcacattttacaaggcacaaggactctcagttggttcttccttggttgaggaagataaacttgagctggcaacatctctccttgcaaaggcaaaggcaaagggtgtctcccttctgttgccatctgacgttatcattgctgataagtttgctcctgatgctaacagtcagaccgtccctgcatctgcaattcctgatggttggatggggctggacattggcccagattcagtcaaaacatttaatgatgccctggacacaacacagacaatcatttggaacggaccaatgggtgtctttgaatttgacaagtttgcagtaggaactgagtctattgcaaagaagttggccgagcttagcaaaaagggtgtgacaactatcattggaggcggagactccgttgcggctgttgagaaggtgggagtggctgatgttatgagccacatctcaactggtggtggcgccagcttggagttgttggaaggaaaggagcttcctggagtcgttgcacttgatgaaggtgtcatgacgaggtcggtgaccgtatgaggctaagcttcatttgttgcatcttaattcctttcatgtaccgttccaaacctgccatgttgtcctccctcttttgctcgtcttcgaccactcgaaatgtaagagaccaatgttttatagagaaatactgggaactgtttgaat

SEQ ID NO: 10515 - protein, 480 aa, Triticum aestivum (common wheat)
MASTAAPPAALVARRAASASVAAPLRGAGLAAGCQPARSLAFAAGADPRLAVHVASRCRAASAARGTRAVATMAKKSVGDLTAADLEGKRVLVRADLNVPLDDNQNITDDTRIRAAIPTIKYLLSNGAKVILTSHLGRPKGVTPKFSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTIIWNGPMGVFEFDKFAVGTESIAKKLAELSKKGVTTIIGGGDSVAAVEKVGVADVMSHISTGGGASLELLEGKELPGVVALDEGVMTRSVTV

SEQ ID NO: 10516 - DNA, 1473 bp, Triticum aestivum (common wheat)
  CDS (79)..(1284)
gggccaagcccatcgccactccaatccagcgaccacctcgcccagatcgccgccgattcgatccggttcctcgacgggatggcgaccaagaggagcgtgggcaccctcggggaggcggatctcaaggggaagaaggtgttcgtgcgcgccgacctcaacgtgccgctcgacgacgcccagaagatcaccgacgacacccgcatccgcgcctccatccccaccatcaagtacctcctcgagaagggcgccaaggtcatcctggccagccatctgggccgcccaaaaggtgtcacccccaagttcagcttgaagcctcttgttgcacgcttgtctgagctccttggacttgaagttgtgatggcccctgactgcatcggtgaagaagttgagaaattggctgctgctttgccagatggtggtgttctactcctagagaatgttagattctacaaggaggaagagaagaacgatcctgagtttgctaagaagcttgcgtcagttgctgacctttatgtaaatgacgctttcggcactgcacatagggctcatgcttcaactgagggtgtaaccaagtttttgaggccttctgttgctggcttcctcatgcagaaggaacttgactatcttgtcggagctgttgccaacccaaagaagccatttgctgccattgttggtggatcaaaggtctcatctaagattggtgtgatcgagtctctgctggccaaggttgatatcctcatccttggtggtggtatgatcttcacattctacaaggcccagggattagctgttggaaagtctcttgtggaggaagacaaacttgaactggcaacttcactgattgaaacggcaaagtccaagggtgttaagctcttgcttccgactgatgtcgttgtggctgacaagtttgcagcagatgccgaaagcaagattgttcctgccactgctatccctgatggttggatgggtctggatgttggcccagattccatcaagacttttgcagaagccttggacaccaccaagactgttatctggaacggtcctatgggagtctttgagtttgagaagtttgccgcaggcactgatgcgatcgcgaagcagttggctgagcttactgggaagggtgtcacgaccatcattggtggaggtgactccgttgctgctgttgagaaggctgggctggccgacaagatgagccacatttccaccggcggtggcgcgagcttggagctgctggaaggcaagcccctccctggtgttcttgcccttgacgaggcgtaggttgattcggtttcacctatcagcttgctgcgtgccccttttgtttgggatctcatctcggtgtaacgctggaacgttatatgtcccaaggaaactttgagataggcttgtcgccaatttttgctagtagatgagtcgtgaataattatcaacttcctctgtgcgtgtgaagtgatgtggctggaattt

SEQ ID NO: 10517 - protein, 401 aa, Triticum aestivum (common wheat)
MATKRSVGTLGEADLKGKKVFVRADLNVPLDDAQKITDDTRIRASIPTIKYLLEKGAKVILASHLGRPKGVTPKFSLKPLVARLSELLGLEVVMAPDCIGEEVEKLAAALPDGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGLAVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADKMSHISTGGGASLELLEGKPLPGVLALDEA

SEQ ID NO: 10518 - DNA, 1777 bp, Physcomitrella patens
  CDS (135)..(1562)
gctaaacctagtgatgcacgagccgttttgcccatcggcacgaggaaacctcgatcatctccgcctgtgcagcagctgcagccgttctgttggagtgcttgtgtggtgccgcgcgcggtctttaagcttgaaggatggagtccctcgcgctgcgatctgccgtggttgccaccggattgacctccagtgtggcatcccaaacctctgtgcagacccgcgctacggtttcgtctgctttcatcgggaagagcatacgtgtgaacactaaactcaacgcctcagctgtgcccgtccagcagaagttccgctacgtgcgtgccgacgctggtgcacagactgcgcaggttgagaccgttgagaagaaggctagcattaaggacgttcccgagtcggaattccagggcaaggttgtgttcgtgcgtgctgatctgaacgtacctctcaatgatgcatgcgaaatcaccgatgacacccgaatccgtgcctccctcccgaccatccagcatcttacgaaggccggagccaaggtggtgctcgctagccatttgggtcgccccaagaagggccctgaggacaaattcagcttgaagcccgttgcagggagactgaccgagttgcttggccagaccgtggaattggcccctgattgcattggtgctgaagtagaatctaagattgcagcactgaagaatggtgaagttctccttctggagaatgttaggttctacaaggaagaggagaagaacgacagcgagttctcccaaaagcttgccaagggtgtcgatatcttcgttaacgacgccttcggcactgcccaccgcgctcactcatctactgcaggaattgctgagtacgttggcaagactgtggctgggttcctcttggagaaggagttggcttatctcgctggcgccgtgaaggccccagccaggcctttcgttgccattgttggaggcagcaaggtctcatcgaagattactgtgattgagtccttgatgaacgtgtgcgacaaggtcattttgggaggtggcatgatctttaccttcttcaaggcagacggcaaggatgttggaagttccctagtggaggatgacaagattgatttggccaaggacctcgtggctctagctaagaagaagggcgttgagctcattctccccgtcgatgtcaccgcagctgataagttctctcccgaagccaacactcaagtgtgcagctcctcgaacatccctgccggctggatgggactagacattggcccgaaggcaatcgaccaattccaggatgccctgaagggcgccaagacggttctgtggaacggaccgatgggagtgttcgagttcgagaagttcgcggacggaacaactgccgtcgctaaaactttggcaggtttgaccaaggagggtgccatcaccatcattggaggaggtgactccgtcgcagccgttgagaaggctggactcgccgaccagatgagccatgtgtccaccggaggaggggccagtctcgagttgttggaaggcaaggtattgccaggagttgctgctcttgacaacgcttaaatgcctcttttgccgaagaggtgaattccgtccacgaactcgcagtagagtgacaatgtcactgagtgcacccccggctctggctgtctaatcatatgattcatttttttggtagttttttttgtgatttgcctttgtaccagtaaacacagattatgaccagtaaagaactccagctcgatttacctggatgcttggtattctcttaaaaaaaa

SEQ ID NO: 10519 - protein, 475 aa, Physcomitrella patens
MESLALRSAVVATGLTSSVASQTSVQTRATVSSAFIGKSIRVNTKLNASAVPVQQKFRYVRADAGAQTAQVETVEKKASIKDVPESEFQGKVVFVRADLNVPLNDACEITDDTRIRASLPTIQHLTKAGAKVVLASHLGRPKKGPEDKFSLKPVAGRLTELLGQTVELAPDCIGAEVESKIAALKNGEVLLLENVRFYKEEEKNDSEFSQKLAKGVDIFVNDAFGTAHRAHSSTAGIAEYVGKTVAGFLLEKELAYLAGAVKAPARPFVAIVGGSKVSSKITVIESLMNVCDKVILGGGMIFTFFKADGKDVGSSLVEDDKIDLAKDLVALAKKKGVELILPVDVTAADKFSPEANTQVCSSSNIPAGWMGLDIGPKAIDQFQDALKGAKTVLWNGPMGVFEFEKFADGTTAVAKTLAGLTKEGAITIIGGGDSVAAVEKAGLADQMSHVSTGGGASLELLEGKVLPGVAALDNA

SEQ ID NO: 10520 - DNA, 2000 bp, Ashbya gossypii
  CDS (447)..(1793)
ctgcagcacgtggtcctgccggtttcgcagttcgccgcacagctcccgcaccgccatgtaccgaagatctacatcctcctgctcgcgatagcgcatcacgcaccgcagcgcgctctccatctccgtctccatccttgcgcttgcccgtatctgccaacaagccgtccagaacgccgctgcttagtacgagctcgtcacgtgcgactgccagcttcctgttctgtggaagccggcttctcccctggctttttccgtagcatgacgccggggctcaccagagaacgaggaagaatttccagttggcgagcacaggccaggcgggctccctacgggtaccgtggggcgagcaaggcagggcaatgatgcaataagcgcaggccggcacgcaattgagcgagcaacgtgcacgaggatttttctgggggcgaaaaaagcgagtataaaggatgggccggtcgtggggtctgctctggatggcgtgcttgctgtacggcgtgttcacagagtgtcgcagatcttcacagcacgcacacacaggaaaaatgtcgctatcctctaagctaacagtcaaggacctgagccttgcgggcaaacgcgtgttcatccgcgtggacttcaacgtgccgctagacgggaagacgatcacgtcgaaccagcgcattgtggccgcgctacccacgatcaagtacgtgttggagcagggccccaaggcggtggtgttggcgtcgcacctagggcggcccaacggcgagcgcaacgagaagtactcgttggcgccggtggccgcggagctggagaagctgctgggccagaaggtgaacttcctggacgactgcgtgggcgagcacgtgaccgctgcggtcaacggcgcggctgcggggtccgtgttcctgcttgagaacctgcggttccacatcgaggaggagggctcgcgcaaggtggacggcgagaaggtcaaggcgtctgcggaggacgtgcagaagttccgccagggcctcatgtcgctcgcggacgtctacgtcaacgacgccttcggcaccgcgcacagagcgcactcctcgatggtcggcttcgagctgcctgagagggccggcggcttcttgttgtcgcgcgagctggagtacttcagcaaggcgttggagaaccctacgagacccttcttggcgatcctgggcggtgccaaggttgccgacaagatccagttgatcgacaacttgttggacaaggtcgactcgattgtgatcggcggtggcatggccttcaccttcaagaaggtgcttgagaacatggagatcggtaactccatctacgacaaggcgggtgccgagatcgttcctaagctagcggagaaggccaagaagaacggcgtcaagatcgtgttgcctgtggacttcgtgatcggcgacgacttctcccaggacgccaacaccaagattgtctctgcctccgagggcattccatccggctgggagggtctagactgtggtcctgagtccagaaagctgttcagcgagaccatcgcgagcgcgaagaccatcgtgtggaacggcccaccaggtgtctttgagattccaaagttctccgagggtacccaggccatgcttgcggccgctgtcaaggcctccgaggctggcagcaccgtcatcatcggcggtggtgacaccgctaccgtggccaagaagtacggtgtggtcgagaagatctcccatgtgtccaccggtggtggtgcctccctagagctattggagggtaaggacctaccaggtgtcaccttcttgtccagcaagcagtagatgcgtccgcgcgcctgccggcttgaatagataataaactatatacgcaacgtaatggaaagttgagaaactactatatgcgcctgttgcgctgctcgtccgtgggctccagccgcgggaacccgagcagctccatgatgcagtactcgtccgggctctcgacgcacgcgccgctcgacttgtcaaacaggccgtgctgattcagcg

SEQ ID NO: 10521 - protein, 448 aa, Ashbya gossypii
MGRSWGLLWMACLLYGVFTECRRSSQHAHTGKMSLSSKLTVKDLSLAGKRVFIRVDFNVPLDGKTITSNQRIVAALPTIKYVLEQGPKAVVLASHLGRPNGERNEKYSLAPVAAELEKLLGQKVNFLDDCVGEHVTAAVNGAAAGSVFLLENLRFHIEEEGSRKVDGEKVKASAEDVQKFRQGLMSLADVYVNDAFGTAHRAHSSMVGFELPERAGGFLLSRELEYFSKALENPTRPFLAILGGAKVADKIQLIDNLLDKVDSIVIGGGMAFTFKKVLENMEIGNSIYDKAGAEIVPKLAEKAKKNGVKIVLPVDFVIGDDFSQDANTKIVSASEGIPSGWEGLDCGPESRKLFSETIASAKTIVWNGPPGVFEIPKFSEGTQAMLAAAVKASEAGSTVIIGGGDTATVAKKYGVVEKISHVSTGGGASLELLEGKDLPGVTFLSSKQ

SEQ ID NO: 10522 - DNA, 1453 bp, Populus nigra
  CDS (91)..(1296)
cttacaccactctctcacactattcttttcttgatctcacctaaagccgaagtctttgttctcttctctcgcgtcgattggttttgaaaaatggctactaagaagagtgttagcagtttaaaggaagcagatttgaagggaaaaagcgtttttgtaagagtagatctgaatgttcctttggatgataactttaatattaccgatgatactaggatccgtgctgctgtccccactatcaagtacttgatgggtcatggtgccagagttattctttcctctcacttgggacgcccaaagggtgtcacacctaaatacagcttgaagcctcttgtaccaaggctatctgaacttcttggtgttgatgttaagatggcaaatgattgtattggtgtggaggttgagaaaattgtggctgagattccagaagggggtgttttgctccttgaaaatgtaaggttttataaggaggaagagaagaatgaccctgaatttgcaaagaagctcgcttctctagcagaaatctatgtgaatgatgcattcggcactgctcacagagcccatgcatccactgagggcgtggctaaatacttgaagcctgctgttgctggtttccttatgcagaaggaactcgattatcttgttggagctgtggcaaatcccaagaagccatttgctgcaattgttggtggctcaaaggtatcttctaagattggagttatcgaatcactcttggagaaggttgacctcctcttcttgggtggaggaatgatctatactttttacaaagcacaagggcactcagttgggtcctcccttgttgaggaagacaaacttgatcttgcaacttcacttattgagaaggccaaggtcaagggggtaaaactgctgctgcctgcagatgtggttgttgctgacaagtttgctccagatgccaacagcaaggtggtgccagcttctgagataccagatggttggatgggtttggacataggacctgattccatcaagacatttagcgaggcattggatacaaccaagaccatcatttggaatggaccaatgggtgtctttgagttcgagaagtttgcagcgggaactgaggcaattgccaggaagcttgccgagctcagcggcaagggagtgactaccatcattggaggaggtgactctgtcgctgctgtggagaaggctggacttgctgacaagatgagccacatctcaacaggaggtggtgccagcttagagcttctagagggcaaaccattacctggagtcctggctcttgatgacgcttaagccgaatttttcctcgtgttacttcttaagaacatgcttggtaaatgtttggtattacaatcagagtggactagatgagtgctgatctttggaggctgtagagtgactaaataaatcttctctcaagtatattcaaccatggaatggtttcggattg

SEQ ID NO: 10523 - protein, 401 aa, Populus nigra
MATKKSVSSLKEADLKGKSVFVRVDLNVPLDDNFNITDDTRIRAAVPTIKYLMGHGARVILSSHLGRPKGVTPKYSLKPLVPRLSELLGVDVKMANDCIGVEVEKIVAEIPEGGVLLLENVRFYKEEEKNDPEFAKKLASLAEIYVNDAFGTAHRAHASTEGVAKYLKPAVAGFLMQKELDYLVGAVANPKKPFAAIVGGSKVSSKIGVIESLLEKVDLLFLGGGMIYTFYKAQGHSVGSSLVEEDKLDLATSLIEKAKVKGVKLLLPADVVVADKFAPDANSKVVPASEIPDGWMGLDIGPDSIKTFSEALDTTKTIIWNGPMGVFEFEKFAAGTEAIARKLAELSGKGVTTIIGGGDSVAAVEKAGLADKMSHISTGGGASLELLEGKPLPGVLALDDA

SEQ ID NO: 10524 - DNA, 1394 bp, Populus nigra
  CDS (56)..(1261)
tctcaattgaagcccaactcttgacttctttctcttagcgagatttattgaaaaaatggccactaagaagagtgttagcagtttaaaggaaacagatttgaagggaaagagagtgtttgtgagggtagatctgaatgttcctttggatgataactttaatattactgatgatactaggatccgtgctgccgtacccactgtcaagtacttgatggatcatggtgccagagttattctatgctctcacttgggacgcccaaagggtgttacacctaaatacagcttgaagcctcttgtaccaaggctatccgaacttcttggtgttgaggttaagatagcaaatgattgtattggcgaggaagttgagaaattggtggctgagattccaggaggaggtgttgtgcttcttgaaaatgtaaggttccacaaggaggaagagaagaatgaccctgaatttgcaaagaagcttgcttctctagcagaagtctatgtgaatgatgcatttggcactgctcacagagcccatgcttccaccgagggagtggctaaatacttgaagcccgctgttgctggtttccttatgcagaaggaacttgactatcttgttggagctgtggcaaatcccaagaagccatttgctgctattgttggtggctcaaaggtatcatccaagattggagtgattgaatccctcttagagaaggttgacttcctcttcttgggtggaggaatgatctttactttttacaaagcccaagggtactcagttgggtcatcccttgtggaggaagacaagcttgatcttgcaacttcacttattgagaaggccagggtcaagggggtaaaactactgctgcctaccgatgtggttgttgctgacaagtttgcttcagatgccaacagcaaggtggtaccagcttctgagatagcagatggttggatgggtttggatataggacctgattctatcaagacattcagtgaggcattggatacaaccaaaaccattatttggaatggaccaatgggtgtgtttgagttcgagaagtttgcagcaggaactgaggcaatcgcctggaagcttgctgagctcagtggcaagggagtgactaccatcattggaggaggtgactctgttgctgcagtggagaaggttgggctcgctgataagatgagccacatctcaacaggaggtggtgccagcttagagcttcttgaggggaagccgctgcctggagtcctggctcttgacgacgcttaagctggatttttcttttagtgctggtatatgtttggttttgccaccggagtgggctaaatgatagagctgatcttatggaggctgtagagtgaccgaataaatgctcttccaagtatattcaactatgcaatgg

SEQ ID NO: 10525 - protein, 401 aa, Populus nigra
MATKKSVSSLKETDLKGKRVFVRVDLNVPLDDNFNITDDTRIRAAVPTVKYLMDHGARVILCSHLGRPKGVTPKYSLKPLVPRLSELLGVEVKIANDCIGEEVEKLVAEIPGGGVVLLENVRFHKEEEKNDPEFAKKLASLAEVYVNDAFGTAHRAHASTEGVAKYLKPAVAGFLMQKELDYLVGAVANPKKPFAAIVGGSKVSSKIGVIESLLEKVDFLFLGGGMIFTFYKAQGYSVGSSLVEEDKLDLATSLIEKARVKGVKLLLPTDVVVADKFASDANSKVVPASEIADGWMGLDIGPDSIKTFSEALDTTKTIIWNGPMGVFEFEKFAAGTEAIAWKLAELSGKGVTTIIGGGDSVAAVEKVGLADKMSHISTGGGASLELLEGKPLPGVLALDDA

SEQ ID NO: 10526 - DNA, 1802 bp, Populus nigra
  CDS (205)..(1650)
caaaaaccaacacacaccgcccattcattccctccttcgttcttcccgtccacagcttcccccattattttcatctctcactctcactccaaaagatcagagaaagagagcctcgttttcacatccacataacccctcattacctcctcttttccttttagtccacacaacttctctcacgaaacagtccacaaacaccgccaaatggcctctgccacagcaccaacaactctatctctcctcaaaacagccgccgcctccacctccacttctgcccgtgcctcccttctcccagtctccacctctggcctccgcacaaccagcctccgtggtcttggtttctctgctgcagacccattgtttagttctcatgtggtgtccaaaatccgatcttttaagtcaaatggcagagcaccaagagctgtggtgtctatggcaaagaagagtgtgggtgacttgactgctgctgacttgaaagggaagaaagtgtttgttagagctgatttgaatgtgcctcttgatgagaatcagaaaattactgatgataccagaattagagccgctgttcctactattaaatatttgatttcaaaaggggccaaagttattctttctagtcatttgggacgaccaaaaggtgtaactccaaaattcagcttggcacctcttgttccccggttatctgaactccttggaattcaggttgtgaaagctgatgattgcattggtccagaggtagaaaagttggttgcttcacttcccgagggtggtgttcttcttcttgaaaatgtcaggttttacaaggaagaagagaagaacgaacctgaattcgcaaagaagcttgcttccatggcagatctttatgtaaatgatgcatttggaactgcacatagagcacacgcctcaactgagggagtcacgaaattcttgaaaccatctgttgctggtttcctcttgcagaaggagctggactaccttgttggggcagtttcaaacccaaagaggccatttgctgccattgtgggtggttctaaggtctcatcgaagattggagtcattgagtcactcctggagaagtgtgatatcctccttttgggtggaggtatgattttcacattttacaaggctcaaggcctcgcagtaggttcatccttggttgaggaagataagcttgatttggcgaccacactacttgagaaggccaaggcaaaaggagtgtctcttttgctacctagtgatgtggtaattgcagacaagtttgctcctgatgcaaatagcaagactgtgccagcatcagccatcccagatggttggatgggactggatattggaccagaatctgtgaaaacattcagtgaggctttgggaaccacccaaactgtcatctggaatggacccatgggagtgtttgagtttgagaagtttgcgaatggaacagaggccattgcaaagaagcttgctgagcttagtggcaagggagttacaactattattggaggtggagattctgttgcagctgtagaaaaagtaggagttgctgatgtcatgagccacatatcaactggtggtggtgccagcttggagttgttggaagggaaagagctaccaggtgtccttgctcttgacgaagtcgaacgagttgctgtgtaggataatttgatttccccccaatcccgttcccatttccatgtcctcgcttttactgttacgaaagggagatgcaatgttgtagagaagtacgagtcatgctgtacgttgaggttggttaacaagagtgatccaagactttaaataaatagttg

SEQ ID NO: 10527 - protein, 481 aa, Populus nigra
MASATAPTTLSLLKTAAASTSTSARASLLPVSTSGLRTTSLRGLGFSAADPLFSSHVVSKIRSFKSNGRAPRAVVSMAKKSVGDLTAADLKGKKVFVRADLNVPLDENQKITDDTRIRAAVPTIKYLISKGAKVILSSHLGRPKGVTPKFSLAPLVPRLSELLGIQVVKADDCIGPEVEKLVASLPEGGVLLLENVRFYKEEEKNEPEFAKKLASMADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLAVGSSLVEEDKLDLATTLLEKAKAKGVSLLLPSDVVIADKFAPDANSKTVPASAIPDGWMGLDIGPESVKTFSEALGTTQTVIWNGPMGVFEFEKFANGTEAIAKKLAELSGKGVTTIIGGGDSVAAVEKVGVADVMSHISTGGGASLELLEGKELPGVLALDEVERVAV

SEQ ID NO: 10528 - DNA, 1263 bp, Trypanosoma brucei
  CDS (1)..(1263)
atgtcactaaaagagaggaagagcattaacgaatgcgatcttaagggaaagaaggttcttatccgtgttgactttaatgttcctctggatgatggtaatattaccaacgactaccgaatccgatcagctctgccagccgtccaaaaagttctcacagaaggcggcagctgtgttctcatgagccacctcgggaggccgaaaggcgtttctatggctgaaggcaaagaactgcggagcgctggcggtattcccgggttcgagcagaaggcaacactcaaaccggtagccaagcgcctcagcgaattgttatcgagacccgtcacattcgcacctgactgtctgaacgctgcagatgtcgtctctaagatgtctccgggcgatgttgttctgcttgaaaatgtacggttctacaaagaagagggcagcaagagcactgaggaacgtgaagccatggccaagatccttgcgtcatatggtgatgtttacatcagtgatgcttttggtacagctcaccgtgacagtgctaccatgaccggaattccaaagattttgggtcacggtgctgccggttatttgatggagaaggagatttcatacttcgctaaggtgcttggtaacccgccgcgtccgctggttgctatcgttggtggagcgaaagtgagcgaaaagatccaacttctggataacatgttgcagcgcatcgattatctcttaattggtggtgcaatggcatacacatttctgaaggctcagggttacagcattggaaaatcgaagtgcgaggaaagtaaacttgaatttgctcgatccctgctgaagaaggcggaggaccgcaaggtgcaggttattcttccaattgatcatgtttgccacacggaattcaaagctgtggattctccattgataactgaggatcaaaacatccctgaagggcatatggctctggatattggtcccaagactattgaaaaatatgttcagacgattgggaagtgtaagagcgccatttggaacggtcccatgggtgtatttgaaatggttccttattccaaaggtacatttgcaattgcgaaagccatgggtcgaggaactcacgagcatggactcatgagtatcatcggtggtggtgacagcgcaagtgcagctgagttgagcggtgaggcgaagcgcatgtctcatgtttcaacgggtggtggtgcgtctttggaactcctcgagggcaaaacgcttcccggtgttacagtattggacgaaaaggagtaa

SEQ ID NO: 10529 - protein, 420 aa, Trypanosoma brucei
MSLKERKSINECDLKGKKVLIRVDFNVPLDDGNITNDYRIRSALPAVQKVLTEGGSCVLMSHLGRPKGVSMAEGKELRSAGGIPGFEQKATLKPVAKRLSELLSRPVTFAPDCLNAADVVSKMSPGDVVLLENVRFYKEEGSKSTEEREAMAKILASYGDVYISDAFGTAHRDSATMTGIPKILGHGAAGYLMEKEISYFAKVLGNPPRPLVAIVGGAKVSEKIQLLDNMLQRIDYLLIGGAMAYTFLKAQGYSIGKSKCEESKLEFARSLLKKAEDRKVQVILPIDHVCHTEFKAVDSPLITEDQNIPEGHMALDIGPKTIEKYVQTIGKCKSAIWNGPMGVFEMVPYSKGTFAIAKAMGRGTHEHGLMSIIGGGDSASAAELSGEAKRMSHVSTGGGASLELLEGKTLPGVTVLDEKE

SEQ ID NO: 10530 - DNA, 1251 bp, Debaryomyces hansenii CBS767
  CDS (1)..(1251)
atgtctttatctaacaagttatctgtcaaggacttagatgtctccggtaagagagttttcatcagagtggatttcaatgttccattagatggtaaaaccatcaccaacaaccaaagaattgttgctgctttaccaactatcaagtatgtgttagaaaacaagcctaaggctgttatcttggcttctcacttaggaagaccaaacggtgaaaaagttgacaagttctctttagctccagttgccagtgaattggaaaagttgttgggtaagaaggttaacttcttagacgactgtgttggtgacaatgttgaaaaagctgtgaacggtggtagtgacggtgaagttttcttattagaaaacttgagattccacatcgaagaagaaggttcgcaaaagaaggacggtgaaaaggtcaaggcttccggcgaagatgtcaagaaattcagacaacaattgaccaacttggccgatgtctacgttaatgatgctttcggtactgcccacagagcccactcttctatggttggtttagaattaccacaaaaagctgctggtttcttaatggccaaggaattagaatactttgctaaggccttagaaaacccagtcagaccattcttagccatcttaggtggtgccaaggtttctgacaagatccaattgatcgacaacttgttagacaaggtcgatttattgattgttggtggtggtatgtctttcaccttcaagaaggtcttagacaacatgccaattggtgactccttgttcgacgaagctggtgctaagaacgtcgaaaacttagttgctaaggctaagaagaacaacgtcaagattgtcttgccggttgatttcattactgccgacaaattcgacaaggatgctaagacctccactgccactgaagacgaaggtatcccagacaattggatgggtttagatgctggtccaaagtccaacgaattgtttgctaagactgttgctgaagctaagactattgtctggaatggtccaccaggtgttttcgaattcgacaacttcgctaaaggtactaagtctttattagatgctgctgtcaagtctgctgaatctggtaacactgttatcatcggtggtggtgacactgctactgttgctaagaagtacggtgttgttgacaagttgtcccatgtctctaccggtggtggtgcttctttagaattattggaaggtaaggaattgccaggtgttgttgctatttccgataagaaataa

SEQ ID NO: 10531 - protein, 416 aa, Debaryomyces hansenii CBS767
MSLSNKLSVKDLDVSGKRVFIRVDFNVPLDGKTITNNQRIVAALPTIKYVLENKPKAVILASHLGRPNGEKVDKFSLAPVASELEKLLGKKVNFLDDCVGDNVEKAVNGGSDGEVFLLENLRFHIEEEGSQKKDGEKVKASGEDVKKFRQQLTNLADVYVNDAFGTAHRAHSSMVGLELPQKAAGFLMAKELEYFAKALENPVRPFLAILGGAKVSDKIQLIDNLLDKVDLLIVGGGMSFTFKKVLDNMPIGDSLFDEAGAKNVENLVAKAKKNNVKIVLPVDFITADKFDKDAKTSTATEDEGIPDNWMGLDAGPKSNELFAKTVAEAKTIVWNGPPGVFEFDNFAKGTKSLLDAAVKSAESGNTVIIGGGDTATVAKKYGVVDKLSHVSTGGGASLELLEGKELPGVVAISDKK

SEQ ID NO: 10532 - DNA, 1281 bp, Yarrowia lipolytica CLIB99
  CDS (1)..(1281)
atgagcacatttcacacgcatctcaaaatgtctcttaccaacaagctctccatcaaggatctcgatctcaagaacaagcgagtcttcatccgagtcgactttaacgttcctctcgatggcaccaccatcaccaacaaccagcgaattgttgctgccctgccctccatcaagtatgccattgatcagggtgccaaggctgtgatccttgcttctcatctcggccggcccaacggccagcgagtcgagaagtactctctcaagcccgtccaggccgagctttcaaagctccttggcaagcccgtcaccttccttgacgactgcgtcggccccaaggttgaggaggaggtctccaaggccaaggacggtgaggtcattctcctcgagaacctgcgattccaccccgaggaggagggatcccacaaggacgccgacggcaagaagatcaaggctgaccccgccaaggttgaggagttccgaaagtctctgacttctctcgccgatgtctacgtcaacgacgctttcggaaccgcccaccgagcccactcctccatggtcggcattgagcttccccagcgagccgctggtttccttgtcgccaaggagctcgagttcttcgccaaggctctggagcaccccgagcgacccttccttgccatccttggtggtgccaaggtctccgacaagatccagctcatcgacaacctacttgacaaggtcaacgccctgatcattggtggtggtatggctttcaccttcaagaagacccttgagaacgtcaagattggaaactctctcttcgacgaggatggatccaagattgtcgccggcctcgttgagaaggccaagaagaacaacgtcaagcttgtcttccccgtcgactacgtcaccgccgacaagttctccaaggatgccaaggttggccacgcaaccgacgctgagggtatccccgacggatggcagggtctggactgtggtcccaagtctatcgaggagttccagaaggtcattggcgagtccaagaccatcctctggaacggaccccccggtgtctttgagttcgacaacttcgccaagggtaccaaggctgtgcttgacgcctgtgtcaaggccgttgacaacggtgctaccgtgatcattggtggtggagataccgccactgtcgccaagaagtacggtgccgaggacaagctctcccatgtttccactggaggaggagcttctcttgagcttctcgagggtaagacccttcccggtgtcgctgctctctccgagaagaagtaa

SEQ ID NO: 10533 - protein, 426 aa, Yarrowia lipolytica CLIB99
MSTFHTHLKMSLTNKLSIKDLDLKNKRVFIRVDFNVPLDGTTITNNQRIVAALPSIKYAIDQGAKAVILASHLGRPNGQRVEKYSLKPVQAELSKLLGKPVTFLDDCVGPKVEEEVSKAKDGEVILLENLRFHPEEEGSHKDADGKKIKADPAKVEEFRKSLTSLADVYVNDAFGTAHRAHSSMVGIELPQRAAGFLVAKELEFFAKALEHPERPFLAILGGAKVSDKIQLIDNLLDKVNALIIGGGMAFTFKKTLENVKIGNSLFDEDGSKIVAGLVEKAKKNNVKLVFPVDYVTADKFSKDAKVGHATDAEGIPDGWQGLDCGPKSIEEFQKVIGESKTILWNGPPGVFEFDNFAKGTKAVLDACVKAVDNGATVIIGGGDTATVAKKYGAEDKLSHVSTGGGASLELLEGKTLPGVAALSEKK

SEQ ID NO: 10534 - DNA, 1164 bp, Erwinia carotovora subsp
  CDS (1)..(1164)
atgtctgtaattaagatgaccgatctggatctggctggtaaacgtgttcttattcgtgcggatctgaacgtaccagtaaaagaagggaaagtgacgtctgatgcgcgcatccgtgcctctctgccgaccatcgaaatcgctctgaaacaaggcgctcgcgttatggtcacttcccacttgggacgtccgaccgaaggcgagtacaacgaagatttttctctgctgcctgttgttgactacctgaaagagaaactctcttctcccgtacgtctggcgaaagactacctagatggtgttgatgtcgccgaaggcgagctggttgtactggaaaacgtccgctttaacaaaggcgagaagaaagacgacgaagtgctctccaagaaatacgcggcactgtgcgatgtgttcgtgatggacgccttcggtacggcgcaccgtgcacaggcttcaacccacggcgtaggtaaatttgccactatcgcttgtgcgggcccgctgctgtctggtgagctggaagcgctgggtaaagcactgagcaaaccagcccgtccgatggtcgccattgtgggcggttctaaagtttctactaaactgaccgtactggattcactgtctaaaatcgccgatcagctgatcgtgggtggcggtatcgccaatacctttgttgccgcacaaggccacaatgtaggtaagtccctgtatgaagcagacctgatttctgaagcgaaaaagctgctggaaacgtgtgatattcctgttccgagcgatgtgcgtgtagcgtcagaattctctgaaactgctgcagcaacgctgaagtctgttacggaaattaaagacgaagagcagattcttgatctgggagatgtttccgctgagcgtttggctgaaattctgaagaatgccaaaaccatcctgtggaatggcccagttggcgtcttcgaattcccgaatttccgtaaaggaaccgagattatcgctcgtgctatcgcggatagcgacgcattctctatcgcaggtggcggcgatacgctagctgcgatcgatctgtttggtattgcagacaagatctcctacatttctactggtggtggcgcattcctggagttcgttgaagggaaaaaactgccagcagtcgttatgctggaagaacgcgccaagcagtaa

SEQ ID NO: 10535 - protein, 387 aa, Erwinia carotovora subsp
MSVIKMTDLDLAGKRVLIRADLNVPVKEGKVTSDARIRASLPTIEIALKQGARVMVTSHLGRPTEGEYNEDFSLLPVVDYLKEKLSSPVRLAKDYLDGVDVAEGELVVLENVRFNKGEKKDDEVLSKKYAALCDVFVMDAFGTAHRAQASTHGVGKFATIACAGPLLSGELEALGKALSKPARPMVAIVGGSKVSTKLTVLDSLSKIADQLIVGGGIANTFVAAQGHNVGKSLYEADLISEAKKLLETCDIPVPSDVRVASEFSETAAATLKSVTEIKDEEQILDLGDVSAERLAEILKNAKTILWNGPVGVFEFPNFRKGTEIIARAIADSDAFSIAGGGDTLAAIDLFGIADKISYISTGGGAFLEFVEGKKLPAVVMLEERAKQ

SEQ ID NO: 10536 - DNA, 1215 bp, Mesoplasma florum
  CDS (1)..(1215): transl_table=4
atgaattacaatttgaaaaaaacattaaaagatattaatgtaaaaggaaaaaaagttttagttcgtgttgactttaatgttccattaaaagatggagttattactgatgacaatcgtattcaagcagcattaccaacaattaaatatttagttgaaaatggcgcaaaagttatcttattttcacacttatcaagaattaaaagtgaagatgacaaaaaaactaaatcattagctccagtagcaaaaagattggaagaagttttagcacaatcagtaaactttgttaaccaaacaagaggaactgaattagaaactgcaattaatgcattaaatgaaaaagaagttttattatttgaaaacactcgtttcgaagatgtaaaagatggtgaagtagttaaagctgaatcaaaaaatgatccagaattaggaaaatactgagcaagccttggagatgtatttattaatgatgcatttggtactgcacaccgtgctcatgcttcaaacgttggtatagcttcaaacatttctgaatcagcattaggtttcttagttcaaaatgaaattgaaatgttaggtaaaggaatagacgcacctgaaagaccttttgttgcaattttaggaggagcaaaagtttctgacaaaattggtgttattgataaccttttaactaaagttgacaaaattttaattggtggaggtatgacttatacattccataaagcaatgggattagaaattggtaactcattattagaagctgataaagttgaattggctaaagaatacttagaaaaagctaatggaaaaataatgttacctgttgatagtttatgtgctcctgaatatgctgatgttgctccaacattatgtggagaaaatgttccagcaggaatgatgggattagatatcggaccaaaaactattgaaatgtatgaaaaagaattagcaaacgcaaaaactgttgtttgaaatggaccaatgggagttagtgaatttgaaaacttcaaagctggtactgttgctgtttgtgaagctgctgcaaaacgtaaagctgatggaggtttcactttaattggtggaggagactcagctgcagctgcaattaaattaggattcaaagatgaattctcatgaatttctacaggtggtggagcttcattagaatatatggaaggtaaagaattacctggaattgctgcaatccaaaacaaataa

SEQ ID NO: 10537 - protein, 404 aa, Mesoplasma florum
MNYNLKKTLKDINVKGKKVLVRVDFNVPLKDGVITDDNRIQAALPTIKYLVENGAKVILFSHLSRIKSEDDKKTKSLAPVAKRLEEVLAQSVNFVNQTRGTELETAINALNEKEVLLFENTRFEDVKDGEVVKAESKNDPELGKYWASLGDVFINDAFGTAHRAHASNVGIASNISESALGFLVQNEIEMLGKGIDAPERPFVAILGGAKVSDKIGVIDNLLTKVDKILIGGGMTYTFHKAMGLEIGNSLLEADKVELAKEYLEKANGKIMLPVDSLCAPEYADVAPTLCGENVPAGMMGLDIGPKTIEMYEKELANAKTVVWNGPMGVSEFENFKAGTVAVCEAAAKRKADGGFTLIGGGDSAAAAIKLGFKDEFSWISTGGGASLEYMEGKELPGIAAIQNK

SEQ ID NO: 10538 - DNA, 1188 bp, Acinetobacter sp
  CDS (1)..(1188)
atgaactttaagcgtatgacggacctcgacttaagcgaaaaacgtgtattaattcgtgaagatttaaatgtaccagtaaaaaatggccagattaccagtgatgctcgtttgcgtgcagcattaccaaccattcaggctgcacttgctcaaggtgctgctgtgatggtttgctctcacttagggcgtcctgttgaaggtgaaccaaaacctgaacagtcacttgcacctgttgcagcttacctttcagatgcattagggcaggaagttaaacttttgactgactaccttgaaggggttgagatagcaccaggtcaagttgttcttcttgaaaatgtacgttttaacctcggcgaaaagaaaaataatgctgaacttgcacaaaaatatgcagcactctgtgatgtattcgtgatggatgcatttggcactgcacatcgtgcagaagcatcaaccgaaggtgctgctcgttatgccaaagttgcagcggcaggcccattgcttgcgactgagctagatgcattaggtcgtgcacttcaaacccctgaaaagccaatggtggcgattgttgcaggttctaaagtttcaacaaaacttgatgttttaacctcactttctgacatttgcggtcaattgattgtgggtggtggaattgccaataccttcttggcagcagctggtttcaatgtaggcaaatcgctttgtgaaaatgatttgattgataccgctaaagcaattgccgctaaagtatctgttccacttcctacggatgtggtggtagctgatgccacagagattgactttgctgacttcttgggttcattagcaaaagcacaagcaattgtgaaaaaagtggaagatattgctgacaatgacatgattctggatgtgggtcctgacacggcgaaagcatttgctgagatcttaaaaacagctaaaacgatactttggaacggcccagttggtgtatttgaagtagatcagtttggtgaaggaaccaaaacgctttcattggcaattgctgaatctaaaggattttctattgcaggtggtggtgatactttggctgcaattgataaatataaagttgctgacaaaattggttatatctcaacaggtggcggcgcattccttgagtttgtagaaggaaaaaccttaccagccgttgctgtattactcgaacgtgcctaa

SEQ ID NO: 10539 - protein, 395 aa, Acinetobacter sp
MNFKRMTDLDLSEKRVLIREDLNVPVKNGQITSDARLRAALPTIQAALAQGAAVMVCSHLGRPVEGEPKPEQSLAPVAAYLSDALGQEVKLLTDYLEGVEIAPGQVVLLENVRFNLGEKKNNAELAQKYAALCDVFVMDAFGTAHRAEASTEGAARYAKVAAAGPLLATELDALGRALQTPEKPMVAIVAGSKVSTKLDVLTSLSDICGQLIVGGGIANTFLAAAGFNVGKSLCENDLIDTAKAIAAKVSVPLPTDVVVADATEIDFADFLGSLAKAQAIVKKVEDIADNDMILDVGPDTAKAFAEILKTAKTILWNGPVGVFEVDQFGEGTKTLSLAIAESKGFSIAGGGDTLAAIDKYKVADKIGYISTGGGAFLEFVEGKTLPAVAVLLERA

SEQ ID NO: 10540 - DNA, 1251 bp, Candida glabrata CBS138
  CDS (1)..(1251)
atgtctctatcctctaagctaactgttcaagaccttgaattgaaggacaagcgtgtcttcatcagagttgacttcaacgtcccattggatggtaagaagatcacttctaaccaaagaattgttgctgctttgccaaccatcaagtatgttttggagcacaacccacgttacgttgtcttggcctcccacttgggtagaccaaacggtgaaagaaacgagaaatactccttggctccagttgctgaagagctacaatccttgttgggtaagccagttactttcttgaacgactgtgtcggtagcgaagttgactccgctgtcaaggcttccgccccaggctccgttatcctattggaaaacttgagataccacatcgaagaagaaggttccagaaaggtcgacggccaaaaggtcaaggcctccgctgaagacgtcgccaagttcagaaaggagctgtgctctctagctgatgtttacatcaacgacgctttcggtaccgcccacagagctcactcctccatggtcggtttcgacttgccacaacgtgctgctggtttccttttgaccaaggaattgcaatacttcggtaaggctttggaaaacccaaccagaccattcttggctatcctaggtggtgctaaggtcgctgacaagatccaattgatcgacaacttgttggacaaggtcgactccatcatcatcggtggtggtatggctttcaccttcaagaaggttttggaaaacgctgaaatcggtgactccatcttcgacaaggctggtgctgaaatcgttccaaagttgatggaaaaggctaaggctaagggtgtcgaagtcgtcctaccagttgacttcgtcattgctgacgctttctccgctgacgctaacaccaagatcgtctccgacaaggaaggtatcccagccggctggcaaggtttggacaatggtccagagtccagaaagttgttcgctgcaactatcgctaaggctaagaccattgtctggaacggtcctccaggtgtcttcgaattcgagaagttcgcttccggtaccaaggctatgttggacgaagttgtcaagtcctccacttccggtaacaccgtcatcatcggtggtggtgacactgctaccgtcgctaagaagtacggtgtcactgacaagatctcccacgtttccactggtggtggtgcctccttggaattgttggaaggtaaggaattgccaggtgtcgctttcctatctgaaaagaactaa

SEQ ID NO: 10541 - protein, 416 aa, Candida glabrata CBS138
MSLSSKLTVQDLELKDKRVFIRVDFNVPLDGKKITSNQRIVAALPTIKYVLEHNPRYVVLASHLGRPNGERNEKYSLAPVAEELQSLLGKPVTFLNDCVGSEVDSAVKASAPGSVILLENLRYHIEEEGSRKVDGQKVKASAEDVAKFRKELCSLADVYINDAFGTAHRAHSSMVGFDLPQRAAGFLLTKELQYFGKALENPTRPFLAILGGAKVADKIQLIDNLLDKVDSIIIGGGMAFTFKKVLENAEIGDSIFDKAGAEIVPKLMEKAKAKGVEVVLPVDFVIADAFSADANTKIVSDKEGIPAGWQGLDNGPESRKLFAATIAKAKTIVWNGPPGVFEFEKFASGTKAMLDEVVKSSTSGNTVIIGGGDTATVAKKYGVTDKISHVSTGGGASLELLEGKELPGVAFLSEKN

SEQ ID NO: 10542 - DNA, 1194 bp, Bartonella quintana
  CDS (1)..(1194)
atgggttttcgtacacttgatgatgttgatgtcactgggaaacgtgttcttgtgcgggttgattttaatgtgccaatgtcgcaaggtaaggtatgcgatgaaacccgcctcaagcgacataaagaaacactccttgagcttcaaaaacgtggtgctaagcttattcttctctcccattgtggtcgccctaaaggacagggggagccagaattttcgctacgccccgttgtgcgagtgctggaaaaaataatcaaccaaccagttgcttttgcacccgattgtgtcggtgtcgcagcgcagacagcaattgaggcattgcaaaatggtggtcttttgctgcttgaaaatgttcgttttcatccaggtgaagaaaagaatgattgttcttttgctgaagctttagcccataatggggatctttatgtcaatgatgctttttcagtttctcatcgtgcccatgcttcggtggagggaataacacatttgttgccctcctatgcggggcgctctttacaatgtgaattgcaggcgttggaaaaaggacttgacaatccgaagcgtccagtggtcgcacttgttggaggtgcaaaagtttccagtaagctttttgtgctcaatcatttagttgaaaaagtcgattatttggtgattggcggtggcatggccaacagttttttagctgcgcaaggtgtccatattggtaagtcattgtgtgaacatgcactaatgcagacgataaaaaaagtcattgaaaaagcacaagagtaccaatgtacgcttctactccctgtggatgcagtggttgggtttcgctttgaaaaaggtgcaccgcatcgcctctatgatattggagatattcctgatgatggaatgattttggatattggtacccgctccattgcgcatatcaatgaagtgattgataaagccgctacccttgtgtggaatggcccccttggtgtttttgagatgtctccctttgatcaaggaacgattgcagttgcacgtcatgcagcagaatgcagcttgacagggaaatgtgtttcaattgctggagggggagatacggtttttgctcttaaccacgctggtgttgccaatgatttcacttatctttcaaccgcagggggagcctttttagaatggatggaaggcaaggtgcttcccggtatttttgctctcagacaagcttaa

SEQ ID NO: 10543 - protein, 397 aa, Bartonella quintana
MGFRTLDDVDVTGKRVLVRVDFNVPMSQGKVCDETRLKRHKETLLELQKRGAKLILLSHCGRPKGQGEPEFSLRPVVRVLEKIINQPVAFAPDCVGVAAQTAIEALQNGGLLLLENVRFHPGEEKNDCSFAEALAHNGDLYVNDAFSVSHRAHASVEGITHLLPSYAGRSLQCELQALEKGLDNPKRPVVALVGGAKVSSKLFVLNHLVEKVDYLVIGGGMANSFLAAQGVHIGKSLCEHALMQTIKKVIEKAQEYQCTLLLPVDAVVGFRFEKGAPHRLYDIGDIPDDGMILDIGTRSIAHINEVIDKAATLVWNGPLGVFEMSPFDQGTIAVARHAAECSLTGKCVSIAGGGDTVFALNHAGVANDFTYLSTAGGAFLEWMEGKVLPGIFALRQA

SEQ ID NO: 10544 - DNA, 1543 bp, Oryza sativa
  CDS (86)..(1294)
cacatcgcaatccaaaccttcgtcttcgtcttcctctcgccgctgattcgattcgatccgatccgatccaaggggaggggaagcaatggcgacgaagaggagcgtggggacgctgggggaggcggatctgagggggaagaaggtgttcgtgcgggccgacctcaacgtgccgctcgacgacgcccagaagatcaccgacgacacccgcatccgcgcgtccgtgcccactgtcaagttcctcctcgagaagggcgccaaggtcatcctcgccagccatctgggccgtccgaagggtgtcacccccaagtacagcttgaagcctcttgttccacgcttgtctgagctacttggagtcgatgttgtgatggccaatgattgcattggtgaggaagttgagaaattggctgctgctttgccggaaggtggtgttctactcctagagaatgttagattctacaaggaggaagaaaagaatgatcctgagtttgccaagaagcttgcagctgtcgctgacctctatgtaaatgatgcttttggcactgcacacagagctcatgcttcaactgagggagtgaccaaatttttgaagcctgctgttgctggcttcctgatgcagaaggaacttgactatcttgttggagctgttgcaaacccaaagaagccatttgcggccatcgttggtggatccaaggtctcaactaagattggggtgattgagtctctgttggcaaaggttgatgtcctcatccttggtggtggtatgatcttcacattctacaaagcccagggatatgctgttggaaaatctcttgtggaggaagacaaacttgagcttgcaacttcacttattgagaaggcgaaggcgaagggtgtttctctcttacttcctaccgatgttgtagtggctgacaagtttgccgcagatgctgaaagcaagactgttgctgcctccgctatccccgatggttggatgggtcttgatgttggcccagatgccatcaagacttccagcgaagcattggacacctgcaacactatcatttggaacggacctatgggagtctttgagtttgagaagtttgcagcaggcactgatgcaattgccaagaagttggctgatcttactaccacaaagggcgccacgaccatcatcggtggtggtgactccgttgctgcggtcgagaaggctgggctggccgacaagatgagccacatctccaccggcggtggtgctagcttggagttgctggaaggcaagaccctcccaggtgttcttgcccttgatgaagcgtaagctaattcggcttgtctccatcagcagtctgcacttttgtttcagacctctcggtgtaactttgcaatgtcaatgcttgtatgaagaacttgagataggcttatcgtcaagttttgctagatgagtcgtgaataagcttttcgacttcctcgctgccgcgagtgaagtggttcgaactgacatacatactctcatggatcgatattttgatatgcggttatcacatccctatgatggcatcatctgttg

SEQ ID NO: 10545 - protein, 402 aa, Oryza sativa
MATKRSVGTLGEADLRGKKVFVRADLNVPLDDAQKITDDTRIRASVPTVKFLLEKGAKVILASHLGRPKGVTPKYSLKPLVPRLSELLGVDVVMANDCIGEEVEKLAAALPEGGVLLLENVRFYKEEEKNDPEFAKKLAAVADLYVNDAFGTAHRAHASTEGVTKFLKPAVAGFLMQKELDYLVGAVANPKKPFAAIVGGSKVSTKIGVIESLLAKVDVLILGGGMIFTFYKAQGYAVGKSLVEEDKLELATSLIEKAKAKGVSLLLPTDVVVADKFAADAESKTVAASAIPDGWMGLDVGPDAIKTSSEALDTCNTIIWNGPMGVFEFEKFAAGTDAIAKKLADLTTTKGATTIIGGGDSVAAVEKAGLADKMSHISTGGGASLELLEGKTLPGVLALDEA

SEQ ID NO: 10546 - DNA, 1254 bp, Homo sapiens
  CDS (1)..(1254)
atgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggttaaagccgagccagccaaaatagaagctttccgagcttcactttccaagctaggggatgtctatgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaggagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccaccataggtggtggagacactgccacttgctgtgccaaatggaacacggaggataaagtcagccatgtgagcactgggggtggtgccagtttggagctcctggaaggtaaagtccttcctggggtggatgctctcagcaatatttaa

SEQ ID NO: 10547 - protein, 417 aa, Homo sapiens
MSLSNKLTLDKLDVKGKRVVMRVDFNVPMKNNQITNNQRIKAAVPSIKFCLDNGAKSVVLMSHLGRPDGVPMPDKYSLEPVAVELKSLLGKDVLFLKDCVGPEVEKACANPAAGSVILLENLRFHVEEEGKGKDASGNKVKAEPAKIEAFRASLSKLGDVYVNDAFGTAHRAHSSMVGVNLPQKAGGFLMKKELNYFAKALESPERPFLAILGGAKVADKIQLINNMLDKVNEMIIGGGMAFTFLKVLNNMEIGTSLFDEEGAKIVKDLMSKAEKNGVKITLPVDFVTADKFDENAKTGQATVASGIPAGWMGLDCGPESSKKYAEAVTRAKQIVWNGPVGVFEWEAFARGTKALMDEVVKATSRGCITTIGGGDTATCCAKWNTEDKVSHVSTGGGASLELLEGKVLPGVDALSNI

SEQ ID NO: 10548 - DNA, 1536 bp, Mycoplasma mobile
  CDS (1)..(1536): transl_table=4
atgaaaaaaacactagatcaaattagtttaaaaaacaaaaaagttatcatcagagtagattttaatgttccaatcgtaaatggtattgttacatcaaataaaagaatagaagcagtaattcctacaattaaaaaagttgttaatgaaggtggtaaggccattcttatgtcacatttaggaagagtaaaatctgaagaagatcttaagaaaaaatctcttgcacctgttgtagaaatattagtaaatttattaggaatgcctatcacttttgtcccagctactaatggaacagaacttgaagaaacaattaatagcatgaaatcaggcgaaattgttatgatggaaaatactcgttttgaggatttaaataatgatgctgaatcatcaaacaatccagatttaggaatgtattgagcttctttaggagatgtttttattaatgatgcttttggaacagtgcatagaaaacatgcttcaaatgtcggaatttcaacatacattgctgaatcaggaattggatatttagttgaaaaagaaattaaaaatcttgacaaagctttatctaggccagaaagaccaattgttgctattttaggtggagcaaaagtttcagataaaattggagttttaaataatcttttaaaatacgttgataaaataattattggtggagctatggcttatacttttttagcggcacaaggaatcgggattgggaagtctttagtcgaggaagacaaaattgatttagcgagagaatatcttaaaaataatttagataaatttgttttacctattgattatgctttagcaaaagattttgaagatgtaaagccattttataatcttgaaaatactttagaaattccaaatggatatatgggattagacattggtcctaaatcaattgaagtatttaaaaaatatataaaagatgcaaaaacaattctttgaaatggacctttaggtgttactgaatttaaatactttaaagaaggaacaaaagctattgcaaaggcaatcacagaattaaaaggaaatgtttatactgttgtaggtggtggtgatagtgttgctattattgaagaacttggattagatagaagatttagtcacgtttcaacaggtggaggagcaacattagaatttctagaaggtaaagaattaccaggaattcaagcaattcaaaatgaaggtgagctaggacgtacaaaagaagaaattttttcaattctaactcagaattcagaagaagtattacatgaacacacagcagctttttctacaagtgaagttgagccagctaatgaagagtttccatcagaatataatgattcaaattcacaaacttatttttcaaatgaagttgaaaatgatgaagattttttgcttaatacaaacgattttccaacaagagaagcttcttttccaaatgaagttaaaacagaagaaattattttaaatgaaaatgatgatgaatttgatattgaagatgaagaattagattctttaccaaatgatgatattaaattttaa

SEQ ID NO: 10549 - protein, 511 aa, Mycoplasma mobile
MKKTLDQISLKNKKVIIRVDFNVPIVNGIVTSNKRIEAVIPTIKKVVNEGGKAILMSHLGRVKSEEDLKKKSLAPVVEILVNLLGMPITFVPATNGTELEETINSMKSGEIVMMENTRFEDLNNDAESSNNPDLGMYWASLGDVFINDAFGTVHRKHASNVGISTYIAESGIGYLVEKEIKNLDKALSRPERPIVAILGGAKVSDKIGVLNNLLKYVDKIIIGGAMAYTFLAAQGIGIGKSLVEEDKIDLAREYLKNNLDKFVLPIDYALAKDFEDVKPFYNLENTLEIPNGYMGLDIGPKSIEVFKKYIKDAKTILWNGPLGVTEFKYFKEGTKAIAKAITELKGNVYTVVGGGDSVAIIEELGLDRRFSHVSTGGGATLEFLEGKELPGIQAIQNEGELGRTKEEIFSILTQNSEEVLHEHTAAFSTSEVEPANEEFPSEYNDSNSQTYFSNEVENDEDFLLNTNDFPTREASFPNEVKTEEIILNENDDEFDIEDEELDSLPNDDIKF

SEQ ID NO: 10550 - DNA, 1245 bp, Picrophilus torridus
  CDS (1)..(1245)
atgaatggttcattctttacaatggacgatttcgatcttgatggtaaaagaatctatttaaggatagatataaattcccctgtaaaccctgaaaccggagaaattcttgatgattcacgcttcagggcatattcaaagaccataaatgagctgaaatcatcaaaggttgttatagtttcacaccagagccggcctggtaagaatgatttcacatcattaatgggtcatgccaggtacatgtcaaatataataaaaaaagagataaaatttattgattccctcttctcccatgatgccataaatgccatatcaaatatgtcagccggtgatataataatgcttgaaaattcaagattttacagcgaggagacattaaatgctgattttgaaactataaaaaacacacatatagtaagaaggctatcgccgctcttcgattattatgtaatcgatgcttttcctgcaatacacagggcccagacaacattaataggctttaagggctccggtccaaacatagctggaaggctgatggagcgtgagattacaatgcttgataaattcaaatttttcaggggctcgccaaaaattgcaattctggccggatcaaagatagaggattcaataaaggtctccagggcattcttaaaagataacatcgttgattacatattaaccggcggcgtggttgcaaatgcatttctttacgccggtggttttaacataggcagaaaaaacatggagtttataatcaagaataatgataattacgaatcattgattaacagtgcaacacagctcttacaaacatttcgcggcaggattttaatgcccgatgatttccttttgagtccatcgggcaggcatgtaacaataagcgaaagcataaacgatgatgagatcatagccgatataggctttaatactgttgataaatacagcaagataatatccagggcctccgcaatatttatgaatggcccaatgggaatctatgaaatacctgaatattcaataggaaccagggaaatatttaacattgttgccgagacccctgcactgaaaatagcgggtggcggccacacactgaatgcacttaatagcatgcatttaaccaaaaaactggattacacatcaacaggtggtggtgcattaataaattatttatcaggtgattcaattccagttatagatgctttaatagaaaataaaaggttatttgggggcaaatacaatggcaggtaa

SEQ ID NO: 10551 - protein, 414 aa, Picrophilus torridus
MNGSFFTMDDFDLDGKRIYLRIDINSPVNPETGEILDDSRFRAYSKTINELKSSKVVIVSHQSRPGKNDFTSLMGHARYMSNIIKKEIKFIDSLFSHDAINAISNMSAGDIIMLENSRFYSEETLNADFETIKNTHIVRRLSPLFDYYVIDAFPAIHRAQTTLIGFKGSGPNIAGRLMEREITMLDKFKFFRGSPKIAILAGSKIEDSIKVSRAFLKDNIVDYILTGGVVANAFLYAGGFNIGRKNMEFIIKNNDNYESLINSATQLLQTFRGRILMPDDFLLSPSGRHVTISESINDDEIIADIGFNTVDKYSKIISRASAIFMNGPMGIYEIPEYSIGTREIFNIVAETPALKIAGGGHTLNALNSMHLTKKLDYTSTGGGALINYLSGDSIPVIDALIENKRLFGGKYNGR

SEQ ID NO: 10552 - DNA, 1209 bp, Parachlamydia sp
  CDS (1)..(1209)
atgagggtgaaggataaattatcgattcgcgatttaaatttgaaagacaagaaagccttaattcgtgtcgattttaacgtccctttagaaaaaggtttgattacagatgatagtcgtattcaagcctctcttcccacaattcaatatgttttagatcaagaaggagccgttattttgatgagccatctcggtcgtcctaaaggtttgtttgattctaaattttcgttggctccttgtgctaaacgtttatcagaattattaaataagcctgtaaaaatggctgcagattgttgtggattagacgttgaacagatggttcgtcagctaaaatcaggagaagttttattgcttgaaaatttacgttttcacaaaggcgaagaaaggcctgatgatgaacctaattttacaagtgctttgtcagagttgggagatgtttatatcaatgatgcttttggaactgctcatcgtgctcatgcttcgacaacaaaaattgcaaaattttttcccaatcgtgcagcagcgggtttgttacttgaaaaggaaatttcttatctaggttgtgctttaacgaatcctaaacgtcctttttgtgcagtgttaggaggtgcaaaaatttccacaaagtttaaagtcatcgaagctttacagtctaaagcagatgttttattaatagggggagcgatggctttcacttttttcaaatctgaaggaatacctattggggattcgctttacgaaagcgaattcgttgctgtcgctcgtgaattgttaggtgttgagacacagtctcgctgccgccttttactacccatagacttggtcattgctaaaaaaatggatgaatccttcactgaaacgagaattatttcagttaaagaaggaattcctgatgggtatcaaggggtagatattgggccagacactattaaactttatcaagaagaattgaacagagcagctacgattttttggaacggccctttaggagtatttgaagttcctgctttttctaaagggactcaaactattgctcaaactcttgctgttgtcaacgcgattactattgttgggggaggggattccttagctgctatagaacaagctggggtttctaaacaaataaaccatctttcaactggagggggtgcctctttagaatatatagaatttgggcaattacctgggattgaagctctatcagataaataa

SEQ ID NO: 10553 - protein, 402 aa, Parachlamydia sp
MRVKDKLSIRDLNLKDKKALIRVDFNVPLEKGLITDDSRIQASLPTIQYVLDQEGAVILMSHLGRPKGLFDSKFSLAPCAKRLSELLNKPVKMAADCCGLDVEQMVRQLKSGEVLLLENLRFHKGEERPDDEPNFTSALSELGDVYINDAFGTAHRAHASTTKIAKFFPNRAAAGLLLEKEISYLGCALTNPKRPFCAVLGGAKISTKFKVIEALQSKADVLLIGGAMAFTFFKSEGIPIGDSLYESEFVAVARELLGVETQSRCRLLLPIDLVIAKKMDESFTETRIISVKEGIPDGYQGVDIGPDTIKLYQEELNRAATIFWNGPLGVFEVPAFSKGTQTIAQTLAVVNAITIVGGGDSLAAIEQAGVSKQINHLSTGGGASLEYIEFGQLPGIEALSDK

SEQ ID NO: 10554 - DNA, 1906 bp, Rattus norvegicus
  CDS (86)..(1339)
gggggcacgcttcaaaagcgcacgtctgctgcagtgttctcctcttcctctcctccgggcctctcgacctcacggtgttgccaaaatgtcgctttctaacaagctgactttggacaagctggacgtgaaggggaagcgggtcgtgatgagggtggacttcaatgttcctatgaagaacaaccagataacgaataaccaaaggatcaaggctgctgtcccaagcatcaaattctgcttggacaatggagccaagtcggttgtgcttatgagccacctgggccgtcctgatggtgtgcccatgcccgacaagtactccttagagccagttgctgcagaactcaaatctctgctgggcaaggatgttctgttcttgaaggattgtgtgggctcagaagtagagaatgcctgtgccaacccagcggctgggactgtcatcctcctggagaacctccgctttcatgtagaggaagaagggaagggaaaagatgcttctgggaacaaggttaaagctgagccagctaaaattgatgctttccgagcctccctgtccaaacttggagatgtctatgtcaatgatgcttttgggactgcacacagagcccacagttccatggtgggtgtgaatctgccacagaaggctggtggatttttgatgaagaaggagctgaactactttgccaaggctttggagagtccagagcgacccttcctggctatcttgggaggagctaaagttgcagacaagatccagctgatcaataatatgctagacaaagtcaatgagatgatcatcggtgggggaatggcttttaccttccttaaggtgctcaacaacatggagattggcacatctctgtatgatgaagagggagccaagattgtcaaagatctcatggccaaagctgagaaaaatggtgtgaagattaccttgcctgttgactttgtcactgctgacaaatttgatgagaatgcaaagactggccaagctactgtggcctctggtatacctgctggctggatgggcttggactgtggtactgagagcagtaagaaatatgctgaggctgtggctcgagctaagcagattgtttggaacggtcctgttggggtatttgaatgggaagcctttgccaggggaaccaagtccctcatggatgaggtggtgaaagccacgtctaggggctgcatcactatcataggaggcggagacaccgccacttgctgtgccaaatggaacacagaggataaagtcagccatgtgagcactgggggcggcgccagtctagagctcctggaaggtaaagtccttcctggggtggatgctctcagcaatgtttagtattttcctgcctttggttcctgtgcacagcccctaagtcgacctagtgttttccgcatctccatttggtgttagtgcagctagtggccaagacgcagcaccaggaaccctaagcagctgcacagcatctcagctcgtctttactgcatcgggattcatctactacgttcaagatcccatttaaattccttagtgactaaaaccattgtgcattgtagagggcatctatttatactctgcctgtgaaaggaagtgagctgtaaaagcttagctctcttcgctgtatgtagcctctggttagctttgtcactgttcatgacagcatggaaataacggtgagattccagctgtaggtttggagttgatctattgaacaataaagatgcccactgaaactgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccaaaaaaaaaaaaaaaaaaaaaaaaaaaaa

SEQ ID NO: 10555 - protein, 417 aa, Rattus norvegicus
MSLSNKLTLDKLDVKGKRVVMRVDFNVPMKNNQITNNQRIKAAVPSIKFCLDNGAKSVVLMSHLGRPDGVPMPDKYSLEPVAAELKSLLGKDVLFLKDCVGSEVENACANPAAGTVILLENLRFHVEEEGKGKDASGNKVKAEPAKIDAFRASLSKLGDVYVNDAFGTAHRAHSSMVGVNLPQKAGGFLMKKELNYFAKALESPERPFLAILGGAKVADKIQLINNMLDKVNEMIIGGGMAFTFLKVLNNMEIGTSLYDEEGAKIVKDLMAKAEKNGVKITLPVDFVTADKFDENAKTGQATVASGIPAGWMGLDCGTESSKKYAEAVARAKQIVWNGPVGVFEWEAFARGTKSLMDEVVKATSRGCITIIGGGDTATCCAKWNTEDKVSHVSTGGGASLELLEGKVLPGVDALSNV

SEQ ID NO: 10556 - DNA, 1613 bp, Mus musculus
  CDS (66)..(1319)
gttaaaaatcaccaccaagccagcctcccagcagcagtaaagaggctgttgtgcataccatcaagatggctctttctgctaagttgactctggacaaagtggatcttaagggaaaaagagtaatcatgagagtagacttcaacgttcccatgaagaataaccaaattacaaacaaccagagaatcaaggctgccatcccaagtatcaagcactgtctggacaatggagccaagtccgtagttctcatgagtcacctcggtcggcctgatggtatccctatgccagacaagtattcattagagcctgttgctgatgagctcaagtccctgctgaacaaggacgtcatattcttgaaggactgtgtgggccctgaagtagagcaagcctgtgccaacccagataatgggtctatcatcctgctggagaacctgcgcttccatgtggaggaagaaggtaagggtaaagattcttctggaaaaaagattagtgctgaccctgctaaagtagaagccttccaagcatcactgtctaaacttggcgatgtctatgtcaacgatgcatttggcactgcacatcgggctcacagttctacggtcggagtaaatttgccccagaaggcatctggtttccttatgaagaaggaactggattatttttccaaggctttagaaaagccagagaggcccttcctggctatccttggtggagccaaagtgaaagacaagatccaactcattaaaaatatgttagacaaagtcaatttcatgattattggtggtggaatggcttacaccttcctgaaagaactcaagaacatgcagattggtgcttccttgtttgatgaagagggagccacgattgttaaagagatcatggaaaaagcagaaaagaatggtgtaaagatagtttttcctgttgactttgttactggtgacaagtttgatgagaatgctaaagttggacaagccactatagaatctggtataccatctggttggatgggcttggactgtggccctgagagcattaaaatcaatgctcaaattgtggcccaagcaaagctgatagtttggaatggacctattggggtatttgaatgggatgcctttgctaaaggaaccaaagctctcatggatgaagttgtaaaggccacctccaatggctgtgtcaccattataggaggcggagatactgctacttgctgcgccaaatggggcactgaagacaaggtcagccatgtgagcacaggaggtggggcaagtcttgagcttctggaaggtaaaatccttccaggggtagaggccctcagcaacatgtaattgtcataatgtacttgcttcctgtttcctgcgcacaggaccagaaccaactcaacctaacctatatctcaacatttgttaacctctactatgaatcaagacccaggtaatgagctagcagtgagccatcaatatcacatcagcaagtcttaattctgtcacacatttgttagtctcttcaagatctcatcaggatttcccacagtccttcctagggaggaaacattctcatgtcaactattaaagaagtgagctaagtaagttaaaaaaaaaaaaaaaaaaaaaaaaaaaaaa

SEQ ID NO: 10557 - protein, 417 aa, Mus musculus
MALSAKLTLDKVDLKGKRVIMRVDFNVPMKNNQITNNQRIKAAIPSIKHCLDNGAKSVVLMSHLGRPDGIPMPDKYSLEPVADELKSLLNKDVIFLKDCVGPEVEQACANPDNGSIILLENLRFHVEEEGKGKDSSGKKISADPAKVEAFQASLSKLGDVYVNDAFGTAHRAHSSTVGVNLPQKASGFLMKKELDYFSKALEKPERPFLAILGGAKVKDKIQLIKNMLDKVNFMIIGGGMAYTFLKELKNMQIGASLFDEEGATIVKEIMEKAEKNGVKIVFPVDFVTGDKFDENAKVGQATIESGIPSGWMGLDCGPESIKINAQIVAQAKLIVWNGPIGVFEWDAFAKGTKALMDEVVKATSNGCVTIIGGGDTATCCAKWGTEDKVSHVSTGGGASLELLEGKILPGVEALSNM

SEQ ID NO: 10558 - DNA, 1665 bp, Sus scrofa
  CDS (124)..(1377)
aagataggggcgggccaagaggaagggcgttaggaaacgccatccgcgcaacatcgcagcagcagtgaagtggttccctgcaacatcgggatctaagtgttagcctgtcttcgtattgtcaaaatgtctctttctaagaagttaactttggacaaactggacgtgaaagggaaacgagtcatcatgagagtagacttcaatgttcccatgaagaggaaccaagttacaaacaaccaaagaatcaaggcttccctcccaagcatcagatactgcctagataacggagccaggtcagtagttctcatgagtcatttaggtagacctgatggtgttgcgatgcctgataaatactccttagagccggtggctgctgaactcaaatccttgctggggaaagacgttctgttcctaaaagactgtgtgggctcagaagcagagcaagcttgtgccaacccacctgcgggttcagtcatcctactggagaaccttcgctttcatgtggaagaggaagggaagggccaagatccttctgggaataagctgaaagctgagccagataaagtagaagccttccgcgcatcgctctccaagctgggggatgtgtatgtcaatgatgcttttggcacggctcaccgggctcacagttccatggtgggagtgaatctgccgcagaaggcatctggattcctgatgaaaaaggagctggattactttgccaaagccttggaaaacccagagagaccctttctggctatccttggtggagctaaagtggcagacaagatccaactcatcaaaaatatgctggacaaagtcaatgagatgattattggtggcggaatggcctttaccttccttaaggtactcaacaacatggagattggtgcctccctgttcgacaaagagggagccacgattgtcaaagagatcatggccaaagctgaaaagaatagggtgaacattacctttcctgttgactttgtcattgctgacaagtttgaggaaaatgctaaggttggccaggccacggtagcgtcaggtatacctgccggctgggtggctttggactgtggtcctgagaccaacaagaagtatgcacaagttgtggcccgagccaagctaattgtgtggaatggacctttaggggtctttgaatgggatgcctttgctaatggaacgaaagccctcatggatgaaattgtgaaagccacctccaagggctgtatcactattataggaggtggagacacggccacttgctgtgccaaatggaacactgaagataaagtcagtcatgtgagcactggaggaggtgccagtctagagcttctggaaggtaaagtccttcctggagtggaggctctcagcaatctgtagttgatagtgttccttcctactgttttctgtgcacagcctttaagtcaacttagtgcttttacatctcaacttgacttttgttaaaatctacccctccatcaagactcaggcaaagaccaaggaatgggccatcaggaactcttaacatcagcttaacagtacaactcatttttgttctgtgatgcatttgcctactgtcttaaagatctcatttgaacttcactgttgtaattcatagaaagtgagctgcctattaaagtgaattgaataagctgaaaaaaaaaaaaa

SEQ ID NO: 10559 - protein, 417 aa, Sus scrofa
MSLSKKLTLDKLDVKGKRVIMRVDFNVPMKRNQVTNNQRIKASLPSIRYCLDNGARSVVLMSHLGRPDGVAMPDKYSLEPVAAELKSLLGKDVLFLKDCVGSEAEQACANPPAGSVILLENLRFHVEEEGKGQDPSGNKLKAEPDKVEAFRASLSKLGDVYVNDAFGTAHRAHSSMVGVNLPQKASGFLMKKELDYFAKALENPERPFLAILGGAKVADKIQLIKNMLDKVNEMIIGGGMAFTFLKVLNNMEIGASLFDKEGATIVKEIMAKAEKNRVNITFPVDFVIADKFEENAKVGQATVASGIPAGWVALDCGPETNKKYAQVVARAKLIVWNGPLGVFEWDAFANGTKALMDEIVKATSKGCITIIGGGDTATCCAKWNTEDKVSHVSTGGGASLELLEGKVLPGVEALSNL

SEQ ID NO: 10560 - DNA, 1221 bp, uncultured bacterium 106
  CDS (1)..(1221)
atggataaaatgggtatgaccgaaaaaaattttattgaagatttaaatcttaatggattgcgtgtcttgacacgtgttgattttaatgtacccctcaacaaagatttgcaaattactgacaatgggagaattgaggccgctttgacgaccattcggtacatcgttgaacaaagaggaaaagcgatcttgatgtcgcacttgggccgtccgggtggagagcgggtcgagagcctgagcctaaaaccggccgcggaagagttgtcactgttgctcgggcagcctgtaacctttgctaaagattgtattggtgaagaggttgaggctctgattgaagggatgcaaaacggagaagtacttttgctggaaaatttgcgttttcataaagcagaaacgaaaaatgagcctgagttttgcggagcattgggcaaactgggagatgtttatgttaatgatgcttttggaacggcacatcgggcccatgcttctactgccggagttacaggatttattccggaatccgccgtcggatatttgattcgtaaagaactgcagtttcttggtggagcagttatgaatcctgcaagaccttttactgcaattttaggaggcgctaaagtatccgataaaattaaagttatcgacaaattgttaaacaaagttcaaactttaataatcggaggaggaatgtcatgcacttttttgaaagctcaaggttacaaaattggcgcttccctgttggaagaagactccttggatttcgcaaaagaactgatacagaaggcacaggagaaaggtgttgaactcctgttgcccgtggatgcggtaattgcagacagttttgacaaaagtgcttcaacccgaagcgtttctgtagaagagggtgcttcggatggttggcttattttggacattggtccaaaaagtgctgaaatattttgcgactccgtacgtaaatcaggaactgttctttggaatggccctatgggggtttttgagatggaaccctttgctctgggaacattcgcaattgcacaatgtcttgcggaagtgactgacaaaggtgttgtgacaattattggaggcggagattccgcggcagcgatacaacaatttggactcagtgaacggatcactcatgtctcaaccggaggtggtgcgtcacttgaatttttggaaggcaaagaacttccgggagtgaccgcaattcagcaatctaaataa

SEQ ID NO: 10561 - protein, 406 aa, uncultured bacterium 106
MDKMGMTEKNFIEDLNLNGLRVLTRVDFNVPLNKDLQITDNGRIEAALTTIRYIVEQRGKAILMSHLGRPGGERVESLSLKPAAEELSLLLGQPVTFAKDCIGEEVEALIEGMQNGEVLLLENLRFHKAETKNEPEFCGALGKLGDVYVNDAFGTAHRAHASTAGVTGFIPESAVGYLIRKELQFLGGAVMNPARPFTAILGGAKVSDKIKVIDKLLNKVQTLIIGGGMSCTFLKAQGYKIGASLLEEDSLDFAKELIQKAQEKGVELLLPVDAVIADSFDKSASTRSVSVEEGASDGWLILDIGPKSAEIFCDSVRKSGTVLWNGPMGVFEMEPFALGTFAIAQCLAEVTDKGVVTIIGGGDSAAAIQQFGLSERITHVSTGGGASLEFLEGKELPGVTAIQQSK

SEQ ID NO: 10562 - DNA, 1965 bp, Geobacter sulfurreducens
  CDS (1)..(1965)
atggcaatccgctatattgacgaaatatccgaactcaaagacaaaaaggtcttcatcagggtcgacttcaacgttcccttggatgaacatcagaacatcactgaagacacgcgcatcagggcggtcctccctacgatcaactttgccctcgatgccggcgcgaaagtggttctcgcctctcacctgggacgcccaaagggagagcgcaagcccaagtattccatggccccggcggcaaagcgtctctcgcggcttctgggcaaagaggtactcttggcgcccgactgcatcggcagcgaagtacggcagatgatcgatgccatgaaatccggcgacatcatcatgctggaaaacgtgcgcttttatgaaggtgaggagaaaaatgacgaaaactttgcccgagaactggccaacggctgtgagatctacgtaaacgatgcctttgccgtctcacaccgggctcatgcgtcggttgaagcgataacaaagttctttccggtagttgcggccggatttctcatgaagaacgagatgaattatttcgaaaaggcgatgcaaaagccgattcgccccctggtcgctatcttgggcggggccaaagtctcgggcaaactggaagttctcgaaagccttctcaacaaggtggacaaaatcatcatcggcggcggcatggcattcacctttctgaaggccctcggctacaacgtgggcaagtcgctggtggaggaagacctgatcgaaacggcccgctcaacctacgccaaagcccgtgaaaagggaatcaagttctatctccccgttgattgcgtggctgccgatcgattcaaccccgaggccgagaccaaggtaaccaccattcaggaaatccccgaagagtggatggctctcgatatcggtcctgccacggttgccctcttcaccgaggcactccagagcgccaagaccatcatctggaacggtcccatgggggttttcgagatggatgccttctcccgcggcacctttgccatggtgactgccgtggccaactcctacgcccttaccatcgtcggcggcggcgacaccgactctgcggtccaccgcgccggcgaatatgccaagatcagctacatctccaccggcggcggcgctttccttgagctcctcgaaggcaagaaacttccccggcatcaaggtgctggaagaaaacggaaaataggaggagcggccatgagaacacctgtgattgcaggaaactggaagctgttcaaaaaacgcgccgaggcccgtgagctggtcaatggacttgtttccctggtgaaggacgtccagggggtcgaaatcgtcgtagctccggtcttcaccgtactggccgccgtaaagggcgccctggacggctcagccatcaagctcgctggccaggactgcttctgggaagaggaaggggcttacaccggcgagatttccccgggcatgctcgtggatgccggatgcagccacgtcattatcggccattcggagcgccgtcagtatttcggcgaaactgatgaaaccgtgaatcgtaagatcaaggccgccctcaaagcaggactcgcggccattgcctgcatcggagaatccctggcagagcgcgaagcaggcacgacgttcgacgtgctgcggacgcagctgaacggcggactggccgggctatccgccgacgacctcaaagacgtcatcatcgcctatgagccggtatgggccataggcaccggaaaaaccgccacggacgcccaagcccaggaggctcacgccttcatcagaggggtggtgtccgaacttctcggcaaaccggcagcagaggcggttcgcatcctttacgggggcagcgtaaagccagagaacatcaaggggctcatgacccaacccgatatcgacggcgccctggtgggaggagccagcctcaaggcggactcttttgcggcgattgcctcgttcagcatgtaa

SEQ ID NO: 10563 - protein, 654 aa, Geobacter sulfurreducens
MAIRYIDEISELKDKKVFIRVDFNVPLDEHQNITEDTRIRAVLPTINFALDAGAKVVLASHLGRPKGERKPKYSMAPAAKRLSRLLGKEVLLAPDCIGSEVRQMIDAMKSGDIIMLENVRFYEGEEKNDENFARELANGCEIYVNDAFAVSHRAHASVEAITKFFPVVAAGFLMKNEMNYFEKAMQKPIRPLVAILGGAKVSGKLEVLESLLNKVDKIIIGGGMAFTFLKALGYNVGKSLVEEDLIETARSTYAKAREKGIKFYLPVDCVAADRFNPEAETKVTTIQEIPEEWMALDIGPATVALFTEALQSAKTIIWNGPMGVFEMDAFSRGTFAMVTAVANSYALTIVGGGDTDSAVHRAGEYAKISYISTGGGAFLELLEGKKLPRHQGAGRKRKIGGAAMRTPVIAGNWKLFKKRAEARELVNGLVSLVKDVQGVEIVVAPVFTVLAAVKGALDGSAIKLAGQDCFWEEEGAYTGEISPGMLVDAGCSHVIIGHSERRQYFGETDETVNRKIKAALKAGLAAIACIGESLAEREAGTTFDVLRTQLNGGLAGLSADDLKDVIIAYEPVWAIGTGKTATDAQAQEAHAFIRGVVSELLGKPAAEAVRILYGGSVKPENIKGLMTQPDIDGALVGGASLKADSFAAIASFSM

SEQ ID NO: 10564 - DNA, 1344 bp, Ashbya gossypii
  CDS (1)..(1344)
atgggccggtcgtggggtctgctctggatggcgtgcttgctgtacggcgtgttcacagagtgtcgcagatcttcacagcacgcacacacaggaaaaatgtcgctatcctctaagctaacagtcaaggacctgagccttgcgggcaaacgcgtgttcatccgcgtggacttcaacgtgccgctagacgggaagacgatcacgtcgaaccagcgcattgtggccgcgctacccacgatcaagtacgtgttggagcagggccccaaggcggtggtgttggcgtcgcacctagggcggcccaacggcgagcgcaacgagaagtactcgttggcgccggtggccgcggagctggagaagctgctgggccagaaggtgaactcctggacactgcgtgggcagcacgtgaccgctgcggtcaacggcgcggctgcggggtccgtgttcctgcttgagaacctgcggttccacatcgaggaggagggctcgcgcaaggtggacggcgagaaggtcaaggcgtctgcggaggacgtgcagaagttccgccagggcctcatgtcgctcgcggacgtctacgtcaacgacgccttcggcaccgcgcacagagcgcactcctcgatggtcggcttcgagctgcctgagagggccggcggcttcttgttgtcgcgcgagctggagtacttcagcaaggcgttggagaaccctacgagacccttcttggcgatcctgggcggtgccaaggttgccgacaagatccagttgatcgacaacttgttggacaaggtcgactcgattgtgatcggcggtggcatggccttcaccttcaagaaggtgcttgagaacatggagatcggtaactccatctacgacaaggcgggtgccgagatcgttcctaagctagcggagaaggccaagaagaacggcgtcaagatcgtgttgcctgtggacttcgtgatcggcgacgacttctcccaggacgccaacaccaagattgtctctgcctccgagggcattccatccggctgggagggtctagactgtggtcctgagtccagaaagctgttcagcgagaccatcgcgagcgcgaagaccatcgtgtggaacggcccaccaggtgtctttgagattccaaagttctccgagggtacccaggccatgcttgcggccgctgtcaaggcctccgaggctggcagcaccgtcatcatcggcggtggtgacaccgctaccgtggccaagaagtacggtgtggtcgagaagatctcccatgtgtccaccggtggtggtgcctccctagagctattggagggtaaggacctaccaggtgtcaccttcttgtccagcaagcagtag

SEQ ID NO: 10565 - protein, 447 aa, Ashbya gossypii
MGRSWGLLWMACLLYGVFTECRRSSQHAHTGKMSLSSKLTVKDLSLAGKRVFIRVDFNVPLDGKTITSNQRIVAALPTIKYVLEQGPKAVVLASHLGRPNGERNEKYSLAPVAAELEKLLGQKVNSWTLRGQHVTAAVNGAAAGSVFLLENLRFHIEEEGSRKVDGEKVKASAEDVQKFRQGLMSLADVYVNDAFGTAHRAHSSMVGFELPERAGGFLLSRELEYFSKALENPTRPFLAILGGAKVADKIQLIDNLLDKVDSIVIGGGMAFTFKKVLENMEIGNSIYDKAGAEIVPKLAEKAKKNGVKIVLPVDFVIGDDFSQDANTKIVSASEGIPSGWEGLDCGPESRKLFSETIASAKTIVWNGPPGVFEIPKFSEGTQAMLAAAVKASEAGSTVIIGGGDTATVAKKYGVVEKISHVSTGGGASLELLEGKDLPGVTFLSSKQ

SEQ ID NO: 10566 - DNA, 1230 bp, Giardia lamblia ATCC 50803
  CDS (1)..(1230)
atgtccttagcgaagctctccattgccgacgtagatctctctggaaagcgtgttttcgtgcgcacggattacaatgtcccccaggacaaggagggtaacatcaccaatttggcgagaatcgaggcttctttgccgaccttgaggcactgtcttgagaagggctgtaagtcccttgtcttggcctcccatcttggccgcccaaagggcaccggaccagaagcggcattcactctggctccagtcgccaaggctctcgaaagccttctgggaaagcctgtcacccttcttaaggattgctgtggacccgaggttgagagtgcctgtgccaaccctgcgcctggttccattttcctcttggagaatctgcgctttcataaggaggagaccaacgagaatgaggacaattctgaagtaaaggctttcagagcgtctctcgcgaagctcgctgacatctactgtaatgatgcattcggaaccgcgcaccgccctcactcttctatggtcggagaagggtattcgatccgttgcgctggcttcctgatgcagaaggagatcgactacttccgtatcgccctttctgagcccaagaagccatacttggctattcttggaggcgctaaggtagcagacaaaatcaagctcatcaagaacctacttccgaaggtcgacaagattatcatctgcggtggcatgtcgtttaccttcctcaagaagctcaaggggatgaacatcgcgaactcgctttacgacaaagagggtgcagagactgttgacacattgatggacatcgccaaggctcacaatgtggaagtgattcttcctgtcgattgcatcgcggcctcggagtttgacgacaacgccaagacgaaggttgttacatgcgaggagggtattcctgaaggttggatgggccttgattgtggccctgcctccaacgagctctttgcgaaggccatcatgtcttcaaagacagtcatctggaatggtccaccgggcgtctttgagatgaacagcttctgccgtggaaccatggccatggtagatgcagtggttaaggctactgaggcaggcgccatcaccattatcggtggcggagactctgcaactgcagccaaaaaggccaaagcaacgaacaagatctcccacgttagtaccggaggtggcgcgtctctcgagcttcttcagggcgacccgcttcctggagtcatcagactgtctgacaagaagtag

SEQ ID NO: 10567 - protein, 409 aa, Giardia lamblia ATCC 50803
MSLAKLSIADVDLSGKRVFVRTDYNVPQDKEGNITNLARIEASLPTLRHCLEKGCKSLVLASHLGRPKGTGPEAAFTLAPVAKALESLLGKPVTLLKDCCGPEVESACANPAPGSIFLLENLRFHKEETNENEDNSEVKAFRASLAKLADIYCNDAFGTAHRPHSSMVGEGYSIRCAGFLMQKEIDYFRIALSEPKKPYLAILGGAKVADKIKLIKNLLPKVDKIIICGGMSFTFLKKLKGMNIANSLYDKEGAETVDTLMDIAKAHNVEVILPVDCIAASEFDDNAKTKVVTCEEGIPEGWMGLDCGPASNELFAKAIMSSKTVIWNGPPGVFEMNSFCRGTMAMVDAVVKATEAGAITIIGGGDSATAAKKAKATNKISHVSTGGGASLELLQGDPLPGVIRLSDKK

SEQ ID NO: 10568 - DNA, 1251 bp, Plasmodium yoelii yoelii
  CDS (1)..(1251)
atgttaggaaacaaacttacaatatctgatatccccagtgtcaaaaacaaaaaggttttagtaagagcagattataatgtacctattgaaaatggggaagtaaaagataacacaagaattgttgcaacattaccaactattaattatttaaaaaaagaaggtgcttcaaaaataattttaatttcacattgtggtagaccagatggaatcaaaaatttaaaatatacattaaagccagtagctgatgttttatcaaaattattaggagagaatgtattatttttaaatgattgtgttggagatgatatagaaaaagaaataaataatgctaaagaacaatctattattttattagaaaacttaagatttcatattgaagaagaaggtaagggtgttgatgctgcagggaataaaataaaagcaaataaagaagatgttgaaaaatttcaaaatcaacttacaaaattaggagatgtatttattaatgatgcatttggaacagcacatcgtgcacatagtagtatggttggaatcaaattaaatgttaaagcatctggatttttaatgaaaaaagaattagaatattttagtaaagctttagaaaacccacaaagacctgtattagctattttaggtggtgcaaaagtatcagataaaattcaattaatcaaaaatttattagataaagttgatagaatgattattggtggtggtatggcatatacttttaaacgtgttttaaaaaatatggaaattggagattctttgtttgatgaggcaggaagtaaaattgtaaatgaaattatggagaaagcaaaaagtaaaaatgtacaaatttgtttaccaatagattttaaaattgctgataaatttgataataatgcaaatacaaaatttgtaacagatgaagaaggaatacctgataaatggatgggattagatgctggacctaaaagtattgaaagttataaagatgttattttaggctctaaaactattatatggaatggtccacaaggtgtttttgaaatggaaaattttgctaaaggaagtatacaatgtcttgaattagttattcaagcaacacaaaatggagctattacaattgtaggaggaggcgatacagcttctttagtagaacaacaaaaaaagaaagatcaaattagccacgtttcaactggtggtggagcatctctcgaattattagaaggaaaggagttacctggtgttgtagctttatcaaacaaataa

SEQ ID NO: 10569 - protein, 416 aa, Plasmodium yoelii yoelii
MLGNKLTISDIPSVKNKKVLVRADYNVPIENGEVKDNTRIVATLPTINYLKKEGASKIILISHCGRPDGIKNLKYTLKPVADVLSKLLGENVLFLNDCVGDDIEKEINNAKEQSIILLENLRFHIEEEGKGVDAAGNKIKANKEDVEKFQNQLTKLGDVFINDAFGTAHRAHSSMVGIKLNVKASGFLMKKELEYFSKALENPQRPVLAILGGAKVSDKIQLIKNLLDKVDRMIIGGGMAYTFKRVLKNMEIGDSLFDEAGSKIVNEIMEKAKSKNVQICLPIDFKIADKFDNNANTKFVTDEEGIPDKWMGLDAGPKSIESYKDVILGSKTIIWNGPQGVFEMENFAKGSIQCLELVIQATQNGAITIVGGGDTASLVEQQKKKDQISHVSTGGGASLELLEGKELPGVVALSNK

SEQ ID NO: 10570 - DNA, 1188 bp, Fritschea bemisiae
  CDS (1)..(1188)
atggataaactctctttgagagatttgaagctcaaccaaaaaagggtgctgatgcgggtcgattttaatgttcccttaaatgcagatggttcgattcgagatgcgacgcggatcattttaacccttccttcaattgaatatattttaaggcaaaaggggcgtttggttttaatcagccatttgggtcgacctaaggggtcttttgactcaaaggtttcattaaggccttgcgcgcaaaaattgggtgagcttctcgggaaagaggtcggattttgcttcgattgtattggagctgaagttcaaaaaagggttcaaaacttaaaccctggggaggttcttcttttagaaaaccttcggtttcacaaaggagaagagtctcctgaaaaagatccagggtttgcacaatctcttgctgagctcggggatgtttacattaatgacgcttttggagccgcccatcgctcgcacgcttcaatcgttccgattgcgcaattttttccagcaaattgtggggtaggatttttaatggaaaaagaaattgctgcattttcaaaaatatatttaaatccaaaccgtccgttctatgcaatggttggaggggccaaaattgggaataaaatagatattttacaggccctttctaaaagagtcgatggattgtttattggagggggaatggcttttaccttttttaaggcaaaagggcttgcaattggagagtccatttgcgatgaaagccggttaaaatttgctcgtgactttttgaaagagtgtgaaaggaaagggattcggctccaccttcccatagatgttgtggtgacaaatgggaaaaagattcaaacagttcaaataaaaggcggtgttcccgataaatgggaggggaaagatattgggcctcaaacagttgagctgtggtcgaaagagctcaatcgaggagctacccttttttggaatgggccgatgggggtttttgaggaaagggcgtttgcctcgggaacggagcggctggcgcactttttatccgaagtgcctggagatgtcacgatagggggaggggacttagttgccgctgtccaatctctgaatctggaaaaaaaattgagccacgtttcctcgggaggaggcgcctctttggaatttttagccaatggaaccttgcctggagtggaggcccttagtaataaataa

SEQ ID NO: 10571 - protein, 395 aa, Fritschea bemisiae
MDKLSLRDLKLNQKRVLMRVDFNVPLNADGSIRDATRIILTLPSIEYILRQKGRLVLISHLGRPKGSFDSKVSLRPCAQKLGELLGKEVGFCFDCIGAEVQKRVQNLNPGEVLLLENLRFHKGEESPEKDPGFAQSLAELGDVYINDAFGAAHRSHASIVPIAQFFPANCGVGFLMEKEIAAFSKIYLNPNRPFYAMVGGAKIGNKIDILQALSKRVDGLFIGGGMAFTFFKAKGLAIGESICDESRLKFARDFLKECERKGIRLHLPIDVVVTNGKKIQTVQIKGGVPDKWEGKDIGPQTVELWSKELNRGATLFWNGPMGVFEERAFASGTERLAHFLSEVPGDVTIGGGDLVAAVQSLNLEKKLSHVSSGGGASLEFLANGTLPGVEALSNK

SEQ ID NO: 10572 - DNA, 1680 bp, Chlorarachnion sp
  CDS (53)..(1513)
caacgccatcgttgatctcgagacccaggttgcgcccaagcgctcctccaacatgctcgtcaaggcactctctgtgtctgccgttgctctctccatggttctttgctaccaggcagtatccatggcaaatcagcaagttgctgtcgagcctctcgttggaggtgggttctccatggcaggtgtccgccctgtttcccgcatggctgttgctcctatgcactccgtttctcctatgaacgttggccgcttctccaagccttctgttaccaagttctctgcagtctcccgccctcagcagcttaaggttaacgttgaaaagaagatgtctgttggtgacttgaagaaggaagagctcgacggaaaggttgctctcgttcgttgcgacctcaacgttcctcttgacggaaagaccatcactgatgacacccgtatccgcgcttccatcccaaccatcaagcacctggttgagagcggcgctaaggttctccttacctcccaccttggacgtcctaaagacggacctgaggataagttctccctcgctcctgtcgctgctcgtctttccgagctcctcggacaggacgtgaccttcgtcaaggactgcattggagagcctgtcaaggaggctgttgccaccatgacacctggatccgtcgctctcctcgagaacgttcgtttctacaaggaagagaccaagaacgaaccagagttcgctaagaagctcgctgctaacgctgacctcttcgtgaacgatgctttcggaaccgctcaccgtgctcacggatccaccgagggagtaccgctcacctcaagccttccgtcgctggattccttcttcagaaggagctcgactaccttcaggcgctgtgcagaacctgctcgtcctttcgctgctatcgttggtggatccaaggtttcctccaagatcggtgttatcgagtccctcctcgagaaggttgacaagctcgtcatcggaggcggtatggttttcaccttcctcaaggctcgcggcctcgaagtaggaagctccctcgtcgaggaggacaagctcgagctcgctaaggaccttgagcgcatcgcaaaggagaagggcgttgaactcatcctccctaccgacgttgtcctcgctgatgcattcgccaaggatgctaacacccaggtcgctgatgctaccgcaatccctgagggatggatgggacttgaccaggggcctaaggctaccgaggagatcattgctgctctcaaggactgcaagactgttatctggaacggacctatgggtgtcttcgaattcgaggcgttctccaagggaaccttcggagttgctgacgctctcgctgatctcaccaagggaggcgcaaccaccatcatcggcggaggagactccgttgctgctgtagagcaggctggccttgctgaccagatgtcccacatctctaccggaggtggagcttccctcgagctcctcgaaggaaaggtccttcctggagttgctgcccttaacgcagcttaaacagtccatgtaccttattacctcgcgcgtgatgaagcttccaattaagagccgcacgagaacccatgttacgcatgagcgtttgtgtatgccaaagaagttgattctaagcgagattattaatctttaattaaaaaaatcaaaagaaaaaaaaaaaaaaaaaaaaa

SEQ ID NO: 10573 - protein, 486 aa, Chlorarachnion sp
MLVKALSVSAVALSMVLCYQAVSMANQQVAVEPLVGGGFSMAGVRPVSRMAVAPMHSVSPMNVGRFSKPSVTKFSAVSRPQQLKVNVEKKMSVGDLKKEELDGKVALVRCDLNVPLDGKTITDDTRIRASIPTIKHLVESGAKVLLTSHLGRPKDGPEDKFSLAPVAARLSELLGQDVTFVKDCIGEPVKEAVATMTPGSVALLENVRFYKEETKNEPEFAKKLAANADLFVNDAFGTAHRAHGSTEGVPLTSSLPSLDSFFRRSSTTFRRCAEPARPFAAIVGGSKVSSKIGVIESLLEKVDKLVIGGGMVFTFLKARGLEVGSSLVEEDKLELAKDLERIAKEKGVELILPTDVVLADAFAKDANTQVADATAIPEGWMGLDQGPKATEEIIAALKDCKTVIWNGPMGVFEFEAFSKGTFGVADALADLTKGGATTIIGGGDSVAAVEQAGLADQMSHISTGGGASLELLEGKVLPGVAALNAA

SEQ ID NO: 10574 - DNA, 1463 bp, Schistosoma japonicum
  CDS (5)..(1267)
cgtgatgggtttgtcgaagcttagtatctccgatgtagatttaaaggataaacttggcttactcctaatgctttgtagggttgattttaacgtccctatgaaagatggaaaagtcactaatacccaacggattgcagctgctataccaactattaaatatgccttggataagggagctaaaagcgtagtcctgatgtctcacttaggtagacctgatgggtataaagttgaaaaatattcgctgaaacccgtttgctctgaagtttccaagttgttaggcaaagaagttactttccttagtgactgtgttggtcctgatgtcattagtgcgtgttctaatcctgctcctggcagcgtcttcttacttgagaatttacgctttcatatagaagagaaaggaaaaggtgtctcaccatctgaagataaaacaaaggccactgctgatcaaatcaaagctttcagtgaaagtttaacaaaacttggggatgtttatgtcaatgatgccttcggaacagcacatcgtgctcatgcctctatggtcggctgccaattgccacaaaaagcttgtggatttctcatgaataaagagttgacatatttcgctaaagctctggaaaatcctgaacgtcctttcttagctattttgggcggcgctaaggttagcgataagatccagttgatcaataatatgctggacaaggttaacgaattgatcattgggggcggcatggcgtatactttccttaagcaaatacacaatatgcatataggagctagtttatttgacgcaccaggtgcagaaattgttcagaaggtaatggaaactgcaaaggctaaacacgtggcaattcacttacctgttgattttgtaactgctgataaatttgctgaagatgctaacaccggaacagcaactatagaatctggaattccagatggttggatggggctggatattggtccgaaaaccatagaggaattccgtaaagtgataagtcgtgccaaaacaatagtttggaatggtccgatgggtgtttttgaaatggataagtttgctgcagggacaaaagcagcaatggatgcggtagttgaagctactaaaaacggtgctacaactattattggtggcggtgatacagcgacttgttgtgccaagtggaacacagaagataaagtcagtcatgtcagtaccggtggtggtgctagccttgaacttttagaaggtaaacaactgccaggagtcgttgcacttacggatgctcactaatctatcagactatgatttcctagttaattgtcattagtactcctcttactttcataatgttcaaattatttacttggtattataacacgtttgatttgtcgtatatttttctctacctaatttcaatacgtgtagatctatttctgccatatgtgcattttcaggcaataaaaactcatagatttttgcacattta

SEQ ID NO: 10575 - protein, 420 aa, Schistosoma japonicum
MGLSKLSISDVDLKDKLGLLLMLCRVDFNVPMKDGKVTNTQRIAAAIPTIKYALDKGAKSVVLMSHLGRPDGYKVEKYSLKPVCSEVSKLLGKEVTFLSDCVGPDVISACSNPAPGSVFLLENLRFHIEEKGKGVSPSEDKTKATADQIKAFSESLTKLGDVYVNDAFGTAHRAHASMVGCQLPQKACGFLMNKELTYFAKALENPERPFLAILGGAKVSDKIQLINNMLDKVNELIIGGGMAYTFLKQIHNMHIGASLFDAPGAEIVQKVMETAKAKHVAIHLPVDFVTADKFAEDANTGTATIESGIPDGWMGLDIGPKTIEEFRKVISRAKTIVWNGPMGVFEMDKFAAGTKAAMDAVVEATKNGATTIIGGGDTATCCAKWNTEDKVSHVSTGGGASLELLEGKQLPGVVALTDAH

SEQ ID NO: 10576 - DNA, 1251 bp, Pichia pastoris
  CDS (1)..(1251)
atgtctctttcaaataaactttcagtcaaagatctcgatgttgccggaaagcgtgtcttcatccgtgtcgacttcaacgttcctctggatggtgacaagatcaccaacaaccagcgtatcgttgctgctttgccaactatccaatatgttttggatcacaagccaaaggtcgtcgttctggcttctcatttaggccgtccaaacggagaggtcaacccaaaattctctttaaaaccagttgctgctgaattgtcctccctactaggtaagaaggtgactttcttgaacgatagtgttggaccagaggttgagaaggctgtcaactctgcctccaatggagaggttattcttttggagaacttgcgtttccacattgaagaagaaggatctcaaaagaaagatggtcaaaagatcaaggccgacaaggaggctgttgccaggttcagaaagcaattgaccgcattggccgatgtctacgttaacgacgccttcggtaccgctcacagagcccactcttccatggttggatttgaattggagcaaagagctgctggtttcttgatggctaaggagttgacatacttcgctaaggccctggaaaaccctgtcagaccattcttggccatccttggtggtgctaaggtttctgacaagattcaattgattgacaatttgctggacaaggtcgattccatcatcattggtggaggaatggctttcacttttatcaaggttttggataacgttgccattggtaactctttgttcgacgaggctggtgccaagttagttcccggcttagttgagaaagccaagaagaacaatgtcaaactggttcttccagtcgacttcgtcactgccgacgccttctccaaggatgcaaaggtcggtgaagccacggttgagtctggtattccagacggattgcaaggattggacgctggtccaaaatccagagaattgttcgcagctaccatcgctgaggctaagacaatcgtctggaacggtcctccaggtgttttcgagtttgacaagtttgctgaaggtaccaagtctatgttggcagctgccatcaagaacgctcagaacggtggaactgtcatcgttggtggtggtgacacggctaccgttgctaagaagttcggtggtgctgacaagctatcccacgtttccactggaggaggagcttctttggaattattggagggaaaggagcttccaggtgtagtttacttgtccaaaaaggcttaa

SEQ ID NO: 10577 - protein, 416 aa, Pichia pastoris
MSLSNKLSVKDLDVAGKRVFIRVDFNVPLDGDKITNNQRIVAALPTIQYVLDHKPKVVVLASHLGRPNGEVNPKFSLKPVAAELSSLLGKKVTFLNDSVGPEVEKAVNSASNGEVILLENLRFHIEEEGSQKKDGQKIKADKEAVARFRKQLTALADVYVNDAFGTAHRAHSSMVGFELEQRAAGFLMAKELTYFAKALENPVRPFLAILGGAKVSDKIQLIDNLLDKVDSIIIGGGMAFTFIKVLDNVAIGNSLFDEAGAKLVPGLVEKAKKNNVKLVLPVDFVTADAFSKDAKVGEATVESGIPDGLQGLDAGPKSRELFAATIAEAKTIVWNGPPGVFEFDKFAEGTKSMLAAAIKNAQNGGTVIVGGGDTATVAKKFGGADKLSHVSTGGGASLELLEGKELPGVVYLSKKA

SEQ ID NO: 10578 - DNA, 1480 bp, Populus tremuloides
  CDS (63)..(1268)
cacattctcacctaaagcccaagtctttgttctcctctctcgcttcgatttggttttgaaaaatggctactaagaagagtgttagcagtttaaaggaagcagatttgaagggaaaaagagtttttgtaagagtagatctgaatgttcctttggatgataactttaatattaccgatgatactaggatccgtgctgctgtccccactatcaagtacttgatgggtcatggcgccagagttattctttcctctcacttgggacgcccaaagggtgtcacacctaaatacagcttgaagcctcttgtaccaaggctatctgaacttcttggtgttgatgttaagatggcaaatgattgtattggtgtggaggttgagaaaattgtggctgagattccagaagggggtgttttgctccttgaaaatgtaaggttttataaggaggaagagaagaatgaccctgaatttgcaaagaagctcgcttctctagcagaaatctatgtgaatgatgcattcggcactgctcacagagcccatgcttccactgagggcgtggctaaatacttgaagcctgctgttgctggtttccttatgcagaaggaactcgattatcttgttggagctgtggcaaatcccaaaaagccatttgctgcaattgttggtggctcaaaggtatcttctaagattggagttatcgaatcactcttggagaaggttgacctcctcttcttgggtggaggaatgatctatactttttacaaagcacaagggcactcagttgggtcctcccttgttgaggaagacaagcttgatcttgcaacttcacttattgagaaggccaaggtcaagggggtaaaactgctgctgcctgcagatgtggttgttgctgacaagtttgctccagatgccaacagcaaggtggtcgcagcttctgagataccagatggctggatgggtttggacataggacctgattccatcaagacattcaacgaggcattggatacaaccaagaccattatttggaatggaccaatgggtgtctttgagttcgagaagtttgcagcgggaactgaggcaattgccaggaagcttgccgagctcagtggcaagggagtgactaccatcattggaggaggtgactctgtggctgctgtggagaaggctggactcgctgacaagatgagccacatctcaacaggaggtggtgccagcttagagcttctagagggcaaaccattacctggagtcctggctcttgatgatgcttaacccgaaattttcctcgtgttacttcttaagaacatgcgcggtaaatgtttggtattacaatcagagtggactagatgagtgctgatctttgggggctgtagagtgactaaataaatcttctctcaagtatattcaaccatggaatggtttcggattggatcctttccgggttttttttttattattattttgatgatccaaaaaaaaaaaaa

SEQ ID NO: 10579 - protein, 401 aa, Populus tremuloides
MATKKSVSSLKEADLKGKRVFVRVDLNVPLDDNFNITDDTRIRAAVPTIKYLMGHGARVILSSHLGRPKGVTPKYSLKPLVPRLSELLGVDVKMANDCIGVEVEKIVAEIPEGGVLLLENVRFYKEEEKNDPEFAKKLASLAEIYVNDAFGTAHRAHASTEGVAKYLKPAVAGFLMQKELDYLVGAVANPKKPFAAIVGGSKVSSKIGVIESLLEKVDLLFLGGGMIYTFYKAQGHSVGSSLVEEDKLDLATSLIEKAKVKGVKLLLPADVVVADKFAPDANSKVVAASEIPDGWMGLDIGPDSIKTFNEALDTTKTIIWNGPMGVFEFEKFAAGTEAIARKLAELSGKGVTTIIGGGDSVAAVEKAGLADKMSHISTGGGASLELLEGKPLPGVLALDDA

SEQ ID NO: 10580 - DNA, 1548 bp, Chondrus crispus
  CDS (252)..(1508)
atgtactattggttgattagtttctcttcgcaagtccattgggctagcagccaaccgaaaaatctgaccatcccattggatcacatcaaaaccatctcgtacaagtccaaacaccgcagccaaccctatcagacgaatctaaaaccagtcctttttaatagtcgaggttagcccttccagcctaggtactaacctacatcgccattgacccacccattcttttccaactcgcagctcaaattcccactaccatgtctttctccaagctctgtatcgacgctctcgatctcgctggcaagcgcgtcttcatccgtgtcgacttcaacgtccccttcgacaaggagaccggcaagaccatcaccaacacccagcgtatcgacgccgccctccccaccatcaaatacgctctggaaaagggcgccaagtccgtcgtcctcgcttcgcatctcggacgcccgtccggccgtgttaaccccaagttctcgctcaagcccgtggcagacgtcgtctcggagaagatcggcaagacggtcaccttcctcgaagatgccgtcggctccgctactgaggaggcttgcaaggaccccgagaccggatccgtcttcttgctcgagaatttgcgcttccacatcgaggaggagggcaagggcgttgatgctgatggcaacaagatcaaggctgatgctgctaaggtgacggagtttcggaagagtctcagcactttggctgatgtttacgttaacgacgcctttggcactgctcaccgcgctcactcgtccatggtcggcgtggatctcccacaaaaggcctctggctttctcatgaagaaggagcttgagtattttggaaaggccctgcaggaaccccaacgcccgtttcttagcattttaggaggatccaaggtgtccgataagatccaactcattgagaacttacttgataaggtcgatgagatgatcattggaggaggtatggcattcacattcaagaaagccgtcgagggaatggccattggacagtcgcttttcgacgaagccggtgcaaagatcgcgcaggaaattgtggacaaagctaaggcgaagaatgtcaagcttcatttccccgtcgacttcacgattgctgacaagtttgccccagtggctaacacaagagttgcgacggactcagagggcattccggatgaatggatgggtctcgatgcaggtccgaagagccaagaggcaatgcgcgaggtcgtgttgcgggcgaagacagtcgtgtggaacggtcctgtcggcgtgtttgagtttgaagcgtttgcaaaaggaacaaaggccgtggtcgatgctgtcgtggaagctacttcatctggagctgtgacgatcattggtggaggtgacacggccactgcagtaaaagagatgggtgcagcggattctgtgtctcacgtttccacgggcggtggtgcgagcctcgaactgctcgaaggaaagactctacccggcgtggccgcattgacagacgcatgaaactgtcgtcgcaccgcaaaagtgcaatgttttcctcgag

SEQ ID NO: 10581 - protein, 418 aa, Chondrus crispus
MSFSKLCIDALDLAGKRVFIRVDFNVPFDKETGKTITNTQRIDAALPTIKYALEKGAKSVVLASHLGRPSGRVNPKFSLKPVADVVSEKIGKTVTFLEDAVGSATEEACKDPETGSVFLLENLRFHIEEEGKGVDADGNKIKADAAKVTEFRKSLSTLADVYVNDAFGTAHRAHSSMVGVDLPQKASGFLMKKELEYFGKALQEPQRPFLSILGGSKVSDKIQLIENLLDKVDEMIIGGGMAFTFKKAVEGMAIGQSLFDEAGAKIAQEIVDKAKAKNVKLHFPVDFTIADKFAPVANTRVATDSEGIPDEWMGLDAGPKSQEAMREVVLRAKTVVWNGPVGVFEFEAFAKGTKAVVDAVVEATSSGAVTIIGGGDTATAVKEMGAADSVSHVSTGGGASLELLEGKTLPGVAALTDA

SEQ ID NO: 10582 - DNA, 2154 bp, Chondrus crispus
  CDS (618)..(1988)
caccaaccaacatgcacaaatgttcgcacgggatccccaattccacacgtgtaaaattgatatatccaatcattgtagtacacggtggcatgctggacaaggcatgctggacacgtacgagttttccccatcgtaggacgtgcagtacaggagtaagtttagtcttgtgctcgactgctggagcaggcaacggagacgaatcggataggatcacttttttgactctgttggctctgcgccacacacctggtgcggtttcattggatgtattaatgaacccggtcccattagcgctcctcattggctctttaggaatggatggccctcgttcccaagcatttcctccgagattcacattcccaccccgtacaggggcacaacccttgatctccaacgcgctctctctagccgtcaaccaccacaaatgcccgacttcccttcgcattcgccattcatactgttctcccgttcccaatccaaccatcccttcgcccctcctataaactctacctgctccaacactagtttccccgccgcttctctcgcccatcggttttcccacaccccactcctgatcacttctcattccccatatccacactaaccaacccttcaccatggtcaccggcttcgtaccctgcgccgctcccctgcgcgccaccacccgccagacggccgccgtgtccgttgtctcccgctctgccagcaccttcgttgccccctcgcgccgcgtcacggcccctgccgcccccgtccccaccgtccgcatgaccactgccgccgccaccaccaagaagtccattaaggacctcagccccgcggacatcgccggcaaacgcgtccttgtccgctgcgatctcaacgtcccgctcgatggcaagaccatcaccgacgacacacgcatccgcgcatctgtccccaccatcaagttcctcatggaagccggcgcaaaggtcctcctctcctcccatctcggccgccccaaggatggtccggaggataagttctccctcagccccgtcgccgcccgccttacccaactgctgggcaaggacgttaccatggctccagattgcattggtgacggagtcacaaaaatcgtgtccggcatggctaacggtgatgtcactcttctcgagaacgttcgcttctacaaggaggagacgaagaacgaccctgactttgctaagaaacttgctgctaacgctgattttttcgtcaacgatgcttttggtaccgcccatcgcgcccatggctcgaccgccggtgttacggcgcatcttaagccctctgttgccggcttacttctggagaaggagcttgcatacctcgcaggcactgtgtcggaccccgcgcgcccgtttgctgcaattgttggtggttccaaggtatcttccaagattggcgttatcgactcgcttctccagaaggttgacaagctcatcattggaggcggtatggtcttcaccttcctcaaagcaaagggcctcaacgttggttcttcccttgttgaggatgataagctcgagcttgcgagggagcttgtcaaaacggccgaagccaagggtgtctccatcatccttcccactgacgtcgtcctcgctgacaagttcgccgctgatgccaacactcaggtgacctctgttgactctatccccgatggatggatgggtctggaccaaggagaagacagcacaaagctcattcagaatgagcttaaggagtgcaagaccgtaatctggaacgggccgatgggtgtgtttgagatggagaagttcgcgaagggtacgttcgccattgctgacacattagccgatctcactgaatccggctgcattaccatcatcggtggtggtgactctgtcgcagctgtcgagaaggctggtctggctgagaagatgtcccatatctctactggtggtggtgcctcgctcgagcttttggaaggaaaggtgcttcctggcgtggctgctttggatgacaattagatagaagtaataaacttttctaatcattttgcacagaccttgttacctcttgacatctatgtgaagtatcccgtcgaaacatatcctaatccgacacaagatatttgaactaaaactcgtatcttagttccacaactattttagaaaagaccagctttcagttcca

SEQ ID NO: 10583 - protein, 456 aa, Chondrus crispus
MVTGFVPCAAPLRATTRQTAAVSVVSRSASTFVAPSRRVTAPAAPVPTVRMTTAAATTKKSIKDLSPADIAGKRVLVRCDLNVPLDGKTITDDTRIRASVPTIKFLMEAGAKVLLSSHLGRPKDGPEDKFSLSPVAARLTQLLGKDVTMAPDCIGDGVTKIVSGMANGDVTLLENVRFYKEETKNDPDFAKKLAANADFFVNDAFGTAHRAHGSTAGVTAHLKPSVAGLLLEKELAYLAGTVSDPARPFAAIVGGSKVSSKIGVIDSLLQKVDKLIIGGGMVFTFLKAKGLNVGSSLVEDDKLELARELVKTAEAKGVSIILPTDVVLADKFAADANTQVTSVDSIPDGWMGLDQGEDSTKLIQNELKECKTVIWNGPMGVFEMEKFAKGTFAIADTLADLTESGCITIIGGGDSVAAVEKAGLAEKMSHISTGGGASLELLEGKVLPGVAALDDN

SEQ ID NO: 10584 - DNA, 1374 bp, Phytophthora infestans
  CDS (21)..(1265)
cgataagtaacaccataaccatggccaagctcagcatcaagaacgtggacgtcaagggcaagcgcgtgctcatccgcgtggatttcaacgttcctttcgcacaggacggctccatctccaacacgcagcgcatcgacgccgcgctgcccactgtgcagtacgtgctggaccagggtgctaaggctgtggtgctcatgtcccatttgggccgccccgagggcaagcccaaggccaaggactcgctggcccctgtggctgtggctgtggaacagaagctcggtcgtaaggtgacgttcctgaaggactgtgttggccccgaggttgaggctgcctgcgccaacccgactgagggcagcattattctgcttgagaaccttcgttttcacgtcgaagaggagggtaagggcaaggatgccgagggcaacaagaccaaggcgtcgtctgaggctgtggcagctttccgcgcctcgctgagcaagcttggcgacgtgtacgtcaacgacgcgttcggtacggcccaccgcgctcacagctccatggtgggcgtggatctccctattaaggccgctggctttctgctggacaaggagctagtgtacttcgccaaggctctggacgcccctcagcgccccttcgtgtcgattctgggtggtgccaaggttgctgacaagatccagctcatcatgaatatgctggacaaggtggacgagatggtcatcggtggcggcatggcctacacgttcaagaaggtgatcaacaacatggagatcggtggatcgctgtacgacgaggaaggcgccaagatcgtgcctcagatcgtggagaaggccaaggccaagggcgtgacgcttcacctgcctgtggacttcgtcatcgccgacaagttcgccgcggatgctgctacgaagatctcgacggaagaggagggcatccctgctggctggatgggtctggacgtcggccccaagtcgcaggaagcgttcagcgccgctgtggcgaaggccaagaccgtcgtctggaacggacccatgggcgtgttcgagttcgatgcttttgctgacggcacgaaagttgtcatggacgctgtggtcaaggccaccgagtcgggcgccactacgatcattggcggcggcgacacggccacgtgctgcgtcaagttcaacacggaggacaaggtctctcatgtgagcacgggcggcggtgccagtctggagcttctggagggcaagattctgcctggtgtggacgccctgtcctcggcgtgaattgcacggtcatccgatcctatcaggagcgggctgtagtaattgtccctttatcccagcaaatacaaatagcattctaaaagggtaaaaaaaaaaaaaaaaaaaaaaa

SEQ ID NO: 10585 - protein, 414 aa, Phytophthora infestans
MAKLSIKNVDVKGKRVLIRVDFNVPFAQDGSISNTQRIDAALPTVQYVLDQGAKAVVLMSHLGRPEGKPKAKDSLAPVAVAVEQKLGRKVTFLKDCVGPEVEAACANPTEGSIILLENLRFHVEEEGKGKDAEGNKTKASSEAVAAFRASLSKLGDVYVNDAFGTAHRAHSSMVGVDLPIKAAGFLLDKELVYFAKALDAPQRPFVSILGGAKVADKIQLIMNMLDKVDEMVIGGGMAYTFKKVINNMEIGGSLYDEEGAKIVPQIVEKAKAKGVTLHLPVDFVIADKFAADAATKISTEEEGIPAGWMGLDVGPKSQEAFSAAVAKAKTVVWNGPMGVFEFDAFADGTKVVMDAVVKATESGATTIIGGGDTATCCVKFNTEDKVSHVSTGGGASLELLEGKILPGVDALSSA

SEQ ID NO: 10586 - DNA, 1537 bp, Arabidopsis thaliana
  CDS (148)..(1353)
agattccgattgttttcttcgattaagttttgagctagattctctagatctgtttcaccgatttggttgatttctccgtcaatctgaactcgcggtgtgcatcttgttgtttgcagtgtttttagtttgttttacgaagaatcaactatggcgacgaagagaagcgttggaactttgaaggaagcggatctgaagggaaagagtgtgttcgtgagggttgatctcaacgttcctttggatgataactctaacatcaccgatgacaccaggattcgtgccgctgttcccaccatcaagtacttgatgggtaatggatctagggttgttctctgcagtcacttgggccgcccaaaaggtgttactcctaagtacagcttaaagcctcttgtgcccagattgtctgaacttcttggtgttgaggttgtaatggcaaatgactctattggtgaggaagtccagaagttggttgcaggactacctgaaggtggtgttttgctcttggagaatgtgaggttctacgccgaggaagagaagaatgatcctgaatttgcaaagaagcttgctgctcttgccgatgtttacgttaatgatgccttcggaactgctcacagagctcatgcttccactgagggagttgccaaatacttgaagccttcagttgctggtttcctcatgcagaaggaacttgattaccttgtcggagctgtggcaaaccccaagaagccttttgctgccattgttggaggctcaaaggtttcaacaaagattggtgtcattgagtctctcttgaacacagttgacatcctccttctcggtggaggtatgatttttactttctacaaggcacaaggactctcagtcggatcttcccttgtggaggaggacaagcttgacttggcaaagtcactcatggagaaagcaaaggccaaaggtgtctctctcttgctcccaaccgatgtggttattgctgacaagtttgctcccgatgctaacagcaagatagtgccagccactgccatccctgatggctggatgggtctagatattggtccagactccatcaagacattcagcgaagctctggacacaaccaaaaccatcatctggaatggtcccatgggtgtgtttgaattcgataagtttgctgctggaactgaggccgtagcaaagcagcttgcagaactaagcggaaagggagtaaccacaatcattggaggaggtgactctgttgctgccgtcgagaaggttggtttggcagacaagatgagccacatctctaccggaggcggtgctagtttggagcttattgagggtaagccacttccaggagtcctcgctctcgacgaagcttgaaaatcctcacgttggatttcatcgctattttgtgttgttatatgtataagtcgtctggttatcttgtgaccagacgagcaagccattatttatcagcttgagattttcgtctacggctctctttttatgagttttttagtttggagcctttttttaataataagagatgaaactctgattgacg

SEQ ID NO: 10587 - protein, 401 aa, Arabidopsis thaliana
MATKRSVGTLKEADLKGKSVFVRVDLNVPLDDNSNITDDTRIRAAVPTIKYLMGNGSRVVLCSHLGRPKGVTPKYSLKPLVPRLSELLGVEVVMANDSIGEEVQKLVAGLPEGGVLLLENVRFYAEEEKNDPEFAKKLAALADVYVNDAFGTAHRAHASTEGVAKYLKPSVAGFLMQKELDYLVGAVANPKKPFAAIVGGSKVSTKIGVIESLLNTVDILLLGGGMIFTFYKAQGLSVGSSLVEEDKLDLAKSLMEKAKAKGVSLLLPTDVVIADKFAPDANSKIVPATAIPDGWMGLDIGPDSIKTFSEALDTTKTIIWNGPMGVFEFDKFAAGTEAVAKQLAELSGKGVTTIIGGGDSVAAVEKVGLADKMSHISTGGGASLELIEGKPLPGVLALDEA

SEQ ID NO: 10588 - DNA, 1254 bp, Equus caballus
  CDS (1)..(1254)
atgtctctttctaagaagttaactttggacaaactagatgttaaagggaaacgaatcatcatgagagtagacttcaacgttcccatgaagaagaaccagattacaaacaaccagagaatcaaggcttccatcccaagcatcaagtactgcctggataatggagccaggtcagtagttcttatgagtcatttaggtcgacctgatggtgttcccatgcctgataaatactctttagagcctgttgctgctgagctcaaatccttgctgggcaaggatgttctgttcctgaaggactgtgtgggctcagaagtggagaaagcctgtgccaacccagctactggttcagttatcctgctggagaacctgcgctttcatgtggaggaagaagggaagggccaagatccttctggaaataagcttaaagctgaggcaggtaaaatagaagccttccgggcatcactgtccaagctcggggatgtctatgtcaatgatgcttttggcactgctcaccgagcccacagttccatggtgggaataaatctgccccagaaggcatctggatttctgatgaagaaggagctggagtactttgccaaagccttggaaaacccagagagaccctttctggctatacttggtggagccaaagtggcagacaagatccaactcatcaaaaatatgctggacaaggtcaatgagatgattattggtggtggaatggcttataccttccttaaggtacttaacaacatggagattggtgcttccctgtttgatgaagagggagccaagattgtcaaagatatcatggccaaagccaataagaatggtgtgcgcattacatttcctgttgattttgttactgctgacaagtttgaggagaatgctaaggttggccaagccactgtagcatcaggcatacctgccggctggatgggtttggactgcggtcctgagactaataagaagtatgctcaagtgatggcccaagccaaactaattgtgtggaatggacctgtaggggtatttgaatgggatgcctttgctaagggaaccaaagccctcatggatgaaattgtgaaagccacttccaggggctgtatcaccattataggaggtggagacactgctacttgctgtgctaaatggaacaccgaagataaagtcagtcatgtgagcactggaggaggtgccagtctagagcttctggaaggtaaaatccttcctggagtggatgctctcagcaacctgtag

SEQ ID NO: 10589 - protein, 417 aa, Equus caballus
MSLSKKLTLDKLDVKGKRIIMRVDFNVPMKKNQITNNQRIKASIPSIKYCLDNGARSVVLMSHLGRPDGVPMPDKYSLEPVAAELKSLLGKDVLFLKDCVGSEVEKACANPATGSVILLENLRFHVEEEGKGQDPSGNKLKAEAGKIEAFRASLSKLGDVYVNDAFGTAHRAHSSMVGINLPQKASGFLMKKELEYFAKALENPERPFLAILGGAKVADKIQLIKNMLDKVNEMIIGGGMAYTFLKVLNNMEIGASLFDEEGAKIVKDIMAKANKNGVRITFPVDFVTADKFEENAKVGQATVASGIPAGWMGLDCGPETNKKYAQVMAQAKLIVWNGPVGVFEWDAFAKGTKALMDEIVKATSRGCITIIGGGDTATCCAKWNTEDKVSHVSTGGGASLELLEGKILPGVDALSNL

SEQ ID NO: 10590 - DNA, 1197 bp, Streptococcus agalactiae
  CDS (1)..(1197)
atggctaaattgactgttaaagacgttgatttgaaggtaaaaaaagtcctcgttcgtgttgactttaatgtgcctttgaaagacggcgttatcactaacgacaaccgtatcactgcggctcttccaacaatcaagtatatcatcgaacaaggtggtcgtgctatcctcttctctcaccttggacgtgttaaagaagaagctgacaaagaaggaaaatcacttgcaccggtagctgctgatttagctgctaaacttggtcaagatgttgtattcccaggtgttactcgtggtgcaaaattagaagaagcaatcaatgctttggaagatggacaagttcttttggttgaaaacactcgttttgaagatgttgacggtaagaaagaatctaagaatgacgaagaacttggtaaatactgggcttcacttggagatggaatcttcgttaacgatgcatttggtacagcacaccgtgctcatgcatcaaacgtaggtatttcagcaaacgttgaaaaagctgtagctggtttccttcttgaaaacgaaattgcttacatccaagaagcagttgaaactccagaacgcccattcgtagctattcttggtggctcaaaagtttctgataagattggtgttatcgaaaaccttcttgaaaaagctgataaagttcttatcggtggtggtatgacttacacattctacaaagctcaaggtatcgaaatcggtaactcacttgtagaagaagacaaattggatgttgctaaagacctccttgaaaaatcaaacggtaaattgatcttgccagttgactcaaaagaagcaaacgcatttgctggttatactgaagttcgcgacactgaaggtgaagcagtttcagaagggttccttggtcttgacatcggtcctaaatcaatcgctaaatttgatgaagcacttactggtgctaaaacagttgtatggaacggacctatgggtgtctttgaaaaccctgacttccaagctggtacaatcggtgtaatggacgctatcgttaaacaaccaggcgttaaatcaatcatcggtggtggtgattcagcagcagctgctatcaaccttggtcgtgctgacaaattctcatggatctctactggtggtggagcaagcatggaattgctcgaaggtaaagtattaccaggtttggcagcattgactgaaaaataa

SEQ ID NO: 10591 - protein, 398 aa, Streptococcus agalactiae
MAKLTVKDVDLKVKKVLVRVDFNVPLKDGVITNDNRITAALPTIKYIIEQGGRAILFSHLGRVKEEADKEGKSLAPVAADLAAKLGQDVVFPGVTRGAKLEEAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKDLLEKSNGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 10592 - DNA, 1167 bp, Encephalitozoon cuniculi GB
  CDS (1)..(1167)
atgaaaacaattagcaatgcggagattgagggaaaacgggtatttctccgggtggacttcaatgtgccgatattggactctgtggttctgaacgacttcaaaataacttctgtgcttccaacaatcagacttcttcattctaggaatcccaggagagtgattattggaagtcaccttggaagacccaaggggaagtattccaaggagctttccctgaggcctgtctactcagtactaaaggcgcgcctctgggaggaacttggcgtagagttggatttctgcgacctgtgggatgttgggaatgtgcaaagtccatggatactcctggagaacctcaggttttattccgcagaggaagacgccggcgacaaggatgctgttgatcagtacagaaatgtattcgtagacaatatggatgttgctgttatagatgcattcggatgtctgcatagagaatgcgggtctatacagagaaccgggcttccttcattctctgggcttctggtccagaaagagttgaactttactaaggaaatcatggaggaaagggtggatcttatgatactgggaggaaagaaagtgtccgacaagatcaagctgctggaatctcttggacagaaaacaggaagcttatttgttaccggaggactggcatttccattcattagatacatattgggaaaggaggttggaaagagcataggagaaagtgtttctgaagaggaagtaaagaggatacataagatctgtgaggagcacaaaacaaggattatccttccatctgacttcacggttgtttgcaacgacagcgtacaaacaactagcaacatcccccctgaggggagtgcaatggacataggcccggaaactatagaaatgctaaggagagaagtttctaaggcaaaggccgtgttttggaatggccctcccggaatgtatgaagaacaaagtttctcgaggggaacggaggctttggtgagtgccttggagagtcttaaaggagaagggaagaagtctttctgcggaggaggggagactgcaggcgcaatcagattgtttggtagctatgatgcctttacttatgtatctaccggaggaggggtgctgatgaagctgctgggtggaaaaaggcttcctgggctagacttcctctccatgcagccctga

SEQ ID NO: 10593 - protein, 388 aa, Encephalitozoon cuniculi GB
MKTISNAEIEGKRVFLRVDFNVPILDSVVLNDFKITSVLPTIRLLHSRNPRRVIIGSHLGRPKGKYSKELSLRPVYSVLKARLWEELGVELDFCDLWDVGNVQSPWILLENLRFYSAEEDAGDKDAVDQYRNVFVDNMDVAVIDAFGCLHRECGSIQRTGLPSFSGLLVQKELNFTKEIMEERVDLMILGGKKVSDKIKLLESLGQKTGSLFVTGGLAFPFIRYILGKEVGKSIGESVSEEEVKRIHKICEEHKTRIILPSDFTVVCNDSVQTTSNIPPEGSAMDIGPETIEMLRREVSKAKAVFWNGPPGMYEEQSFSRGTEALVSALESLKGEGKKSFCGGGETAGAIRLFGSYDAFTYVSTGGGVLMKLLGGKRLPGLDFLSMQP

SEQ ID NO: 10594 - DNA, 1560 bp, Aedes aegypti
  CDS (99)..(1346)
aagaagcactcggtggagaataatctgttaaagtgtgatctccccctaaaattctttttaaacttaagtcacttgtgcgaatttactgcaaagcaacgatggctctcaataaactcagcatcgagaatgttgatttgaagggcaaacgagtttttatgcgtgtggatttcaatgtccctatcaaagagggaaagatcaccagcaaccagcgtatcgtagctgccctggacagtattaaatatgccttggaaaagggtgccaagtccgttgtccttgcctcccaccttggacgtccggacggcaacaagaatgccaaatacaccctagccccggtggccgaggagatgacgaagctgttgggtcgtgatgtgaccttcctgaacgactgtatcggtgctgaggttgaagccgcatgcaaagaccctgcacccggttcgatcattttgttggagaatgtccgattctacgttgaagaggagggcaagggcgttgacgcctccggcaataaggttaaggctgataaggacaaggtcaaggccttccgcgaaagtcttgctaaattgggagatttgtatgtcaacgatgctttcggaactgctcatcgtgcgcatagttccatgatgggtgagggatacgcccagcgtgctgctggtttgttgttgaacaaggaattgcgttacttctcgcaagctctggataacccgccacgaccattccttgccattctgggtggagctaaggttgctgacaaaatccagctcattgaaaatctcctcgacaaggtgaacgaaatgatcattggaggtggaatggcatttacgttccttaaggtattgaacaatatgcaaattggaggatcattgttcgacgaggagggttcaaagaccgttcagaagctggtggacaaagccaaggccaacaacgtgcaactgcatttaccagtggatttcgtaactggcgataaatttgccgaagatgctgccgttggagctgctaccgtcgagagcggaattcccgctggacacatgggtctcgacgttggaccgaagtctcgtgaggcattcgctgctccgattgcccgctccaagatcattgtttggaacggtccacccggcgtttttgagttccccaatttcgccaacggaacgaaagctcttatggatgccgttgtcgctgcaacaaaggcaggcactgtatctattattggcggtggagataccgcttcgtgtcgcgccaagtggggaacagaatctcaggtatcacacgtttctactggtggtggagcgtctttggaactgttggaaggcaaggttctacctggtgtcgacgccttgagcagcgcttaaataatcgaaaacatgttccagcataagagttatttagctgatgttccgagctggcttatctaatcactaaagtttaagctttgttagagtcaaaaagaaagtcgaaactcgtcataaaataatcaatgtgcacctagcgctaagatgtaagtgtagactacaccatgtgctgttatcaggagagaaaataaagtcatgtgttacgattagagag

SEQ ID NO: 10595 - protein, 415 aa, Aedes aegypti
MALNKLSIENVDLKGKRVFMRVDFNVPIKEGKITSNQRIVAALDSIKYALEKGAKSVVLASHLGRPDGNKNAKYTLAPVAEEMTKLLGRDVTFLNDCIGAEVEAACKDPAPGSIILLENVRFYVEEEGKGVDASGNKVKADKDKVKAFRESLAKLGDLYVNDAFGTAHRAHSSMMGEGYAQRAAGLLLNKELRYFSQALDNPPRPFLAILGGAKVADKIQLIENLLDKVNEMIIGGGMAFTFLKVLNNMQIGGSLFDEEGSKTVQKLVDKAKANNVQLHLPVDFVTGDKFAEDAAVGAATVESGIPAGHMGLDVGPKSREAFAAPIARSKIIVWNGPPGVFEFPNFANGTKALMDAVVAATKAGTVSIIGGGDTASCRAKWGTESQVSHVSTGGGASLELLEGKVLPGVDALSSA

SEQ ID NO: 10596 - DNA, 1560 bp, Aedes aegypti
  CDS (99)..(1346)
aagaagcactcggtggagaataatctgttaaactgtgatctccccctaaaattctttttaaacttaggtcatttgtgcgaatttactgcaaagcaacgatggctctcaataaactcagcatcgagaatgttgatttgaagggcaaacgagtttttatgcgtgtggatttcaatgtccctatcaaagagggaaagatcactagcaaccagcgtatcgtagctgccctggacagtattaaatatgccttggaaaagggtgccaagtccgttgtccttgcctcccaccttggacgtccggacggcaacaagaatgccaaatacaccctagccccggtggccgaggagatgaagaagctgttgggtcgtgatgtgaccttccttaacgactgtatcggtgctgaggttgaagccgcatgcaaagaccctgcaccgggttcgatcattttgttggagaatgtccgattctacgttgaagaggagggcaagggcgttgacgcctccggcaataaggttaaggctgataaggacaaggtcaaggctttccgcgaaagtcttgccaaattgggagatgtgtatgtcaacgatgctttcggaactgctcatcgtgcgcatagttccatgatgggtgagggatacgcccagcgtgctgctggtttgttgttgaacaaggaattgcgttacttctcgcaagctctggataacccgccacgaccattccttgccattctgggtgcagctaaggttgctgacaaaatccagctcattgaaaatctcctggacaaggtgaacgaagtgatcattggaggtggaatggcatttacgttccttaaggtattgaacaatatggaaattggaggatcattgttcgacgaggagggttcaaagatcgttcagaagctggtagacaaagccaaggccaacaacgtgcaactgcatttaccagtggatttcgtaactggtgataaatttgccgaagatgctgccgttggagctgctaccgtcgagagcggaattcccgctggacacatgggtctcgacgttggacccaagtctcgtgaagcattcgctgctccgattgcccgctccaagatcattgtttggaacggtccacccggcgtttttgagttccccaatttcgccaacggaacgaaagctcttatggatgccgttgtcgctgcaacaaaggcaggcactgtatctattattggcggtggagataccgcttcgtgttgcgccaagtggggaacagaatctcaggtatcacacgtttctactggtggtggagcgtctttggaactgttggaaggcaaggttctacctggtgtcgacgccttgagcagcgcttaaataatcgaaaacatgttccagcataagagttatttagctgatgttccgagctggcttatctaatcactaaagtttaagctttgttagagtcaaaaagaaagtcgaaactcgtcataaaataatcaatgtgcacctagcgctaagatgtaagtgtagactacaccatgtgctgttatcaggagagaaaataaagtcatgtgttacgattagagag

SEQ ID NO: 10597 - protein, 415 aa, Aedes aegypti
MALNKLSIENVDLKGKRVFMRVDFNVPIKEGKITSNQRIVAALDSIKYALEKGAKSVVLASHLGRPDGNKNAKYTLAPVAEEMKKLLGRDVTFLNDCIGAEVEAACKDPAPGSIILLENVRFYVEEEGKGVDASGNKVKADKDKVKAFRESLAKLGDVYVNDAFGTAHRAHSSMMGEGYAQRAAGLLLNKELRYFSQALDNPPRPFLAILGAAKVADKIQLIENLLDKVNEVIIGGGMAFTFLKVLNNMEIGGSLFDEEGSKIVQKLVDKAKANNVQLHLPVDFVTGDKFAEDAAVGAATVESGIPAGHMGLDVGPKSREAFAAPIARSKIIVWNGPPGVFEFPNFANGTKALMDAVVAATKAGTVSIIGGGDTASCCAKWGTESQVSHVSTGGGASLELLEGKVLPGVDALSSA

SEQ ID NO: 10598 - DNA, 1248 bp, Aedes aegypti
  CDS (1)..(1248)
atggctctcaataaactcagcatcgagaatgttgatttgaagggcaaacgagtttttatgcgtgtggatttcaatgtccctatcaaagagggaaagatcaccagcaaccagcgtatcgtagctgccctggacagtattaaatatgccttggaaaagggtgccaagtccgttgtccttgcctcccaccttggacgtccggacggcaacaagaatgccaaatacaccctagccccggtggccgaggagatgaagaagctgttgggtcgtgatgtgaccttcctgaacgactgtatcggtgctgaggttgaagccgcatgcaaagaccctgcacccggttcgatcattttgttggagaatgtccgattctacgttgaagaggagggcaagggcgttgacgcctccggcaataaggttaaggctgataaggacaaggtcaaggccttccgcgaaagtcttgctaaattgggagatttgtatgtcaacgatgctttcggaactgctcatcgtgcgcataggtccatgatgggtgagggatacgcccagcgtgctgctggtttgttgttgaacaaggaattgcgttacttctcggaagctctggataacccgccacgaccatcccttgccattctgggtggagctaaggttgctgacaaaatccagctcattgaaaatctcctcgacaaggtgaacgaaatgatcattggaggtggaatggcatttacgttccttaaggtattgaacaatatggaaattggaagatcattgttcgacgaggagggttcaaagatcgttcagaagctggtagacaaagccaaggccaacaacgtgcaactgcatttaccagtggatttcgtaactggcgataaatttgccgaaaatgctgccgttggacctgctaccgtcgagagcggaattcccgctggacacatgggtctcgacgttggaccgaagtctcgtgaggcattcgctgctccgattgcccgctccaagatcattgtttggaacggtccacccggcgtttttgagttccccaatttcgccaacggaacgaaagctcttatggatgccgttgtcgctgcaacaaaggcaggcactgtatctattattggcggtggagataccgcttcgtgtcgcgccaagtggggaacagaatctcaggtatcacacgtttctactggtggtggagcgtctttggaactgttggaaggcaaggttctacctggtgtcgacgccttgagcagcgcttaa

SEQ ID NO: 10599 - protein, 415 aa, Aedes aegypti
MALNKLSIENVDLKGKRVFMRVDFNVPIKEGKITSNQRIVAALDSIKYALEKGAKSVVLASHLGRPDGNKNAKYTLAPVAEEMKKLLGRDVTFLNDCIGAEVEAACKDPAPGSIILLENVRFYVEEEGKGVDASGNKVKADKDKVKAFRESLAKLGDLYVNDAFGTAHRAHRSMMGEGYAQRAAGLLLNKELRYFSEALDNPPRPSLAILGGAKVADKIQLIENLLDKVNEMIIGGGMAFTFLKVLNNMEIGRSLFDEEGSKIVQKLVDKAKANNVQLHLPVDFVTGDKFAENAAVGPATVESGIPAGHMGLDVGPKSREAFAAPIARSKIIVWNGPPGVFEFPNFANGTKALMDAVVAATKAGTVSIIGGGDTASCRAKWGTESQVSHVSTGGGASLELLEGKVLPGVDALSSA

SEQ ID NO: 10600 - DNA, 1215 bp, Mycoplasma capricolum subsp
  CDS (1)..(1215): transl_table=4
atgaattataataacaaaaaaacattaaaagacatagatgttaaaaataaaactgtactagttcgtgtggattttaatgtaccaattcaaaatggagttattactgatgataatcgtataattgctgctcttcctactataaattacttaatagaaaatgatgccaaaatagtattattttcacatttatcaagaattaaaactaatgaagataaattaaaaaaatctttagctccagttgcaaaaagattagaagaattattgaataaaaaagttaaatttattaaccaaactagaggaaaagaattagaacaagctgttagtttattgcaaactaaagaaattattttagttgaaaatactagatttgaagatgttttagatgatcaagttgttaagtatgaatcaaaaaatgatcctgaattaggaaagtattgagcaagtttaggtgaagtatttgtaaatgatgcttttggaacagcacatagatcacatgcttcaaatgttggaattgcttcaaatattaaaatttcagctattggttttttagttgaaaaagaattaaaaatgttatctcaagcagttaatgactctaaaaaaccatttattgcaattttaggtggagcaaaagtttcagataaaattggtgttattgaaaatttattaccaaaagttgataaattactaattggtggtggaatgagctatacttttttaaaagctcaaggtcgtagcattggtaaatcattattagaagaagataaaattgatttagctaaacattatttagaagttggaaaagataaaattgttttaccagttgatacagcatgtgcaaaagaatttgctgatgtaaagccaactatttttgaaactaatattcctgatgaatgagatggattagatgctggaccaaaaacaattgaaatgtataaagaagaaattaaaaaagctaaaactattgtttgaaatggtcctgttggtgtatttgaattcaaaaattttgaaactggtacaaaatctatatgtcaagcaattgctgaacaaactaaaactggagcctttactttaattggtggtggagatagtgcttctgctgctattaatatggggtttaaagataatttttcatgaatttcaacaggtggaggagcctcacttgaatttatggaaggaaaagaattacgaggaatttcggcaattcaaaataaataa

SEQ ID NO: 10601 - protein, 404 aa, Mycoplasma capricolum subsp
MNYNNKKTLKDIDVKNKTVLVRVDFNVPIQNGVITDDNRIIAALPTINYLIENDAKIVLFSHLSRIKTNEDKLKKSLAPVAKRLEELLNKKVKFINQTRGKELEQAVSLLQTKEIILVENTRFEDVLDDQVVKYESKNDPELGKYWASLGEVFVNDAFGTAHRSHASNVGIASNIKISAIGFLVEKELKMLSQAVNDSKKPFIAILGGAKVSDKIGVIENLLPKVDKLLIGGGMSYTFLKAQGRSIGKSLLEEDKIDLAKHYLEVGKDKIVLPVDTACAKEFADVKPTIFETNIPDEWDGLDAGPKTIEMYKEEIKKAKTIVWNGPVGVFEFKNFETGTKSICQAIAEQTKTGAFTLIGGGDSASAAINMGFKDNFSWISTGGGASLEFMEGKELRGISAIQNK

SEQ ID NO: 10602 - DNA, 1696 bp, Trypanosoma cruzi
  CDS (94)..(1605)
gggagcaattctttctatttgatttgattttgtttttgacataacagcagtggaagaaatagaagcgaaaaagggagtaaaggagtcgctttgatgcaaagcactttaattcttaaaaagaccgttgacgacgtctggccgctcacggccaaacgtgtgctcatcagcgtcgacttcatcgtccctattcataatgggaccatcacgaacgattatcgcatccgcgctgccatccctacaatccgtcgtgtgattgatcaagggggcatatgtatcttgatgagccaccttggccgccccaaaggcgtgtcatacacctctgcgaagaaagacattcaaaagaggtaccatggagggctgtttaacgacagcagagggaagaccgccttttttgccgtacttccgggtgaggagaaggcaaagattttggcactctccagtgcaaaggatgaggcttccagactttcactcagcgaggggtctggtaagactgctgtcttttcacggttgtcggaagaggagaagcaaacgttgctagtgcggtacatttctgaaaataaagaacaaatctttccgcagctcagcctcagttcaggatatgaagaaaaacttactctacgaccaattgccgtgcgacttgctgagttgcttaatcaacacgtttactttgctcacgattgtatggatgccaagatggaaatcagtcttctcaggagaggcgaggttatgctgctcgagaacgtgcgcttctacgtggaggagggaagtaagaaggaggaggagcgtgacgcaatggcgcgcgtactggcgtcgtacggcgacgtgtacatcagcgacgcttttggcacagcccaccgcgagagtgcgacgatgacgggcattccaaaggtgcttggccacggtgccgccggctacttgatggagaaggagatctcgtacttcgcgaaggtgctgggcagcccagcgcggccgctggtggcgattgtgggcggcgcgaaagtgagcgacaagatccagctgctggacaacatgctgcagcgcattgaccacctgatcattggtggcgcgatggcgtacacgtttctgaaggcgcagggccacaagattgggagctcgatgtgcgaggaggacaagctggacctcgcacgctcgctgctgaaaaaggccgaggaccgcaaggtgactgtgctgctgcccgtggaccacgtgtgccacaccgaattcaaggctgtggaggcaccgttggtgacggagggatgtggacatcctgacggctacatggcgctggacatcggcccgaggacgattgagaaatacgttgagattgtggcgaagtgcaagagtgcgatctggaacggtccgatgggtgtgtttgagatggcgccgtactcgaagggcacgtttgcgatcgcgaaggtgatgggcgacagcacgcagaaccatgggctgatgagcatcatcggtggcggtgacagtgcgagcgcagcggagctgagtggcgaggcgccgcgcatgtcccacgtgtcgacgggtggtggcgcgtcgctggagctgctggaaggcaagactcttcctggcgttgccgtgctggacgacaaggagtaacgcgacctgtgtgttgtgtggattaaaaaaaaagaaaaaagaaaaaggcaacgttattttcgttggcgcacaatgcgtgcacattctcttt

SEQ ID NO: 10603 - protein, 503 aa, Trypanosoma cruzi
MQSTLILKKTVDDVWPLTAKRVLISVDFIVPIHNGTITNDYRIRAAIPTIRRVIDQGGICILMSHLGRPKGVSYTSAKKDIQKRYHGGLFNDSRGKTAFFAVLPGEEKAKILALSSAKDEASRLSLSEGSGKTAVFSRLSEEEKQTLLVRYISENKEQIFPQLSLSSGYEEKLTLRPIAVRLAELLNQHVYFAHDCMDAKMEISLLRRGEVMLLENVRFYVEEGSKKEEERDAMARVLASYGDVYISDAFGTAHRESATMTGIPKVLGHGAAGYLMEKEISYFAKVLGSPARPLVAIVGGAKVSDKIQLLDNMLQRIDHLIIGGAMAYTFLKAQGHKIGSSMCEEDKLDLARSLLKKAEDRKVTVLLPVDHVCHTEFKAVEAPLVTEGCGHPDGYMALDIGPRTIEKYVEIVAKCKSAIWNGPMGVFEMAPYSKGTFAIAKVMGDSTQNHGLMSIIGGGDSASAAELSGEAPRMSHVSTGGGASLELLEGKTLPGVAVLDDKE

SEQ ID NO: 10604 - DNA, 1440 bp, Leishmania major
  CDS (1)..(1440)
atgtctctcgtgctgaagaagagcatcgatgacgccaccgtcagggacaagaaggtgctcatccgcgtggacttcaacgtccccgtgaagaacggtaagatcacgaatgacttccgcattcgctccgcccttccgacgatccaaaaggtgctgaaggagggcggctcctgcatcctgatgagccaccttggtcggccgaagggtgcgagaatgagtgacccaagtccggagaagggtgtgcgcgggtacgaggaggccgccacgctgcgcccggttgctgcacgcatcgcggagctgctggggcagaaggtggagtttgcaccggactgcctggacgctgcggcgtacgcgtcgaagctgaagaacggcgacgtgctgttgctggagaacgtgcgtttctacgcggaggagggcagcaagaaggaggaggagcgcgacgcgatggcgaaggtactggcgtcgtacgcggacctgtatgtcagtgacgcctttggcactgcgcaccgcgacagcgcgacgatgacgggcatccccaaggtgctgggtgcgggctacgccgggtacctgatggagaaggagatcaactacttctcgcgagtgctgaacaacccgccgcggccgctggttgcgattgtcggcggtgcgaaggtcagcgacaagatcgagctgcttgacaacatgctgggccgcatcaactaccttgtgattggtggcgcgatggcgtacacgttccagaaggcgcagggccgcaagatcggcatctcgatgtgcgaggaggataagctggaccttgccaagtcgctgctgaagaaggcgcaagagcgcggtgtgcaggtgtttctgccagttgaccacgtgtgcaacaaggaatttaaggccgcggactcgccgctggtgacggagagcgtggacgtcccggacggctacatggcgctcgacattggcccaaggacgatccacatgtacgaggaagtgattggccgctgcaagagcgcgatctggaacggcccgatgggcgtgttcgagatgccgtgctactcgaagggcacatttgccgttgcgaaggcgatggggactggaacgcagaagaacgggctgctgagcatcatcggcggtggtgacagcgcgagcgctgcggagctgagcggcgaggcgaagaacatgtcgcatgtgtccaccggcggcggtgcgtccctggagctgctggagggcaagacgctgcctggcgtcgccattctgacggacaaggacgtgaaggagcggggagcttcgtgcaagttcgctttcggggtcgggagcccgagcagggaggcttgtccgctccgttgtgggcatatctttggcggtgcctccatcgtaagagagatagttaagatcgtcgtcgcgctgctgatcggcatttttattggtcgccgcatgagcaccaagctgatccggtaa

SEQ ID NO: 10605 - protein, 479 aa, Leishmania major
MSLVLKKSIDDATVRDKKVLIRVDFNVPVKNGKITNDFRIRSALPTIQKVLKEGGSCILMSHLGRPKGARMSDPSPEKGVRGYEEAATLRPVAARIAELLGQKVEFAPDCLDAAAYASKLKNGDVLLLENVRFYAEEGSKKEEERDAMAKVLASYADLYVSDAFGTAHRDSATMTGIPKVLGAGYAGYLMEKEINYFSRVLNNPPRPLVAIVGGAKVSDKIELLDNMLGRINYLVIGGAMAYTFQKAQGRKIGISMCEEDKLDLAKSLLKKAQERGVQVFLPVDHVCNKEFKAADSPLVTESVDVPDGYMALDIGPRTIHMYEEVIGRCKSAIWNGPMGVFEMPCYSKGTFAVAKAMGTGTQKNGLLSIIGGGDSASAAELSGEAKNMSHVSTGGGASLELLEGKTLPGVAILTDKDVKERGASCKFAFGVGSPSREACPLRCGHIFGGASIVREIVKIVVALLIGIFIGRRMSTKLIR

SEQ ID NO: 10606 - DNA, 1368 bp, Dictyostelium discoideum
  CDS (53)..(1315)
ggcacgaggttttttttatttttttttaatttttaacaaatcattaatcaaaatgtcttcaaataaaattggtaataaattaagtcttgacaaggtagatgtaaaaggtaaaagagttttaattagagttgattataatgtaccattagataaaaataataatattacaagtactcaaagaattgatgcatcaattccaacattagaatattgtttaaagaatggtgctaaatcaattgtattgatgtcacatttaggtcgtccagatggtttggttaaaccagagtatagtttgaaaccagtggttaaagtattggaagatcaattaaaaagaccaattaaattcttatcagattgtgttggtgaacaagttgaaaaagaatgtgcaaatccagaggaaggtaccgttattttattggagaatctccgtttccacattgaagaggaaggttcaggtgttgatgcagagggtaaaaaggtcaaagccaacccagagaaagttaaagaattccgtgaatcactcaccaagctcggtgatgtctatgtgaacgatgcctttggtactgctcatagagcacatagttcaatggttggtattaatctcccacaaaaagccgctggtttcctcatgaaaaaagaattggaatactttgccaaggctttagagtcaccatcaaaaccattcttggcaattcttggcggtgcaaaggttagtgataaaattaaactcattgaaaaccttttgtataaagtcgatgaaatgatcattggtggtggtatggccttcactttcaagaaattcattgataacaaagagattggttcatcattgtttgagaaaacagccgaacaaatcaccaaagatatcattgccaaagccgctaaaaataatgtaaaattacatttcccagtcgattatgtcattgccgataaatttgataatgatgccaacatcaaaaccgtcactcaagatcaaggtatcccagaaggttggatgggtttagattgtggtccagagactatcaaagaaaacagagataccatctcaagagcaaaaaccatcgtttggaatggtcctatgggtgtatttgaaaagagcaatttcgaagccggtacaaaagctgccatggatgatgttgtcaatgccacaaccaatggtgctatcactatcattggtggtggtgataccgccacttgtgctgccaaatacaacactgaagataaagttagtcatgtctcaactggtggtggtgcttcattagaattattagaaggtaaagaattaccaggtgttactgctttatctgatttatgaattttaaaaaataaattataaaaaaataataataataataataataataatac

SEQ ID NO: 10607 - protein, 420 aa, Dictyostelium discoideum
MSSNKIGNKLSLDKVDVKGKRVLIRVDYNVPLDKNNNITSTQRIDASIPTLEYCLKNGAKSIVLMSHLGRPDGLVKPEYSLKPVVKVLEDQLKRPIKFLSDCVGEQVEKECANPEEGTVILLENLRFHIEEEGSGVDAEGKKVKANPEKVKEFRESLTKLGDVYVNDAFGTAHRAHSSMVGINLPQKAAGFLMKKELEYFAKALESPSKPFLAILGGAKVSDKIKLIENLLYKVDEMIIGGGMAFTFKKFIDNKEIGSSLFEKTAEQITKDIIAKAAKNNVKLHFPVDYVIADKFDNDANIKTVTQDQGIPEGWMGLDCGPETIKENRDTISRAKTIVWNGPMGVFEKSNFEAGTKAAMDDVVNATTNGAITIIGGGDTATCAAKYNTEDKVSHVSTGGGASLELLEGKELPGVTALSDL

SEQ ID NO: 10608 - DNA, 1685 bp, Arabidopsis thaliana
  CDS (84)..(1529)
aaatggctaataaataagaacattgtgagtcactctctctgtttctcatctcctcatctttttatcttctttgattgatccacatggcttccgctgccgcaagttccgccttttcactccttaagtccaccggcgctgttgcttcctccgccggaactcgcgcacgtgcctcccttctgccaattccctctacctctgtttccgcgcgtcctctaggcttctccgccactctagattcccgtcgtttctctctccacgttgcttccaaagttgaatcggtgcgtgggaagggaagcagaggagtggtttctatggcgaagaagagcgtcggagatctgacctcagctgatttgaaggggaagaaggttttcgtgagagctgatctcaatgtacctctcgatgataatcagactatcactgacgataccagaatccgtgccgccattccaacgatcaagtatttgattgaaaatggtgctaaagttatcctctccactcatctgggaaggccaaagggagtcaccccaaagtttagtttggctcctcttgtccctaggctctccgagcttcttggtattgaggtcacgaaagctgatgattgtattggcccagaagtggaaagcttggtggcttctctacctgaaggtggagttttgcttcttgagaacgtcaggttttacaaggaggaagagaagaacgatcctgagtttgctaagaagcttgcttctctagctgacctttatgtcaatgatgctttcggaactgctcacagagctcatgcttctaccgaaggagtcactaagttcttgaagccttcagttgctggtttccttttgcaaaaggaactggactacctagttggtgctgtttcaaacccaaagagaccatttgcagccatagtgggtggttccaaagtctcatccaagattggagttattgaatcgcttctggagaagtgtgatattcttcttcttggtggtggaatgatcttcacattctacaaggcacagggtctttcagttggttcgtcccttgttgaagaagacaagcttgaattggctacagaactccttgccaaagctaaggccaaaggagtctctcttttgttgccaacagatgttgtagttgctgacaagtttgctcctgatgccaacagcaagattgtgcctgcatcaggcattgaggacggatggatgggactggacattggtccagactctatcaaaactttcaacgaagctctggacacaacacaaacagtcatttggaatggacctatgggagttttcgagatggaaaagtttgcggctggaacagaggcgatagcgaataaactagcagagctaagtgaaaaaggagtgacaacgataataggaggaggagactcagtggctgcagtggagaaagtaggagtagcaggagtcatgagtcacatctccactggtggtggagccagcttggagctgttggaaggaaaagtacttcccggtgtgatcgcccttgatgaagcaatcccagtcactgtttagaaactcttaccatctataaggcaaacgctgtatacttaaaagagtttctttcgctttaaatctacctatgcaaaactttactatgtatcagagtctcattccccggaaaagaaaactcacatattaaaattctgaaaaaaaatatcaagagataag

SEQ ID NO: 10609 - protein, 481 aa, Arabidopsis thaliana
MASAAASSAFSLLKSTGAVASSAGTRARASLLPIPSTSVSARPLGFSATLDSRRFSLHVASKVESVRGKGSRGVVSMAKKSVGDLTSADLKGKKVFVRADLNVPLDDNQTITDDTRIRAAIPTIKYLIENGAKVILSTHLGRPKGVTPKFSLAPLVPRLSELLGIEVTKADDCIGPEVESLVASLPEGGVLLLENVRFYKEEEKNDPEFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATELLAKAKAKGVSLLLPTDVVVADKFAPDANSKIVPASGIEDGWMGLDIGPDSIKTFNEALDTTQTVIWNGPMGVFEMEKFAAGTEAIANKLAELSEKGVTTIIGGGDSVAAVEKVGVAGVMSHISTGGGASLELLEGKVLPGVIALDEAIPVTV

SEQ ID NO: 10610 - DNA, 1501 bp, Pisum sativum
  CDS (61)..(1266)
acgcggggagtgtccgaactccgatctcaaccatccattatttgtgtaaagttgaagaaaatggcgacaaagagaagcgttggaacattgaaggaagctgatttgaagggaaagagggtttttgttagggttgatctaaacgttcctttggatgataacttgaacatcaccgatgataccagaatccgtgctgctattcctaccatcaagtacttgactggttatggtgctaaagtcatcctctcctcccatctgggacgtccaaagggtgtaacacctaagtacagtttgaagccccttgtaccaaggttgtctgaacttcttggatccgaggttacgattgctggtgacagtattggtgaggaggttgagaagttggttgcacaaattccagaaggtggtgttttgcttttagagaatgtgaggttccacaaggaagaggagaagaatgatcctgaatttgccaagaagttggcttcccttgccgatctttatgtgaatgatgcatttggcactgcccatcgtgctcatgcttctacagaaggtgttgctaaatacttgaagccctctgttgcaggattcctcatgcagaaggagcttgattatctagttggagctgtgtcaaaccccaagaaaccgtttgctgccattgttggtggttctaaggtgtcttccaagattggagttattgaatccttgttggagaaggttgacattctcttgcttggtggaggaatggtgtttaccttttacaaagctcaaggttattcagttgggacctctcttgtggaggaagacaagcttggtcttgcaacttcacttattgagaaagccaaggctaaaggagtttcccttttgcttccaactgatgtggttatagctgacaagttttctgctgatgctaacgacaagattgtaccagcatcaagcatccctgatggttggatgggattggatattggacctgattccatcaaaacatttaacgaagcattggacaagagtcaaaccgtaatttggaatgggccaatgggtgtttttgagtttgataagtttgccgcaggaacagaggccatagccaagaaactggcagaaataagtggcaaaggagtaacaaccatcattggaggaggtgactctgtagccgccgtggagaaggctggactagcagacaagatgagccacatctctaccggcggaggtgcgagcttagagcttcttgaggggaagccactacctggagtccttgctcttgatgatgcttaaacatgttgtattttgtgttatattataatggttgggtttcaaccaatgttggtttaattgaggttgtcactaaagagctgctcttttagaaggcttaatataggatagttttcaaaaataaaaatgtttttgcggcatccatggtgcttgatcaaattgttactggataatgttcatttttaaagagtgcttatttagttgttaaagaaaaaaaaaaaaaaaaaaaaaaaaaaaa

SEQ ID NO: 10611 - protein, 401 aa, Pisum sativum
MATKRSVGTLKEADLKGKRVFVRVDLNVPLDDNLNITDDTRIRAAIPTIKYLTGYGAKVILSSHLGRPKGVTPKYSLKPLVPRLSELLGSEVTIAGDSIGEEVEKLVAQIPEGGVLLLENVRFHKEEEKNDPEFAKKLASLADLYVNDAFGTAHRAHASTEGVAKYLKPSVAGFLMQKELDYLVGAVSNPKKPFAAIVGGSKVSSKIGVIESLLEKVDILLLGGGMVFTFYKAQGYSVGTSLVEEDKLGLATSLIEKAKAKGVSLLLPTDVVIADKFSADANDKIVPASSIPDGWMGLDIGPDSIKTFNEALDKSQTVIWNGPMGVFEFDKFAAGTEAIAKKLAEISGKGVTTIIGGGDSVAAVEKAGLADKMSHISTGGGASLELLEGKPLPGVLALDDA

SEQ ID NO: 10612 - DNA, 1350 bp, Phaeodactylum tricornutum
  CDS (1)..(1350)
atgttgttccgtatgttgacttcaacggctttgcggcgttcaccagtaaccaccagcttgacctgttgctgtaaagcaaatgcttttgcagtccgaattcgtagctttcacgctgccccagtgatccaagccaaaatgacggtcgagcaactggcccagcaagtccatatgaaagggaccaatgttctcgtgcgcgttgatttgaatgcccccctggccacggatgatgtaacggtgacggatgacacacgcctgcgcgccattgttccaaccacgaaattcttgctcgagcagggagccaacgtgattctctgcagccattttggccgacccaagggtgaaattatcgaaactggcaagaatggtcggctcaacccagtggtgaagccgctcgaagtactgctggggcagacgattaccaaacttgatgattgcatgggaccggatgttgaagccgcaacgaaaaatttgggtgagggaaaggttgtcttgttggaaaacacccgtttttacagcggagaaaccaagaacgatccggaactcgcagccgggctcggaaaacttgctgattatttcgtcatggacgcctttggcacggctcaccgagcacattcttcgactgccggtgtgaccacccatatgaagttcaacgctgctggaaaacttatggagaaggaattgcaatacttgcaaggtgccgtggaagagcccaaacgccccatgatggctattgtcggtggtgccaaagtatccaccaaaattccggtcatcgaatcgcttttggacaagtgcgatgtcattttgattggcggcggtatgatctttaccttttacaaggctctcggttacgacattggcgcatcgctcgtggaagacgacattgtggaattggcgagttcattgatgaaaaaggccgaagaaaagggtgtcaaactgattctgcctgttgacgttgtcctggctgataagtttgacaatgatgcaaactcggccgtggcgaaggtcaccgacatttccggagactggatgggactggacattggaccggaaacgatcgatttgtttcgtagcgaaattgccgaagccaatacaattgtttggaacggtccgatgggcgtctttgaatttagcaactttgcggctggcaccaacgatgttgcccagatgctcgcccaagccactgccgaacggggcgccgtcaccataattggtggtggcgactctgtggccgccgtcaacaaagcgggtttgggtgacaaggtttctcacatttcgacgggcggtggcgccagtttggagcttctggagggcaaggtattgcccggcgttgcggctttgacagaagtgtaa

SEQ ID NO: 10613 - protein, 449 aa, Phaeodactylum tricornutum
MLFRMLTSTALRRSPVTTSLTCCCKANAFAVRIRSFHAAPVIQAKMTVEQLAQQVHMKGTNVLVRVDLNAPLATDDVTVTDDTRLRAIVPTTKFLLEQGANVILCSHFGRPKGEIIETGKNGRLNPVVKPLEVLLGQTITKLDDCMGPDVEAATKNLGEGKVVLLENTRFYSGETKNDPELAAGLGKLADYFVMDAFGTAHRAHSSTAGVTTHMKFNAAGKLMEKELQYLQGAVEEPKRPMMAIVGGAKVSTKIPVIESLLDKCDVILIGGGMIFTFYKALGYDIGASLVEDDIVELASSLMKKAEEKGVKLILPVDVVLADKFDNDANSAVAKVTDISGDWMGLDIGPETIDLFRSEIAEANTIVWNGPMGVFEFSNFAAGTNDVAQMLAQATAERGAVTIIGGGDSVAAVNKAGLGDKVSHISTGGGASLELLEGKVLPGVAALTEV

SEQ ID NO: 10614 - DNA, 1326 bp, Phaeodactylum tricornutum
  CDS (1)..(1326)
atgaaattcgttcaagctgccatcttcgccctcgctgcctcggccagtactactgctgcttttgcccctgccaaaacctttggtgtccgtagctttgccccggtttctctgatcgagctcgaagccaaggcctccattgaagacctcagcgatgccgagcttaagggaaagaaggttctcgtccgttgcgacgtcaacgtccccctggacggtaagaagatcaccgacgatacccgaattcgttcctccatccctaccattgagtacttgaagaacaagggtgccatcgtcagtgtctgctcacatttgggacgccccaaggacggccccgaagataagttctccctcggaccttgcgccgagcgcatgggggaactcctcggacaaactgtaaccctcgcacccgactgcatcggtgaagaagtcgccaagattgtcaatgatgccaaggaaggcgatgttatcatgctcgagaacacccgcttctacaaggaagagaccaagaacgacccggaattcgtcgaaaagcttgccgctccctttgacctgtacgtcaacgacgcctttggaacggcccaccgtgcccatgcctccaccgaaggtgtgaccaagttcctcaaaccttccgttggaggattcttgctcgccaaggaactcgaataccttgatggtgccattagcaacggaaagaaacccatggccgccattgtcggtggatccaaggtctcttccaagatcaccgtcctcgaagccctgctcgataaatgcgacaaggtcatcatcggaggtggtatggtattcaccttcctcaaggcaaagggattcaatgttggtacctccctcgtcgaggatgactttgtggataccgccaaggaagtcttggccaaggccgaaaagttgggcaaggaaatccttcttcccattgatatcgtgattgccgacaagttcgacgcggaagccgagaccaaggtcgtaagtgccgaagaaatccctgatggctggatgggtctggacaacggtcccgaaaccaccgcacagcagaaggaagcactttccgactgcaagactatcatcatgaacggtcccatgggagtctttgagttcgaaaagttcgccaagggaacttttgaccttgtcaacatccttgccgatctttccaaagacaagggtgccattactattatcggaggaggtgattccgttgccgccactgaacagagcggacgtgccggtgacatgtcacacatctccaccggcggtggtgccagtttggagctgttggaaggaaaggtcctccccggtgtggccgcgctcaacgacaaataa

SEQ ID NO: 10615 - protein, 441 aa, Phaeodactylum tricornutum
MKFVQAAIFALAASASTTAAFAPAKTFGVRSFAPVSLIELEAKASIEDLSDAELKGKKVLVRCDVNVPLDGKKITDDTRIRSSIPTIEYLKNKGAIVSVCSHLGRPKDGPEDKFSLGPCAERMGELLGQTVTLAPDCIGEEVAKIVNDAKEGDVIMLENTRFYKEETKNDPEFVEKLAAPFDLYVNDAFGTAHRAHASTEGVTKFLKPSVGGFLLAKELEYLDGAISNGKKPMAAIVGGSKVSSKITVLEALLDKCDKVIIGGGMVFTFLKAKGFNVGTSLVEDDFVDTAKEVLAKAEKLGKEILLPIDIVIADKFDAEAETKVVSAEEIPDGWMGLDNGPETTAQQKEALSDCKTIIMNGPMGVFEFEKFAKGTFDLVNILADLSKDKGAITIIGGGDSVAATEQSGRAGDMSHISTGGGASLELLEGKVLPGVAALNDK

SEQ ID NO: 10616 - DNA, 1530 bp, Trypanosoma brucei
  CDS (1)..(1530)
atgtccactgcaccgaatgcgaagaacaacataagcctgaagaagtctgtgggcgatgtttggccgttaacggcgaagcgagtgcttatgcgtgtcgatttcaacgttcctatgcaaaatggccatattactaacgattatcgaatccgtgcggcgattccaacgatacggcgggttattgatcagggtggtatttgtattctcctgagccatcttggacggcccagaggcgtttcaatggttgcgggtgtgcgagatataagacggcgatatcacgaggctcagtttcacgacaacaaaggtaaaacagcgttttttagtgttctaccgggagaggagaaagttaaaatattagcgaaatccagtgcacgggaagaggcaacgcacatatcacctgaggtgaaatctggaaaaacaatgctgtttgcgcgccttcctgaggacgagaagaaatctttgcttatgcagtacttaaacgaaaacaaagacagtgcgttaccgcagatgagtgttagtgcaggctacgaagagcaatacagtcttcgtccagttgctgtaaggcttgccgaattactcggccaacatgtatattttgctcacgactgcttggatgccagagtagaggtttcgcggttaaagcgtggaaatgttatgttacttgaaaatgtacggttctacagcgaagaaaacggtgaaaatgctgaggaacgtgaagccatggccaagatccttgcgtcatatggtgatgtttacatcagtgatgcttttggtgcagctcaccgtgacagtgctaccatgaccggaattccaaagattttgggtcacggtgctgccggttatttgatggagaaggagatttcatacttcgctaaggtacttggtaacccgccgcgtccgctggttgctatcgttggtggagcgaaagtgagcgaaaagatccaacttctggataacatgttgcagcgcatcgattatctcttaattggtggtgcaatggcatacacatttctgaaggctcagggttacagcattggaaaatcgaagtgcgaggaaagtaaacttgaatttgctcgatccctgctgaagaaggcggaggaccgcaaggtgcagattattcttccaattgatcatgtttgccacacggaattcaaagctgtggattctccattgataactgaggatcaaaacatccctgaaggacatatggctctggatattggtcccaagactattgaaaaatatgttcagacgattgggaagtgtaagagcgccatttggaacggtcccatgggtgtatttgaaatggttccttattccaaaggtacatttgcaattgcgaaagccatgggtcgaggaactcagaaacgtggactcatgagtatcatcggtggtggtgagagtgcgggtgcggctgaactctgtggtgaagctgcacgtatttctcatgtttcaactggtggtggtgcgtctttggaactcctcgagggcaaaacgcttcccggtgttgcagtattggatgataaggagtaa

SEQ ID NO: 10617 - protein, 509 aa, Trypanosoma brucei
MSTAPNAKNNISLKKSVGDVWPLTAKRVLMRVDFNVPMQNGHITNDYRIRAAIPTIRRVIDQGGICILLSHLGRPRGVSMVAGVRDIRRRYHEAQFHDNKGKTAFFSVLPGEEKVKILAKSSAREEATHISPEVKSGKTMLFARLPEDEKKSLLMQYLNENKDSALPQMSVSAGYEEQYSLRPVAVRLAELLGQHVYFAHDCLDARVEVSRLKRGNVMLLENVRFYSEENGENAEEREAMAKILASYGDVYISDAFGAAHRDSATMTGIPKILGHGAAGYLMEKEISYFAKVLGNPPRPLVAIVGGAKVSEKIQLLDNMLQRIDYLLIGGAMAYTFLKAQGYSIGKSKCEESKLEFARSLLKKAEDRKVQIILPIDHVCHTEFKAVDSPLITEDQNIPEGHMALDIGPKTIEKYVQTIGKCKSAIWNGPMGVFEMVPYSKGTFAIAKAMGRGTQKRGLMSIIGGGESAGAAELCGEAARISHVSTGGGASLELLEGKTLPGVAVLDDKE

SEQ ID NO: 10618 - DNA, 1263 bp, Trypanosoma brucei
  CDS (1)..(1263)
atgtcactaaaagagaggaagagcattaatgaatgcgatcttaagggaaagaaggttcttatccgtgttgactttaatgttcctctggatgatggtaatattaccaacgactaccgaatccgatcagctcttccagccgtccaaaaagttctcacagaaggcggcagttgtgttctcatgagccacctcgggaggccgaaaggcgtttctatggctgaaggcaaagaactgcggagcactggcggtattcccgggttcgagcagaaggcaacactcaaaccggtagccaagcgcctcagcgaattgttatcgagacccgtcacattcgcacctgactgcctgaatgctgcagatgtcgtctctaagatgtctccgggcgatgttgttctgcttgaaaatgtacgcttctacaaagaagagggcagcaagagcactgaggaacgtgaagccatggccaagatccttgcgtcatatggtgatgtttacatcagtgatgcttttggtacagctcaccgtgacagtgctaccatgaccggaattccaaagattttgggtcacggtgctgccggttatttgatggagaaggagatttcatacttcgctaaggtacttggtaacccgccgcgtccgctggttgctatcgttggtggagcgaaagtgagcgacaagatccaacttctggataacatgttgcagcgcatcgattatctcttaattggtggtgcaatggcatacacatttctgaaggctcagggttacagcattggaatatccatgtgcgaggaaagtaaacttgaatttgctcgatccctgctgaagaaggcggaggaccgcaaggtgcaggttattcttccaattgatcatgtttgccacacggaattcaaagctgtggattctccattgataactgaggatcaaaacatccctgaaggacatatggctctggatattggtcccaagactattgaaaaatatgttcagacgattgggaagtgtaagagcgccatttggaacggtcccatgggtgtatttgaaatggttccttattccaaaggtacatttgcaattgcgaaagccatgggtcgaggaactcacgagcatggactcatgagtatcatcggtggtggtgacagcgcaagtgcagctgagttgagcggtgaggcgaagcgcatgtctcatgtttcaactggtggtggtgcgtctttggaactcctcgagggcaaaacgcttcccggcgttacagtattggacgaaaaggagtaa

SEQ ID NO: 10619 - protein, 420 aa, Trypanosoma brucei
MSLKERKSINECDLKGKKVLIRVDFNVPLDDGNITNDYRIRSALPAVQKVLTEGGSCVLMSHLGRPKGVSMAEGKELRSTGGIPGFEQKATLKPVAKRLSELLSRPVTFAPDCLNAADVVSKMSPGDVVLLENVRFYKEEGSKSTEEREAMAKILASYGDVYISDAFGTAHRDSATMTGIPKILGHGAAGYLMEKEISYFAKVLGNPPRPLVAIVGGAKVSDKIQLLDNMLQRIDYLLIGGAMAYTFLKAQGYSIGISMCEESKLEFARSLLKKAEDRKVQVILPIDHVCHTEFKAVDSPLITEDQNIPEGHMALDIGPKTIEKYVQTIGKCKSAIWNGPMGVFEMVPYSKGTFAIAKAMGRGTHEHGLMSIIGGGDSASAAELSGEAKRMSHVSTGGGASLELLEGKTLPGVTVLDEKE

SEQ ID NO: 10620 - DNA, 1323 bp, Trypanosoma brucei
  CDS (1)..(1323)
atgacccttaacgagaagaagagcattaatgaatgcgatcttaagggaaagaaggttcttatccgtgttgactttaatgttcccgtgaaaaacggtaagatcaccaacgactaccgaatccgatcagctctgccaacgctcaagaaggttctcacagaaggcggcagttgtgttctcatgagccacctcgggaggccgaaaggtattcccatggcgcaagctgacaaaatacggagcactggcggtgttcccgggttccaacagaaggcaacactcaaaccggtagccaagcgcctcagcgaactgctattgaggcccgtcacattcgcacctgactgcctgaatgctgcagatgtcgtctctaagatgtctccgggcgatgttgttctgcttgaaaatgtacgcttttacaaagaagagggcagcaagaaggcaaaagaacgtgaagccatggccaagatccttgcgtcatatggtgatgtttacatcagtgatgcttttggtacagctcaccgtgacagtgctaccatgaccggaattccaaagattttgggcaacggtgctgccggttatttgatggagaaggagatttcatacttcgctaaggtacttggtaacccgccgcgtccgctggttgctatcgttggtggagcgaaagtgagcgacaagatccaacttctggataacatgttgcagcgcatcgattatctcttaattggtggtgcaatggcatacacatttctgaaggctcagggttacagcattggaaaatcgaagtgcgaggaaagtaaacttgaatttgctcgatccctgctgaagaaggcggaggaccgcaaggtgcaggttattcttccaattgatcatgtttgccacacggaattcaaagctgtggattctccattgataactgaggatcaaaacatccctgaaggacatatggctctggatattggtcccaagactattgaaaaatatgttcagacgattgggaagtgtaagagcgccatttggaacggtcccatgggtgtatttgaaatggttccttattccaaaggtacatttgcaattgcgaaagccatgggtcgaggaactcacgagcatggactcatgagtatcatcggtggtggtgacagcgcaagtgcagctgagttgagcggtgaggcgaagcgcatgtctcatgtttcaactggtggtggtgcgtctttggaactcctcgagggcaaaacgcttcccggcgttgcagtattggacgaaaagtcggcggttgtgtcgtatgcctctgcaggtactggaactctttctaaccggtggagctctctttaa

SEQ ID NO: 10621 - protein, 440 aa, Trypanosoma brucei
MTLNEKKSINECDLKGKKVLIRVDFNVPVKNGKITNDYRIRSALPTLKKVLTEGGSCVLMSHLGRPKGIPMAQADKIRSTGGVPGFQQKATLKPVAKRLSELLLRPVTFAPDCLNAADVVSKMSPGDVVLLENVRFYKEEGSKKAKEREAMAKILASYGDVYISDAFGTAHRDSATMTGIPKILGNGAAGYLMEKEISYFAKVLGNPPRPLVAIVGGAKVSDKIQLLDNMLQRIDYLLIGGAMAYTFLKAQGYSIGKSKCEESKLEFARSLLKKAEDRKVQVILPIDHVCHTEFKAVDSPLITEDQNIPEGHMALDIGPKTIEKYVQTIGKCKSAIWNGPMGVFEMVPYSKGTFAIAKAMGRGTHEHGLMSIIGGGDSASAAELSGEAKRMSHVSTGGGASLELLEGKTLPGVAVLDEKSAVVSYASAGTGTLSNRWSSL

SEQ ID NO: 10622 - DNA, 1908 bp, Pseudomonas sp
  CDS (213)..(1376)
cacgccagctgtgatttcaacaatgacccgcactcggcgattgttgacgccagccagacccgcgtttccggcccccggctggtgaacctgctggcgtggttcgacaacgaatgggggtttgccaatcgaatgatcgatgtggctgagcactatctgcacgtaactcacccaaaacccgctctctaacattagaaactcaggaactgcgacccatgaccgtgttgaagatgaccgacctcgatctgcaaggtaagcgcgtgctgatccgcgaagacctcaacgtcccagtcaaggacggtgttgtcaccagcgatgcgcgcatccttgcttcgctgccgaccatcaagctggcgttggaaaaaggcgcggcagtcatggtctgctcgcacctgggccgtccgactgaaggcgagttttcagcagaaaacagcctcaagcctgttgctgattacttgagcaaggcgctgggccgtgaagtgccgctggtgagcgactacctcaatggcgtggacgttaaagccggcgacatcgtgctgttcgaaaacgtgcgcttcaacaaaggcgaaaagaaaaacgctgacgaattggccaagcaatacgcggccctgtgcgacgtgtttgtgatggatgcctttggcactgcacaccgcgccgaaggtccgacccacggcgtggccaagttcgccaaagtggcggctgcgggcccgttgctggcggcggaactggacgcactgggcaaagccctgggtgctccggccaagccaatggctgcgattgttgcaggctccaaggtgtcgaccaaacttgacgtactcaacagcctgagccagatctgcgacctgctgatcgttggcggtggcattgccagcacgttcctcgcggcggccggtcatccggtgggcaagtcgctgtacgagcctgatttgctggacaccgcgcgtgccatcgccgccaaggtcaacgtgccgttgcctaccgatgtggtcgtggccaaggaatttgctgaaagcgccgaagccaccgtcaagctgattgctgacgtggcagcagacgacatgattctggatatcggcccacaaacagccgagcacttcgcgcagctgttgaagacctcgaagactatcctgtggaacggacctgtcggcgtgttcgagttcgatcagttcggcaacggtaccaaagtgctggccaaggccatcgccgacagcgctgcattttctattgcaggcggcggcgacacattggcggccatcgacaagtacggtgtggccgatcaaatttcctacatctccaccggtggcggtgcattccttgagttcgttgaaggcaaagtgctgcctgctgtagaagtgctggaaagccgcgccaaagcctgaaaatgattcaggccctgaaaggtagcatggacatggtcaacgttgttaccgctgttgatgatcgcgggcttgttggccggttgcgccggttcaagcgagtcagtacctgaagcggctacgcctgaagagagcggctgctatcaggccgactggcaggcgcagagcttgccattggtcaataaacgatcagggccgcaagcgctggaaaaatacgagtcacccacgccttcaaaagtacgcgggtgcccatgatttgaacacgccagctcctacagagcggcgtgtagctatggctggagctgtaacgtttcagcgaaaacgaattcgcagtaaagggctaaaccccgatctgcaaaaacttgaatagcagctgccgctacggcaggcttgcacgattaacgaccctcgtccgggagagagacacacaatggcacttatcagcatgcgtcaggtgctggaccacgccgccgaattcggctacggcgttccagctttcacgtcaccaaccttgagccagatgcgcgccattatt

SEQ ID NO: 10623 - protein, 387 aa, Pseudomonas sp
MTVLKMTDLDLQGKRVLIREDLNVPVKDGVVTSDARILASLPTIKLALEKGAAVMVCSHLGRPTEGEFSAENSLKPVADYLSKALGREVPLVSDYLNGVDVKAGDIVLFENVRFNKGEKKNADELAKQYAALCDVFVMDAFGTAHRAEGPTHGVAKFAKVAAAGPLLAAELDALGKALGAPAKPMAAIVAGSKVSTKLDVLNSLSQICDLLIVGGGIASTFLAAAGHPVGKSLYEPDLLDTARAIAAKVNVPLPTDVVVAKEFAESAEATVKLIADVAADDMILDIGPQTAEHFAQLLKTSKTILWNGPVGVFEFDQFGNGTKVLAKAIADSAAFSIAGGGDTLAAIDKYGVADQISYISTGGGAFLEFVEGKVLPAVEVLESRAKA

SEQ ID NO: 10624 - DNA, 1449 bp, Drosophila melanogaster
  CDS (11)..(1357)
tttatttaatatgcttccaattcggcagagtttataccaaagagctcaaactcgatttacaaaattaagatttccaagattttttagcaaagacgattgcaatggaaagcaagtaaagaagttgagcttaaaaaatgtagatgtggctgggaaaagggtttttatgagagtggactttaatgtacccatgaaagatggcaaaataaccaacaaccaacgaattgtttccgcacttcccagtattaaatatgccttggacaagaaatgtaagtccttggttttggcatcccacttggggcgtccggatggcaaaaagaacaaaaagtttagcctggaacccgtggccaaggagctggagagtgtgctgggccagccggttcaattcctggacgactgcgtgggtgatagcaccctgagagctttgaaggatccctccgacggcactgtgttcctgttggagaatcttcgtttctatgccgaggagacgggcagcagcaaggacgataacaagaagaaggtcaaagcagatcccgcgaaggtgaaggaattccgagccaagttggcgcagctgggcgagatctatgtgaacgatgcctttggaacagcacatcgtccgcatagttccatgatgggcgatggctacaaggtgcgagcggctggtttcctgctggacaaggaactggagtactttgccaaggttctccacgatccggccaagccctttttggccattctgggtggcgccaagatagccgataaaattccactgataacgaacctcctgaacaatgtaacggccatgatcatatccggtggcatggccttcacctttctcaaagtgctcaatggcatggagattggaaagtccctcttcgacgagaagggatccgagttggtcaacgacatagtctgcaaggcgaaggagaaggacgtgaatatactatttccgattgactttgtcatagccaataagatcgacaaggagccggataaagtggaacatgtggatgccacacagggcataccggaggacatgatgggtctggaccacggccaggcatccagtcagatgtttgctggcgctatttgtgcatccaaaaccatcgtctggaacggaccgccaggcttgttcgaaaacgagctattctccaaaggcaccgagtccatgctggaggcagtaatcggggccactaaccgaggagccaccacaatcgttggtggtggggatacggccaccgcttgcttgaagttcggaggcgccgacaaggtctcgcatgtgtccaccggtggaggagcttccctggagttgctggagggtaaggttctgcctggagtggctgctctttcggatgcctaaacgcactgctttacaatggttattccacttatatgtacatgtatcttaaattcaatttggacaatttaaacaatcagtctctcaaaatacaa

SEQ ID NO: 10625 - protein, 448 aa, Drosophila melanogaster
MLPIRQSLYQRAQTRFTKLRFPRFFSKDDCNGKQVKKLSLKNVDVAGKRVFMRVDFNVPMKDGKITNNQRIVSALPSIKYALDKKCKSLVLASHLGRPDGKKNKKFSLEPVAKELESVLGQPVQFLDDCVGDSTLRALKDPSDGTVFLLENLRFYAEETGSSKDDNKKKVKADPAKVKEFRAKLAQLGEIYVNDAFGTAHRPHSSMMGDGYKVRAAGFLLDKELEYFAKVLHDPAKPFLAILGGAKIADKIPLITNLLNNVTAMIISGGMAFTFLKVLNGMEIGKSLFDEKGSELVNDIVCKAKEKDVNILFPIDFVIANKIDKEPDKVEHVDATQGIPEDMMGLDHGQASSQMFAGAICASKTIVWNGPPGLFENELFSKGTESMLEAVIGATNRGATTIVGGGDTATACLKFGGADKVSHVSTGGGASLELLEGKVLPGVAALSDA

SEQ ID NO: 10626 - DNA, 1239 bp, Methanosarcina acetivorans
  CDS (1)..(1239)
atgtctcagaaaactgctggaaaggattatttaactatggatgatgttgaactggataacaaaagaatacttttaagagtggactttaattcacctatggatgctaatggaaacatcctggatgatagaaaaattaagagccatttgtatacattgcggtccttggagaactcaagagtagttatgatgtctcatcagggtagacccggagataaggactatacaactctggaagctcatgcaaagctggcgacagaacttctgggcaggaaagtaacctatgaggatgacatattcagcgcttgcgcaaggaatgccataaaatcccttgagaaaggagatatcttgctccttgagaacacacgtttctatgccgaagagaacatgaatcgtgctcctgaagaacaggccagaacccagatggtacggaagctgtatcctttatttgatgtatttataaatgatgccttttcagtttctcacaggtctcaatgttctgtggtagggtttacagaggttttgcccagtgttgccggtatcctcatggatagggaaattacaggcctggacaaaggcttgaaatgtcatgaacatccggcagtcttcgcgctgggaggaacaaaagccaaagatatcgttaaggtcatttctgatattctcaagcggggtggcgctgacagaatccttactaccggggttgtagctacagtattcatgatggctataggcatcgaggtaggcgaggtcaacaggaaattcattgaggaccataaatatctggaccaggtttctatcgcttccaggctgctcaaggaatattcaggcaagatcatagtgcctaaggatatagcgctaaacaatgacggaaaacgtgaggaagtcaaagtggacaagataaagggagatcttccaatagctgatattggcccggagacaatatcagattattctaagtttcttaaagaagcaaagttaagcgtttttcacggcccggctggtattttcgagttagagagtttcaggctaggcaccgaagaacttcttaaagctgcagctcaatcaaattactctattgcaggaggagggcataccctagccgccattgatcaacttggcctggaatcaaaatattcccacttaagcatgggtggaggtgcgagcataacctatctctctggcgagcacatgccaggaattgaggctctaaaaaattatgcatccaggtgctgtaaagattaa

SEQ ID NO: 10627 - protein, 412 aa, Methanosarcina acetivorans
MSQKTAGKDYLTMDDVELDNKRILLRVDFNSPMDANGNILDDRKIKSHLYTLRSLENSRVVMMSHQGRPGDKDYTTLEAHAKLATELLGRKVTYEDDIFSACARNAIKSLEKGDILLLENTRFYAEENMNRAPEEQARTQMVRKLYPLFDVFINDAFSVSHRSQCSVVGFTEVLPSVAGILMDREITGLDKGLKCHEHPAVFALGGTKAKDIVKVISDILKRGGADRILTTGVVATVFMMAIGIEVGEVNRKFIEDHKYLDQVSIASRLLKEYSGKIIVPKDIALNNDGKREEVKVDKIKGDLPIADIGPETISDYSKFLKEAKLSVFHGPAGIFELESFRLGTEELLKAAAQSNYSIAGGGHTLAAIDQLGLESKYSHLSMGGGASITYLSGEHMPGIEALKNYASRCCKD

SEQ ID NO: 10628 - DNA, 1263 bp, Trypanosoma congolense
  CDS (1)..(1263)
atgacgctgaacgagaagaagagcattaacgagtgtgaccttaaggggaagaagacccttgtccgcgttgacttcaatgtccccgtgaaaggcggggtgatcaccaacgactatcgcatccggtcagcacttccaacaattcaaaaggtactgaatgagggtggcagctgcatcctgatgagccacctgggcaggccgaaggggatttcgatctctgaggccgccgcggtgcgcagcgctggtaaggtgcccggctacgaggaggcggctaccctacggcctgttgcacaaaggctcggcgagcttctgtcgaagcctgtcgtgttcgcacccgactgtttggacgccgctgatgtcgtcaagaagatgtctcctggagatgttgtactgttggagaatgtgcgcttctaccgcgaggagggcagcaagaaggaggaggagcgcgaggccatggccaaggtcctcgcgtcctacggtgatatcttcgtgagcgacgcctttggcaccgcgcaccgtgacagcgccacgatgacgggcatcccgaaggtgcttgggcacggcgctgctggttacctgatggagaaggagatctcgtacttctccaaggtgcttggcaacccgccgcgtccactggtggcgattgttggcggctcgaaggtgagcgataagattcagctgcttgacaatatgctgcagcgaatcgactacctgttgattggcggggcgatggcgtacaccttcttgaaggcacaaggccaccgcattggcacctcgatgtgtgaggaggacaggctggacctcgcacggtcgctgctgaagaaggctgaggaccgcaaagtgcaggtgctgctgccggtggaccacgtgtgccacacggagttcaaggcagttgatacgcctgtggtgacggctgatgccgatatcccggatggccacatggcactggacattggccccaagacaattgcgaattatgttgagacgattggtaaatgcaagagtgcgatttggaatggccccatgggcgtgtttgaaatgacgccgtactcgaagggcacgtttgctgttgccaaggcgatgggcgactgcactcaaaagaacggactgatgagcatcatcggtggcggtgacagtgcgagtgctgctgagcagagcggtgaagcgacgcgcatgtcacacgtgtccactggtggcggtgcctcactggagctgcttgagggcaaaacgctcccaggcgtcgccatattggatgagaaagtatga

SEQ ID NO: 10629 - protein, 420 aa, Trypanosoma congolense
MTLNEKKSINECDLKGKKTLVRVDFNVPVKGGVITNDYRIRSALPTIQKVLNEGGSCILMSHLGRPKGISISEAAAVRSAGKVPGYEEAATLRPVAQRLGELLSKPVVFAPDCLDAADVVKKMSPGDVVLLENVRFYREEGSKKEEEREAMAKVLASYGDIFVSDAFGTAHRDSATMTGIPKVLGHGAAGYLMEKEISYFSKVLGNPPRPLVAIVGGSKVSDKIQLLDNMLQRIDYLLIGGAMAYTFLKAQGHRIGTSMCEEDRLDLARSLLKKAEDRKVQVLLPVDHVCHTEFKAVDTPVVTADADIPDGHMALDIGPKTIANYVETIGKCKSAIWNGPMGVFEMTPYSKGTFAVAKAMGDCTQKNGLMSIIGGGDSASAAEQSGEATRMSHVSTGGGASLELLEGKTLPGVAILDEKV

SEQ ID NO: 10630 - DNA, 1251 bp, Methanosarcina acetivorans
  CDS (1)..(1251)
atgctgagggtaatgacttccagaaactttcttacgatcgatgactttgacatacgcggaaagacgattcttttaagggtcgacatgaactctcctatggacacacagggccacattctggacgatatgaggattaaaagccatattgcgaccttgaaagaccttgagagcgcaaaagtcgttctgcttgctcaccagagcaggcccgggaaaaaagatttcactactatgaaacctcatgcccacctgctgtcaagatatctgggcaagcaagttacttatgtggatgacattttcgggacatttgcaaaaacccatatagcctctatggaggacggggacgtaatcatgctcgaaaacgtccggttttattcggaagaaagccttgaaagaacacctgcagagcaggctaatacctatatggttaaaaaactggcaccttttgttgatattttcctgaacgacgcctttgcagtagctcacaggtctcatctctcggttgtaggctttaccgaggtccttccgtcaggcgcgggtagggtaatggaaaaagagcttgtttctctggatcggggagtaaaaggaggagaaaggccaagcattttcgtgctgggtggggcaaaggtagacgattctctgagagtgaccgaaaacgtccttacaagtggcggggctgacagggtgctgcttacaggtgtggttgcaaatgttgctcttgctgcttcgggagtaaacatcgggaaagtcaacatggatttcatcaaatctcagggttacgaaaaccagattgaaaaagcaagaggcttgcttgcgaagtttaaagacaggatcggccttccaaaagacgtagccttaaacgataacagggaacgcgttgaagttcatatctccgagctaaactccgattctctgcctattaatgatattgggctcgaaactattgtggactatacaaatgaaatccagaactccaaaaccgttgtcttaaacggtcctgcaggagtttccgagattgaagattttgccctcgggacccacgaaattataaaagctgccattaaatccgatttctcgatcattggcggcggtcacatctcagttgaggttgcacatctaggccttgaacaccgcttctcgcatatcagcacaggtgggggagcctgtattgattatcttgcaggagaaaagctgccgggagtcgagtctctgaaagctgcctacataaaatatcaggaagctaaaaagctttaa

SEQ ID NO: 10631 - protein, 416 aa, Methanosarcina acetivorans
MLRVMTSRNFLTIDDFDIRGKTILLRVDMNSPMDTQGHILDDMRIKSHIATLKDLESAKVVLLAHQSRPGKKDFTTMKPHAHLLSRYLGKQVTYVDDIFGTFAKTHIASMEDGDVIMLENVRFYSEESLERTPAEQANTYMVKKLAPFVDIFLNDAFAVAHRSHLSVVGFTEVLPSGAGRVMEKELVSLDRGVKGGERPSIFVLGGAKVDDSLRVTENVLTSGGADRVLLTGVVANVALAASGVNIGKVNMDFIKSQGYENQIEKARGLLAKFKDRIGLPKDVALNDNRERVEVHISELNSDSLPINDIGLETIVDYTNEIQNSKTVVLNGPAGVSEIEDFALGTHEIIKAAIKSDFSIIGGGHISVEVAHLGLEHRFSHISTGGGACIDYLAGEKLPGVESLKAAYIKYQEAKKL

SEQ ID NO: 10632 - DNA, 1254 bp, Rhizopus niveus
  CDS (1)..(1254)
atgtctttatctaacaaactttctatccgtgaccttgacctcaagaataagcgtgtccttattcgtgttgacttcaacgttcccatgaaggatggtgctatcaccaacaacaaccgtattgttcaagctcttcctactgtcaagtatgctcttgacaatggtgcttctgctgtcatcttgatgtctcacttgggtcgtcctaacggtgaagctgttgccaagtactctcttaagcccgttgctgctgaagtggagaagcttttgggtaagcccgtcgaattcctcaacgactgtgtaggtcccgatgtcgaaaaggcctgtcaatctgctactggtggtaaggtcatccttttggaaaaccttcgtttccacatcgaagaagaaggttctgccaaggtccgatggtcaaaggtcaaggcagatgctgaagctgtcaaaaagttccgtgcatctttgactgctcttgctgatatctatgtcaatgatgccttcggtaccgctcaccgtgctcactcttctatggtcggtgttgacctttctcaacgtgctgctggtttccttatgcaaaaagaactcgagtactttgccaaggctctcgaaaatcccgctcgtcctttccttgctatcctcggtggtgccaaggtctccgataagatccaattgattgaaaacatgcttgacaaggtaaacgctttgattgtctgtggtggtatggctttcactttcaagaagacgcttgataacgtcaagcagattggtaagtctctctttgatgaagctggttccaagttggtacgaaaccttgtcaagaaggccgccgaaaagaacgtcaaactcgttttccctgttgactttgtcactgctgataaattcgctcctgatgctaacactggttatgcaaccgatgctgatggtattcctgatgaatgggaaggccttgactgtggtaaaaaatcctccgagttgttccgtgaagaaatcttgaagtccaagaccatcgtctggaacggtccctctggtgtattcgaattcgatgcttttgctaatggtaccaagtctgttcttaatgctgtcatcgaagctacaaaggaaggtgctactacaatcattggtggtggtgacactgctactgctgctctcaagtggggtgctgaaggtaaagtttctcacatctctactggtggtggtgcctctcttgaactcctcgaaggcaaagaacttcctggtgtcaccgctctttctagcaagaattaa

SEQ ID NO: 10633 - protein, 417 aa, Rhizopus niveus
MSLSNKLSIRDLDLKNKRVLIRVDFNVPMKDGAITNNNRIVQALPTVKYALDNGASAVILMSHLGRPNGEAVAKYSLKPVAAEVEKLLGKPVEFLNDCVGPDVEKACQSATGGKVILLENLRFHIEEEGSAKVRWSKVKADAEAVKKFRASLTALADIYVNDAFGTAHRAHSSMVGVDLSQRAAGFLMQKELEYFAKALENPARPFLAILGGAKVSDKIQLIENMLDKVNALIVCGGMAFTFKKTLDNVKQIGKSLFDEAGSKLVRNLVKKAAEKNVKLVFPVDFVTADKFAPDANTGYATDADGIPDEWEGLDCGKKSSELFREEILKSKTIVWNGPSGVFEFDAFANGTKSVLNAVIEATKEGATTIIGGGDTATAALKWGAEGKVSHISTGGGASLELLEGKELPGVTALSSKN

SEQ ID NO: 10634 - DNA, 1750 bp, Leishmania major
  CDS (166)..(1419)
gtgtgcaatatcctttattggtcttcgctaatatgtctcgctacatcgagtacgccgcacgcacaatacgtgtctcacatgaacttgcccatcagcgcgtcagcagcaaaacatttctcttgtccctcgcctccaataaccttacgtatccccctccgccgagccatgtctctcgtgctgaagaagagcatcgatgacgccaccgtcagggacaagaaggtgctcatccgcgtggacttcaacgtccccgtgaagaacggtaagatcacgaatgacttccgcattcgctccgcccttccgacgatccaaaaggtgctgaaggagggcggctcctgcatcctgatgagccaccttggtcggccgaagggtgcgagaatgagtgacccaagtccggagaagggtgtgcgcgggtacgaggaggccgccacgctgcgcccggttgctgcacgcatcagcgagctgctggggcagaaggtggagtttgcaccggactgcctggacgctgcgtcgtacgcgtcgaagctgaagaacgcggacgtgctgttgctggagaacgtgcgtttctacgcggaggagggcagcaagaaggaggaggagcgcgacgcgatggcgaaggtactagcgtcgtacggcgacgtgtatgtcagtgacgcgtttggcactgcgcaccgcgacagcgcgacgatgacgggcatccccaaggtgctgggtgcgggctacgccgggtacctgatggagaaggagatcaactacttctcgcgagtgctgaacaacccgccgcggccgctggttgcgattgtcggcggtgcgaaggtcagcgacaagatccagctgcttgacaacatgctgggccgcatcaactaccttgtgattggtggcgcgatggcgtacacgttccagaaggcgcagggccgcaagatcggcatctcgatgtgcgaggaggataagctggaccttgccaagtcgctgctgaagaaggcgcaagagcggaatgtgcaggtgtttctgccagttgaccacgtgtgcaacaaggaatttaaggccgcggactcgccgctggtgacggagagcgtggacgtcccggacggctacatggcgctggacattggcccaaggacgatccacatgtacgaggaagtgattggccgctgcaagagcgcgatctggaacggcccgatgggcgtgttcgagatgccgtgctactcgaagggcacatttgccgttgcgaaggcgatggggactggaacgcagaagaacgggctgatgagcatcatcggcggtggtgacagcgcgagcgctgcggagctgagcggcgaggcgaagaacatgtcgcatgtgtccaccggcggcggtgcgtccctggagctgctggagggcaagacgctgcctggcgtcgccattctgacggacagagaatgagtgttgccctcatacgcaaagtgagccgtaaatcctttgataagctcttctctcagcttccgtcgaatcttgtcatgggtggccgcgacggcagcgtgtcgctacagacttctgtcttctattcgtattgtgacctacagatgtgcctctagctgtttctttcatacctctgtaacggtttctcttgtctcttgcactgtcctctacatacacacacatatatatatatatatgtatggtttgtgctcctcctgtttctcgatgaggggagaagtctcgacgacttcagagtcggcgacgccctccgctgtcatttggtctccctctctct

SEQ ID NO: 10635 - protein, 417 aa, Leishmania major
MSLVLKKSIDDATVRDKKVLIRVDFNVPVKNGKITNDFRIRSALPTIQKVLKEGGSCILMSHLGRPKGARMSDPSPEKGVRGYEEAATLRPVAARISELLGQKVEFAPDCLDAASYASKLKNADVLLLENVRFYAEEGSKKEEERDAMAKVLASYGDVYVSDAFGTAHRDSATMTGIPKVLGAGYAGYLMEKEINYFSRVLNNPPRPLVAIVGGAKVSDKIQLLDNMLGRINYLVIGGAMAYTFQKAQGRKIGISMCEEDKLDLAKSLLKKAQERNVQVFLPVDHVCNKEFKAADSPLVTESVDVPDGYMALDIGPRTIHMYEEVIGRCKSAIWNGPMGVFEMPCYSKGTFAVAKAMGTGTQKNGLMSIIGGGDSASAAELSGEAKNMSHVSTGGGASLELLEGKTLPGVAILTDRE

SEQ ID NO: 10636 - DNA, 1440 bp, Leishmania mexicana
  CDS (1)..(1440)
atgtcgctcgtgctgaagaagagtatcgatgatgtcgccttgaaggataagaaggtgctcatccgcgtggacttcaacgtccctgtgaaaaatggcgaaatcacgaatgacttccgcatccgttccgccttgccgacgatccagaaggtgctgaaggagggcggctcctgcatcctgatgagccaccttggcaggccgaagggtgcgaggatgagtgacccgaaaccagagaaaggtgtgcgcgggtacgaggaggctgcgacgcttcgcccggtcgctgcggccctctcggagcttctggagaagaaggtggcgtttgcgccggactgcctgaacgcttctatatacgtgtcgaagctgaagcgcggcgacgtgctgctgctggagaacgtgcgcttctacacggaggagggcagcaagaaggaggaggaggccgatgcgatggcgaaggtgctggcgtcatacgcggacctgtacgtcagcgatgcctttggcactgcgcaccgtgacagcgcgacgatgacgggcatccccaaggtgctgggctctggctatgcggggtacctgatggagaaggagatcaattacttctcgcgggtgctgaacaacccgccgcggccactggttgcgattgtcggcggcgcgaaggtgagcgacaagatcgagctgcttgacaacatgctgggccgcatcaattaccttgtgattggtggcgcgatggcgtacacgtttcagaaggcgcagggccgcaagatcggcatctcgatgtgcgaggaggataagctggatcttgccaagtcgctgctgaagaaggcgcaggagcgcggtgtgcaggtgcttctgccggtcgaccacgtgtgcaacaaagaattcaaggccgtggactcgccactggtgacggaggacgtggacgtaccggatggctacatggcgctggacattggcccaaagacgatccacatgtacgaggaggtgattggtcgctgcaagagtgccatctggaacggcccgatgggcgtgtttgagatgccgtgctactcgaagggcacatttgctgtcgcgaaggcgatggggactggaacgcagaaggacgggcttctgagcatcatcggcggtggcgacacggcgagtgctgcagagctgagcggcgaggcaaagaacatgtcgcatgtatccaccggcggcggtgcgtcgctcgagctgctggagggcaaaacgcttcctggcgttgctattctgacagacaaggaagtgaaggggcgtggacctttgttgaagtgcgcgtgtggtggtgcgagtccgagcaatgagtcttgtccgcgtaggagggagggtatctggggaggcggcttcatcgtaactgagattgtcaaacttgttggtgcgctgctgattggcatttttattggacgtcgcctgaacactaagcttatccggtaa

SEQ ID NO: 10637 - protein, 479 aa, Leishmania mexicana
MSLVLKKSIDDVALKDKKVLIRVDFNVPVKNGEITNDFRIRSALPTIQKVLKEGGSCILMSHLGRPKGARMSDPKPEKGVRGYEEAATLRPVAAALSELLEKKVAFAPDCLNASIYVSKLKRGDVLLLENVRFYTEEGSKKEEEADAMAKVLASYADLYVSDAFGTAHRDSATMTGIPKVLGSGYAGYLMEKEINYFSRVLNNPPRPLVAIVGGAKVSDKIELLDNMLGRINYLVIGGAMAYTFQKAQGRKIGISMCEEDKLDLAKSLLKKAQERGVQVLLPVDHVCNKEFKAVDSPLVTEDVDVPDGYMALDIGPKTIHMYEEVIGRCKSAIWNGPMGVFEMPCYSKGTFAVAKAMGTGTQKDGLLSIIGGGDTASAAELSGEAKNMSHVSTGGGASLELLEGKTLPGVAILTDKEVKGRGPLLKCACGGASPSNESCPRRREGIWGGGFIVTEIVKLVGALLIGIFIGRRLNTKLIR

SEQ ID NO: 10638 - DNA, 1530 bp, Trypanosoma congolense
  CDS (1)..(1530)
atgtcacacgttaccggcgtgacaagcaacatccgtatcaagaaaactatcgatgacatatggccgttaacagcgaagcgagtcctcgttcgcgttgactttaacgttcctatccaaaacggccacatcaccaatgactaccgcattcgtgccaccatccccaccattcagcgcatcattgatcagggcggcatttgtattcttctcagccaccttggaaggccggcaggcatttccatgacaacggcggtgcgggacgtcaggcgccgttaccacgaagctcatttccatgacaacaagggcaaaactgcgttcttcagtgtcctaccacccgaagagaaaataaagattttagctcagtctagtctcagggaggaggcaacacacataatgccgggggttaaatccgggaagacaatcctctttgcgcgactgccagaagacgagaagaaacagctcctgatgcagtacctcgatgaaaagaaagacaatggcctaccgcagcttagcgttagtgctggatatgaagagcagtacagtcttcgaccagtcgccgtacgattagccgaactacttggtcaacatgtctattttgcgcatgattgtatggacgctaaaatggagctgtctcgtttaaagaggggaaacgtcatgcttttggagaatgtgcgcttctaccgcgaggaggacagcaagaaggaggaggagcgcgaggccatggccaaggtcctcgcgtcctacggtgatatcttcgtgagcgacgcctttggcaccgcgcaccgtgacagtgccacgatgacgggcatcccgaaggtgcttgggcacggcgctgctggttacctgatggagaaggagatctcgtacttctccaaggtgcttggcaacccgccgcgtccactggtggcgattgttggcggctcgaaggtgagcgataagattcagctgcttgacaatatgctgcagcgaatcgactacctgttgattggcggggcgatggcgtacaccttcttgaaggcacaaggccaccgcattggcacctcgatgtgtgaggaggacaggctggacctcgcacggtcgctgctgaagaaggctgaggaccgcaaagtgcaggtgctgctgccggtggaccacgtgtgccacacggagttcaaggcagttgatacgcctgtggtgacggctgatgccgatatcccggatggccacatggcactggacattggccccaagacaattgcgaattatgttgagacgattggtaaatgcaagagtgcgatttggaatggccccatgggcgtgtttgaaatgacgccgtactcgaagggcacgtttgctgttgccaaggcgatgggcgactgcactcaaaagaacggactgatgagcatcatcggtggcggtgacagtgcgagtgctgctgagcagagcggtgaagcaacgcgcatgtcacacgtgtccactggtggcggtgcctcactggagctgcttgagggcaaaacgctcccaggcgtcgccatattggatgataaggagtaa

SEQ ID NO: 10639 - protein, 509 aa, Trypanosoma congolense
MSHVTGVTSNIRIKKTIDDIWPLTAKRVLVRVDFNVPIQNGHITNDYRIRATIPTIQRIIDQGGICILLSHLGRPAGISMTTAVRDVRRRYHEAHFHDNKGKTAFFSVLPPEEKIKILAQSSLREEATHIMPGVKSGKTILFARLPEDEKKQLLMQYLDEKKDNGLPQLSVSAGYEEQYSLRPVAVRLAELLGQHVYFAHDCMDAKMELSRLKRGNVMLLENVRFYREEDSKKEEEREAMAKVLASYGDIFVSDAFGTAHRDSATMTGIPKVLGHGAAGYLMEKEISYFSKVLGNPPRPLVAIVGGSKVSDKIQLLDNMLQRIDYLLIGGAMAYTFLKAQGHRIGTSMCEEDRLDLARSLLKKAEDRKVQVLLPVDHVCHTEFKAVDTPVVTADADIPDGHMALDIGPKTIANYVETIGKCKSAIWNGPMGVFEMTPYSKGTFAVAKAMGDCTQKNGLMSIIGGGDSASAAEQSGEATRMSHVSTGGGASLELLEGKTLPGVAILDDKE

SEQ ID NO: 10640 - DNA, 2014 bp, Volvox carteri
  CDS (23)..(1411)
gcagttccacacagtaaatacaatggccctctcgatgaagatgcgcgccaacgcgcgtgtggtctctggccgccgcgttgccgctgttgccccgcgcgttgtgcctttctcgtcggtcgcgcgtccagtcctgcgcagcacctttgcccctgaggtctccattgatattcgccgtgctggtcgcagccgcattgttgtcgaggcggttaagaagtcggtcggcgatctcggcaaggctgatttggagggcaagcgcgtcttcgtccgcgccgatctgaacgtgccgcttgataagaagaccctggccattaccgatgacacccgcatccgcgcggcggtcccaaccttgaagtacctgttggacaatggtgccaaggttctcctgacctcgcacctgggccgcccgaagggaggccccgaggacaagtaccgcctcacccctgtggtggcgcgactgtcggagctgctgggcaaggaggtgaagaaggtcgacgactgcattggcccgtccgttgagcaggctgtggcttccctgaagagcggcgagctcctgctgctcgagaacgtccgcttctacaaggaggaggagaagaacgaccccgagttcgccaagaagcttgcctccaacgctgacttgtacgtcaacgacgccttcggcactgcccaccgcgcccacgcctccactgagggtgtcaccaagttcctgaagccctccgtggcaggcttcctgctgcagaaggagctggactacctagacggcgccgtgtccgcccccaagcgccccttcgtggccattgttggaggctctaaggtgtcctccaagatcaccgtcattgagaagctcatggagaagtgcgacaagattatcattggtggtggcatgatcttcaccttctacaaggctcgcggcctgaaggtcggctcctcgctggtcgaggaggacaagctggagctggccaagaacctggaggccattgctaaggccaagggcgtgcagctcctcctgccgtctgacgtcgtggtggcggacaagttcgacgccaacgccaacacacagaccgtcagcgtggaggccatccccgacggctggatgggtctggacatcggccccgactccatcaagacgttccaggatgccctggctgacgccaagactgtcgtctggaacggccccatgggtgtgttcgagttccccaagttcgccgtcggcactgtggccattgccaacactctgtctgagctgacgccaaagggcgccatcaccatcatcggcggtggtgactcggtggccgccgttgagcaggctggtgtggctgagaagatgagccacatttccactggtggcggtgcctctctggagctgctggagggcaaggtcctgccgggcgttgctgctttggatgagaagtaattgcggcttgagtaaggtgtcgacagtcttttcgcgttggttgctgttctttttggaggcgattcgtctcgaggatgtgccccggggaaccgatcctggcgaaagtggctctccttggcgtgagtgtgcacctatctgctgggaggcactgcatgcgggtcggtgtgtgcgttggcgctatggatgtactgtgcggatctgttctgcgacatgctgcgacatgcctgtgctaaaccagaaatggttgggctctagctgaaaaataacatctgtgcggtgctctgcaacggcaatctacggatagttggttgtttttgaattttcggagtttagtaaccggcgacgctgaggtggtcatcgcatgcatttgctttttcgctgtggcataattcgcggttgcaataggaggttcaggaggagaagtgatgtgctgcacgtgtgcacggctctatttttggttggcaaaagcaaaagttttgttatgtttcgttgctttatcggccttgatgaagacatgaaatgtcggctatatgcccgttgtcgcccacagcgctcacttttctcggacctcgggaggtaaaatgttgtgtaacgccaaaaggc

SEQ ID NO: 10641 - protein, 462 aa, Volvox carteri
MALSMKMRANARVVSGRRVAAVAPRVVPFSSVARPVLRSTFAPEVSIDIRRAGRSRIVVEAVKKSVGDLGKADLEGKRVFVRADLNVPLDKKTLAITDDTRIRAAVPTLKYLLDNGAKVLLTSHLGRPKGGPEDKYRLTPVVARLSELLGKEVKKVDDCIGPSVEQAVASLKSGELLLLENVRFYKEEEKNDPEFAKKLASNADLYVNDAFGTAHRAHASTEGVTKFLKPSVAGFLLQKELDYLDGAVSAPKRPFVAIVGGSKVSSKITVIEKLMEKCDKIIIGGGMIFTFYKARGLKVGSSLVEEDKLELAKNLEAIAKAKGVQLLLPSDVVVADKFDANANTQTVSVEAIPDGWMGLDIGPDSIKTFQDALADAKTVVWNGPMGVFEFPKFAVGTVAIANTLSELTPKGAITIIGGGDSVAAVEQAGVAEKMSHISTGGGASLELLEGKVLPGVAALDEK

SEQ ID NO: 10642 - DNA, 1587 bp, Agaricus bisporus
  CDS (276)..(1526)
cagagcacgagtgacggatgtgacagtggggtcgacgcctagatcaatctttgcgcgagacttgacgatagactaatgccgcccgggcagcgctggcctgggggtatctgggaaatgcgcgtgcaggtggtctgcacttgtggtctgcagaaaatccgtcatcctggggctggacgcgggacggtggaggctggagacgggcgtgactgtgaccggactagaaagatatcttatctgctatatatactgggctcatactggcttatactgcagccatgtctctctccaacaaactctccatcactgacctcgccctcaccggcaagcgtgtccttatccgcgtcgacttcaactcccccatccaagacggaaagataaccaaccccgcccgtatcaatgccgccctccccactatcaaatatgccctcgacaatggcgcctccaaggtcatcttaatgtcgcatctcggcaggcccgatggcaaggcgatctccaaatactcactcaaacctgtggcctcagagctggaaaagctcttgaagaaaccggtcttcttcttgcatgactgcgtcggccctgacatcgaaaaggcagtcctggaggcacccgagggtgctgtcgttctgctcgagaaccttcgcttccacattgaggaagaaggctctgccaagaacgaggaaggaaaaaaaatcaaagctgatccttccaaggtcacccagttccgcgagcagctcaccaggctcggcgatgtttatgtgaacgatgcctttggtacggctcatcgcgctcactccagcatggttggcatcaagcttcctcgaagggcttctgggtttttggtcaagaaagaactagactactttgcaaaggcactggaaaaccccgaacgacccttccttgctatccttggtggtgccaaagtgtctgacaagatccagctgattgaaaacatgctcgacaaggtcaactgtctcgtcatcggaggtggtatggcattcactttcaagaagacaatgcaaaatgttgcgattggcaactctctctttgacaaaccagggtctgaaaaagtggccgggatcgtcgaaaaggccaagaagaacaatgtcgaaattgtgttccccgtcgactatgttgtcggagacaagtttgatgcaaacgccaaccacaagatagtcacggatgacgaaggcgttccggatggttggatgggtctcgacgttggtccaaagtctaatgagctcttccgtgaagcggtcctgaaagccaagacgattctctggaacggtcctcccggagtgttcgaatttcctgcgtttgccaagggatcaaaggtgcttttggatgccacggtagaggcggtacaaaagggggctactgttatagttggtgggggtgatacagctacggtagttgcgaatcatgacgcagaagagaagctgagccacgtcagcactggtgggggtgcgagtctggagctgctggagggcaagacgctgcctggagtggcagaattgagcaacaaatgacggtgtagctacttgtagatagaattcccacagtaaacatgtgactgggagtgaatgtgtc

SEQ ID NO: 10643 - protein, 416 aa, Agaricus bisporus
MSLSNKLSITDLALTGKRVLIRVDFNSPIQDGKITNPARINAALPTIKYALDNGASKVILMSHLGRPDGKAISKYSLKPVASELEKLLKKPVFFLHDCVGPDIEKAVLEAPEGAVVLLENLRFHIEEEGSAKNEEGKKIKADPSKVTQFREQLTRLGDVYVNDAFGTAHRAHSSMVGIKLPRRASGFLVKKELDYFAKALENPERPFLAILGGAKVSDKIQLIENMLDKVNCLVIGGGMAFTFKKTMQNVAIGNSLFDKPGSEKVAGIVEKAKKNNVEIVFPVDYVVGDKFDANANHKIVTDDEGVPDGWMGLDVGPKSNELFREAVLKAKTILWNGPPGVFEFPAFAKGSKVLLDATVEAVQKGATVIVGGGDTATVVANHDAEEKLSHVSTGGGASLELLEGKTLPGVAELSNK

SEQ ID NO: 10644 - DNA, 1295 bp, Aplysia californica
  CDS (55)..(1293)
gcacgagccttagtctcgagttattttctctcattttagattgcattcgcaaagatgaacaagctcagtattaacgacgtggatgtgagggacaagagagtcctgatcagagtcgatttcaacgtccccttgaaaaatggacagatctcaaacaaccagagaatcgctgcagccctgcctacgatcaagcttgccttggagaagggtgccaagtcagtggtgctcatgtctcatctcggtcggccagacgggcgcccaatccatgcggccagtatgaagccggtggtggcagagctggagaacctgttgggaaagaaaatcatgtttctggaagactgcgtgggttccaaggtagaggccgcctgtgccaacccggagcccggcagcgtgatcctgctggaaaatctccgcttccacgtggagaaggaggggaagggcaaggacgctcagggcaacaaggctaaggcagatgatgctgctgtggctgccttcagggcctccttgtccaaactgggagacgtctacgtgaacgacgcttttggcacagctcatagagctcacagctccatggtgggtgtggatctgccggtcaaggcctgcggtctgctcatgaagaaagagttggactactttgccaaagccctggagaaccccgctcgtccgttcctggctatcctgggaggagctaaagttgctgacaaaatccagctgattgagaaccttatggacaaagtcaatgagatgatcattggtggtggaatggctttcacattcttgaaagtactcaacaatatggacatcggaggttctctgtttgacgagggggccaagatcgttggccgtctggtggacaaggcgaaggagaagggagtgaagctccacctgccctccgacttcatcaccggcgacaagtttgccgacgtcgccaagtccgccacggcgtctgttgcgtctggcatcccagaaggttggatgggtctggatgttgggaccaaaaccaacgaagtattccagaaggtgattgaaggagcaaagacaattgtgtggaacgggccccccggagtgtttgagtttgagaacttcagcacgggctccaagcagatgatggactctgtggtcagggccaccgaggcaggaaccatcactatcattggtggatgtgacactgccacgtgtgccaagaattcaaacgccacggagaaggtgagccatgtgagcacaggaagcggaaccagcctggagctgttggaaggcaaaatccttcctggcgtggctgccctgtcccagccgtgatg

SEQ ID NO: 10645 - protein, 412 aa, Aplysia californica
MNKLSINDVDVRDKRVLIRVDFNVPLKNGQISNNQRIAAALPTIKLALEKGAKSVVLMSHLGRPDGRPIHAASMKPVVAELENLLGKKIMFLEDCVGSKVEAACANPEPGSVILLENLRFHVEKEGKGKDAQGNKAKADDAAVAAFRASLSKLGDVYVNDAFGTAHRAHSSMVGVDLPVKACGLLMKKELDYFAKALENPARPFLAILGGAKVADKIQLIENLMDKVNEMIIGGGMAFTFLKVLNNMDIGGSLFDEGAKIVGRLVDKAKEKGVKLHLPSDFITGDKFADVAKSATASVASGIPEGWMGLDVGTKTNEVFQKVIEGAKTIVWNGPPGVFEFENFSTGSKQMMDSVVRATEAGTITIIGGCDTATCAKNSNATEKVSHVSTGSGTSLELLEGKILPGVAALSQP

SEQ ID NO: 10646 - DNA, 1254 bp, Aspergillus oryzae
  CDS (1)..(1254)
atgtctctctccaacaagcttgccatcaccgatgtcgaccttaaggacaagcgcgtcttgatccgtgtcgacttcaacgttcctctcgatgccgacaagaagatcaccaacaatcagcgtatcgtcggtgctctgcctaccatcaagtacgccattgagaatggtgctaaggccgttgtcctcatgtcccacctcggccgtcccgatggcaaggccaatcccaagtacagcctgaagcctgttgctactgagctggagaagctgcttagcaagtctgtcatcttcgccgagaactgcgtcggcaaggagactgaagagattgtgaacaaggccactggtggccagatcatcctccttgagaacctgcgtttccacgccgaggaggagggcagctctaaggatgccgagggcaagaaggtcaaggctgacaaggagaaggtcgaagagttccgcaagggactgactgctcttggtgacgtctacatcaacgacgctttcggaactgcccaccgtgctcacagctcgatggttggtgttgacctgccccagaaggcttccggcttcttggtgaagaaggaacttgagtactttgctaaggctttggaaagcccccagcgccccttcctggccattctgggaggtgccaaggtctctgacaagatccagctgatcgacaacctgttgcccaaggtcaacagcttgatcatcactggtgctatggccttcaccttcaagaagaccctcgagaacgtcaagattggcaacagtttgttcgatgaggccggtagcaagattgtcggcgatatcgttgagaaggccaagaagaacaatgtcaagattgttctgcccgttgactacgtgaccgctgacaagttcgccgccgatgccaagactggctatgccaccgatgctgacggtattcccgatggatacatgggcctggatgtcggtgagaagagtgttgagctgtacaagaagactattgccgaggccaagaccatcctctggaacggtcctcctggtgtcttcgagctggagcccttcgccaacgctaccaagaagacccttgatgctgctgttgcggctgctcagtctggttctattgtcatcatcggcggtggtgacactgcaaccgtcgctgccaagtacggtgctgaggccaagctcagccatgtctccaccggtggtggtgcatccctggagctccttgagggcaaggttctccctggtgttgatgctctgtcaagtaagtaa

SEQ ID NO: 10647 - protein, 417 aa, Aspergillus oryzae
MSLSNKLAITDVDLKDKRVLIRVDFNVPLDADKKITNNQRIVGALPTIKYAIENGAKAVVLMSHLGRPDGKANPKYSLKPVATELEKLLSKSVIFAENCVGKETEEIVNKATGGQIILLENLRFHAEEEGSSKDAEGKKVKADKEKVEEFRKGLTALGDVYINDAFGTAHRAHSSMVGVDLPQKASGFLVKKELEYFAKALESPQRPFLAILGGAKVSDKIQLIDNLLPKVNSLIITGAMAFTFKKTLENVKIGNSLFDEAGSKIVGDIVEKAKKNNVKIVLPVDYVTADKFAADAKTGYATDADGIPDGYMGLDVGEKSVELYKKTIAEAKTILWNGPPGVFELEPFANATKKTLDAAVAAAQSGSIVIIGGGDTATVAAKYGAEAKLSHVSTGGGASLELLEGKVLPGVDALSSK

SEQ ID NO: 10648 - DNA, 1260 bp, Bacteroides thetaiotaomicron
  CDS (1)..(1260)
atgcagacaattgacaaattcaattttgccggtaaaaaggcatttgttcgcgtggacttcaatgtacccctggacgaaaacttcaacattacagatgacactcgtatgcgtgcagctcttcctactttgaagaagattttggctgacggcggtagcatcatcatcggttctcacctgggccgtccgaaaggcgttgccgacaaattctctttgaaacatatcatcaaacatctgtctgaactgctgggcgttgaagttcagtttgctaacgactgcatgggcgaagaagccgctgtaaaagctgctgctctgcaaccgggagaagttctgttgctcgaaaaccttcgcttctatgctgaggaagaaggcaaaccaagaggtttggctgaagatgccacagacgaagaaaaggctgctgcaaagaaggctgtcaaagaaagccagaaagaattcaccaagaaattggcttcttacgctgactgctacgtaaacgacgcattcggtacagctcaccgtgcacacgcttctacagctctgatcgctaaatacttcgacactgacaacaagatgttcggttacctgatggagaaagaagtaaaagctgttgataaagtattgaacgacatccaacgtccgttcactgctatcatgggtggttctaaagtttcttctaaaatcgaaatcatcgaaaacctgttgaataaggtagacaacctgatcatcgcaggtggtatgacttatacattcaccaaagcaatgggtggtaaaatcggtatctctatctgtgaggacgacaaacttgacctggctttggatctgatcaagaaagcaaaagaaaagggtgtaaaccttgtactggctgttgacgctaagatcgctgacgctttctctaacgacgctaacactcagttctgcgctgttgatgaaattcctgacggatgggaaggtcttgacatcggtcctaagactgaagaaatcttcgctaacgtaatcaaagaatccaaaactattctttggaacggtcctacaggtgtattcgaatttgaaaacttcactcacggttcacgtacagtaggtgaagctatcgttgaagcaactaagaacggtgcattctcacttgtggggggtggtgactctgtagcttgtgttaacaagttcggtctggctagcggcgtatcttatgtttctacaggtggtggcgcattgctcgaagcaatcgaaggaaaagttcttccgggtatcgctgccattaatgaataa

SEQ ID NO: 10649 - protein, 419 aa, Bacteroides thetaiotaomicron
MQTIDKFNFAGKKAFVRVDFNVPLDENFNITDDTRMRAALPTLKKILADGGSIIIGSHLGRPKGVADKFSLKHIIKHLSELLGVEVQFANDCMGEEAAVKAAALQPGEVLLLENLRFYAEEEGKPRGLAEDATDEEKAAAKKAVKESQKEFTKKLASYADCYVNDAFGTAHRAHASTALIAKYFDTDNKMFGYLMEKEVKAVDKVLNDIQRPFTAIMGGSKVSSKIEIIENLLNKVDNLIIAGGMTYTFTKAMGGKIGISICEDDKLDLALDLIKKAKEKGVNLVLAVDAKIADAFSNDANTQFCAVDEIPDGWEGLDIGPKTEEIFANVIKESKTILWNGPTGVFEFENFTHGSRTVGEAIVEATKNGAFSLVGGGDSVACVNKFGLASGVSYVSTGGGALLEAIEGKVLPGIAAINE

SEQ ID NO: 10650 - DNA, 1194 bp, Bartonella henselae
  CDS (1)..(1194)
atgggttttcgtacacttgatgatgttgatgtcacaggaaaacgtgttcttgtgcgggtggattttaatgtaccaatggcgcaaggaaaagtttgtgatgatacgcgtcttaaacgacataaagaaacgctccttgaattgcaaaagcgtggtgctaagcttattcttctttcccattgtgggcgccctaaaggacaagtggagccagaattttcactccatcctgttgtgcaagtgctggaaaaaataatcaaccaacccgtgaattttgcatcagattgtattggtgtagctgtacagacagcggttgaagcattgcaaaatggtggtattttactgcttgaaaatgttcgttttcattcaggtgaagaaaagaatgcgggctcttttgctgaggctctagcccataatggagatctctatgtcaatgatgctttttcagtctctcatcgtgcccatgcttcggtagaggggataacacattttttgccttcctatgcggggcgttctttacaatgtgagttgcaagcattggaaaaagggcttggtaagccagagcgtccggtgatcgcaattgttggaggggcgaaggtttccagtaagctttttgtgctcaatcatttggttaaaaaggtcgattatttggtcattggtggtggcatggccaatagttttttagcagcgcaaggtgtgtgtgttggaaagtcattgtgtgaacatgcgctgatcgaaacggtaaaaaaagttattgaaaaagcacgggagtgccaatgtacgcttctgctccctgtggatgcaatcgttggatttcgctttgaaaaagatgcgccacatcgtctctatgatattggagatattcctgaggatgggatgattttggatgttggtacgcgctccattgcgcatatcaatgccgtgatcgataaagccgctacccttgtgtggaatggacctcttggtgtttttgagatgtctccttttgatcaaggaacgattgcagtggcacgccatgcagcagaacttagtttgacagggaaattggtttcaattgctggagggggagatacggtgtttgcacttaatcatgctggtgttgctgatgattttacttatctttcaaccgcgggtggagcctttttggaatggatggaaggcaagatgctgcctggtattctagccctcacgcaggcttga

SEQ ID NO: 10651 - protein, 397 aa, Bartonella henselae
MGFRTLDDVDVTGKRVLVRVDFNVPMAQGKVCDDTRLKRHKETLLELQKRGAKLILLSHCGRPKGQVEPEFSLHPVVQVLEKIINQPVNFASDCIGVAVQTAVEALQNGGILLLENVRFHSGEEKNAGSFAEALAHNGDLYVNDAFSVSHRAHASVEGITHFLPSYAGRSLQCELQALEKGLGKPERPVIAIVGGAKVSSKLFVLNHLVKKVDYLVIGGGMANSFLAAQGVCVGKSLCEHALIETVKKVIEKARECQCTLLLPVDAIVGFRFEKDAPHRLYDIGDIPEDGMILDVGTRSIAHINAVIDKAATLVWNGPLGVFEMSPFDQGTIAVARHAAELSLTGKLVSIAGGGDTVFALNHAGVADDFTYLSTAGGAFLEWMEGKMLPGILALTQA

SEQ ID NO: 10652 - DNA, 1206 bp, Bdellovibrio bacteriovorus
  CDS (1)..(1206)
atggctaacggtcttaaaggcatcaagacagttcgtgatttcgagttggcgggaaaagttgttttcctgcgcttggatttgaacgttccaatggagaacggcaagatcacggatgaaaatcgcatcacggcatctttgccgacaatcaagtattgcatggagcagggagcgaagctggtaatggcttctcacctgggccgtccaaaaaccaaagacgacacagagttttctttggagccagtggcaaaacgcctgcaggaccttttgaatgccgaagtgattctggtggaagaaccggactctgacgctccaaaacacctgcttccatctttgaagcctcatcagctgatccttcttgaaaacgtgcgttttgaagaaggggagacgaaggactctgttgagttcgcgcaaaagatcgccaactacagcgacatttacatcaatgacgctttcggcgcttctcaccgcgctcacgcgaccattcacgctttgccttcagtgatgaaggacaaaggtatcggcttcctgattgaaaaggaaatcacgatgctggattcccttctgcaaaacccaaaacgcccgtacatcgcggtgatgggtggcgcgaaggtttctgacaagatcgcggttattgaacgccttatggacgttgttgacggtttcatcgtgggtggcgcgatggcgtacactttcctgaaagctcaaggcctgccagttggtaagtctttggttgaaaatgacaaattgaaatacgccaaagaaatgatcgagcgtatcgaagcccgcaacaaaaccattttgttgccggtggatcacgtggcgaccaaaggcatcacagacacagcgcacgcgcatgtgaccaatgatgtggcgattgcggaagacgaattgggtgtggacatcggtcctaaatccatcaagaacttctctgcggctttgcgtgaagcaggcactattttctggaacggtcctatgggcatctttgaaaatccggcttttgcaaaaggcaccttcggcgtggctcaggccattgctgacagcgaagcgatcaaaatcgtgggtggtggtgattctgcagcggcagcggaagcttccggctttgcaggtaaaatgacccacatctccactggtggtggcgcatccttggaatacttgcagggcgataaattgccaggacttgaaattttaagaactcgcatccgctaa

SEQ ID NO: 10653 - protein, 401 aa, Bdellovibrio bacteriovorus
MANGLKGIKTVRDFELAGKVVFLRLDLNVPMENGKITDENRITASLPTIKYCMEQGAKLVMASHLGRPKTKDDTEFSLEPVAKRLQDLLNAEVILVEEPDSDAPKHLLPSLKPHQLILLENVRFEEGETKDSVEFAQKIANYSDIYINDAFGASHRAHATIHALPSVMKDKGIGFLIEKEITMLDSLLQNPKRPYIAVMGGAKVSDKIAVIERLMDVVDGFIVGGAMAYTFLKAQGLPVGKSLVENDKLKYAKEMIERIEARNKTILLPVDHVATKGITDTAHAHVTNDVAIAEDELGVDIGPKSIKNFSAALREAGTIFWNGPMGIFENPAFAKGTFGVAQAIADSEAIKIVGGGDSAAAAEASGFAGKMTHISTGGGASLEYLQGDKLPGLEILRTRIR

SEQ ID NO: 10654 - DNA, 1206 bp, Bifidobacterium longum
  CDS (1)..(1206)
atgaagacactcaaggaccttggagatctcaagggcaagcgcgttctggttcgcgctgatttcaatgttccgctggacggcaccaccatcaccgatgacggtcgaatcaaggctgctctgccgaccatcaagaccctgcgcgaagaaggcgccaaggtcatcctcatggcccaccttggccgcccgaagggcaaggtcgttcctgagctgagcctggccccggttgccgcccgcctcggcgagctgctcggcgccaacgtgccgctggccaaggacacctacggcgaggacgctcaggccaaggtcgccgccatgaacgatggcgacgttgtgctgcttgagaacgttcgtttcaacccggaggagacctctaaggacgccgacgaacgcgccgcttacgccaagaagatcgccgccctcggcgaggccttcgtttccgatggcttcggcgtggtccaccgcgctcagggctccaactacgacgttgccgccgatctgccggccgccgcaggcctgctggtcgagaaggaagtcaaggccttgtccaaggccaccgagaacccggagcgtccgttcaccgtggtgctcggcggttccaaggtctccgacaagctcggcgtcatcgagaacctgctcgacaaggccaaccgtctggtcatcggcggtggcatggtgttcaccttcctcaaggccaagggctacgaggtcggcacctccctgcttgaagaggaccagcttgagaaggtcaagggctacatcgagaccgccgagaagaacggcgttgagctcgtgctgccgaccgacgtcgtcgtgaacgccggcttcccggccggtgacaccccggttgctccggaagtcgttgccgccgacgccatcccggccgacaagatgggtctggacatcggcccggagtcccagaagctcttccacgacaagatcgtcgactccaagaccgtcgtgtggaacggcccgatgggcgtgttcgaggttcctgagttcgccgccggcaccaaggccgtggcccagggtctggtcgacgccaccgcagtcggtgcgttcaccatcgtcggtggcggcgactccgcctccgccgtgcgcaacctcggcttcccggaggacggcttctcccacatctccaccggtggtggcgcttccctcgagttcctcgaaggcaaggagctccctggcctgaaggtgcttgagtaa

SEQ ID NO: 10655 - protein, 401 aa, Bifidobacterium longum
MKTLKDLGDLKGKRVLVRADFNVPLDGTTITDDGRIKAALPTIKTLREEGAKVILMAHLGRPKGKVVPELSLAPVAARLGELLGANVPLAKDTYGEDAQAKVAAMNDGDVVLLENVRFNPEETSKDADERAAYAKKIAALGEAFVSDGFGVVHRAQGSNYDVAADLPAAAGLLVEKEVKALSKATENPERPFTVVLGGSKVSDKLGVIENLLDKANRLVIGGGMVFTFLKAKGYEVGTSLLEEDQLEKVKGYIETAEKNGVELVLPTDVVVNAGFPAGDTPVAPEVVAADAIPADKMGLDIGPESQKLFHDKIVDSKTVVWNGPMGVFEVPEFAAGTKAVAQGLVDATAVGAFTIVGGGDSASAVRNLGFPEDGFSHISTGGGASLEFLEGKELPGLKVLE

SEQ ID NO: 10656 - DNA, 1194 bp, Bordetella pertussis
  CDS (1)..(1194)
atgtccaacgtcaatacgctttccgcgctggccaagagcggcgctctgtccggcaagcgcgttttcatccgcgccgacctcaacgtgccgttcgacgacgccggccgcatcagcgaagacacccgcatccgcgcctcggtgcccggcatccgcctggcgttagacgccggcgcggcggtcatggtcacctcgcacctgggccgccccaaggagggcgcgctgaccgaggcggactcgctggccccggtcgcgcagcgcctgtccgaactgctgggcatgcaggtgcgcctggtgcccgactgggtcgacggcgtttccgtcgagccgggcgaagtcgtgctgctggagaactgccgcggcaacgtgggcgagaaaaaggacgacgaaggcttgtcgcgcaagatggcggcgctgtgcgatgtgtacgtcaacgacgccttcggcaccgcgcaccgcgccgaggccaccacgcacggcatcgcgcgcttcgcgccggtggcctgcgccggcccgctgctggaggccgagctcgacgcgctggggcgcgcgctgcatgatcccaagcggccgctggtggcgatcgtgggcggctccaaggtgtcgaccaagctgtccatcctgcaatcgctggccgacaaggtcgaccagctggtggtcggcggcggcatcgccaacaccttcatgctggccgccggcctgcccatcggcaagtcgctggccgagcccgagcaggtcgagcaggcgcgcgccgtgatcgaaatcatgaagcgccgcggcgccgaggtgccgattcccaccgacgtggtttgcgccaagtcgttcggcgcggacgccgcggccaccgtcaaggcggccgccgacgtggccgaggacgacatgatcctcgacatcggaccgcagaccgcgcagcgcctggccgatatcctcaagacggccggcaccatcgtctggaacggtccggtcggcgtgttcgagttcgaccagttcgcccacggcaccgaggtggtggcgcgcgccatcgccgactcggcgggcttttcgattgccggcggcggcgatacgctggcggccatcgccaagtacggcatcgccgaccagaccggctatatctcgaccggcggcggcgctttcctggagttcctggaaggcaaggcgctgccggccgtggccgtgctgcaggcgcgcgccgcgtaa

SEQ ID NO: 10657 - protein, 397 aa, Bordetella pertussis
MSNVNTLSALAKSGALSGKRVFIRADLNVPFDDAGRISEDTRIRASVPGIRLALDAGAAVMVTSHLGRPKEGALTEADSLAPVAQRLSELLGMQVRLVPDWVDGVSVEPGEVVLLENCRGNVGEKKDDEGLSRKMAALCDVYVNDAFGTAHRAEATTHGIARFAPVACAGPLLEAELDALGRALHDPKRPLVAIVGGSKVSTKLSILQSLADKVDQLVVGGGIANTFMLAAGLPIGKSLAEPEQVEQARAVIEIMKRRGAEVPIPTDVVCAKSFGADAAATVKAAADVAEDDMILDIGPQTAQRLADILKTAGTIVWNGPVGVFEFDQFAHGTEVVARAIADSAGFSIAGGGDTLAAIAKYGIADQTGYISTGGGAFLEFLEGKALPAVAVLQARAA

SEQ ID NO: 10658 - DNA, 1197 bp, Bradyrhizobium japonicum
  CDS (1)..(1197)
atggcgaacaaattccgcaccctcgacgacgtcgacgtgaagggcaaacgcgtgctgctgcgcgtcgacctcaacgtgcccatggagaacgggcgcgtcaccgacgcaacccggctcgagcgcgtcgcgccgaccatcaccgagctcgccgacaagggcggcaaggtgatcctgctcgcgcatttcggccggccgaagggacgcgatgccaaggagtcgctcaagcccgtcaccgaggcgctgtcgaaggtcctgaacaagcccgtcgcgtttgccgacgactgcatcggcgagcccgcggccacggccgtggcggcactcaaggacggcgacatcctgtgcctggaaaacacccgcttccacaaggaagaggaaaagaacgatcccgccttcgtcgcggaattggccaagctcggcgacatctgggtcaatgacgcgttctcggccgcgcaccgcgcccacgcctcgaccgaaggcctcggccacaagctgccggcctatgccggccgcaccatgcaggccgagctcgatgcgctggagaaggcgctgggctcgccgaccaagccggtcatcgcgatcatcggcggcgccaaggtctcgaccaagatcgacctgctcgaaaacctcgtcagcaaggtcgacgcgctggtgatcggcggcggcatggccaacaccttcctgcacgcccagggcgtcggcatcggcaagtcgctggccgagaaggatctcgcgccgaccgcgctgcgcatcatcgagaaggcggaagccgccaactgcgccatcatcctgccggtcgacgccaccgtcgcctatcatttcgcggccaacgcgccgtcccacgcctacggcctcgatgcgatcccggccgacggcatgatcctcgacgtcggcccgcaatcggtcgcgcgcgtgcacgcggcgatcgacgacgcggcgacgctggtctggaacgggccgctcggcgccttcgagatgcagccgttcgaccgcggcacggtcgcggccgccaagcacgccgccgagcgcaccaaggcgaaaaagttgatctcgatcgcgggcggcggcgacaccgtcgcggccctcaaccaggcccacgtggccggtgacttcacctatgtctcgaccgccggtggcgcatttcttgaatggatggaaggcaagccactgcccggcgtcgaggtcctgcgcatcaagtag

SEQ ID NO: 10659 - protein, 398 aa, Bradyrhizobium japonicum
MANKFRTLDDVDVKGKRVLLRVDLNVPMENGRVTDATRLERVAPTITELADKGGKVILLAHFGRPKGRDAKESLKPVTEALSKVLNKPVAFADDCIGEPAATAVAALKDGDILCLENTRFHKEEEKNDPAFVAELAKLGDIWVNDAFSAAHRAHASTEGLGHKLPAYAGRTMQAELDALEKALGSPTKPVIAIIGGAKVSTKIDLLENLVSKVDALVIGGGMANTFLHAQGVGIGKSLAEKDLAPTALRIIEKAEAANCAIILPVDATVAYHFAANAPSHAYGLDAIPADGMILDVGPQSVARVHAAIDDAATLVWNGPLGAFEMQPFDRGTVAAAKHAAERTKAKKLISIAGGGDTVAALNQAHVAGDFTYVSTAGGAFLEWMEGKPLPGVEVLRIK

SEQ ID NO: 10660 - DNA, 1191 bp, Brucella abortus
  CDS (1)..(1191)
atgatgttccgcacccttgacgatgccaatgtccaatccaagcgcgtgctggtccgtgttgacctcaacgtgccgatggcaaacggcgaagtcaccgaccttacccgcatcgaacgcatcgttccgaccatcgcggaactgtcaaggaagggcgcgaaggtcatcctgctcgcccatttcggtcgcccgaagggggttgcctcggatgaaaattcgctgaagcatgtcgtgaagccgctctccaaggttctggatcacagtgttcattttgccgaagactgcatcggcgacaaggcgaaaccggccgtcgatgcgctgaaggacggcgacgtcctgcttctggaaaatacccgtttccacaagggcgaggaaaagaacgatcctgaattcgtgcaggcgctggccgccaatggggatctctatgtgaacgatgccttttccgccgctcaccgcgcccatgcctcgactgaaggtctggccaatgtcctgcctgccttcgcgggccgcgccatgcaggctgagcttgaagcacttgaaaagggcctcggcaatccggcccgcccggtggtcgccatcgtcggcggtgcaaaggtttcgaccaagctcgacctcctgtccaacctgatcgaaaaggtcgatgcgcttgtcatcggcggcggcatggccaacacgttccttgcagccaagggtcttgatgtcggcaaatcgctctgcgagcatgagctggcctcgaccgcacgcgaaatcatggccaaggccgaaaccaccaaatgcgccatcatcctgccggtggacgcggtcgtgggctggcacttcgccgccgatacgccacaccagacctatggcgtggattcggttccgggcgacgccatgatccttgacgcaggcgagctttcgaccgacctcattgcttcggccatcgatgatgccgcaacattggtctggaacggcccgcttggggctttcgagttgagcccctttgacacagcaacggtgaaggtcgcaaggcatgtcgcaaagcgcacaaaggaaggcaagcttgtttcggtcggcggcggcggcgatacggtggcagccctcaaccatgcgggcgtggccgacgacttcacctatatctcaaccgctggcggcgctttcctcgaatggatggaaggcaaaccgcttccgggcgtcgatgtattgaagaagtga

SEQ ID NO: 10661 - protein, 396 aa, Brucella abortus
MMFRTLDDANVQSKRVLVRVDLNVPMANGEVTDLTRIERIVPTIAELSRKGAKVILLAHFGRPKGVASDENSLKHVVKPLSKVLDHSVHFAEDCIGDKAKPAVDALKDGDVLLLENTRFHKGEEKNDPEFVQALAANGDLYVNDAFSAAHRAHASTEGLANVLPAFAGRAMQAELEALEKGLGNPARPVVAIVGGAKVSTKLDLLSNLIEKVDALVIGGGMANTFLAAKGLDVGKSLCEHELASTAREIMAKAETTKCAIILPVDAVVGWHFAADTPHQTYGVDSVPGDAMILDAGELSTDLIASAIDDAATLVWNGPLGAFELSPFDTATVKVARHVAKRTKEGKLVSVGGGGDTVAALNHAGVADDFTYISTAGGAFLEWMEGKPLPGVDVLKK

SEQ ID NO: 10662 - DNA, 1188 bp, Brucella suis
  CDS (1)..(1188)
atgttccgcacccttgacgatgccaatgtccaatccaagcgcgtgctggtccgtattgacctcaacgtgccgatggcaaacggcgaagtcaccgaccttacccgcatcgaacgcatcgttccgaccatcgcggaactgtcaaggaagggcgcgaaggtcatcctgctcgcccatttcggtcgcccgaagggggttgcctcggatgaaaattcgctgaagcatgtcgtgaagccgctctccaaggttctggatcacagtgttcattttgccgaagactgcatcggcgacaaggcgaaagcggccgtcgatgcgctgaaggacggcgacgtcctgcttctggaaaatacccgtttccacaagggcgaggaaaagaacgatcctgaattcgtgcaggcgctggccgccaatggcgatctctatgtgaacgatgccttttccgccgctcaccgcgcccatgcctcgactgaaggtctggcccatgtcctgcctgccttcgcgggccgcgccatgcaggctgagcttgaagcacttgaaaagggcctcggcaatccggcccgcccggtggtcgccatcgtcggcggtgcaaaggtttcgaccaagctcgacctcctgtccaacctgatcgaaaaggtcgatgcgcttgtcatcggcggcggcatggccaacacgttccttgcagccaagggtcttgatgtcggcaaatcgctctgcgagcatgagctggcctcgaccgcacgcgaaatcatggccaaggccgaaaccaccaaatgcgccatcatcctgccggtggacgcggtcgtgggctggcacttcgccgccgatacgccacaccagacctatggcgtggattcggttccgggcgacgccatgatccttgacgcaggcgagctttcgaccgacctcattgcttcggccatcgatgatgccgcaacattggtctggaacggcccgcttggggctttcgagttgcgcccctttgacacagcaacggtgaaggtcgcaaggcatgtcgcaaagcgcacaaaggaaggcaagcttgtttcggtcggcggcggcggcgatacggtggcagccctcaaccatgcgggcgtggtcgacgacttcacctatatctcaaccgctggcggcgctttcctcgaatggatggaaggcaaaccgcttccgagcgtcgatgtattgaagaagtga

SEQ ID NO: 10663 - protein, 395 aa, Brucella suis
MFRTLDDANVQSKRVLVRIDLNVPMANGEVTDLTRIERIVPTIAELSRKGAKVILLAHFGRPKGVASDENSLKHVVKPLSKVLDHSVHFAEDCIGDKAKAAVDALKDGDVLLLENTRFHKGEEKNDPEFVQALAANGDLYVNDAFSAAHRAHASTEGLAHVLPAFAGRAMQAELEALEKGLGNPARPVVAIVGGAKVSTKLDLLSNLIEKVDALVIGGGMANTFLAAKGLDVGKSLCEHELASTAREIMAKAETTKCAIILPVDAVVGWHFAADTPHQTYGVDSVPGDAMILDAGELSTDLIASAIDDAATLVWNGPLGAFELRPFDTATVKVARHVAKRTKEGKLVSVGGGGDTVAALNHAGVVDDFTYISTAGGAFLEWMEGKPLPSVDVLKK

SEQ ID NO: 10664 - DNA, 1167 bp, Buchnera aphidicola
  CDS (1)..(1167)
atgaatttaagaaaaatgactgaattaaatataacaggaaaaaaaattttaataagaacagatttaaatgttcctataaaaaatggcgtgattcaatctgatgcaagaatacttgctgctcttcctaccattgaaatagctattgaaaaaaaagctaaaataattattttatctcatttaggacgtccaaaagaagggtgctatacaaaaaaatattctttatttcctatttttgagtatctaaaaaagaaattaaaaaaaacaaaaatttacttttctgataatcacttaaaaaaagttgaaataaattcaggagaaatattaattttagaaaatgttcgttttaacgtgggagaattaaaaaacgatgaaaatttatctaaagaatatgctaatttatgcgatatttttgttatggatgcttttggtagtgcacatagaatgcaatcttcaacatatggcattggaaaatttgttaaaattgcatgtgcaggacctcttttaatatctgaaattaacaacttaaaaaaagcgttaaaaaatccgaaacgtcctatggtcgctatagtaggaggtgcaaaggtatcaaccaaatttaatgtgttaaataaattagctgcaatttcagatacaatcattgttggaggaggtatagctaatacatttttagctattgataataaaattggaaaatcgttacatgaaccgaaatttatactaaaagctaaaaagttacgtgataaatacaacaacattgtgataccaatcgattctcgtgtaggaaaaaacttttctcataaagaaaaatgcacaataaaattatcttctaatattgaaaaaaacgaagaaatcatggatttaggtgataaaacaataaaaaaaattatcaaaatacttaaaaaatcaaaaacaattctttggaatggacctgttggtgtttttgagtttcctaattttcgtaaaggaactgaaatgattgcaaaagcaattgcagaaaataatggattttcaatagctggcggtggagatacactatctgttattgatatgtttcaaataaaagataaaatttcttatatttcaacaggaggaggagcatttttagaattcatagaagggaaaaaattacctgccatgaaaatgttagaagaaaattttcacaaataa

SEQ ID NO: 10665 - protein, 388 aa, Buchnera aphidicola
MNLRKMTELNITGKKILIRTDLNVPIKNGVIQSDARILAALPTIEIAIEKKAKIIILSHLGRPKEGCYTKKYSLFPIFEYLKKKLKKTKIYFSDNHLKKVEINSGEILILENVRFNVGELKNDENLSKEYANLCDIFVMDAFGSAHRMQSSTYGIGKFVKIACAGPLLISEINNLKKALKNPKRPMVAIVGGAKVSTKFNVLNKLAAISDTIIVGGGIANTFLAIDNKIGKSLHEPKFILKAKKLRDKYNNIVIPIDSRVGKNFSHKEKCTIKLSSNIEKNEEIMDLGDKTIKKIIKILKKSKTILWNGPVGVFEFPNFRKGTEMIAKAIAENNGFSIAGGGDTLSVIDMFQIKDKISYISTGGGAFLEFIEGKKLPAMKMLEENFHK

SEQ ID NO: 10666 - DNA, 1182 bp, Buchnera aphidicola
  CDS (1)..(1182)
atgtctattattaaaattactgatttaaatcttttaaataaaaaagttcttattcgctcagatttaaacgtaccaataaaaaacaataaaatttcatcatatgcacgtattcatgcatcacttccaacaattaaatttgctctaaaaaatctagctaaagtaattgtcacttcacacctaggtaggccaactgaaggcatatacaaaaaaaaattttcattatttcctgtttttaaatattttaaaaaaatacttcctgaaactaatatatatttttctcaaaatttaactgaatgctcttcaataaaatccggtgaattaattatattagaaaacgtgcgattcaaccaaggagaaaaagaaaatagcaaaattctatctaaaaaatatgctactttatgtgatatatttgtcatggatgcatttggtgcaatacatagaaacgaagcatcaactaatgggataataaaatacgctaaattagcatgttctgggttattacttgaatcagaactaaaaacattaaattcagctttaactaatcctgttcgtcctatggttgcaattgtaggaggagctaaagtatctactaagtttaaaacattaactacattagcaaaaatttcagataccttgatagtaggaggaggtattgctaatacatttatatctattgatcacaatattggaaaatctttacatgatccaaaatttattgaacaagctaaaatactaaaagaaaaatacaacatttttattccaacagattctcgagttagcactacgtttacatatgacagtatagccactataaaaagtacatctgatattcacgctaatgaagaaattatggattttggcgatattagtattaaaaatatgataaatataataaaaaaagctaaaactatcttatggaatggaccaataggagtgtttgaattcaaaaactttagtaaaggaacagaacaattgtcaaaagctatcgcttccagtgatgcattttccatagcaggtggaggtgatacattatcagttgttgaaatgtttaaagtacaaaataacatctcatatctttctactggaggtggttcgtttttaaaatttttagaagggaataaatttcgtataattgagttattagaaaaacactttaataaatttaaaaataataatttttaa

SEQ ID NO: 10667 - protein, 393 aa, Buchnera aphidicola
MSIIKITDLNLLNKKVLIRSDLNVPIKNNKISSYARIHASLPTIKFALKNLAKVIVTSHLGRPTEGIYKKKFSLFPVFKYFKKILPETNIYFSQNLTECSSIKSGELIILENVRFNQGEKENSKILSKKYATLCDIFVMDAFGAIHRNEASTNGIIKYAKLACSGLLLESELKTLNSALTNPVRPMVAIVGGAKVSTKFKTLTTLAKISDTLIVGGGIANTFISIDHNIGKSLHDPKFIEQAKILKEKYNIFIPTDSRVSTTFTYDSIATIKSTSDIHANEEIMDFGDISIKNMINIIKKAKTILWNGPIGVFEFKNFSKGTEQLSKAIASSDAFSIAGGGDTLSVVEMFKVQNNISYLSTGGGSFLKFLEGNKFRIIELLEKHFNKFKNNNF

SEQ ID NO: 10668 - DNA, 2061 bp, Candida albicans
  CDS (714)..(1967)
aacggaactacactagtgtcctagaatatgtatactaatttgcaaaacaaatgctggcaaaaaaaaaaacctacagtggtggttataataaattatagatatgaaaaaggagatgcagcaactgttgagaagttgttaattaggaagctttatacagtattactattattattacttgctgcaccacctgatgaaatattaaaaaattgtagtgttgcgtgtgtgtcaggaggcatgcgaaatatggagcgttcttccccgggataaactcaatcgaggtattttttttttcttcacttgaacacgagacgctttgacattgaccaaatatgacgcaaacattatgatttggtgattgtttagctatagggaaggcaattggaataggtgtcatatgatctagggctacaattgatcaatttgagcaaaaataatagacgtagacactaattattaatcttgatttcattatacgtatgttcaaatttgttttctctctcttccagttgtgcgtctactgactcctgattgaattttttttttgttcactttctacaaaaatatataaatcctcttttaattccaactcaattcactcctcatttcattcaattgaatttttttttctttcttctttctttttttatttcttatattttctaattcaatttttcaatcaagcgattatcaattgcagaagaataactatcaaaatgtcattatctaacaaattatcagtcaaagacttagacgttgctggaaagagagtctttatcagagttgacttcaacgtcccattggacggtaagactatcaccaacaaccaaagaattgttgctgctttgccaaccatcaaatacgttgaagaacataaaccaaaatacattgtcttggcttcccacttgggtagaccaaacggtgaaagaaacgacaaatactcattagctccagttgctactgaattggaaaaattgttgggtcaaaaagtcaccttcttgaacgattgtgttggtccagaagtcaccaaggctgttgaaaacgccaaagatggtgaaatctttttgttggaaaacttgagataccacattgaagaagaaggttcttccaaagacaaggatggtaagaaagtcaaggctgatccagaagccgttaagaaattcagacaagaattgacttcattggctgatgtctacattaacgatgcctttggtactgctcacagagcccactcctctatggttggtctcgaagttccacagagagctgctggtttcttaatgtccaaagaattggaatactttgctaaggctttggaaaacccagaaagaccattcttggccattttgggtggtgctaaagtttctgacaagattcaattgattgacaacttgttggacaaggttgatatgttgattgttggtggtggtatggccttcactttcaagaaaatcttgaacaaaatgccaattggtgattctcttttcgatgaagccggtgctaaaaacgttgaacacttggttgaaaaagctaagaaaaacaatgttgaattgatcttgccagttgattttgtcactgctgataaattcgacaaagatgccaaaacttcttctgctactgatgctgaaggtattccagacaactggatgggtttggactgtggtccaaaatctgtcgaattgttccaacaagctgttgccaaagctaagaccattgtttggaacggtccaccaggtgttttcgaatttgaaaaattcgccaacggtactaaatccttattggatgctgctgtcaaatctgctgaaaatggtaacattgttatcattggtggtggtgatactgctactgttgctaagaaatacggtgtcgttgaaaaattatcgcacgtttctactggtggtggtgcttcattggaattattagaaggtaaagacttgccaggtgtagttgctctttccaacaaaaactaattgatagtcgataatatagttacgttatataatatataagtgttatatgtatcttgaatattaattgaaaacaaaaaaaaaaagtaaaaattat

SEQ ID NO: 10669 - protein, 417 aa, Candida albicans
MSLSNKLSVKDLDVAGKRVFIRVDFNVPLDGKTITNNQRIVAALPTIKYVEEHKPKYIVLASHLGRPNGERNDKYSLAPVATELEKLLGQKVTFLNDCVGPEVTKAVENAKDGEIFLLENLRYHIEEEGSSKDKDGKKVKADPEAVKKFRQELTSLADVYINDAFGTAHRAHSSMVGLEVPQRAAGFLMSKELEYFAKALENPERPFLAILGGAKVSDKIQLIDNLLDKVDMLIVGGGMAFTFKKILNKMPIGDSLFDEAGAKNVEHLVEKAKKNNVELILPVDFVTADKFDKDAKTSSATDAEGIPDNWMGLDCGPKSVELFQQAVAKAKTIVWNGPPGVFEFEKFANGTKSLLDAAVKSAENGNIVIIGGGDTATVAKKYGVVEKLSHVSTGGGASLELLEGKDLPGVVALSNKN

SEQ ID NO: 10670 - DNA, 1203 bp, Candidatus Blochmannia floridanus
  CDS (1)..(1203)
atggttatgattaaaatgagtgatgtagatttatttaataaacgtattttaattcgtgctgacttaaatgtgcctatcagaaatggaattattacttctgctagaagaattcatgcgtcattgccaactattcagctagctttgtctagaagtaatcaagttatggtgacatctcatttaggtaggcctgtagaaggagaatatgactcacaattttctttgcaacctgtagtagattattttcaaaaaaatttaagcgctaaaattggaggtgtaagattagttaaagattatttagatggaattaattggatttcaaatgagttattgattttagaaaatgttcgattcaataaaggtgaaaaaacagatgatgaagtattagcaaaaaaatatgcatctttatgtgatgtatttgtaatggatgcttttggaagcgctcatcgtatacaatcttctactcacaatgttagtaaattcgttaaagtagcttgttctggtttattattagaacaggaaatagcagcgttacataaagctttgtctaatcctgttaggccaatggttgctatagttggtggatctaaagtttctagtaaattgatggtcttagagtctttatcaaaagtagtggattatttaatagtaggaggaggtattgctaatacttttttagcggctcaaggtcaaaatgtaggaaaatcgctgtatgaggcggaattaatttctacagctaaaagtttgttaaaggattgtaatatccctatacctactgatgttcgagtaagttcagagttttctgaaacagctcaatcgattatgaaaaatgtaactgaaattaaagatgatgaacaaattttagatttaggagataattcaattattaatatattaaatattttaaataatgctaaaactattttatggaatggtcctgttggagtatttgagtttcctaattttagaaagggtacagaaatggtatcaaatgctattgctaatagcaatgctttttctattgcaggaggtggtgatactttaatggccatcgatttatttggtattgcaaatcaaatatcttatgtttctactggaggaggagcctttttagaatttattgaaggtaaaactttaccatctattgaagttttagaggaacataaaagaatgagaaatggtaattattctgatattaattactga

SEQ ID NO: 10671 - protein, 400 aa, Candidatus Blochmannia floridanus
MVMIKMSDVDLFNKRILIRADLNVPIRNGIITSARRIHASLPTIQLALSRSNQVMVTSHLGRPVEGEYDSQFSLQPVVDYFQKNLSAKIGGVRLVKDYLDGINWISNELLILENVRFNKGEKTDDEVLAKKYASLCDVFVMDAFGSAHRIQSSTHNVSKFVKVACSGLLLEQEIAALHKALSNPVRPMVAIVGGSKVSSKLMVLESLSKVVDYLIVGGGIANTFLAAQGQNVGKSLYEAELISTAKSLLKDCNIPIPTDVRVSSEFSETAQSIMKNVTEIKDDEQILDLGDNSIINILNILNNAKTILWNGPVGVFEFPNFRKGTEMVSNAIANSNAFSIAGGGDTLMAIDLFGIANQISYVSTGGGAFLEFIEGKTLPSIEVLEEHKRMRNGNYSDINY

SEQ ID NO: 10672 - DNA, 1212 bp, Chlamydophila caviae
  CDS (1)..(1212)
atggatagattgacagtcagggaactttccccagaagaaaacaaggttttagttcgtgtagattttaatgttcctataaaagatgggaagattcttgatgatattcgcattcgtagtgctatgccaacaattaactatctgttgcaaaaacgcgctgctgtaattttaatgagtcatttaggccgccctaagggaacggggtttgaagagaagtattccctccagcctgttgttgaagttttagaaggctacttaggccatcacgttcctttagctcccgattgtattggggaggttgctcgtcaggcagtagcgcagctatctccagggcgcgtattgctattagaaaatctccgtttccataggggtgaagaacatcccgaagaagatcctacatttgctgctgaactttcttcttatggagatttttatgtgaatgatgcttttgggacttctcatagaaaacatgcttctgtttatcatgtgccccaagctttccctggaagatctgcagcaggccttcttatggagaaagaactcgagtttttagggcagcaccttctgcattctcctaaacgtccttttactgctatccttggtggggctaaagtatcttcaaaaatcggggtaatagaagccttactatcgcaagtgaacaacttactcttagcaggaggcatgggattcaccttcttaaaggcactaggtaagtccgtagggaattccctagttgaagaatcgggaatagagcttgctcgtcgtgttttgaaacttgcagagcagcgtaatgtgcgtatcgttctccctatagatgtaaaagttgccaaggcgtgcgagcctggagtcagctggtcagaaacacttatagatcaggggattcctgcagatcttgaaggtttagatatcggaaccaaaacgattcaagagttttgtaagatcattgatgcttcagcaacagtattttggaacggccccgtcggtgtttatgaagttcctccttttgatcaaggttctatggctatcgccaactgtctagcacgacattcttctgcaactaccgtcgtgggtggtggtgacgccgctgctgttgttgctttagccggatgtacctctcaagtctcacacgtatcgacaggcgggggagcttctttagagtttttagaaaacggctttttaccaggcacagaagttctctctccagcgcaagattaa

SEQ ID NO: 10673 - protein, 403 aa, Chlamydophila caviae
MDRLTVRELSPEENKVLVRVDFNVPIKDGKILDDIRIRSAMPTINYLLQKRAAVILMSHLGRPKGTGFEEKYSLQPVVEVLEGYLGHHVPLAPDCIGEVARQAVAQLSPGRVLLLENLRFHRGEEHPEEDPTFAAELSSYGDFYVNDAFGTSHRKHASVYHVPQAFPGRSAAGLLMEKELEFLGQHLLHSPKRPFTAILGGAKVSSKIGVIEALLSQVNNLLLAGGMGFTFLKALGKSVGNSLVEESGIELARRVLKLAEQRNVRIVLPIDVKVAKACEPGVSWSETLIDQGIPADLEGLDIGTKTIQEFCKIIDASATVFWNGPVGVYEVPPFDQGSMAIANCLARHSSATTVVGGGDAAAVVALAGCTSQVSHVSTGGGASLEFLENGFLPGTEVLSPAQD

SEQ ID NO: 10674 - DNA, 1212 bp, Chlamydia muridarum
  CDS (1)..(1212)
atggataaactatcaataaaagacctttccccagaagggaaaaaggtactagttcgtgtagattttaatgttcctattaaggacggaaaaattttagatgatgtccgtattcgtagtgctatgcctacgatcaattacctattgaagagagatgctgcgatcattttagtcagtcatttagggcgtcctaagggagatatgttcgaagaagcgtattcgttagctcctattgtgcctgtattagaaggatatttggggcatcatgtgcctctatctccagattgtgttggagaagttgcacggcaggctgttgcgcagttgtctcctggaagagtgcttcttcttgaaaatgtacgttttcatagaggggaagagcatcctgaggaggatcctagttttgctgttgagcttgctgcttacgccgatttttatgtaaatgatgccttcggaacctctcatcggaagcatgcttctgtgtatcgagttcctcaaatgttccccgatcgtgctgctgcgggatttctaatggaaaaagagcttgaatttttgggacagcatttattagtggagcctaagcgtccctttacggccatcctaggtggtgctaaggtatcttcaaaaataggggtaatcgaagctttactctcgagagttgataatttagtgttagctggaggtatggggtatacttttctaaaagctatgaatcagcaagttgggaattcattggtggaagagacaggcattcctttagcgaaaagggttttggaaaaagctcggacacaaggggttaagatttatcttccggtagatgccaaagttgcaagacgttgcgaaactggggaagattggcaagagttgtcaatacaggaggggattcctgagggtttctctggtttcgatattgggtctaagacgatagctctattttctgaggtgatccaagattccgcaacggtattttggaatggccctgttggggtttatgaagttcctcctttcgatcaaggatcaaaagccatcgctcagtgtcttgcaagtcattcttctgcagtgacggttgttggtgggggtgatgccgctgccgtagttgctttagcaggatgtacctcgcagatttcccatgtatccacaggaggaggagcttctttggaattcttagagaagggctatcttccagggacagaaattctctcccctgctcgcagttaa

SEQ ID NO: 10675 - protein, 403 aa, Chlamydia muridarum
MDKLSIKDLSPEGKKVLVRVDFNVPIKDGKILDDVRIRSAMPTINYLLKRDAAIILVSHLGRPKGDMFEEAYSLAPIVPVLEGYLGHHVPLSPDCVGEVARQAVAQLSPGRVLLLENVRFHRGEEHPEEDPSFAVELAAYADFYVNDAFGTSHRKHASVYRVPQMFPDRAAAGFLMEKELEFLGQHLLVEPKRPFTAILGGAKVSSKIGVIEALLSRVDNLVLAGGMGYTFLKAMNQQVGNSLVEETGIPLAKRVLEKARTQGVKIYLPVDAKVARRCETGEDWQELSIQEGIPEGFSGFDIGSKTIALFSEVIQDSATVFWNGPVGVYEVPPFDQGSKAIAQCLASHSSAVTVVGGGDAAAVVALAGCTSQISHVSTGGGASLEFLEKGYLPGTEILSPARS

SEQ ID NO: 10676 - DNA, 1194 bp, Chlorobium tepidum
  CDS (1)..(1194)
atgcagaaaaagacattgtctgacatatcgttacaaggaaaacgcgtcctgatgcgagtcgatttcaacgtgccgctcgaccaggacaggaacatcactgacgagaaaaggatcgtggaggcactgccttcaatccgcaaggtcatcgacaatggcggcaggctgattctgatgtcgcacctcggaagaccgaaaggcaaggtcaacccggcattctccctttcaccggtcgcaaagcgcctctccgagctgcttgattgcccggtgacgatggctggtgactgcatcggcaccgaggtgatgcagcaggtgctcgccttgcaggacggtgacgtgctcatgctcgaaaacctccgcttccaccccgaagaggaggctaatgatcctgacttcgccagggagctggcttcgctgggcgaaatctacgtcaacgacgcattcggtacggcgcaccgcgcccacgcctcgaccgagggcatcacccacttcatgcagaccgccgttgcgggctacctcatcgaaaaggagctgcgctatctcggtacggcgctcaacgatgcacagcgtccgttcgtggccattctcggcggcgcgaagatttcaggcaagatcgacgtgctcgaaagcctcttcgagaaagtcgataccgttcttgtcggcggcgcgatggtcttcaccttctttaaggctcagggcctcgacgttggcaactcgcttgtcgaagaaaacaagctcgaactggctgtttccctgcttgaaaaagccaaagcgaaaaacgtgcgcttgcttcttccggaagacgtggtcgtggccggagagatttccgccgacgcgccttcgcgtgtcgagccggtcagcgccatctccgcaggcatgattggtctcgacatcggcccggcaaccatcgaaacctaccgcaaggaaattctcgacgcgaaaaccgtgctctggaatggcccgatgggtgtgttcgagatcgaccagttcgccaggggcaccttcgccgtcgcccaggcgcttgccgacgcaaccgcagagggcgcgatcaccatcatcggcggcggcgactcggcggcggccatcgcaaaggctggcctctccgacaaggtgacgcacgtttcgaccggcggtggcgccagcctcgaattcctcgaaggcaaggagctgccgggcatcgcagccctgaacgattag

SEQ ID NO: 10677 - protein, 397 aa, Chlorobium tepidum
MQKKTLSDISLQGKRVLMRVDFNVPLDQDRNITDEKRIVEALPSIRKVIDNGGRLILMSHLGRPKGKVNPAFSLSPVAKRLSELLDCPVTMAGDCIGTEVMQQVLALQDGDVLMLENLRFHPEEEANDPDFARELASLGEIYVNDAFGTAHRAHASTEGITHFMQTAVAGYLIEKELRYLGTALNDAQRPFVAILGGAKISGKIDVLESLFEKVDTVLVGGAMVFTFFKAQGLDVGNSLVEENKLELAVSLLEKAKAKNVRLLLPEDVVVAGEISADAPSRVEPVSAISAGMIGLDIGPATIETYRKEILDAKTVLWNGPMGVFEIDQFARGTFAVAQALADATAEGAITIIGGGDSAAAIAKAGLSDKVTHVSTGGGASLEFLEGKELPGIAALND

SEQ ID NO: 10678 - DNA, 1176 bp, Chromobacterium violaceum
  CDS (1)..(1176)
atgaaattcaacaaactctccgaacagaatctttccggcaagcgcgcgctgatccgcgtggacatgaacgtgccgctgaagaacggcgtgatcggcgacgacacccgcatccgcgccagcctgcccaccatcgaacactgcctgaaggccggcgccgccgtgctgctgatgacccatctcggccgtccgaccgagggcgagcccaagccggaggacagcctggcgccggtggtggcccgcctgtccgagctgctgggcaagccggtgcgcctgatcgccgacttccacgccggcgtcgagcttgcgccgggcgaagtggcgatgctggagaacgtgcgcctgaacaagggcgagaagaagaacaacgacgagctgggccgcgcttacgccgcgctgtgcgacgtcttcgtccacgacgccttcggcaccgcgcaccgcgccgaggcctccacccacgcggtggccaagttcgcgccggtcgcctgcgccggcctgctgctgtcggccgagctcgacgcgctgggcaaagcgctgcaggcgccggcccgcccgctggtggccatcgtcgccggctccaaagtgtcgaccaagctgaccatcctggaagcgctggccgacaaggtggaccagctgatcgtcggcggcggcatcgccaacaccttcctgctggccgagggcaaggccatcggcaaatcgctggccgaggccgatctggtggaagacgcccgccgcgtgatcgccaagatccgcgcccgcggcggcgacgtgccgctgccggccgacgtggtgtgcgccaaggaattcgccgaaaccgccgccgcggccaccaagaacgtggcggaagtggtcgccgacgacatgatcctcgacatcggcccggacgctgccaaacagctggccgccatcatcgcccaggccggcaccgtggtgtggaacggcccggtcggcgtgttcgagttcgaccagttcggcaacggcaccaagacgctggcccaagccatcgcccagtccaaggcgttttcgatcgccggcggcggcgatacgctggcggcgatcgccaagtacggcatcaccgacgacatcagctacatctcgaccggcggcggcgccttcctggagttcctggaaggcaaggagctgccggcggtggccatcctggccgagcgcgcgcagtaa

SEQ ID NO: 10679 - protein, 391 aa, Chromobacterium violaceum
MKFNKLSEQNLSGKRALIRVDMNVPLKNGVIGDDTRIRASLPTIEHCLKAGAAVLLMTHLGRPTEGEPKPEDSLAPVVARLSELLGKPVRLIADFHAGVELAPGEVAMLENVRLNKGEKKNNDELGRAYAALCDVFVHDAFGTAHRAEASTHAVAKFAPVACAGLLLSAELDALGKALQAPARPLVAIVAGSKVSTKLTILEALADKVDQLIVGGGIANTFLLAEGKAIGKSLAEADLVEDARRVIAKIRARGGDVPLPADVVCAKEFAETAAAATKNVAEVVADDMILDIGPDAAKQLAAIIAQAGTVVWNGPVGVFEFDQFGNGTKTLAQAIAQSKAFSIAGGGDTLAAIAKYGITDDISYISTGGGAFLEFLEGKELPAVAILAERAQ

SEQ ID NO: 10680 - DNA, 1194 bp, Clostridium perfringens
  CDS (1)..(1194)
atgaacttcaataaaaagactatagaagacgttcaagtaaaaggtaaaaaagtattagtaagatgcgactttaacgttccattaaaagatggtgttataactgatgaaaacagattaaacggagctatgccaactataaaatacttagttgataatggcgctaaagtaatcctttgctcacatatgggtaaaccaaaaggagaagctaaaccagaattctcattagcacctgtagctaaaagattaagcgaaatgcttggtaaagaagtagtatttgctgctgacgacaacgttgttggagaaaatgctaaaaaagctgtagctgaaatgaaagatggagacgtagttttacttcaaaatacaagatacagaaaagaagaaactaaaaatggtgaagagttatcaaaagaattagctagcttagctgaaatgtttgttaacgatgcattcggtactgctcacagagctcactgctcaacagttggagtaactgaatacttaaaaccagcagtatgtggatacttaatccaaaaagagcttaagttcttaggagatgctgtagaaactccagaaagaccattcgttgctatcttaggtggagctaaagtttcagataagataaacgttataaacaaccttttagaaaaagttgatactttaataataggtggaggaatggcttacacattcttaaaagctcaaggatatactgtaggaagttcattagtagaagaagataaagttgaatacgctaaagaaatgttagctaaagctgaggaaaaaggtgttaaattattattacctgtagaccacagagtagctaaagaattcaaagatgttgaagctgtagttacagaagatcaaaacatcgctgaaggattcatgggattagatatcggaccaaaaactgaagctatctacgctgaagctataaaagatgctaaaacagttatctggaacggaccaatgggagtattcgaattcgaaaacttcaacaaaggaacaatagctgttgctaaagctatggctgaagcagatgctactactataatcggtggtggagattcagctgctgctgtaaacatcttaggattcggtgacaaaatgtctcacatctcaactggtggtggagcttcattagaattcttagaaggaaaagtattaccaggaatagctgctttaaacgataaataa

SEQ ID NO: 10681 - protein, 397 aa, Clostridium perfringens
MNFNKKTIEDVQVKGKKVLVRCDFNVPLKDGVITDENRLNGAMPTIKYLVDNGAKVILCSHMGKPKGEAKPEFSLAPVAKRLSEMLGKEVVFAADDNVVGENAKKAVAEMKDGDVVLLQNTRYRKEETKNGEELSKELASLAEMFVNDAFGTAHRAHCSTVGVTEYLKPAVCGYLIQKELKFLGDAVETPERPFVAILGGAKVSDKINVINNLLEKVDTLIIGGGMAYTFLKAQGYTVGSSLVEEDKVEYAKEMLAKAEEKGVKLLLPVDHRVAKEFKDVEAVVTEDQNIAEGFMGLDIGPKTEAIYAEAIKDAKTVIWNGPMGVFEFENFNKGTIAVAKAMAEADATTIIGGGDSAAAVNILGFGDKMSHISTGGGASLEFLEGKVLPGIAALNDK

SEQ ID NO: 10682 - DNA, 1206 bp, Clostridium tetani
  CDS (1)..(1206)
atggtttatgtggcatttaataaaaaaaccattgaagacattgatgttaaaggaagaaaagttttagtaagatgtgattttaatgtacctttaaaagatggaaaaataacagatgaaaatagattaatgggagcactaccaactattaaatatattatggaaaagggcggtaaagttattttatgttctcaccttggtaaaccaaaaggagagcctaaacaggaattatctctagcaccagtagctaaaagattatctgagcttttaaataaggaagttttatttccagcagataatgaagtagttggagaaaatgctaaaaaagcagtagaaaatatgaaagatggagatgtaatcctattacaaaatacaagatatagaaaagaagaaactaagaatgaagaaaccttttcaaaagaattagcatctcttgcagatatatttgtaaatgatgcttttggaacagcacatagagcacattgctctacagttggagtaacagaatttgttgcaacatcagtatgtggatacttaatccaaaaagaattaaagtttttaggtaatgctgttgaaaatccacaaagaccttttatatcaattcttggaggagctaaagtatctgataaaataaatgtaataaataatttattagaaaaagttgatactctaattataggtggaggaatgagctatactttccaaaaggctcaagggtacacaataggaagctctcttttagaagaagacaaaatagattatgcaaaagaaatgatagaaaaggcaaaagaaaagggagtaaaattacttctacctgtagataatgtagcagctgaaaaatttgcagaagatgcagaagctattataacagaagatcaaaatattaaagaaggatatatgggacttgatataggacctaaaacttcaaaactttattcacaagaggttcaaagcgctaagactgtagtttggaatggacctatgggtgtatttgaatttgaaaaatttgcaaaaggtactatagaagtagcgaaggccatggctgaatcacaagctacaaccataataggtggaggagatagtgctgcggctgtaaatcaacttggatttggggataaaatgacccatatatctacaggtggaggagcttcattagaatttttagaaggaaaagagcttccaggaatagcagcacttaacgataaatag

SEQ ID NO: 10683 - protein, 401 aa, Clostridium tetani
MVYVAFNKKTIEDIDVKGRKVLVRCDFNVPLKDGKITDENRLMGALPTIKYIMEKGGKVILCSHLGKPKGEPKQELSLAPVAKRLSELLNKEVLFPADNEVVGENAKKAVENMKDGDVILLQNTRYRKEETKNEETFSKELASLADIFVNDAFGTAHRAHCSTVGVTEFVATSVCGYLIQKELKFLGNAVENPQRPFISILGGAKVSDKINVINNLLEKVDTLIIGGGMSYTFQKAQGYTIGSSLLEEDKIDYAKEMIEKAKEKGVKLLLPVDNVAAEKFAEDAEAIITEDQNIKEGYMGLDIGPKTSKLYSQEVQSAKTVVWNGPMGVFEFEKFAKGTIEVAKAMAESQATTIIGGGDSAAAVNQLGFGDKMTHISTGGGASLEFLEGKELPGIAALNDK

SEQ ID NO: 10684 - DNA, 1218 bp, Corynebacterium diphtheriae
  CDS (1)..(1218)
atggctattaaaactcttaaagatctcttggcagaaggcgttgaaggacgccacgtgcttgttcgttcagatttcaatgtaccgctgaacgatgatcgtgaaattactgatgctggacgtattaccgcctcgctcccaacgatcaaagcattagttgacaacggtgctcgagtaatcttgatggctcacttgggccgccccaagggagaagtaaatgaaaaattctcactggctcctgtagcggaggcattgtctgaagcccttggacagtatgtcgcactcgcaggcgacgtcgttggtgaagatgctcatgaacgcgcgaacggtctcaatgacggtgacgttctgctccttgaaaacgttcgctttgatccacgcgagacctcgaaggaagaagctgagcgtggcgaatttgcggatcagcttgtcgcactcaccgctgaaaatggtgctttcgtatccgatggctttggcgttgttcaccgagctcaggcatcagtatttgatgttgcgcagagattgccgcattatgcgggaacactcgtggaaaaagagctagaagttcttggaaacaaggttgcctctgctccagaacgtccttatgcggtcattctaggtggcgcaaaggtgtctgacaagcttggcgtgatcgaagcgctagcaacaaaggctgacaaacttattattggtggcggaatgtgctacaccttcttggcagccaaaggtatcaacgtgcaaaagtcgctgttgcaagaagaacaaatcaacaagtgcaaagaacttctagaagcatacgctgataagatcgttcttccagttgatctggtagcagctgcagagttcgccagcgatgcagaaaataagatcgttgcaattgacgaaatccccgaaggctggatgtctcttgatgtcgggcctaagactgttgagaagtttgctgaggttctagcgacatcaaagaccgtattctggaatgggcctatgggcgtttttgagtttgaaaacttctcagccggtacccgtggcgtagcagaagctattatcgcagctacggctaatggtgcattctctgttgtcggcggtggcgattcggctgctgctgttcgacttcttggtctagacgaggatggattcagccatatctctactggtggcggagcatcacttgaactcctcgaaggcaaaaaccttcctggcgtttcggtgctcgaaagctaa

SEQ ID NO: 10685 - protein, 405 aa, Corynebacterium diphtheriae
MAIKTLKDLLAEGVEGRHVLVRSDFNVPLNDDREITDAGRITASLPTIKALVDNGARVILMAHLGRPKGEVNEKFSLAPVAEALSEALGQYVALAGDVVGEDAHERANGLNDGDVLLLENVRFDPRETSKEEAERGEFADQLVALTAENGAFVSDGFGVVHRAQASVFDVAQRLPHYAGTLVEKELEVLGNKVASAPERPYAVILGGAKVSDKLGVIEALATKADKLIIGGGMCYTFLAAKGINVQKSLLQEEQINKCKELLEAYADKIVLPVDLVAAAEFASDAENKIVAIDEIPEGWMSLDVGPKTVEKFAEVLATSKTVFWNGPMGVFEFENFSAGTRGVAEAIIAATANGAFSVVGGGDSAAAVRLLGLDEDGFSHISTGGGASLELLEGKNLPGVSVLES

SEQ ID NO: 10686 - DNA, 1218 bp, Corynebacterium efficiens
  CDS (1)..(1218)
atggctgtaaagaccctcaaggatctgctcgacgaaggcgtcgacggacgtcacgtcatcgttcgttcggacttcaacgtccccctcaacgatgatcgtgaaatcaccgacaagggccgcatcatcgcctccctgcccaccctgaaggcactgaccgaagccggcgccaaggtcatcgtcatgtcccacctcggccgccccaagggtgaggtcaacgagaagtactccctcgccccggtggctgaggcactgtccgacgagctcggtcagtacgtggcgctggcagccgatgtcgtcggcgaagacgcccatgagcgtgcaaacggcctgaccgagggcgatatcctcctgctggagaacgtacgcttcgatccacgtgagacctccaaggatgaggctgagcgcggtgcgttcgccgatgaactcgcagccctggccgccgacaacggtgcctttgtctccgatggtttcggcgtggtccaccgtgcacagacctcggtctacgacatcgccaagcgcctgccacactacgccggcagactggtggagaacgagatctctgtgctggagaagatcgccgagaaccccgaggcaccgtacaccgtcgtgctcggcggctccaaggtctccgacaagctcggtgtcatcgaggcgctggcctccaaggccgattccatcatcatcggtggcggcatgtgctacaccttcctcaaggcccagggacacgatgtccagaaatccatgctccaggatgagatgatcgacacctgcaaggatctcctcgagcgcttcggcgacaagatcgtccttcccgttgatctcacctgggcctccgagttcgccaaggatgctgagaagaaggtcaccgacctggattccgcaccggaggggtggctctccctcgacatcggaccgaagtccgtcgagaagttcgccgacgtcctcggtgcctccaagaccatcttctggaacggccccatgggtgtcttcgagttcgaggccttctccgacggcacccgtggtgttgcccaggcgatcatcgacgccaccgccaataacggggcgttctccgttgtcggcggcggtgactccgcagcatctgtccgtgtgctcggcctggatgaggagggcttctcccacatctccaccggtggcggtgcctccctcgaattcctcgagggcaaggaactgccgggcgtggcgatcctcaaggactaa

SEQ ID NO: 10687 - protein, 405 aa, Corynebacterium efficiens
MAVKTLKDLLDEGVDGRHVIVRSDFNVPLNDDREITDKGRIIASLPTLKALTEAGAKVIVMSHLGRPKGEVNEKYSLAPVAEALSDELGQYVALAADVVGEDAHERANGLTEGDILLLENVRFDPRETSKDEAERGAFADELAALAADNGAFVSDGFGVVHRAQTSVYDIAKRLPHYAGRLVENEISVLEKIAENPEAPYTVVLGGSKVSDKLGVIEALASKADSIIIGGGMCYTFLKAQGHDVQKSMLQDEMIDTCKDLLERFGDKIVLPVDLTWASEFAKDAEKKVTDLDSAPEGWLSLDIGPKSVEKFADVLGASKTIFWNGPMGVFEFEAFSDGTRGVAQAIIDATANNGAFSVVGGGDSAASVRVLGLDEEGFSHISTGGGASLEFLEGKELPGVAILKD

SEQ ID NO: 10688 - DNA, 1176 bp, Coxiella burnetii
  CDS (1)..(1176)
atgtccaatctcaatcttcacaacaaacgcgtgatgattcgtgaagacctgaacgtgccaatgaaaaatggaaaaattacgaatgatgaacggatcgtgcgcgcattgccgacgattcaaaaagccatagaacaaaaagcacgagtgatgattttatcgcatttgggaagacccgaagaagggaaattcgaaaaagaattttctttagccccggtagcgcgattgctgagtaaaaaattaaatcaaaaagtgccgctaatcaatgattggctcaaaggagtcgcggttgaaccgggtcaggccattctttgtgaaaatgtgcggtttaataaaggtgaaaacgaaaataataccgaactcgctaaacggatggcggagttgtgcgatatttttgttatggatgcttttgcaacggcacatcgtgcccaggcatccacggctggcgtcgctgcatacgcaaaattagcctgcgccggtcctttgctcatttccgaagtcgaagctttatcgcgcgccttagaaaatcctcaaaaaccattggtcgctgtggtaggcggctcaaaagtttcaaccaaaattcatttgttagaaaatttattagataaagtcgatcaattaatcgtaggcggtggtattgcaaatacctttttaaaagcgcagggctattcaattggaaaatcgctctgtgaaaatgaatggttggacgcggctcagcaattttgggaaaaagccgccgaaaaaaacgtttctctccccttgccggtggatgttattgtggcggatgaattgtcagaagatgcgaaagcaacggtgaaaaatatcgatgccgtaaccagtaacgaatctattttcgatgtagggccaaacacttcggcaacctacgccaagttaatggcgcaagcgggcacgatcgtttggaacgggcccatcggcgttttcgaaatagaagcatttagtcaaggaacacgcgcgttggcacaagccgttgcaaaaagtaccgcttattctatagtggggggtggagacaccctggctgctttggataaattcaatctgaccgatcaaatgtcttacgtcagtacagccggaggcgcatttttagagtttttggaaggaaaaatactacctgctattaaaattttaacgcaacgagcaaaagagtatgagcaaaaataa

SEQ ID NO: 10689 - protein, 391 aa, Coxiella burnetii
MSNLNLHNKRVMIREDLNVPMKNGKITNDERIVRALPTIQKAIEQKARVMILSHLGRPEEGKFEKEFSLAPVARLLSKKLNQKVPLINDWLKGVAVEPGQAILCENVRFNKGENENNTELAKRMAELCDIFVMDAFATAHRAQASTAGVAAYAKLACAGPLLISEVEALSRALENPQKPLVAVVGGSKVSTKIHLLENLLDKVDQLIVGGGIANTFLKAQGYSIGKSLCENEWLDAAQQFWEKAAEKNVSLPLPVDVIVADELSEDAKATVKNIDAVTSNESIFDVGPNTSATYAKLMAQAGTIVWNGPIGVFEIEAFSQGTRALAQAVAKSTAYSIVGGGDTLAALDKFNLTDQMSYVSTAGGAFLEFLEGKILPAIKILTQRAKEYEQK

SEQ ID NO: 10690 - DNA, 1182 bp, Desulfovibrio vulgaris
  CDS (1)..(1182)
atggccgttatcaagatgaccgatctcgacctcaagggaaaacgggttcttctgcgtgaagacctcaacgtgcccctcaaggaggggcgcatcaccagcgacaagcgcatacgcgccgctctgccgtccattcgcatggcgatggaggcgggggcccgtgtgcttatcgtctcgcatctgggtcgccccgtagagggcgagttcgatgaggctttttcgctcgcccctgtggccgcacatctttcgcgcgaactcgggcgtgatgtgcgtcttgtgaaggactacatcgacggtgtggatgtcgccgagggcgattgcgtcctgtgcgagaacgtccgctttctcaagggtgagaagaagaacaccgaggaactgggcagaaggcttgccgctctgtgcgacatcttcgtcatggacgcgttcggtgccgcacaccgggcgcaggcttctacccacgccgtggcgcgcttcgcccctgttgcctgcgcggggccgctgctggctgcagaacttgacgcgctggaacgcgcccttgacgccccgaagcacccgcttgtgggcatcatcggcggttcgaaggtctcgaccaagctgacgcttctcgacaacctgtcacaccgtgtcgaccgcctcatcgtgggcggcggcatcgccaataatttcatcaaggccgccggttacgaagtgggcaagtccctctatgagcccgaactcgtggaagaggccgcacgcctcatggccgcagccagggcagctggcggtgagattcccgtgccgctggacgtggtggtcggccccgagttggccgatggtgcccctgccacggtgcggaaggtctccgaagtcggccctgacgagatgattctcgacatcggccccgcgacggcgacacgttaccgcgagattctgctcgccgccggaaccatcgtctggaacggcccggtgggtgctttcgagtgggaacagttcggggcaggaacccgcgccctgtgcgaggctgtcgccgacagtcctgccttttcgatagccggcggtggcgataccgtcgccgccgtcgagaagtatggcgttgccagccgtgtgggatacatctccacgggtggtggagccttcctcgagttccttgaaggcaaggaacttccggctgtcgccatactgcaggaaagggccgcgcaatcgtga

SEQ ID NO: 10691 - protein, 393 aa, Desulfovibrio vulgaris
MAVIKMTDLDLKGKRVLLREDLNVPLKEGRITSDKRIRAALPSIRMAMEAGARVLIVSHLGRPVEGEFDEAFSLAPVAAHLSRELGRDVRLVKDYIDGVDVAEGDCVLCENVRFLKGEKKNTEELGRRLAALCDIFVMDAFGAAHRAQASTHAVARFAPVACAGPLLAAELDALERALDAPKHPLVGIIGGSKVSTKLTLLDNLSHRVDRLIVGGGIANNFIKAAGYEVGKSLYEPELVEEAARLMAAARAAGGEIPVPLDVVVGPELADGAPATVRKVSEVGPDEMILDIGPATATRYREILLAAGTIVWNGPVGAFEWEQFGAGTRALCEAVADSPAFSIAGGGDTVAAVEKYGVASRVGYISTGGGAFLEFLEGKELPAVAILQERAAQS

SEQ ID NO: 10692 - DNA, 1194 bp, Enterococcus faecalis
  CDS (1)..(1194)
atggctaaaaagacaattaaagatgtagatttaaaagacaaaaaagtccttgtccgtgttgactttaacgttccgttaaaagatggcgtgatcacaaacgataatcgtatcgtagcggctttaccaacaatcaaatacgtgattgaaaatggcggaaaagcaattcttttctctcatttaggtcgtgtaaaaacagaagaagacaaagctggcaaatcattaaaaccagtggctgaacgtttaagcgaattactaggtcaaccagttacttttgttccagaaacacgtggtaaagaattagaagacgctgttaacaatatgaaagatggcgacgttttagtatttgaaaacactcgttttgaagatgttgacggcaaaaaagaaagcggcaatgacgctgaattgggtaaatactgggcttctttaggcgatgtatttgtcaatgatgcttttggtactgcacaccgtgcacatgcctcaaacgttggaattgcttcaactggtatcccaacagttgctggtttcttaatggaaaaagaaattaaattcatcggcgaagctgttgaaaatccaaaacgtccattcgtagcaatcttgggtggcgcaaaagtttctgacaaaatcgctgtcattgaaaacctaattgaaaaagccgataaaattttaatcggtggcggtatggcttacacattcatgaaagcacaaggctatagtgttggtttatctttacttgaagaagataaagtggacttagcgaaaagcttaatggaaaaagctggcgacaaattagttttaccggttgatacagttgtctctaaagagttcagcaatgacgctcctttccacacggttccttcaactgaaatcccagatgatgaagaaggcttggatattggtgaaaaaacaattgaattattcgctaacgaattacaaggtgcgaaaacagttgtttggaatggaccaatgggcgtatttgaaatgagtaactttgccaaaggaacaattggtgtttgtgaagcgattgctaatttagaagacgcaacaacaatcatcggtggcggggactctgctgctgcagcaattcaattaggctacgaaaacaaattctctcacatctcaacaggtggcggagcaagtttagaattattagaaggcaaaactttaccaggtttagcttctattaacgataaataa

SEQ ID NO: 10693 - protein, 397 aa, Enterococcus faecalis
MAKKTIKDVDLKDKKVLVRVDFNVPLKDGVITNDNRIVAALPTIKYVIENGGKAILFSHLGRVKTEEDKAGKSLKPVAERLSELLGQPVTFVPETRGKELEDAVNNMKDGDVLVFENTRFEDVDGKKESGNDAELGKYWASLGDVFVNDAFGTAHRAHASNVGIASTGIPTVAGFLMEKEIKFIGEAVENPKRPFVAILGGAKVSDKIAVIENLIEKADKILIGGGMAYTFMKAQGYSVGLSLLEEDKVDLAKSLMEKAGDKLVLPVDTVVSKEFSNDAPFHTVPSTEIPDDEEGLDIGEKTIELFANELQGAKTVVWNGPMGVFEMSNFAKGTIGVCEAIANLEDATTIIGGGDSAAAAIQLGYENKFSHISTGGGASLELLEGKTLPGLASINDK

SEQ ID NO: 10694 - DNA, 1419 bp, Euplotes crassus
  CDS (89)..(1345)
ccccaaaacccctgattaagtcgaatcattgaatatttatcaaatttatttgaaaaaattgctgaaatctttaattatttggttagatatgctatctaagaaattgactgttgataagatcccccacatgattaagaacaagagagtcttagtcagagtagactttaatgttccaattaaggatggaaaggttgccgatcctacaagaattgtatctactcttgatacaatcaacttcttaaaggaaaatggtgctaaatccattgtgttgatgagtcatttgggtagaccaaaaggagttagacaagaacaattctcattagctcctgttgtcccagcgcttgaagacattattggccagaaagttaactttttaaacgactgtattggtactgaagttgaaggagaagtggcaaatactaaagatggaaatatcctgcttttggagaatctcagattctacttggaagaggaaggaaaaggagtcataaatggagagaaagtcaaagctgatccaaccaaggttgagtctttcagatcccaactcactagacttggagatctttatgtaaatgatgcttttggaacttgccacagagctcattcctcaatggttggtgtcaatgtggacaccagagctgccggatttttgttaaagaaggaacttgattacttctcaaaagttttagaagatcctaaaagacctctcaccgttattcttggaggagctaaagttgcagataaaattcaactgatcaacaatttgctagacttggcagatgaaatgatcattggtggaggaatggctttcacattcaacaaagtcctgaacaataccccaatcggagcatccctctatgatgaagaaggagctaagactgttcatggcattatggaaaaggcaaaagaaaagggagtaaagattcatattccaagtgattttgtttgtgctgagagctttgcagaagatgctaaatttgcctacaaactgaagatgaaggagtcccaagatggatggttaggtctggacattggagataaaactattcgcagctttgatgaggttattagaagatctaacacccttttctggaatggaccttcaggagtttttgaatggaaaaactttgctaaaggatctcatgcaatgcttcaagctgttactgaatcaaccaagaatggaacagtttctgtatgtggaggaggagataccctcaatcttttgaagcaagtagatggagccaaagagaatatttctcatgttagtactggaggaggtgcctccttagaacttgttgaaggaaaagaacttccaggaatcaaggctttgtctgatatcaactagcttggttactcaacaatttcaacacaatgctctaaagaaggggttttggggttttggggttttggggggaattc

SEQ ID NO: 10695 - protein, 418 aa, Euplotes crassus
MLSKKLTVDKIPHMIKNKRVLVRVDFNVPIKDGKVADPTRIVSTLDTINFLKENGAKSIVLMSHLGRPKGVRQEQFSLAPVVPALEDIIGQKVNFLNDCIGTEVEGEVANTKDGNILLLENLRFYLEEEGKGVINGEKVKADPTKVESFRSQLTRLGDLYVNDAFGTCHRAHSSMVGVNVDTRAAGFLLKKELDYFSKVLEDPKRPLTVILGGAKVADKIQLINNLLDLADEMIIGGGMAFTFNKVLNNTPIGASLYDEEGAKTVHGIMEKAKEKGVKIHIPSDFVCAESFAEDAKFAYKLKMKESQDGWLGLDIGDKTIRSFDEVIRRSNTLFWNGPSGVFEWKNFAKGSHAMLQAVTESTKNGTVSVCGGGDTLNLLKQVDGAKENISHVSTGGGASLELVEGKELPGIKALSDIN

SEQ ID NO: 10696 - DNA, 1197 bp, Fusobacterium nucleatum
  CDS (1)..(1197)
atgaaaaaaattataactgatttagatttaaataataaaaaagttcttatgagagtagattttaatgttcctatgaaagatggaaaaattactgatgaaaatagaattgttcaagcattgcctacaataaaatatgttttagaacataatgctaaacttattttattttcacatttaggaaaagttaaaatagaagaagataaggctacaaaaagtttaaaagctgttgctgaaaaattatcagaacttttaggaaaaaatgtaacttttattcctgaaacaagaggagaaaaattagaatctgctattaataatttaaaatctggtgaagtattgatgtttgaaaatacaagatttgaagatttagatggtaaaaaggaatctaaaaatgattctgaattaggtaaatattgggcatcactaggggatgtttttgtaaatgatgcttttggaactgctcatagagctcatgcttctaatgtaggaattgcagaaaatattggaaatggaaattcagctgttggtttcttagttgaaaaagaattaaaatttattggtgaagcagtaaataatccaaaaagaccattaattgctattttaggaggagcaaaagtttctgataaaataggggttattgaaaatctattgactaaggctgataaaattctaattggtggagctatgatgtttactttcctaaaagcagaagggaaaaatattggaacttcattggttgaagatgataaattagacttggctaaagatttattagctaaatcaaatggaaaaatagttttacctgttgatacagttattgcaagtgaatttaaaaatgatattgaattttctactgttgatgtagataatattccaaataataaaatgggacttgacattggtgaaaaaactgttacactatttgatagttacataaaaactgctaagactgttgtatggaatggacctatgggagtatttgaaatgtctaactttgcaaaaggaacaataggagtatgtgagtcaatagcaaatttaactgacgcagtaacaataataggtggaggggattctgctgctgctgcaattagtttgggctatgcagataaatttactcatatttctactggtggaggagcatctttagaattcttagaaggaaaagttttaccaggagtcgaagctatatcaaataaataa

SEQ ID NO: 10697 - protein, 398 aa, Fusobacterium nucleatum
MKKIITDLDLNNKKVLMRVDFNVPMKDGKITDENRIVQALPTIKYVLEHNAKLILFSHLGKVKIEEDKATKSLKAVAEKLSELLGKNVTFIPETRGEKLESAINNLKSGEVLMFENTRFEDLDGKKESKNDSELGKYWASLGDVFVNDAFGTAHRAHASNVGIAENIGNGNSAVGFLVEKELKFIGEAVNNPKRPLIAILGGAKVSDKIGVIENLLTKADKILIGGAMMFTFLKAEGKNIGTSLVEDDKLDLAKDLLAKSNGKIVLPVDTVIASEFKNDIEFSTVDVDNIPNNKMGLDIGEKTVTLFDSYIKTAKTVVWNGPMGVFEMSNFAKGTIGVCESIANLTDAVTIIGGGDSAAAAISLGYADKFTHISTGGGASLEFLEGKVLPGVEAISNK

SEQ ID NO: 10698 - DNA, 1262 bp, Glomus mosseae
  CDS (1)..(1251)
atgtcactttcaaacaaattatcaatacgagacttaaacgtcaaagacaaacgagtcttaatacgagtcgacttcaacgtccccctcgatggcacaaccataaccaacaaccaacgcatcgtcgcagcccttccaacaatcaagtatgcactagaacagaaagccaaaaccgtcgtgttaatgtcacatcttggccgtcctgacggaaagaaggtcgacaagtattcacttgcgccagtggcgaaggaggtcgagagactgcttgggaagaaggtgacgtttttggaggattgcgttggggagggtgtggagaattatgtgaagaatgcctgtgatggggaggttattctcttggagaatttgaggtttcacgctgaggaggaggggagctccaaggggcctgatggcaagaaagttaaggcggatctggaaaaagttaaggagtttagaaggtctttgacggctcttggtgatgtttacatcaatgatgcttttggaaccgcacatcgagcacacagttccatggttggcgtcgaattacctcaaaaagcagccggtttcctcgtcaagaaagaattagagtactttgccaaagcgctcgaatcccccgaacgacctttcctagctattctcggcggtgcaaaggtgtccgataagatccagctcattgataacttgatcgccaaggtagatagtttgatcatttgtggtggtatggcgttcacgttcaagaagacgcttgagaacgtcaagattgggaactcgctatttgacgcggacggcgcgaagaccgttggagaggtcatggagaaggcgaagaagcatgacgttgaggtcgtcttgcctgttgactacattaccgcggataagtttgccaaggacgcgcaagttgggtatgctactgatcaagagggaattcctgatgggtggatgggattggactgcggcgagaagtctgttgagttgtataagcagactattgctaaggcgaagactatcctttggaatgggcctgctggggttttcgagtttgataactttgctaaggggacgaaggctactttggactgcgcagttgaggcagcacaatctggaaagattgtcatcatcggtggtggtgataccgcaactgttgctgcgaaatatggcgttgaggacaagctgagccatgtctcgactggcggtggagcttctttggagttgctcgaaggcaaggatcttcctggtgtctctgctctctcgagtaagtaaacgagattcac

SEQ ID NO: 10699 - protein, 416 aa, Glomus mosseae
MSLSNKLSIRDLNVKDKRVLIRVDFNVPLDGTTITNNQRIVAALPTIKYALEQKAKTVVLMSHLGRPDGKKVDKYSLAPVAKEVERLLGKKVTFLEDCVGEGVENYVKNACDGEVILLENLRFHAEEEGSSKGPDGKKVKADLEKVKEFRRSLTALGDVYINDAFGTAHRAHSSMVGVELPQKAAGFLVKKELEYFAKALESPERPFLAILGGAKVSDKIQLIDNLIAKVDSLIICGGMAFTFKKTLENVKIGNSLFDADGAKTVGEVMEKAKKHDVEVVLPVDYITADKFAKDAQVGYATDQEGIPDGWMGLDCGEKSVELYKQTIAKAKTILWNGPAGVFEFDNFAKGTKATLDCAVEAAQSGKIVIIGGGDTATVAAKYGVEDKLSHVSTGGGASLELLEGKDLPGVSALSSK

SEQ ID NO: 10700 - DNA, 1224 bp, Gloeobacter violaceus
  CDS (1)..(1224)
atggcgaagaaaacggttgaggccctgggggcggcggacctcaagggtaagcgggctctggtgcgggttgattttaatgttcccctcgacgagagcggccagatcacagacgatacgcgcattcgcgctgcgttgcccaccattggaatgttgaccggtgggggggcgcgggtaatcctggtgagccacctggggcgtcccaagggttttgacgatcagttgcgcctcacgccggtggccaagcgcctgggcgaactgctcggccagacggtctacaaagccgacgacgtgattggcccggaagtcgaagaagcggtcaagaagctcgaagacggcgatgtgctgctgttggagaacgtgcgcttctacccggaagaagaaaaaaacaaccccgaatttgcccagaagctcgcgggcctcgccgaactttatgtcaacgacgccttcggcaccgcccaccgcgcccacgcctccaccgaaggcgtggcgcgctacttgcgcccggcggtggcggggctgcttttgcaaaaagaactcgaatacctgggcaaagccctcgaaagcccggaacggccggtgcttgccatcatgggcggcgccaaagtgagcgacaagattcagcttatccagaacatgctcaccaaggtcgattcgatcttgatcggcggggcgatggcctacacgttcctcaaagcccaaggcgtggatgtgggagcttcccgctgcgagacgagcaccaccaaaaaggacggcacgaccgtcgatttgctccagctggccctcgacctgcttgccgaggcgaaggaacggggcgtcaccttcttgctgccggtcgaccaccgcaccaacgataagtttggtgaccttgccgacccgccggtcacccccgatgccaacatcccggagggccagatggccctggacatcggtcccaagaccgaggaactctacgtggccgaagtccaaaaatcgggcacggtgatctggaacggtccgatgggcgtcttcgaactgccgggattcagcaaaggcaccttcgcggtggcccatgccctggctgagagcgacaacctctcgatcgtgggcggcggcgacagcgcctcggcggccgagaaagccggtgtggtcgacaagctcagccacgtgagcaccggtggcggtgcctcgctcgaatttctcgaaggcaagaccctgcccggggtagcggccctcgacgaagcctga

SEQ ID NO: 10701 - protein, 407 aa, Gloeobacter violaceus
MAKKTVEALGAADLKGKRALVRVDFNVPLDESGQITDDTRIRAALPTIGMLTGGGARVILVSHLGRPKGFDDQLRLTPVAKRLGELLGQTVYKADDVIGPEVEEAVKKLEDGDVLLLENVRFYPEEEKNNPEFAQKLAGLAELYVNDAFGTAHRAHASTEGVARYLRPAVAGLLLQKELEYLGKALESPERPVLAIMGGAKVSDKIQLIQNMLTKVDSILIGGAMAYTFLKAQGVDVGASRCETSTTKKDGTTVDLLQLALDLLAEAKERGVTFLLPVDHRTNDKFGDLADPPVTPDANIPEGQMALDIGPKTEELYVAEVQKSGTVIWNGPMGVFELPGFSKGTFAVAHALAESDNLSIVGGGDSASAAEKAGVVDKLSHVSTGGGASLEFLEGKTLPGVAALDEA

SEQ ID NO: 10702 - DNA, 1176 bp, Haemophilus ducreyi
  CDS (1)..(1176)
atgtccgttaaaaaaatggctgaccttgatttaactggtaaacgtttattcattcgtgctgatcttaacgtccccgtaaaggaaggtaaaatcacctcagatgctcgtattcgagctacaatcccgacgttaaaattagccttacaaaaaggtgcgaaagtgatggtgacatcacacttaggtcgtccaactgaaggcgtatttgaagaagcaaattcattacaacctgtagttgattacttaaatgcatctgatttaggtgtgcctgtacggctagtgcgtgactatttagatggtgtagaagtcaaccaaaatgaaattgttgtccttgaaaatgtgcgcataaataaaggcgagaaaaaaaatgatgctgaactagcaaaaaaatatgctgccttatgcgatatttttgttatggacgcatttggtactgcacaccgcgcagaatgctcaacctatggcatagcagaatttgcacctatagcttgtgcagggccattattggcagccgagcttgaagcattaggtaaagcattaaaagaaccacagcgcccaatgttagcaattgtaggtggttcaaaagtgtcaaccaaactaaccgttttagatagcctctcaaaaattgctgatcaactgattgtcggggggggcattgccaacatattcattgcggcagaagggcataatgtaggtaaatccttatatgaagctgatttaatcccagaagcaaaacgattagcgtcaaccactcatattcctgttcctgttgatgtgcgtgtaggtacagaattttctgaaacagccacagcaaccgaaaaattagtatcagaagtgaccgccgatgaatctatcttcgatattggcgacaaatccgctgaagaattagctcatattattaaatccgcgaaaacgattttttggaatggccctgtaggggtctttgaattcgcgaacttccgtaaaggaacggaaattatctcaaatgcaattgcagaagccactgcaaatggggcattttctatcgcaggtggtggcgatacattggctgcaattgatttatttggcattgccgataaaatttcttatatctcaaccggcggcggtgctttcttagaatttgtagaaggcaaagtattacctgctgttgaaattttagaaaaacgtgcaaacagctaa

SEQ ID NO: 10703 - protein, 391 aa, Haemophilus ducreyi
MSVKKMADLDLTGKRLFIRADLNVPVKEGKITSDARIRATIPTLKLALQKGAKVMVTSHLGRPTEGVFEEANSLQPVVDYLNASDLGVPVRLVRDYLDGVEVNQNEIVVLENVRINKGEKKNDAELAKKYAALCDIFVMDAFGTAHRAECSTYGIAEFAPIACAGPLLAAELEALGKALKEPQRPMLAIVGGSKVSTKLTVLDSLSKIADQLIVGGGIANIFIAAEGHNVGKSLYEADLIPEAKRLASTTHIPVPVDVRVGTEFSETATATEKLVSEVTADESIFDIGDKSAEELAHIIKSAKTIFWNGPVGVFEFANFRKGTEIISNAIAEATANGAFSIAGGGDTLAAIDLFGIADKISYISTGGGAFLEFVEGKVLPAVEILEKRANS

SEQ ID NO: 10704 - DNA, 1209 bp, Helicobacter hepaticus
  CDS (1)..(1209)
atgaaggaaactggaatcgaattaatgaaaaatacaaaaagtgtgcgtgatattgacgtcaaagacaaaagagtgcttattcgcgtggattttaatgtgccaatggacgaggattttgatatttcagatgatacgcgtatccgcgaagcactacccactattaattattgcattgataatcacgcacaaaatatagtgcttgtcagccatttagggcgtcccaaaggacgcaatgcagagttttcactcaaacacgtgcttaaacgtgtagagcgacttttaggacgcgatatagctttcgcagagacaatagaaaatgtagaaaatcttcaacaacaaagcaagagtggaagtgtgattttacttgaaaatattagattctatgagggagaggaaaaaaatgatgaggaactctctactaaactcgcctctatttgtgatgtgtatatcaatgatgcctttggcacaagccatcgcgcacattcaagcacctgtggcattgctaaatatgccaaagagtgtgtagcaggattattgctcaaaaaagaaattgattcatttgctaaagcaatggcaaatccacttaaaccggtgttacttatcgttggcggaagcaaggtaagctctaaactcgcactcttatataatatccttgatgtggtggataaaatcatcattggtggtgcgatgagcaatactttccttaaagcacgaggttttgatatgcaaaaatcccttgtggaagatgatttagtgagtgaagcacgtaagattttggataaagcaaaagaaaaaaaagtcaaaatctaccttcctgtagatgttgtaagcactgatgatattaaagaacatcgccatatcaaaatcacgcctgcacaagatataccagagggctttatggcagtagatatgggacctgcaacaagtaagctctttagtgaagtggtaagggattctcaaacaattatttggaatggaccgcttggcatttatgaaatacaagctttttcacgcggcacttttaaccttgcccacgctgtgagcgatacttatgcctttagtcttattggtggtggcgatactgctgatgcaatagacaaggcaggagagcgagacaatatgagctttatttccacgggtggtggagcaagtttggagctacttgaagggaaaattcttcctgcatttgaggtgcttgagcgcaaataa

SEQ ID NO: 10705 - protein, 402 aa, Helicobacter hepaticus
MKETGIELMKNTKSVRDIDVKDKRVLIRVDFNVPMDEDFDISDDTRIREALPTINYCIDNHAQNIVLVSHLGRPKGRNAEFSLKHVLKRVERLLGRDIAFAETIENVENLQQQSKSGSVILLENIRFYEGEEKNDEELSTKLASICDVYINDAFGTSHRAHSSTCGIAKYAKECVAGLLLKKEIDSFAKAMANPLKPVLLIVGGSKVSSKLALLYNILDVVDKIIIGGAMSNTFLKARGFDMQKSLVEDDLVSEARKILDKAKEKKVKIYLPVDVVSTDDIKEHRHIKITPAQDIPEGFMAVDMGPATSKLFSEVVRDSQTIIWNGPLGIYEIQAFSRGTFNLAHAVSDTYAFSLIGGGDTADAIDKAGERDNMSFISTGGGASLELLEGKILPAFEVLERK

SEQ ID NO: 10706 - DNA, 1525 bp, Lactobacillus delbrueckii
  CDS (127)..(1338)
tcgtactttgttgcactttgctactctttaatttaaagttttctaaattgaattagtagtgtgaaagaaggcggagggaaatttcttccttccgccttttttcgatgaatataggagattttttcaatggctaaattgattgtttctgacgtagacgttaaggacaagaaggttttggttcgcgttgacttcaacgtgccgattaaggacggcgttatcggcgacgacaaccgtatcgtggctgctttgccaactatcaagtacatcatcgaaaacggcggcaaggctatcttgctttcccaccttggccggatcaagagcgatgaagacaagaagagcttgagcctggctccagttgccaaacgtttgggcgaattgcttgaaaagcctgtaactttcgtaccttcaaacgaaggcaaggaagttgaagacgccatcaacaacatgaaggacggcgacgtagttgttttggaaaacacccgtttccaagacatcgacaacgacttcggcaagcgtgaatcaaagaacgaccctaagctgggcgaatactgggcatcattgggtgacgttttcgtaaacgacgcgttcggtactgctcacagaagccacgcttcaaacgttggtatcgctacggccatgaaggctgccggtaaaccagtagctgctggtttcctgcttgaaaaggaaatcaagttcctgggcaacgctgttgctaacccagttcacccattcgtaactattcttggcggggctaaggtttctgacaagatcggcgttattaccaacttgattccaaaggctgaccacatcatcatcggtggtggtatggcttacaccttccttaaggctcaaggccacaatatcggcaagtccctggttgaagacgacaaggttgaatttgccaaggaattgctggaaaaggctggcgacaagctggttctgccaatcgaccacgtagccgcaactgaattcaacaacgatgctgcttcagaagttgttggccaagacatcccagacaacgaaatgggcttggacatcggtcctaagactattgaactcttcaagaagactcttgaaggtgccaagactgttgtttggaacgggccaatgggcgtcttcgaaatgccaaacttcgccaagggtactttggaagttggccgtgctttggctgacttgccagacgctactactattgtcggcggtggtgactcaactgctgctgctaagcaattggggatcgctcctaagttgactcacatctcaactggtggtggtgcatctcttgaataccttgaaggtaaggaattgccaggtatcgcttgcgtttcagacaagtagtttaggaggatttttcaaatgtcacgtaccccaattattgctggtaactggaagctgaacatgaacccaaaggaaactgttgagttcgtaaacgctgttaaggaccaattgccggacccatcaaaggttgaatcagtgatttgtgcaccagcagttgacttggacgccttgctgaaggctgccgaag

SEQ ID NO: 10707 - protein, 403 aa, Lactobacillus delbrueckii
MAKLIVSDVDVKDKKVLVRVDFNVPIKDGVIGDDNRIVAALPTIKYIIENGGKAILLSHLGRIKSDEDKKSLSLAPVAKRLGELLEKPVTFVPSNEGKEVEDAINNMKDGDVVVLENTRFQDIDNDFGKRESKNDPKLGEYWASLGDVFVNDAFGTAHRSHASNVGIATAMKAAGKPVAAGFLLEKEIKFLGNAVANPVHPFVTILGGAKVSDKIGVITNLIPKADHIIIGGGMAYTFLKAQGHNIGKSLVEDDKVEFAKELLEKAGDKLVLPIDHVAATEFNNDAASEVVGQDIPDNEMGLDIGPKTIELFKKTLEGAKTVVWNGPMGVFEMPNFAKGTLEVGRALADLPDATTIVGGGDSTAAAKQLGIAPKLTHISTGGGASLEYLEGKELPGIACVSDK

SEQ ID NO: 10708 - DNA, 1212 bp, Lactobacillus johnsonii
  CDS (1)..(1212)
atggctaaattaatcgtttcagaccttgatcttaaaggtaaaaaagttttagttcgtgttgacttcaatgttccaattaagaatggtgttattggtgacgacaaccgtattgttgctgcattaccaactattaaatacatcattgatcacggtggtaaagcaattttgcttagccacttgggtcgtgttaagtcagatgctgacaagaaagaattgtcattacgtccagtagcagaacgtttaagtgaattattagaaaagcctgtaacttttgtaccagaaaacgagggtaaagaagtagaagaagctatcgacaacatgaaggatggcgacgttgttgttcttgaaaacactagattccaagatattgacaacgactttggtaagcgtgaatctaagaacgatccaaagcttggcgaatactgggcaagtcttggtgatgtatttgtaaacgatgcatttggtactgctcacagaagtcacgcttcaaacgttggtattgcaactgctatgaagaaggctggtaagcctgcagcagctggttacttacttgaaaaggaaattaagttcttaggtgatgctgttgaaaacccagttcacccatttgtaactattcttggtggtgcaaaagtatcagataagattggtgttattgaaaacttaattcctaagtcagatcacattttaatcggtggtggtatggcttatactttcttagctgcacaaggtcacaagattggtaaatcattatttgaagctgacaaggtagaacttgctaagagcttgcttgaaaaggctggcgacaagatcgttcttccagttgataacgttgctgctactgaattctcaaatgatgctcctcacgaaattgttggtgatgatattcctgacaacgaaatgggtcttgacatcggtcctaagactgttgaaaaattcagagacatcttaaaggatgctaagactgttgtatggaacggacctatgggtgcattcgaaatgccaaattacgcagaaggtactttggaagttggtcgtgcattagctgacttaaaggatgccgtaactattattggtggtggtgactcaactgctgctgctaagcaattaggaatcgctcctaagatcagccacatttctactggtggtggtgcttcacttaactaccttgaaggtaaagaattaccaggaatcgcttgtgtttctgacaagtaa

SEQ ID NO: 10709 - protein, 403 aa, Lactobacillus johnsonii
MAKLIVSDLDLKGKKVLVRVDFNVPIKNGVIGDDNRIVAALPTIKYIIDHGGKAILLSHLGRVKSDADKKELSLRPVAERLSELLEKPVTFVPENEGKEVEEAIDNMKDGDVVVLENTRFQDIDNDFGKRESKNDPKLGEYWASLGDVFVNDAFGTAHRSHASNVGIATAMKKAGKPAAAGYLLEKEIKFLGDAVENPVHPFVTILGGAKVSDKIGVIENLIPKSDHILIGGGMAYTFLAAQGHKIGKSLFEADKVELAKSLLEKAGDKIVLPVDNVAATEFSNDAPHEIVGDDIPDNEMGLDIGPKTVEKFRDILKDAKTVVWNGPMGAFEMPNYAEGTLEVGRALADLKDAVTIIGGGDSTAAAKQLGIAPKISHISTGGGASLNYLEGKELPGIACVSDK

SEQ ID NO: 10710 - DNA, 1203 bp, Lactobacillus plantarum
  CDS (1)..(1203)
atggctaaattaatcgtttcagatttagatgttaaagataaaaaagttttaattcgtgtcgactttaatgttccaattaaagacggcaaaattggtgacgacaaccggatcgtcgctgccttaccaacgatcaaatacgtgattgaacatgatggcaaagccatcttattctcacatttaggtcggattaagagcgaagacgacaagaagggcttaagcttacgtcctgttgcagaacgtctttcaaacttattaaacaagcctgttaccttcgtccctgttactgaaggcgaacaacttgaaactgccatcaacaacatgaacgacggtgacgtcttagttgttgaaaacactcgttttgaagacgttgttaacggcgaacaagttaagcgcgaatctggtaacgatcctgaattaggcaagtactgggcttcacttggtgatgtctacgtcaacgatgctttcgggactgctcaccggagccatgcttctaacgttgggattgcttcaaacatggatcaagttgccgctggtttcttaatggaaaaggaaatcaagttcttaggtgacgcggttgacaatcctaagcacccattcgttgctatcttaggtggtgccaaggtttctgataagatcggtgttatcgatcacttaatcagcaaagctgacaagatcatcatcggtggtgggatgacttatacgttctatgctgctaaaggcatgggcattggtaactcacttgttgaaaaagacaagattgaattggctaagtcaatcatcgaaaaagctggcgacaagttagtcttacctagcgactcaatcgttgctgaaaagtttgataacgatgttcctagcaaggttgttgaaggttcaattcctgatggctacatggccttagatattggtcctaagtcaatcgaagaattcgaagatgttttacgcgacgctaagaccgttgtttggaacggaccaatgggtgtcttcgaaatgagcaactacgccaagggtacgcttgaaattggtaagttcttaggaaccttatcagacgcaacgaccatcgttggtggtggggactcaactgccgctgttaagcaacttggcgttggcgacaagttaacccacatttctactggtggcggtgcttcacttgaataccttgaaggtaaggaattacctggtattgctgctatttctgaaaaataa

SEQ ID NO: 10711 - protein, 400 aa, Lactobacillus plantarum
MAKLIVSDLDVKDKKVLIRVDFNVPIKDGKIGDDNRIVAALPTIKYVIEHDGKAILFSHLGRIKSEDDKKGLSLRPVAERLSNLLNKPVTFVPVTEGEQLETAINNMNDGDVLVVENTRFEDVVNGEQVKRESGNDPELGKYWASLGDVYVNDAFGTAHRSHASNVGIASNMDQVAAGFLMEKEIKFLGDAVDNPKHPFVAILGGAKVSDKIGVIDHLISKADKIIIGGGMTYTFYAAKGMGIGNSLVEKDKIELAKSIIEKAGDKLVLPSDSIVAEKFDNDVPSKVVEGSIPDGYMALDIGPKSIEEFEDVLRDAKTVVWNGPMGVFEMSNYAKGTLEIGKFLGTLSDATTIVGGGDSTAAVKQLGVGDKLTHISTGGGASLEYLEGKELPGIAAISEK

SEQ ID NO: 10712 - DNA, 1191 bp, Leptospira interrogans
  CDS (1)..(1191)
atggaattacctagacttgaaaatgtagatctctcaggaaagagagttttcctgagagtagattttaacgttccagtagaaaatggaaaagttacagacaaaactagaattgaaaagactcttcctacaatcgaacttctgattaaaaaaggcgcaaggataattattgcgagtcacttaggaagacccaaaggacaagtaaatcctgaattttctttggcgccagtagttgaaactttccaaagtcttgtaaaatctaaggtttatttttctaagacagtaatcggagaagacgcgattaaactttctaaagaacttaaaaacggcgaaattttagtaattgaaaacgttcgttttcataaagaagaagaggaaaatgatcctggtttttccaaaaaacttgctgcgttagccgacatctatgtgaacgacgcttttggggcagcccacagagcgcactcttccaccgaaggaattgcacgtctacttcctgcatatgcaggtcttctaatgcacaaagagatcttagaactttctgcgcttctgcataaaccggctcgtccatttgtggcgatcataggaggttccaaagtttccactaagatcaaggtcctaaccaatctattcgacaaggtaaatcatcttctcattggtggtggaatggcttatacgtttttaaagtccagagcgatccctattggaaattcactcgtggaaaaagaattcgaagttcaagcctttcagttaatcgaaaaagcaggcgtcgctggtatcgatttacaacttccggtagatcacatcattggagatcagtttaacgaaaaggcaaagaccaagtccgtagataagatgggaattttagacggttggatgggaatggatataggctctaaaacggtttctaactacgaaaagattattaaaaacgctggtacgattttttggaacgggccaatgggtgtttttgaaatggataaatttgcgagtgggactatggcaatcgccaaagcagtcgctaaatccaaggcaaaaacagttgtaggtggaggagattccatcgctgcaatcaacaaagctagagttgcagataaaattactcatatctcaactggcggtggagcttccctcgaatttatggaaggtagaaaacttccaggagtagaagcccttaagaaaaaaacttccgagtaa

SEQ ID NO: 10713 - protein, 396 aa, Leptospira interrogans
MELPRLENVDLSGKRVFLRVDFNVPVENGKVTDKTRIEKTLPTIELLIKKGARIIIASHLGRPKGQVNPEFSLAPVVETFQSLVKSKVYFSKTVIGEDAIKLSKELKNGEILVIENVRFHKEEEENDPGFSKKLAALADIYVNDAFGAAHRAHSSTEGIARLLPAYAGLLMHKEILELSALLHKPARPFVAIIGGSKVSTKIKVLTNLFDKVNHLLIGGGMAYTFLKSRAIPIGNSLVEKEFEVQAFQLIEKAGVAGIDLQLPVDHIIGDQFNEKAKTKSVDKMGILDGWMGMDIGSKTVSNYEKIIKNAGTIFWNGPMGVFEMDKFASGTMAIAKAVAKSKAKTVVGGGDSIAAINKARVADKITHISTGGGASLEFMEGRKLPGVEALKKKTSE

SEQ ID NO: 10714 - DNA, 1221 bp, Methanopyrus kandleri
  CDS (1)..(1221)
atgtacgaaaacatatctactatggacgatttcgagttcgaaaataaatgggtcttgttacgaattgatataaattcgacggttatcgatggtaaaattgaggacgatgaacgtattaaaagacatctcgggacgatcaaggagttaatggaacacgacgccagggtggccattctagcacaccaaggaagaccgggtgaggatgacttcacgacactggaaccacatgcggaaatcatgtccgaagaactcgacaacttcgagtacgtgcccgacgtgttcggacccaccgcgaagaagaagattcggtcgttggagcccggcgaagttatcctgctggagaacgtgcggttctattccgaggaacgtatcaaccgggacccggagtggcacgcacgccgacatttggtgcggaacctggccccgctgttcgacattttcgtgaacgacgccttcgctgcggcccatcgctcgaacgcttcactggtcgggttcactcgaagacttccgtcttgcgtcggccgtgtgatggagcgcgagatcgaagtcctcgaaaccatggtcagagacgagatggaggacggcgtcttcgtgatcggagggtccaagatcgaggatgctatcaaggtcatacgccgagccatcgagatggacaacgtacgtcgcgtgttactgggaggtctcgtgggcaatctcttcctttgggcctccggagtggatctagggaaaccttcacggaaattcctggatatgaagggttacacgggctacttggacgaggcacgggagctcctcgaggaaggtgacgacgtgatcctcgtacccgaagacgtggctctcaaccgcggtggagagcgcgaggaggtagacgtggacgaactgccagcggacgctcccgtcttcgacatcggtaccggaacgatcgaacggtatcgcaaggaggtcgaaagcgcgggtatggtggtcgcgaacgggccgatgggcgtgtacgaggaacccggattcgagaagggaacgtacgaggtcctcaatgctatcgccgattcggaggctttctccgtgatcggaggaggccacataattgcggcggcgaaagcctgtggtgcttatgacagcatagatcacgtcagcacgggtggcggagcgatgctccgaatgctcgccggggagcgactaccggccatagatgccatcctcacttgcccgttctcggggtgctga

SEQ ID NO: 10715 - protein, 406 aa, Methanopyrus kandleri
MYENISTMDDFEFENKWVLLRIDINSTVIDGKIEDDERIKRHLGTIKELMEHDARVAILAHQGRPGEDDFTTLEPHAEIMSEELDNFEYVPDVFGPTAKKKIRSLEPGEVILLENVRFYSEERINRDPEWHARRHLVRNLAPLFDIFVNDAFAAAHRSNASLVGFTRRLPSCVGRVMEREIEVLETMVRDEMEDGVFVIGGSKIEDAIKVIRRAIEMDNVRRVLLGGLVGNLFLWASGVDLGKPSRKFLDMKGYTGYLDEARELLEEGDDVILVPEDVALNRGGEREEVDVDELPADAPVFDIGTGTIERYRKEVESAGMVVANGPMGVYEEPGFEKGTYEVLNAIADSEAFSVIGGGHIIAAAKACGAYDSIDHVSTGGGAMLRMLAGERLPAIDAILTCPFSGC

SEQ ID NO: 10716 - DNA, 1251 bp, Methanosarcina mazei
  CDS (1)..(1251)
atgctgagggtaatgacttccagaaactttcttacgatcgatgattttgacatacgcggaaagacgattcttttaagggtcgacatgaactctcctatggacactcagggtcacattctggacgatatgaggatcaggagtcatattgccactcttaaagaccttgagagtgcaaaagtcgttgtgcttgcgcaccagagccggcctgggaaaaaagacttcaccactatgaaacctcatgctcacctgctgtccaggtatctgggcaggcaagttacttatgtggacgacatcttcgggacttttgcgaagactcagatcgcttctatggaagacggggacgtcatcatgctcgaaaacgtcaggttctattctgaagagagcctcgagaggactacagccgagcaggccaatacttttatggttaaaaaactggcaccctttgttgatattttccttaatgacgcgtttgcggtatctcacaggtctcatctctctgttgtaggctttaccgaagtcctcccttccggagcaggcagggtaatggaaaaagaacttatttccctggaaaaaggagttaaaagtggagagaggccaagcgttttcgtgctggggggggcaaaagtggacgactcacttagagtaaccgaaaatgtcctcacaaacgggggagctgacagagtcctccttacaggggtagttgcaaacgttgcccttgccgcttccggagtaaatataggaaaagccaatctggatttcattaaatcccagggctacgaagaccagatagaaagggcgagaggtttgcttgcgaagttcgaagataaaatcggacttccgaaagacgttgctttaaatgataacaaaaagcgtgttgaagctcctatttccgaacttaattccgattctctgcccattaacgatataggtcttgaaaccattgtggactacaccaatgaaatccagaatgccaaaacagttgtcctgaacggccctgccggggtttcagagattgaggactttgccctcggaacccatgaaattataaaagctgctattaaatccgatttctctatcattggcggcgggcatatctctgtggaagttgcacacctcgggcttgaacaccgcttttcacacataagcactggaggaggagcctgtattgatttccttgcaggggaaaagctgccaggcgtcgaagctctcaaggctgcttacaataagtatcaggaagctaaaaagctttaa

SEQ ID NO: 10717 - protein, 416 aa, Methanosarcina mazei
MLRVMTSRNFLTIDDFDIRGKTILLRVDMNSPMDTQGHILDDMRIRSHIATLKDLESAKVVVLAHQSRPGKKDFTTMKPHAHLLSRYLGRQVTYVDDIFGTFAKTQIASMEDGDVIMLENVRFYSEESLERTTAEQANTFMVKKLAPFVDIFLNDAFAVSHRSHLSVVGFTEVLPSGAGRVMEKELISLEKGVKSGERPSVFVLGGAKVDDSLRVTENVLTNGGADRVLLTGVVANVALAASGVNIGKANLDFIKSQGYEDQIERARGLLAKFEDKIGLPKDVALNDNKKRVEAPISELNSDSLPINDIGLETIVDYTNEIQNAKTVVLNGPAGVSEIEDFALGTHEIIKAAIKSDFSIIGGGHISVEVAHLGLEHRFSHISTGGGACIDFLAGEKLPGVEALKAAYNKYQEAKKL

SEQ ID NO: 10718 - DNA, 1245 bp, Methanococcus maripaludis
  CDS (1)..(1245)
atgtttttaactcttgacgactttgaattggaaggaaaaacggttgcattgagagttgacattaatagccctattgatgttaatactggagatattttagatgatacaaggattaaggcatgcagtgatacgataaaaagtctttcagaaaaaggagcaaaggttgttattttagcacaccagagcaggcctggaaaaaaagattttacgactcttgaagctcacgcgaaaaaactgtccgaagtattaaatatggaagttacacacgtagatggattaatctgcgcgtctgcacgtgaagcaattcttgcaatggataatggggaaataatacttcttgaaaacgtaaggcttcttgcagaagaagttttatccgattggaagtcttgggaagaaattactccagaaaaacaggctaaaacagtcatgattaagaaattacatccttttttcgattattttgttaacgatgcatttgcagcagctcacagggctcaaccttctcttgttggattttcttactatgttccaatgttatgcggaagggtcatggaaaaagaattatttacacttacaaaagttctcaaaaaccctgaaagaccttgcgtgtttgcattgggtggtgcaaaagctgacgacagtattgaagtattgaaaaacgttcttgaaaaacagaccgccgatcaggttttaacaagtggtgttgttgcaaatatctttttagttgcaaaaggttacaaaatcgggccaaatgaaaatgtaattgctgacatgggatacaccaaccagatagaaattgcaaaagagttaatttcaaaatatggggacaaaatcgtggttccaatcgatgcagcattaaatgtcgatggtgaacgggttgaaaaagaactcgacttaaacgaagaaataacttaccctattcacgacatgggcgaaaaaaccatgaaactctacgaagaaattttaaaagatgcaaaaacggttgttgcaaacggacctgctggagttttcgaaaataaaaatttcttaaaaggaacagaagaacttttaaaaagcactgcaaattcaaaaggcttttcggttatcggtggaggacacctctcagcagctgccgaagttgtagggttggcaggaaaaatggaccacatcagcactggtggcggtgcatgtatcgaatttttagctggtaaaaaacttcctgtaattgaaatgctgtccaaatcttacgaaaaacataaactttaa

SEQ ID NO: 10719 - protein, 414 aa, Methanococcus maripaludis
MFLTLDDFELEGKTVALRVDINSPIDVNTGDILDDTRIKACSDTIKSLSEKGAKVVILAHQSRPGKKDFTTLEAHAKKLSEVLNMEVTHVDGLICASAREAILAMDNGEIILLENVRLLAEEVLSDWKSWEEITPEKQAKTVMIKKLHPFFDYFVNDAFAAAHRAQPSLVGFSYYVPMLCGRVMEKELFTLTKVLKNPERPCVFALGGAKADDSIEVLKNVLEKQTADQVLTSGVVANIFLVAKGYKIGPNENVIADMGYTNQIEIAKELISKYGDKIVVPIDAALNVDGERVEKELDLNEEITYPIHDMGEKTMKLYEEILKDAKTVVANGPAGVFENKNFLKGTEELLKSTANSKGFSVIGGGHLSAAAEVVGLAGKMDHISTGGGACIEFLAGKKLPVIEMLSKSYEKHKL

SEQ ID NO: 10720 - DNA, 1242 bp, Mycoplasma gallisepticum
  CDS (1)..(1242): transl_table=4
atgattaactacaataagaagaccttaaaggatgttgatctaaaagataaaacagtaattgtacgtgttgattttaacgtaccaattaaagacaataaggttatagatgatacaagaattgttcaagcattagatacgattaaatatctaatcgaacaaaactgtaagatcgttttattaagtcacttaagccgaattaagtcattagaagatattagttctaaaaagaagagcttaagaccagtttatgaaaacttaaaaaccaaacttaacaacgttaagtttttagaagaaaacgttggttatgacgttgttgaagcggttaaacaattaaaacaccaagaagttttattattggaaaacactcgttataacgatgtcgacaatcaaggtgaagttgttaaaaaagaatctaaaaacagtccagaactaggacgtttctgagctagtttagctgatgtttttgtcaacgacgcatttggtacttcacaccgtgcgcatgcttcaaacgttgggattgctgcaaatatctcgcaatcttgtattggtttcttagttcaaaaagaactagaagcattatcaaaattaacaaacaacccacaacgtccgtttgttgtgatcttaggtggtgctaaggtatcagataaattaaaagtaatcgaatcattactaaaatctgctgatcaaattctaatcggtgggggaatggttaatacctttaataaggctaaaggttatcatattggtaaatcattattcgaacctgagatgttagaaactgctaagaagatcttagctgaagataaggataataagatcattttagcgactgatcagatggtaactaaagctagtacgatcactgatattaaaactgcacctgctggtaagtgtgtgtttgccaaagatgaagcagaaaacgaagattttgaagctttagatatcggtgatgaatcaatcaaaactttcaaatcttatatagctaaagctaaatcaatcttctgaaacggtcctttaggtgtttttgaaaaccctaattacgaacgtggatcttatgagattgctaaagcgatcagtgaatctgatagttatagtgtgatcggtggcggtgatagtgctgctgctgcaaaccaatttaaattagccgacaaatttagctttgtctcaactggtggtggtgcttcattaacatttatggaacaaactgttctaccagggattgaagcgatccaatcaaaataa

SEQ ID NO: 10721 - protein, 413 aa, Mycoplasma gallisepticum
MINYNKKTLKDVDLKDKTVIVRVDFNVPIKDNKVIDDTRIVQALDTIKYLIEQNCKIVLLSHLSRIKSLEDISSKKKSLRPVYENLKTKLNNVKFLEENVGYDVVEAVKQLKHQEVLLLENTRYNDVDNQGEVVKKESKNSPELGRFWASLADVFVNDAFGTSHRAHASNVGIAANISQSCIGFLVQKELEALSKLTNNPQRPFVVILGGAKVSDKLKVIESLLKSADQILIGGGMVNTFNKAKGYHIGKSLFEPEMLETAKKILAEDKDNKIILATDQMVTKASTITDIKTAPAGKCVFAKDEAENEDFEALDIGDESIKTFKSYIAKAKSIFWNGPLGVFENPNYERGSYEIAKAISESDSYSVIGGGDSAAAANQFKLADKFSFVSTGGGASLTFMEQTVLPGIEAIQSK

SEQ ID NO: 10722 - DNA, 1215 bp, Mycoplasma hyopneumoniae
  CDS (1)..(1215): transl_table=4
atgcagccaacctacaaaaataaaaagtttattgatgatattgattttttaaataaaactgtaattctccgtgttgattttaatgtgccgatcaaaaatggagaaattagttctataaaaagaatcattgcaagtcttaaaactattaaaaaaattgtaaataatggcggtaaattagtgattttatcccatcttggccggataaaatccaaagaagatcttccaaaaaaatcccttagaatagtagctgaaaaattagctgaaattttaggtcaggaaattaaatttatccctgaaaaccgtggtcctaaagtcgaaaatgcaattagccaacttgaaaaaggtgaaattttagtacttgaaaatacaagatttcaggacctaaataataaagctgagtccaaaaacgatgctgaattaggcagatattgagcctcccttggtgatgtttttatcaatgatgccttcggaactcttcatcgggctcatggatcaaatgtcggaattgcaacttatattaaagaatcagcaattggatatttagtaaaagaagaattagatgccctttcaaaactaattttttccccgcaaagaccattttatgcaattatcggcggggcaaaaatatccgataaaatcgggataatttcaactttattagaaaaagctgataaagttttaatcggtggcggaatggcttatactttcaaaaaagcacttggttataaaattggtctttcgatttatgaagatgacaaacttgaacttgctgctagtctagtcaaaaaatatccagataaattaattttagctcttgatgcggctctagccccagaatttgccgatcttgaacctttatataatcaggaaaatccccttgaaatccctgatcatttagaaggaatggatattggtcctttaacaattgagttattcaaggatcatctaaaagatggaaaaactatcctttgaaatggaactttaggcgtagccgaatttaaaaattttgcccgtggaaccaaggaagttgccaaaattattgccaatctaaaagaatgttatagtatcattggcgggggagattcaatcgctgcaattgaagccgaaggtcttagtaattcattttcccatatttctacaggcggaggcgcttcaattagttttattgaaaacggtgatttaattggacttggcccaatccaggaaaaagactaa

SEQ ID NO: 10723 - protein, 404 aa, Mycoplasma hyopneumoniae
MQPTYKNKKFIDDIDFLNKTVILRVDFNVPIKNGEISSIKRIIASLKTIKKIVNNGGKLVILSHLGRIKSKEDLPKKSLRIVAEKLAEILGQEIKFIPENRGPKVENAISQLEKGEILVLENTRFQDLNNKAESKNDAELGRYWASLGDVFINDAFGTLHRAHGSNVGIATYIKESAIGYLVKEELDALSKLIFSPQRPFYAIIGGAKISDKIGIISTLLEKADKVLIGGGMAYTFKKALGYKIGLSIYEDDKLELAASLVKKYPDKLILALDAALAPEFADLEPLYNQENPLEIPDHLEGMDIGPLTIELFKDHLKDGKTILWNGTLGVAEFKNFARGTKEVAKIIANLKECYSIIGGGDSIAAIEAEGLSNSFSHISTGGGASISFIENGDLIGLGPIQEKD

SEQ ID NO: 10724 - DNA, 1215 bp, Mycoplasma mycoides
  CDS (1)..(1215): transl_table=4
atgaattacaataacaaaaaaacattaaaagacatagatgttaaaaataaaactgtattagttcgtgtggattttaatgtaccaattcaaaatggagttattactgatgataatcgtataattgctgcttttcctactataaattacttacttgaaaatgatgcaaaaattgttttattttcacacttatcaagaattaaatcaaaagaagataaactaaaaaaatctttagccccagttgctaaaagattagaagaattattaaataaacaagttaaatttattaatcaaactagaggacaagaactagaaaaagctattagttcattacaatctaaagaaattattttagttgaaaacactagatttgaagatgttttagatgatcaagttgttaagtatgaatcaaaaaacaattctgaattaggaaaatattgagctagtttgggagaagtttttgtaaatgatgcttttggaactgcacatagggcacacgcttcaaatgttggaattgcttcaaatattaaagtttcagctattggatttttagttgaaaaagaactaaaaatgttatttcaagcagtcaatgaacctaaaaaaccatttattgctattttagggggagctaaagtttcagataaaattggtgttattgaaaatttattaccaaaagtagataaattattaattggtggaggaatgagttatacattcttaaaagcattaggaaaaactattggtaaatcattattagaagaagataaaattgatttagcaaaacattatttagaaattggtaaagataaaattgtagtacctgttgatactgcttgtgcaaaagaatttgcagatgttagtccaactatttttgaaggaaatattcctgacgaatgagatggattagatgccggaccaaaaacaattgaattatttaaacaagaaattaaaaaagctaaaactattgtttgaaatggacctgttggagtatttgaatttaaaaactttgaaaacggtacaaaatcagtctgtcaagccattgctgaacaaacacaaaatggtgcatttactttaattggtggtggagatagtgcttcagctgcaattaatatgggatttaaagataaattttcatgaatttcaactggtggaggagcttcacttgaatttatggaaggaaaagaattactaggaatttctgcaattcaagataaataa

SEQ ID NO: 10725 - protein, 404 aa, Mycoplasma mycoides
MNYNNKKTLKDIDVKNKTVLVRVDFNVPIQNGVITDDNRIIAAFPTINYLLENDAKIVLFSHLSRIKSKEDKLKKSLAPVAKRLEELLNKQVKFINQTRGQELEKAISSLQSKEIILVENTRFEDVLDDQVVKYESKNNSELGKYWASLGEVFVNDAFGTAHRAHASNVGIASNIKVSAIGFLVEKELKMLFQAVNEPKKPFIAILGGAKVSDKIGVIENLLPKVDKLLIGGGMSYTFLKALGKTIGKSLLEEDKIDLAKHYLEIGKDKIVVPVDTACAKEFADVSPTIFEGNIPDEWDGLDAGPKTIELFKQEIKKAKTIVWNGPVGVFEFKNFENGTKSVCQAIAEQTQNGAFTLIGGGDSASAAINMGFKDKFSWISTGGGASLEFMEGKELLGISAIQDK

SEQ ID NO: 10726 - DNA, 1248 bp, Mycobacterium paratuberculosis
  CDS (1)..(1248)
atggctgtccacaatctcaaagaccttctcgccgaaggtgtttccggacgcggtgtgctggtgcgttcggacctgaacgtgccgctggactccgatggtgagcaaggccggatcaccgaccccggccgcatcaccgcgtcggtgccgacgttgagcgcactggtcgaggcgggcgccaaggtggtggtcgccgcgcacctcgggcgtcccaagaacgggccggacccggcgttgtcgctggccccggtggccgccgcgctcggcgagcagctgggccggcacgtgcagctggcctcggacgtggtgggcaccgacgccctggcccgcgccgaggggttgaccgacggcgacgtcctgctgctggaaaacatccggttcgacgcccgcgaaacgtccaaggacgacgccgagcggctcgcgctggcccggcagctggccgaattggtcggtcccacaggcgctttcgtctccgacggtttcggcgtggtgcaccgcaagcaggcctcggtgtacgacgtcgccacgctgctgccgcactacgccggcacgctggtggccgaggagatcgccgtgctggagcagctgaccggctccaccaaacgcccctacgcggtggtgctcggcgggtccaaggtgtccgacaagctcggcgtcatcgagtcgctggccaccaaggccgacagcatcgtcatcggcggcggcatgtgcttcaccttccttgccgcgcaagggttttcggttggcaagtcgctgctggaaaccgagatggtggacacctgccgccggctgctggacacctacgtcgacgtgctgcggctgccggtggacatcgtggcggccgacaggttcgccgccgacgcggcgccgcagaccgtgccggccgacgccatccccgacgacctgatgggcctggacatcgggccgggatcggtcaagcggttcaccgcgctgctgtccaacgccgagacgatcttctggaacggcccgatgggcgtgttcgagttcccggcgttcgccgcgggcaccaaggggctggccgaagcgatcgccgcggcgaccggcaagggcgccttctccgtggtcggcggcggcgactcggcggccgcggtgcgcgcgctgggcatcccggagagcggcttctcgcacatttccaccggcggcggggcgtcgctggaataccttgagggcaaggcacttccgggcatcgaggtgctgggacgtccgcaaccgacgggaggcgccgcgtga

SEQ ID NO: 10727 - protein, 415 aa, Mycobacterium paratuberculosis
MAVHNLKDLLAEGVSGRGVLVRSDLNVPLDSDGEQGRITDPGRITASVPTLSALVEAGAKVVVAAHLGRPKNGPDPALSLAPVAAALGEQLGRHVQLASDVVGTDALARAEGLTDGDVLLLENIRFDARETSKDDAERLALARQLAELVGPTGAFVSDGFGVVHRKQASVYDVATLLPHYAGTLVAEEIAVLEQLTGSTKRPYAVVLGGSKVSDKLGVIESLATKADSIVIGGGMCFTFLAAQGFSVGKSLLETEMVDTCRRLLDTYVDVLRLPVDIVAADRFAADAAPQTVPADAIPDDLMGLDIGPGSVKRFTALLSNAETIFWNGPMGVFEFPAFAAGTKGLAEAIAAATGKGAFSVVGGGDSAAAVRALGIPESGFSHISTGGGASLEYLEGKALPGIEVLGRPQPTGGAA

SEQ ID NO: 10728 - DNA, 1179 bp, Nitrosomonas europaea
  CDS (1)..(1179)
atgtccgttattaaacttgtcgatcttgatctgaagaacaaacgcgtctttatccgcgctgatttgaatgttcctgtaaaagacgggaaagtgacatcagatgcgcgcattactgcctcgatggcaacgatcaaccactgcctgaaacaaggcgcaaaagtcatggtgacctctcatcttggacggccggaagaaggggtatggacagaagaaaattctctccagccggttgccgatgatattgcccggagactgggaaagcctgtccggttgatcaaagactgggtagagggtggatttgaagttgcatctggagagttggtagtcctggaaaattgtcggatcaataaaggtgaaaaaaagaacctcgaagaaaccgccaagaaatatgccagtttgtgtgatgtattcgtcatggatgcttttggtacagcacaccgtgcagaagcttcgacacatggtatcgccaaatatgcaccgattgcctgtgcaggtattttgcttaccgaagaactcgatgcgctgacaaaagccctgcatcagccagcacatccgctggtggcaatcgtaggcggatcaaaagtttccaccaaactgaccgtgctggaatcgcttgctgaaaaagttgatcagctcgtagtcggcgggggaattgccaacacttttctcaaggccgcagggaacaacattggaaaatccctgtgcgaggatgaactggtacccgttgcaaaatccctgatggataaaatgaacaagcgtaatgcaacgattcccatcgcagtagatgtcgtcgtcggaaagaaattcgctgaagatgaagctgctgttctaaaagcagccaacgctgtttctgatgacgacatgatctttgatatcgggcctgagagtgctcaagaattggtcgacatcatcatgaaagccggtacggtagtctggaatggcccggtcggtgtattcgaattcgatcaatttggagaaggaacacgcgccatagccaaggcaattgctgaaacggatgccttcaccctggcggggggcggtgacacaatcgctgccatccaaaagtacgacatctacgataaagtttcctatatatccactgccggaggagcattcctggagtttctggaagggaagaaattacctgctgtcgagattctggaattacgtgcgaagtga

SEQ ID NO: 10729 - protein, 392 aa, Nitrosomonas europaea
MSVIKLVDLDLKNKRVFIRADLNVPVKDGKVTSDARITASMATINHCLKQGAKVMVTSHLGRPEEGVWTEENSLQPVADDIARRLGKPVRLIKDWVEGGFEVASGELVVLENCRINKGEKKNLEETAKKYASLCDVFVMDAFGTAHRAEASTHGIAKYAPIACAGILLTEELDALTKALHQPAHPLVAIVGGSKVSTKLTVLESLAEKVDQLVVGGGIANTFLKAAGNNIGKSLCEDELVPVAKSLMDKMNKRNATIPIAVDVVVGKKFAEDEAAVLKAANAVSDDDMIFDIGPESAQELVDIIMKAGTVVWNGPVGVFEFDQFGEGTRAIAKAIAETDAFTLAGGGDTIAAIQKYDIYDKVSYISTAGGAFLEFLEGKKLPAVEILELRAK

SEQ ID NO: 10730 - DNA, 1182 bp, Oceanobacillus iheyensis
  CDS (1)..(1182)
atgaacaaaaaaacaattaacgatctacaagttgaaggaaagcgagtatttacacgcgtagactttaatgttcctttaaaagatggtgagattacagatgatacacgtattcgcgccgcactaccgacaattgaacaattaacagcacaaggtgcaaaagtgattttagctagtcatctaggacgacctaaaggaacagttgtagaagaactacgtttagaccctgttgctgatagacttagtgatctattaggtaaagaagtattgaaaacagatcaagtttatggtgaagaagttgatcaggctatcagtgagctagaaaacggtggagttcttttaatagagaacgttcgctttgaagctggagaagaaaaaaatgatcctgaattagtggaagcattcgctaacatggctgacctttatgtcaatgatgcttttggtgctgctcatcgtgcacatgcatctacaactggcgtagcagagaaattaccagcagctgcaggtaaattaatggagaaagaaattgaagcactaggcaacgctctagaaaatccggaacgaccgtttacagcaattgttggtggagcgaaagtaaaagataaaattagtgtgatcgataatctgttagataaagtagataatttgattattggtggcggtctagcttacacgttcatcaaagcacaaggtcatgagattggaaaatcacttctagaagaagataaaattgatttggctaaagaatttatgaacaaagcgaaagaaaaaggtgttaactttgtattgccagtcgacgctattgtggccgatgatttctcagaagaggctaataccaaaattgtagatatagataaaattccttctgactgggaagcgttagatataggcacgaagacaagagaaaaatatagtagtatcgtgaaagattcaaaacttgttatatggaatggaccaatgggagtatttgaattaaatgcattcgcaggtggtacaaaagctgtagcagaagcattagcatctacagaaggctactctataataggtggtggcgattctgcggcagctgttgaaaagttcggccttgcagaagaaatggatcatgtatctacaggtggaggagcatcattagaattcatggaaggaaaagttcttcctggactagctgctctaaatgataaataa

SEQ ID NO: 10731 - protein, 393 aa, Oceanobacillus iheyensis
MNKKTINDLQVEGKRVFTRVDFNVPLKDGEITDDTRIRAALPTIEQLTAQGAKVILASHLGRPKGTVVEELRLDPVADRLSDLLGKEVLKTDQVYGEEVDQAISELENGGVLLIENVRFEAGEEKNDPELVEAFANMADLYVNDAFGAAHRAHASTTGVAEKLPAAAGKLMEKEIEALGNALENPERPFTAIVGGAKVKDKISVIDNLLDKVDNLIIGGGLAYTFIKAQGHEIGKSLLEEDKIDLAKEFMNKAKEKGVNFVLPVDAIVADDFSEEANTKIVDIDKIPSDWEALDIGTKTREKYSSIVKDSKLVIWNGPMGVFELNAFAGGTKAVAEALASTEGYSIIGGGDSAAAVEKFGLAEEMDHVSTGGGASLEFMEGKVLPGLAALNDK

SEQ ID NO: 10732 - DNA, 1197 bp, Onion yellows phytoplasma
  CDS (1)..(1197)
atgacaaaatccttaactaatatgaatattacaaataaaaaagttttattgcgagcagacctaaatgttcctttagaaaacagcgttatcacagatgacaacagaattaaggctattttacctactttaaaatatttagttcagcaaaaagctaaagttattattttttctcatttgggacgcgttaaaactgaagctgataaagcccattttagcttgcaagtggtagctgaaaaaattgctttttatttgcaacaaaaattaaagtttgttccagaaacccaaggcaacaccttaaatcaagctgttggccagatgcttccaggggatgttttagtagtccaaaatactcgttttgaagatgttcctttcaaaaaagaaagtaaaaacgaccccgaattaggcaaatattgggcatctttaggtgatgtttttgtcaatgatgcttttggtacatgccatcgcacccacgcttctaatgtaggcattgcaacatatatcaaagaaaaatgctttggttttttggtcgaaaaagaaatatcttttctcaaaaaaattgtccaaactcctcaaagacctttggttgctgttttgggtggctccaaagtatctgacaaaattggagttattcgtagtcttttgcaaaaagttgatgttcttttgataggtggaggaatgagctatacttgtcttaaagccaaatgttttaacataggaactagcttgttagaagcagacaaaatccctttagtaaaagaattattagcttctccagaaggcaaaaaaatcgttttacctaaagattttgtttgtggcaaagaattttcgccaacaacacaagcagctgtttatagttatgataatatttctgatgatgtaatgggacttgatatcggacctcaaacaattgaacttttcaaaacgtatttacaaacggctcaaacagttgtttggaatggtcctgtaggagtgtttgaatttgaacaattttctaaaggaaccaaagctttagccgaaacaataagcaatctttcgcccaatacaactaccattattggtggtggcgatagcgctgctgcagtctttaaattcggtctagatcaaaatttcagccatatttctacgggtggaggcgcttttttagaatttttagaaggaaaaccaatgccagggcttgcatgtatggagaaactgtaa

SEQ ID NO: 10733 - protein, 398 aa, Onion yellows phytoplasma
MTKSLTNMNITNKKVLLRADLNVPLENSVITDDNRIKAILPTLKYLVQQKAKVIIFSHLGRVKTEADKAHFSLQVVAEKIAFYLQQKLKFVPETQGNTLNQAVGQMLPGDVLVVQNTRFEDVPFKKESKNDPELGKYWASLGDVFVNDAFGTCHRTHASNVGIATYIKEKCFGFLVEKEISFLKKIVQTPQRPLVAVLGGSKVSDKIGVIRSLLQKVDVLLIGGGMSYTCLKAKCFNIGTSLLEADKIPLVKELLASPEGKKIVLPKDFVCGKEFSPTTQAAVYSYDNISDDVMGLDIGPQTIELFKTYLQTAQTVVWNGPVGVFEFEQFSKGTKALAETISNLSPNTTTIIGGGDSAAAVFKFGLDQNFSHISTGGGAFLEFLEGKPMPGLACMEKL

SEQ ID NO: 10734 - DNA, 1383 bp, Opisthorchis sinensis
  CDS (4)..(1251)
gggatggggcttcgcaaattgagcatagccaatgttgacctcaaagataagcgggtgcttatgcgagttgattttaatgttccaatgaaagatggcaaggtgacaaacacccaaagaattgttggggcatcaccaaccatcaagtatgcacttgataagggggccaaaagtatcgtcctaatgtcccatcttggaggtcgggtcggtaacaaagtcgccagatattccctcaacccggtgggagaagaagtgtccaaactccttgggaaaccagtgaaattcttacctgattgtgtcggcccagaaacaacagaaggcatgtgccaatcctctgcaggatccgtgttcctgttagaaaatctacgtttccatgttgaggaggaagggaaaggcgtttcccccactggagaaaagatcaaagccactccagagcaagtcaaggccttcagtgaaaacttgaccaagttgggtgacgtttacctaaacgacgcatttggtacagctcacagagctcacgcttccatggttggctgcagacttacgcaaagggcatgtgggtttctcatggacaaggaattgacctacttctccaagctgttggatcagcctcagcatcctttcttggcgatcattggtggagctaaagtcagtgacaaaattcaactgatcaagaacatgttggacaaagtggacgaactgattataacaggaggcatggctttcactttcctcaagaaactccacaatatgaagattggaaagagtctttacgatgaacccggggctgcaattgtcgacgaatggatgcagttggccaaatccaagaacgttaagattcatctacctgttgatttcataaccggggacaagtttgcggaggatgccaatactggcactgccacagtcgagcctggcatccgggacacgcatatgggcttggatggtggtccgaaaaccatggaagagttctgcaaggtaattagtcgagcaaaaaccattgtttggaacggtccaatgggtgtgttcgaaatggagaagtttgctggcggtacgaaggcagcaatggatgcagtggtggctgctacaaccaagggagttacgaacaataatggtggtggtgacacagctacctgctgtccaaaatggaaaacagaggcacaggtcagtcacgtgagtactggagtaggggctagcttggagctgcttgaaggcaagcaactaccaggtattctcgccctgagtgacgcataatcgccacagctatcggggctaatgattggcatctagtcacaattgtaccgtagcgtttccctgttacttatgttattgtctttatttgcaccaaaacatgcttcttcgttcgttaaaaaaaaaaaaaaaaaa

SEQ ID NO: 10735 - protein, 415 aa, Opisthorchis sinensis
MGLRKLSIANVDLKDKRVLMRVDFNVPMKDGKVTNTQRIVGASPTIKYALDKGAKSIVLMSHLGGRVGNKVARYSLNPVGEEVSKLLGKPVKFLPDCVGPETTEGMCQSSAGSVFLLENLRFHVEEEGKGVSPTGEKIKATPEQVKAFSENLTKLGDVYLNDAFGTAHRAHASMVGCRLTQRACGFLMDKELTYFSKLLDQPQHPFLAIIGGAKVSDKIQLIKNMLDKVDELIITGGMAFTFLKKLHNMKIGKSLYDEPGAAIVDEWMQLAKSKNVKIHLPVDFITGDKFAEDANTGTATVEPGIRDTHMGLDGGPKTMEEFCKVISRAKTIVWNGPMGVFEMEKFAGGTKAAMDAVVAATTKGVTNNNGGGDTATCCPKWKTEAQVSHVSTGVGASLELLEGKQLPGILALSDA

SEQ ID NO: 10736 - DNA, 1260 bp, Oxytricha nova
  CDS (1)..(1260): transl_table=6
atgctttccaaaaagctagccatcgatcacatcccccacctcatcaaaggaaagagagtcctcatgagagttgatttcaatgttcccatcaaggagggcaagatcaaggatcttaccagaattcaaggagcactcccttcaatcaactactgcctagagaatggagctgagtctgttgttctcatgagtcacttaggcagacctgatggccagagagtagagaagcactccctcaagcctgtgctcccagccatcgaagacctactcaagaaaaaggtacagttcctcgatgattgcgttggctccgaggtggagagagagtgcaagtcagcttccaagggaaaggtcattcttcttgaaaacctgagattccatcttgcagaggagggcaaaggagtaatcaatggagagaaggttaaggcaaccaaagaagacattgctgctttcagaaagtcacttaccagccttggagagctctatgttaacgatggcttcggtactgctcacagagctcactcttcaatggtaggagttaacgttgataccagagctgctggcttcttgctcaagaaggaacttcagtatttctccaagattcttgagactcctgagagacccctcactgttgtgatgggaggagccaaggtcgctgataagatccaactcatcatgaagcttctcgagttagctgacgagttgatcattggtggaggtatggccttcactttcaacaaggtgctagacggctcaaacatcggtaaatctcttttcgattaggaaggtgccaagattgttccagacatcattaaaaaggctaaggagagaggagtaaagatccacttgccagttgatgcagttgctgctgataagtttgaagagtctgctgctacttagcttgttgacctcaagactggagctattcctgacggatggatgggacttgatatcggccccaagaccattgagcaaaacagcagagttatcttaagagctaagactgtgttctggaacggaccccaaggagtttttgaaatggctcctttctcaaagggatctctatcaatgctagacgacatcattaaggctacctagaccggagctacctcagttgctggtggcggtgatactgtctctctccttggaaaggttaagggcaccactgacaagttctctcacgtcagcactggaggtggtgcatctcttgagcttctttaaggcaaacaacttccaggtgttgttgctctttcagacagacaatga

SEQ ID NO: 10737 - protein, 419 aa, Oxytricha nova
MLSKKLAIDHIPHLIKGKRVLMRVDFNVPIKEGKIKDLTRIQGALPSINYCLENGAESVVLMSHLGRPDGQRVEKHSLKPVLPAIEDLLKKKVQFLDDCVGSEVERECKSASKGKVILLENLRFHLAEEGKGVINGEKVKATKEDIAAFRKSLTSLGELYVNDGFGTAHRAHSSMVGVNVDTRAAGFLLKKELQYFSKILETPERPLTVVMGGAKVADKIQLIMKLLELADELIIGGGMAFTFNKVLDGSNIGKSLFDQEGAKIVPDIIKKAKERGVKIHLPVDAVAADKFEESAATQLVDLKTGAIPDGWMGLDIGPKTIEQNSRVILRAKTVFWNGPQGVFEMAPFSKGSLSMLDDIIKATQTGATSVAGGGDTVSLLGKVKGTTDKFSHVSTGGGASLELLQGKQLPGVVALSDRQ

SEQ ID NO: 10738 - DNA, 1164 bp, Pasteurella multocida
  CDS (1)..(1164)
atgtcagtaatcaaaatgacagacttggatttgagcggcaaacgtgtgtttattcgtgctgatttaaatgtgccagtcaaagatggcaaagtgacttctgatgcacgtatccgtgcgaccatccctaccttgaaacttgcgcttgaaaaaggcgcaaaagtgatggtgacttcacacttaggtcgcccaacagaaggcgaatttgatgaagcaaactcactgaaacctgtagttgattacttaaatgcaaatttagatgtgcctgttcgtttagtacgcgattatttagacggtgtggacgttaaccaaggcgaaatcgtggtattagaaaacgtgcgcattaacaaaggtgagaagaaaaacgatcctgaattaggcaaaaaatatgccgcactttgcgatgtctttgtgatggatgcctttggtactgcacaccgtgcgcaagcctcgacttacggtgtggctgaatatgcgccagtggcttgtgcaggtccattattagcggctgaattagatgctttaggcaaagccttaaaagaacctgcgcgtccaatggtggcgattgtaggggggtcgaaagtctcaaccaaattagaagtgttaaattccttatctaaaattgcggaccaaattattgtgggcgggggtatcgccaataccttcattgctgcagcaggtcataacgtcggtaaatccttatatgaagaagatttaattcctgtggcgaaaaacttagcagcaagcacagatattcctgtacccgttgatgttcgcgttgggttagaattctctgaaactgcagcagcaacagaaaaagccgtcaatgaagtgaaagatgatgaatccatttttgatattggtgataaatcagcagaacaactcgcggaaatcatcaaaaatgcgaaaacgattctttggaatggtccagtgggcgtgtttgagttcccgaatttccgtaaagggactgaaatcatttctcacgcaatcgctaatagcgaaggtttctcaattgcaggtggtggtgacacattagcggcgattgacctattcggtatcaaagataaaatttcttatatttcaacaggtggtggtgcattcttagaattcgttgaaggtaaagtattaccagcagtagaaatcttagaaaaacgtgcaaatggttaa

SEQ ID NO: 10739 - protein, 387 aa, Pasteurella multocida
MSVIKMTDLDLSGKRVFIRADLNVPVKDGKVTSDARIRATIPTLKLALEKGAKVMVTSHLGRPTEGEFDEANSLKPVVDYLNANLDVPVRLVRDYLDGVDVNQGEIVVLENVRINKGEKKNDPELGKKYAALCDVFVMDAFGTAHRAQASTYGVAEYAPVACAGPLLAAELDALGKALKEPARPMVAIVGGSKVSTKLEVLNSLSKIADQIIVGGGIANTFIAAAGHNVGKSLYEEDLIPVAKNLAASTDIPVPVDVRVGLEFSETAAATEKAVNEVKDDESIFDIGDKSAEQLAEIIKNAKTILWNGPVGVFEFPNFRKGTEIISHAIANSEGFSIAGGGDTLAAIDLFGIKDKISYISTGGGAFLEFVEGKVLPAVEILEKRANG

SEQ ID NO: 10740 - DNA, 1164 bp, Photorhabdus luminescens
  CDS (1)..(1164)
atgtctgtaattaagatgaccgatttagatctggcgggtaagcgtattttgatccgcgctgacctgaacgttccggtaaaagatggcaaagtcacctctgatgcgcgtatccgtgcttccttaccgaccattgaggcagcattaaaacagggcgctaaagtgatgatcacttctcaccttggccgccctactgaaggcgaatacagtgaagaattctcgctgaaaccagtagtagactatctagaagagaaattatcttcccccgttcgactggaaaaagagtatctggaaggcgtggatgtcgcggaaggtgaactggttgtgctggagaatgttcgctttaataaaggtgagaagaaagacgacgaaaccttagccaaaaaatatgcttccctgtgtgatatttatgtcatggatgcattcggtactgctcatcgtgcacaagcttctactcacggtgtggctaagtttgctccagtggcctgtgccggtcctttgttgtccgcagagttagaggcattgggtaaagcgttagataatccagcccgtccaatggtggctatcgttgggggctctaaagtttcaaccaagctgaccgttctggatacgctgtctaaaattgctgaccaattgattgtcggtggtggtatcgcgaatacctttgttgctgcggaaggccataatgtcggtcgttctctctatgaagacgacttgctcccggaagcgaagaaattgctgataagctgtgatattccggtgccaaccgatgttcgtgtggcaacagaattctctgaaacagccgaagcaatcttgaaatctacccacgatattaaagatgatgagcagatcctcgatctgggggatgaatctgctcaacggctggcggatattctgaaaaacgccaaaacgattctatggaatggcccggttggtgtatttgaattccctaatttccgtcaaggaactgaaattgtcgcgcgcgccattgctgatagtgatgccttctctatcgccggtggcggcgatacgctggcagcgatcgacttgttcggtattgctgacaaaatttcttatatctctacgggtggtggtgctttccttgagttcgtggaagggaaaaaactgcctgcggttgtgatgttggaagaacgtgcaaaacagtaa

SEQ ID NO: 10741 - protein, 387 aa, Photorhabdus luminescens
MSVIKMTDLDLAGKRILIRADLNVPVKDGKVTSDARIRASLPTIEAALKQGAKVMITSHLGRPTEGEYSEEFSLKPVVDYLEEKLSSPVRLEKEYLEGVDVAEGELVVLENVRFNKGEKKDDETLAKKYASLCDIYVMDAFGTAHRAQASTHGVAKFAPVACAGPLLSAELEALGKALDNPARPMVAIVGGSKVSTKLTVLDTLSKIADQLIVGGGIANTFVAAEGHNVGRSLYEDDLLPEAKKLLISCDIPVPTDVRVATEFSETAEAILKSTHDIKDDEQILDLGDESAQRLADILKNAKTILWNGPVGVFEFPNFRQGTEIVARAIADSDAFSIAGGGDTLAAIDLFGIADKISYISTGGGAFLEFVEGKKLPAVVMLEERAKQ

SEQ ID NO: 10742 - DNA, 1164 bp, Photorhabdus luminescens
  CDS (1)..(1164)
atgtctgtaattaagatgaccgatttagatctggcgggtaagcgagttttaatccgcgctgacctgaacgttccggtaaaagatggcaaagtcacctctgatgcgcgtatccgtgcctccttgccaaccatcgaagcagcattgaaacagggcgccaaggtcatgatcacttctcaccttggccgcccgattgaaggcgaatacaacgaagaattctcgctgaaaccagtagtagactatctaaaagagaaattatcctcctccgttcgactggaaaaagagtatctggaaggcgtggaagtatcagaaggtgagctggtcgtgctggagaacgttcgctttaataaaggtgagaagaaagacgacgaaagcttggctaaaaaatacgcttccctgtgtgatatttatgtcatggatgcattcggtaccgctcatcgtgctcaggcttcgactcacggcgtggctaagtttgctcctgttgcttgtgccggtcctttattgttcggggaattagaggcattaggtaaagcgttggataatccggctcgcccaatggtggctattgtcggtggttctaaagtttcaaccaagctgaccgttctggatacgctgtctaaaattgccgaccaactgattgttggtggtggtattgcgaatacgtttgttgccgcggaaggtcacaatgttggccgttctctctatgaagatgatttgatcccggaagcgaaaaaattgctgataagctgtgatattccggtgccaaccgatgttcgtgtagcaacagaattctctgaaacggccgaagcaaccttgaaatcctccagtgatattaaagatgatgagcagatcctcgatttgggagatgaatccgctcaacggctggctgatatcctgaaaaacgctaaaacgatcctatggaatggcccggttggtgtatttgaattccctaatttccgtcaagggactgaaattgtcgcgcgcgccattgctgatagtgatgccttctctatcgccggcggcggcgatacgctggcagcgatcgacctgttcggtattgctgacaaaatttcttatatctctacgggtggtggcgctttcctcgagttcgtggaagggaaaaaactgcctgcggttgtgatgttggaagaacgtgcaaaacagtaa

SEQ ID NO: 10743 - protein, 387 aa, Photorhabdus luminescens
MSVIKMTDLDLAGKRVLIRADLNVPVKDGKVTSDARIRASLPTIEAALKQGAKVMITSHLGRPIEGEYNEEFSLKPVVDYLKEKLSSSVRLEKEYLEGVEVSEGELVVLENVRFNKGEKKDDESLAKKYASLCDIYVMDAFGTAHRAQASTHGVAKFAPVACAGPLLFGELEALGKALDNPARPMVAIVGGSKVSTKLTVLDTLSKIADQLIVGGGIANTFVAAEGHNVGRSLYEDDLIPEAKKLLISCDIPVPTDVRVATEFSETAEATLKSSSDIKDDEQILDLGDESAQRLADILKNAKTILWNGPVGVFEFPNFRQGTEIVARAIADSDAFSIAGGGDTLAAIDLFGIADKISYISTGGGAFLEFVEGKKLPAVVMLEERAKQ

SEQ ID NO: 10744 - DNA, 1179 bp, Photobacterium profundum
  CDS (1)..(1179)
atgagaggacgaacaatgtctgtaatcaagatgactgatctggaacttgctggtaagcgcgtatttattcgtgcagatctaaacgtaccagttaaagacggtaaagtaacttctgatgcacgtatccttgcatctctaccaactattaagcgttgcttagaagctggcgctaaagtaatggttacttctcaccttggtcgtccaacggaaggcgagtacaacgaagagttctctctggctccagtagttaactacttaaatgacgcactagattgtgacgttaaactagcgaaagattacctagatggaattgaattaaacgctggtgagctagttgttcttgaaaacgttcgctttaacaaaggcgaaaagaagaacgatgaagcactttctaagaagtatgcagcattatgtgacatcttcgtgatggacgcatttggtacggctcaccgtgcacaagcatcgactcacggtgttggcatgaacgcagctatcgcgtgtgctggtcctctactcgctaacgagcttgaagcacttggtaaagcaatggacaaccctgctcgtccacttgttgcaatcgttggtggttctaaagtatcaactaagctgactgttcttgagtcgctatctaaaattgctgaccaactagttgttggtggtggtatcgcgaacacattcatcgcagctgaaggccacaatgttggtaaatcactgtacgaagcagatttagttgaaacagctaagaaactaatgaaagactgtgcgattcctgttgcaactgacgttgcatgtgcaaaagcattcgatgagaacgcagaagcggtaatcaagcacgtgtctgaagttcaagacgacgacatgatcttcgacctaggtccagattcaactgccgttcttgctgaaatcattagcaatgcaaagacgattctttggaatggccctgttggcgtatttgaattcaaaaactttgaagcgggtactgctggtattgctaaagcaattgcagattctgaaggtttctctgttgcaggcggcggtgacacattagcagctatcgataaattcggtatcaaggctgacgtttcttacatttctactggcggcggcgcgttccttgagttcgttgaaggtaaagtattacctgcagttgctatgctagaagagcgtgcaaaagcataa

SEQ ID NO: 10745 - protein, 392 aa, Photobacterium profundum
MRGRTMSVIKMTDLELAGKRVFIRADLNVPVKDGKVTSDARILASLPTIKRCLEAGAKVMVTSHLGRPTEGEYNEEFSLAPVVNYLNDALDCDVKLAKDYLDGIELNAGELVVLENVRFNKGEKKNDEALSKKYAALCDIFVMDAFGTAHRAQASTHGVGMNAAIACAGPLLANELEALGKAMDNPARPLVAIVGGSKVSTKLTVLESLSKIADQLVVGGGIANTFIAAEGHNVGKSLYEADLVETAKKLMKDCAIPVATDVACAKAFDENAEAVIKHVSEVQDDDMIFDLGPDSTAVLAEIISNAKTILWNGPVGVFEFKNFEAGTAGIAKAIADSEGFSVAGGGDTLAAIDKFGIKADVSYISTGGGAFLEFVEGKVLPAVAMLEERAKA

SEQ ID NO: 10746 - DNA, 1257 bp, Porphyromonas gingivalis
  CDS (1)..(1257)
atgacgatagaacaattcaatttcgccggcaagaaagccttcgtgcgcgtcgatttcaacgttcccctcgatgacaactttaagatcaccgacgacacccgcatccgcgcagccctccccactctccgcaagatcatagccgacggcggtatgaccatcatcggctctcatctgggacgccccaaaggcgtagcaccggagttctccctccggcatatcctgccgcacgtatccgaactgctcggcgtggatgtcctctttgccgatgactgcatcggagccgatgccatggacaaagcggccaagctcaaagccggccaagtgctgctgctcgaaaatctccgcttctatgccgaggaggaaggtaagccgcgcggactctccgacgatgcttcggacgaagaaaaagccgcagcgaagaaagccgtcaaggctgctcagaaagagtttacgcaaaagctggcttccatggccgactgctacgtgaacgatgctttcggcacagcgcatcgggcacatgcttccacagcactgatcgctgactacttcgaccgagaccacaaaatgttcggctatctgatggagaaagaagtaaaagccgtagaaagagtgctgcacgacatcaagcggccgttcaccgccatcatgggaggctccaaggtatcgaccaagatagaaatcatcgagaacctactcaacaaagtggataacctgatcctgaccggcggaatgacctatactttcaccaaagcggcaggcggtcggataggcctctccatcgtggaagacgacaagctggatttggctcgcgacatcgtgaagaaagcagccgaaaagggcgtcaatctgatactctccgtggatacgaaagtagccgacaggttcgacaacgatgcagccacccaagtatgcagcaatatggagatacccgacgactggatgggtatggacataggcccccggtcgatcgagaaattccgcaaagtaatactcgaatccaaaacgatcctttggaacggtcccacgggagtattcgaatttgacaacttctccataggctcgaaagccgtcggcgaagccatcgtggaagctacggccaatggagccttctcgctggtcggaggaggagacagcgttgcctgcgtgaacaaattcggtcttgccgataaggtatcctacgtctccacgggtggcggagccttgctcgaagccatcgagggcaaaaccctccccggcattgcagccatccaaggataa

SEQ ID NO: 10747 - protein, 418 aa, Porphyromonas gingivalis
MTIEQFNFAGKKAFVRVDFNVPLDDNFKITDDTRIRAALPTLRKIIADGGMTIIGSHLGRPKGVAPEFSLRHILPHVSELLGVDVLFADDCIGADAMDKAAKLKAGQVLLLENLRFYAEEEGKPRGLSDDASDEEKAAAKKAVKAAQKEFTQKLASMADCYVNDAFGTAHRAHASTALIADYFDRDHKMFGYLMEKEVKAVERVLHDIKRPFTAIMGGSKVSTKIEIIENLLNKVDNLILTGGMTYTFTKAAGGRIGLSIVEDDKLDLARDIVKKAAEKGVNLILSVDTKVADRFDNDAATQVCSNMEIPDDWMGMDIGPRSIEKFRKVILESKTILWNGPTGVFEFDNFSIGSKAVGEAIVEATANGAFSLVGGGDSVACVNKFGLADKVSYVSTGGGALLEAIEGKTLPGIAAIQG

SEQ ID NO: 10748 - DNA, 1209 bp, Prochlorococcus marinus
  CDS (1)..(1209)
atggcaaagcgttctctctcaaatctcagcgtagaggacctatgcggcaagagagttttggtcagggttgactttaatgtcccattgaacgaagaaggttcaataactgatgacacaaggattcgtgcggctttaccaactattcagcacttaattgaaaaagaggccagagtcattctttccgctcattttggtaggcccaaaggaaaggtcaatgaagatatgcgtctcactccagtttctcaaaggttgagtgaattattaggtaaaaccgttgtcaaaacagaaagttgtattggacctgatgcagaaaaaaaggtacatgaaatgtctaatggtgatgtagttcttcttgagaatgttcgctttatcggagaagaagaaaaaaatgattcagaatttgcaaagaaattagcctctttagctgaagtttatgtcaatgatgcttttggtgccgctcacagagctcatgcttcaactgaaggcgttacgaattacctaagcccaagcgttgctggttatttaatggagaaagagcttaagtatttgcaaggtgctattgattcccctcaacgtcctttggcagcaattgttggaggatctaaggtcagcagtaaaataggtgtattagaatctttgattgataaatgtgacaaggtcctaataggtggaggaatgatcttcactttttataaagctcgtggattatctgtaggcaaaagtttagttgaggatgacaagcttgatcttgctagagctcttgagaaaaaggcaaaagaaaaaggagtgcaattattattacccagtgatgttgtacttgccgacaatttctctccagatgcttctagtcagatggttcagattgattccattcctgaaggatggatgggcttagatatcggaaaggaatcagtgaaattatttcaagatgctttggctgattgtaagactgttatttggaatggacctatgggtgtttttgaatttgataaatttgcaaatggtacaaactctatctcaactacattggcagaattaagtgcaaaaggttgctgcacaattattggaggaggggattctgttgctgcagtagaaaaggcaggacttgcctctaaaatgtctcatatttcaactggtggtggagcaagtttagaattattggaaggcaaggtccttccaggtgttgctgctttggatgacgaaatttga

SEQ ID NO: 10749 - protein, 402 aa, Prochlorococcus marinus
MAKRSLSNLSVEDLCGKRVLVRVDFNVPLNEEGSITDDTRIRAALPTIQHLIEKEARVILSAHFGRPKGKVNEDMRLTPVSQRLSELLGKTVVKTESCIGPDAEKKVHEMSNGDVVLLENVRFIGEEEKNDSEFAKKLASLAEVYVNDAFGAAHRAHASTEGVTNYLSPSVAGYLMEKELKYLQGAIDSPQRPLAAIVGGSKVSSKIGVLESLIDKCDKVLIGGGMIFTFYKARGLSVGKSLVEDDKLDLARALEKKAKEKGVQLLLPSDVVLADNFSPDASSQMVQIDSIPEGWMGLDIGKESVKLFQDALADCKTVIWNGPMGVFEFDKFANGTNSISTTLAELSAKGCCTIIGGGDSVAAVEKAGLASKMSHISTGGGASLELLEGKVLPGVAALDDEI

SEQ ID NO: 10750 - DNA, 1206 bp, Prochlorococcus marinus
  CDS (1)..(1206)
atggcgaagcgttcactgtccaatctcagcgcagcggacctacgcagtaagcgtgtgctggttcgggttgatttcaacgtgcctctcaacgagaacggcgccattaccgatgacacccgcatccgcgccgccctgcccaccatcaatgacctgatcgacaaaggtgctcgggtgatcctctcagcccactttggccgaccaaagggtcaaatcaacgaaggaatgcggctcacaccagtagcaaaacgcctcagcgaactgctgggtaaaaacgtgacaaaaaccgaaagctgcgttggtagcgacgccgaagcaaaggttaatgccatggccgatggagatgtcgtactgctcgagaatgtgcgctttttctcagaagaagaaaaaaacgacgccaacttcgcccaaaagctcgcagcacttgctgacgcttatgtcaatgacgccttcggtgctgcacaccgcgcccacgcctctacagaaggggtcaccaaattcctcaaccccagtgtggcaggccacctgatggagaaggaactgcaatacctgcaaggtgccatcgacgacccgaagcgaccccttgcagcgatcgtgggtgggtccaaggtcagcagcaagatcggcgtgttggaagccttgatcgacaagtgcgacaaggtgctgatcggcggcggcatgatcttcacgttctacaaagcgcgtggcctttcagtcggcaagagcctggtggaagaagacaagttagagctggccaaggagctagaggccaaggcgaaggccaagggggttcaactgcttctgcccactgacgttgtgctagccgatgacttcgcccccgccgccaatagccagaccgtatccatcgacgccattcccgatggttggatgggactggacattggccccgactcaatcaatctcttccaagacgcactggctgactgccaaaccgtgatctggaacggccccatgggcgtgttcgagttcgataagtttgccgccggcaccaacgccatcgccacaaccttggcggacctcagtggcaagggttgctgcacaattattggtggtggtgactccgtagctgctgttgagaaggccggcctcgccgagaagatgtcccacatctccaccggtggtggcgccagccttgagctgctggaaggcaaggtgttgccaggtgtcgccgctctcgacgacgcctaa

SEQ ID NO: 10751 - protein, 401 aa, Prochlorococcus marinus
MAKRSLSNLSAADLRSKRVLVRVDFNVPLNENGAITDDTRIRAALPTINDLIDKGARVILSAHFGRPKGQINEGMRLTPVAKRLSELLGKNVTKTESCVGSDAEAKVNAMADGDVVLLENVRFFSEEEKNDANFAQKLAALADAYVNDAFGAAHRAHASTEGVTKFLNPSVAGHLMEKELQYLQGAIDDPKRPLAAIVGGSKVSSKIGVLEALIDKCDKVLIGGGMIFTFYKARGLSVGKSLVEEDKLELAKELEAKAKAKGVQLLLPTDVVLADDFAPAANSQTVSIDAIPDGWMGLDIGPDSINLFQDALADCQTVIWNGPMGVFEFDKFAAGTNAIATTLADLSGKGCCTIIGGGDSVAAVEKAGLAEKMSHISTGGGASLELLEGKVLPGVAALDDA

SEQ ID NO: 10752 - DNA, 1209 bp, Prochlorococcus marinus subsp
  CDS (1)..(1209)
atgtcgaagttgtctctttccagtcttgataagtctaaattagaaggaaaaaaagttcttgtaagggttgattttaatgtcccattaaatgacagtggtcaaattactgatgatactagaataagagcagcaattcctacgataaaatatcttataaataattcggcaaaagttatattagctgctcattttggaagacctaaagggaaagttaatgagaaaatgagattaaccccagttgctgccagattaagcgatatcttggaacaaaaagttaatctgactgaaagctgcattggtgaagaggctctagctaaatctaatagtttaaacaatggggaggttttattactagaaaatgttcgtttttatgaagaagaagaaaaaaatgatttagatttcgctaaaaatttagcttctcatgcagatatgtatgttaacgatgcttttggagctgcgcatagagctcatgcttcaactcaaggagttacaaaatttttagaacctgctgttgcaggatttttgttagaaaaagagttgaaatatttacagggcgcaattgatgctccaaaacgtcctcttgcagcaatagtaggaggttctaaagtaagtagcaaaattggagttttggattctcttttagataagtgtgacaaaattattattgggggcggtatgatttttactttttacaaggcaagaggattagatgttgggaagagtcttgttgaggaagataaactcgaactagcaagaaatttagaggcaaaagcaaaaaataaaggggtagagcttctattaccatctgatgtattacttgcaaatgagttttctcctgatgcagaaagtaaagtctctcaaatagatgcaataagtggtgattggatgggcctagacattgggccacaatcaatcaaggttttccaaaatgctcttgccgaatgtaaaacaataatttggaatggtccaatgggtgtttttgaatttgataaatttgctgaaggtacaaatgcaatagcaacaaccctggcagatttaagttctttctctgaggtttgtacaattattggagggggagattctgtcgctgcagtagaaaaagctggcttagctgaaaaaatgtcacatatatctactggtggaggggctagtttagaacttttagaaggcaaaactttacctggagtagcagctttaaaagacgcttaa

SEQ ID NO: 10753 - protein, 402 aa, Prochlorococcus marinus subsp
MSKLSLSSLDKSKLEGKKVLVRVDFNVPLNDSGQITDDTRIRAAIPTIKYLINNSAKVILAAHFGRPKGKVNEKMRLTPVAARLSDILEQKVNLTESCIGEEALAKSNSLNNGEVLLLENVRFYEEEEKNDLDFAKNLASHADMYVNDAFGAAHRAHASTQGVTKFLEPAVAGFLLEKELKYLQGAIDAPKRPLAAIVGGSKVSSKIGVLDSLLDKCDKIIIGGGMIFTFYKARGLDVGKSLVEEDKLELARNLEAKAKNKGVELLLPSDVLLANEFSPDAESKVSQIDAISGDWMGLDIGPQSIKVFQNALAECKTIIWNGPMGVFEFDKFAEGTNAIATTLADLSSFSEVCTIIGGGDSVAAVEKAGLAEKMSHISTGGGASLELLEGKTLPGVAALKDA

SEQ ID NO: 10754 - DNA, 1164 bp, Pseudomonas putida
  CDS (1)..(1164)
atgaccgtgttgaagatgaccgacctcgacctgcaaggtaagcgcgtactgatccgcgaagacctcaacgtgcctgtgaaggacggtgtggtagccagcgatgcgcgtatcctggcagcgctgccgaccatcaagctggccctggagaagggcgcagcggtaatggtctgctcgcacttgggccgcccgaccgaaggcgaattctctgccgagaacagcctcaagccggtcgccgattacctgagcaaggccctgggccgcgacgtgccgctggttgccgactacctggacggtgtcgcggtacaggccggtgaactggtgctgttcgagaacgtgcgcttcaacaagggcgagaaaaagaacgccgacgagctggcgcagaaatacgcagccctgtgcgacgtattcgtcatggacgctttcggcaccgcacaccgcgccgaaggctcgacccatggcgtcgccaagttcgccaaggtggccgctgccggcccactgctggcagccgaactggatgccttgggcaaggccctgaaagccccggccaagccaatggcggccatcgttgccggctccaaggtttccaccaagctggacgtgctgaacagcctcagcagtgtttgcgaccagctgatcgtcggtggcggtattgccaacactttcctggccgctgccggccacccggtgggcaagtcgctgtacgagcctgacctggtggacaccgccaaggccattgccgccaaggtcagcgtgccgctgccagtcgacgtggtggttgccaaggagtttgccgagagcgccgaagccaccgtcaaggccattgccgacgtagctgccgacgacatgatcctggacatcggcccgcaaaccgcggccaatttcgccgagctgctgaaatcgtcgaaaaccattctttggaatggcccggttggcgtgttcgaattcgatcagttcggcaacggcaccaaggtactggccaaggccatcgccgacagcgccgcgttctccatcgccggtggcggtgacaccctggcagccatcgacaaatatggcgtcagcaaggaaatctcctacatttctaccggtggtggcgccttcctcgagttcgtcgagggcaaggtcctgccagctgtggcaattctggaagagcgggccaaggcctga

SEQ ID NO: 10755 - protein, 387 aa, Pseudomonas putida
MTVLKMTDLDLQGKRVLIREDLNVPVKDGVVASDARILAALPTIKLALEKGAAVMVCSHLGRPTEGEFSAENSLKPVADYLSKALGRDVPLVADYLDGVAVQAGELVLFENVRFNKGEKKNADELAQKYAALCDVFVMDAFGTAHRAEGSTHGVAKFAKVAAAGPLLAAELDALGKALKAPAKPMAAIVAGSKVSTKLDVLNSLSSVCDQLIVGGGIANTFLAAAGHPVGKSLYEPDLVDTAKAIAAKVSVPLPVDVVVAKEFAESAEATVKAIADVAADDMILDIGPQTAANFAELLKSSKTILWNGPVGVFEFDQFGNGTKVLAKAIADSAAFSIAGGGDTLAAIDKYGVSKEISYISTGGGAFLEFVEGKVLPAVAILEERAKA

SEQ ID NO: 10756 - DNA, 1164 bp, Pseudomonas syringae
  CDS (1)..(1164)
atgaccgtcttgaagatgaccgacctcgatctgcaaggtaaacgtgtactgatccgcgaagacctcaacgtcccgataaaggacggcgttgtcagcagcgatgcacgtattcttgcttcgctgccgaccatcaggctggcgctggaaaaaggcgcggctgtcatggtctgctcgcaccttggccgtccgaccgagggcgagttttctgctgaaaacagcctcaagccggttgctgaatacctgagcaaggcattgggtcgtgacgttccgctggtcgccgattacctggacggcgttgacgtcaaggcgggcgatatcgtgctgttcgagaacgttcgcttcaacaagggcgagaaaaagaacgccgacgagctggcgcagaagtacgcggccctgtgcgacgtgttcgtgatggacgcttttggcaccgctcaccgcgctgaaggctcgacccacggcgtggccaaatacgccaaggttgccgctgctggcccgttgctggctgccgaactggaagcgctgggcaaggcgctgggcgctccggctcagccaatggctgctattgttgccggctccaaagtgtccaccaagctggacgtgctcaacagcctgagcgcgatctgcgatcagttgattgttggcggcgggattgccaacacctttctggctgcagccggtcacaaggtcggtaaatcgctttacgagccagacctgctcgacaccgcgcgcgccattgccgccaaggtcagcgtgccgttgccgactgacgtggtggttgccaaggaattcgccgagagtgccactgcaaccgtcaagctgatcgccgatgtggccgacgacgacatgattctggatattggtccacagactgctgcgcacttcgccgaactgttgaaatcttccgggactatcctgtggaacggtccggttggcgtgttcgaattcgaccagttcggtgaaggcaccaaaacgctggccaaggccattgctgaaagcaaagcgttctccatcgcgggtggtggcgacaccctggccgcgatcgacaagtacggtgtggcagatcagatttcctatatttcgaccggtggcggtgcgttcctcgaattcgtggaaggcaaggttctgccagcggttgaaatgctcgaacaacgtgccagggcctga

SEQ ID NO: 10757 - protein, 387 aa, Pseudomonas syringae
MTVLKMTDLDLQGKRVLIREDLNVPIKDGVVSSDARILASLPTIRLALEKGAAVMVCSHLGRPTEGEFSAENSLKPVAEYLSKALGRDVPLVADYLDGVDVKAGDIVLFENVRFNKGEKKNADELAQKYAALCDVFVMDAFGTAHRAEGSTHGVAKYAKVAAAGPLLAAELEALGKALGAPAQPMAAIVAGSKVSTKLDVLNSLSAICDQLIVGGGIANTFLAAAGHKVGKSLYEPDLLDTARAIAAKVSVPLPTDVVVAKEFAESATATVKLIADVADDDMILDIGPQTAAHFAELLKSSGTILWNGPVGVFEFDQFGEGTKTLAKAIAESKAFSIAGGGDTLAAIDKYGVADQISYISTGGGAFLEFVEGKVLPAVEMLEQRARA

SEQ ID NO: 10758 - DNA, 1227 bp, Pyrobaculum aerophilum
  CDS (1)..(1227)
atgttacttaatgaaattattgacttaataccaaatataaataagtgcctaaaaaagggaaaaacgttaattataagaattgatataaattcgcccattgtaaatggtaaaataattgatgattttagaataagggctcactcgtacaccttgcgcctggcttctgacgcgggggccagggctgtggtgttggcccatcaagggagacctggacaagacgattttacctcacttgagatccataagccgtatatagaaaaatacctagagaggcctataaaatttgtagacgatataataggcccggaggcgaggcgccagataaaagagttgaaagacggcgaaatactgttgctggaaaacgtgaggattctctccgaggaggtaatagaaaaggtgccggaggctcaggcagaaactcttctagtccgcaaactagcccctctagccgactactacgtattcgacggtttcgcggtggctcacagatcgcagccaagcgtagtgggctttccaattgttttgccctcttgcgccggccccgtctttgagagggagctaagggcgttgggagcggtgtttgaaaaacgcggcagaggcgtgacgttaatagcgggaggcgccaaaatgccggacactcttaaggcagtagagcagttgttaaaaaacggctttgtggaaaaagtggccgttggaggcctcgtgggctttgtgtttgccttgggcaaatatggcgtgttaaacagcgcgttaaaacaagaggtagagaagggcggcttcctcccatatatagagagagcccgccaattattggctaaatacggcgcgcagatatacacgcctgtggacttcgcagttaatcaaaacgggaggctagacgttgatatatattcactggcgcaacctccgctagatattgggagatctacgacaattgcgtttaaagaagtgattgaacagagcgagattgtaattttcagcgggcccatgggctatatcgaggacgagagattcgcgacaggaacaatagaactgttaaaagcggcgtcaaacagacggttaatactaggcggggggcacacgattatggccgcggagaaggccggcgtgcttgataaagcataccacgtgtcgactggcgggcgcgcttttattcagacaataggcggcgaggaaatgccggcagtgaaagcgttattaacctctgctaaaaaatttagcctatga

SEQ ID NO: 10759 - protein, 408 aa, Pyrobaculum aerophilum
MLLNEIIDLIPNINKCLKKGKTLIIRIDINSPIVNGKIIDDFRIRAHSYTLRLASDAGARAVVLAHQGRPGQDDFTSLEIHKPYIEKYLERPIKFVDDIIGPEARRQIKELKDGEILLLENVRILSEEVIEKVPEAQAETLLVRKLAPLADYYVFDGFAVAHRSQPSVVGFPIVLPSCAGPVFERELRALGAVFEKRGRGVTLIAGGAKMPDTLKAVEQLLKNGFVEKVAVGGLVGFVFALGKYGVLNSALKQEVEKGGFLPYIERARQLLAKYGAQIYTPVDFAVNQNGRLDVDIYSLAQPPLDIGRSTTIAFKEVIEQSEIVIFSGPMGYIEDERFATGTIELLKAASNRRLILGGGHTIMAAEKAGVLDKAYHVSTGGRAFIQTIGGEEMPAVKALLTSAKKFSL

SEQ ID NO: 10760 - DNA, 1260 bp, Ralstonia solanacearum
  CDS (1)..(1260)
atggcatcgggtaaaatcgccgctttccgtgatttctccgctgctgccatgcccaacgtcctgcgtctgaccgatctcatctccgaaggcaagcttgccggcaagcgtgtcttcatccgcgccgatctcaacgtgccgcaagacgatgccggcaacatcaccgaagacacgcgcatccgcgcttcggtgccggccatccgcgccgcgctcgacgccggtgccgccgtgatggtcacctcgcatctgggccgtccgaccgaaggcgagttcaagccggaagattcgctggccccggtggccgtgcgcctgtccgagttgctcggctgtgaggtgaagctggtgcagaactgggtcgacggcgtggatgtcgcgcccggccaggtggtgctgctggaaaactgccgcgtcaacaagggcgagaagaagaacagcgacgaactggcccagaagatggccaagctgtgcgacgtctacgtcaacgacgccttcggcaccgcccaccgcgccgaggccaccacgcacggcatcgccaagtttgcccccatcgcctgcgccggcccgctgctgggcgccgagctggacgcgctgggcaaggcgctgggccaaccggcccgtccgctggtcgccatcgtggccggctccaaggtgtcgaccaagctgaccatcctgaaatcgctggccgacaaggtggacaacctgatcgtcggcggcggcatcgccaacacgttcatgctggccgcgggcctgaagatcggcaagtcgctggccgaggcggatctggtgggcgatgccaaggcgatcatcgacctgatggctgcccgtggcgcctcggtgcccattcctgtcgatgtggtctgcgccaaggaattcagcgccaccgctgccgccaccgtcaaggacgtgaaggacgtggcggatgacgacatgattctcgacatcggcccgaagaccgccgcgcaactggccgaccagctcaaggcctccggcaccatcgtgtggaacggcccggtcggcgtgttcgagttcgaccagttcggcaacggcaccaaggtgctggccgaggcgatcgcggcctcgtcgggcttctcgatcgccggtggcggcgatacgctggcggcgatcgccaagtacggcatcgccgaccgcgtgggctacatctccaccggcggcggcgcattcctggaattcctggaaggcaagacgctgccggccgtggagatcctggagcagcgtgcccagcgccaggaagcgctggcctga

SEQ ID NO: 10761 - protein, 419 aa, Ralstonia solanacearum
MASGKIAAFRDFSAAAMPNVLRLTDLISEGKLAGKRVFIRADLNVPQDDAGNITEDTRIRASVPAIRAALDAGAAVMVTSHLGRPTEGEFKPEDSLAPVAVRLSELLGCEVKLVQNWVDGVDVAPGQVVLLENCRVNKGEKKNSDELAQKMAKLCDVYVNDAFGTAHRAEATTHGIAKFAPIACAGPLLGAELDALGKALGQPARPLVAIVAGSKVSTKLTILKSLADKVDNLIVGGGIANTFMLAAGLKIGKSLAEADLVGDAKAIIDLMAARGASVPIPVDVVCAKEFSATAAATVKDVKDVADDDMILDIGPKTAAQLADQLKASGTIVWNGPVGVFEFDQFGNGTKVLAEAIAASSGFSIAGGGDTLAAIAKYGIADRVGYISTGGGAFLEFLEGKTLPAVEILEQRAQRQEALA

SEQ ID NO: 10762 - DNA, 1197 bp, Rhizobium loti
  CDS (1)..(1197)
atggccgccttcaagacactggacgatatcggcaacatcagcggcaagcgcgtgctggtgcgcgtcgacctcaacgttcccgtcgccgacggcaaggtcaccgacgccacccgcatcgaacgcatcgcgccgaccatcgccgaactgtcgggcaagggcgccaaggtcatcctgctcgcccatttcggccggcccaaggatgggccatccccggaattctcgctggagccgatcgccagggcgacggccgaggtgctcggccgtcccgtcggctttgcctcggattgcgtcggcgacatggcgggaagtgctgtcgcggccatgaacaagggtgacgtgctgctcttcgaaaatacccgtttctacaaggccgaggagaagaacgacccggccttcagcgagcggctcgccgccaatggcgacattttcgtcaacgacgccttttccgcggcgcaccgcgcccactcttccacagaggggctggcgcgtctgttgccttcctttgctggccgcaccatgcaggccgagctcgaagcgctggagaagggcctgggcaacccggtccgcccggtcgtggcgatcgtcggcggcgccaaggtctcgaccaagatcgacctgctgatgaacctggtgaagaaggtcgacgcgctggtcatcggcggcggcatggccaacaccttccttgccgcgcgcggcaccgatgtcggcaagtcgctgtgcgagcatgatcttgcccccaccgccaagcagatcatgatcgaggccgccgaggccggctgcgccatcatcctgccggtcgacggtgtcgtcgccaaggaattcaaggcgggcgccgcctgcgagaccgtcgccatctccgacgtgccggccgatggcatgatcctggatgtcggcgaaaagaccgtgaagacgatcggcgaatggatcgaccgcgccgcgacactggtctggaacggcccgcttggcgccttcgagatcgagccgttcgatcacgccacggtggcggcggcaaaacacgcggccgcgcgcaccaaggccggcaagctggtctccgttgcgggtggcggcgacacggtggcggcgctcaaccacgccggcgtcgccgacgacttcacctatgtctctaccgccggcggcgccttcctggaatggatggaaggcaagcctctgccaggcgtcgacgtgctgaagcgctga

SEQ ID NO: 10763 - protein, 398 aa, Rhizobium loti
MAAFKTLDDIGNISGKRVLVRVDLNVPVADGKVTDATRIERIAPTIAELSGKGAKVILLAHFGRPKDGPSPEFSLEPIARATAEVLGRPVGFASDCVGDMAGSAVAAMNKGDVLLFENTRFYKAEEKNDPAFSERLAANGDIFVNDAFSAAHRAHSSTEGLARLLPSFAGRTMQAELEALEKGLGNPVRPVVAIVGGAKVSTKIDLLMNLVKKVDALVIGGGMANTFLAARGTDVGKSLCEHDLAPTAKQIMIEAAEAGCAIILPVDGVVAKEFKAGAACETVAISDVPADGMILDVGEKTVKTIGEWIDRAATLVWNGPLGAFEIEPFDHATVAAAKHAAARTKAGKLVSVAGGGDTVAALNHAGVADDFTYVSTAGGAFLEWMEGKPLPGVDVLKR

SEQ ID NO: 10764 - DNA, 1200 bp, Rhizobium meliloti
  CDS (1)..(1200)
atgactttcaagactctcgacgatctgaccgacatcgccggcaagcgcgttctcgtgcgcgtcgatctgaacgtgcctgtcaaggacggccaggtgaccgacaccacccgcatcgagcgcgtggcgccgaccattcgcgaactctccgagaagggcgcgaaagtcgttctgctcgcgcatttcggccggccgaagggcgagcccgtcgccgacatgtcgctgaaggcgatcgcctccgccgtcgaggagatcctcgaccagcgcgtctatttcgctgccgactgcatcggcgacaaggccgccaacgccattgccgaattgaacgacggcgaagtgctgctgctcgagaatacccgcttccacaagggcgaggagaagaacgattcggacttcgtgacggcgctcgccgccaatggcgacatctatgtcaacgacgccttctccgccgcccatcgcgcccacgcctcgaccgaggggcttgcccatcaccttcccgcctatgccggccgcaccatgcaggcggagctcgaagcgcttgaaaaggggctcggcaatccgaagcgcccggtcgtcgcgatcgtcggcggcgccaaggtctcgaccaagatcgaccttctgcagaacctcgtgaagaaggtcgacgcgctggtcatcggcggcggcatggccaacaccttcctcgcggcgcaaggcgtcgatgtcggaaagtcgctctgcgagcacgatcttgcggagaccgccaaggccatcctcgcggccgcctcggaagcgggatgcgcaatcgtgcttccggtcgacggcgtcgttgcccgtgagttcaaggccggtgccgacaacgaggtcgtcgatatcaaggccatccctgccgacgccatggtgcttgacgtcgggccgaaatcgatcgaggccatcaacgaatggatctcgcgcgccgaaaccctcgtgtggaatggcccgctcggcgcgttcgagatcgcgcccttcgacagggcgaccgtggcggcggcgaaacacgcggcagcccgcacccgcgccggctcgctcgtctccgtcgccggcggcggcgacacggtcgcagcactcaaccatgccgaggtcgcggacgatttcacctatgtctcgaccgccggcggcgccttcctcgaatggatggaaggcaagcccttgccgggcgtagatgttctccggcagcggaactga

SEQ ID NO: 10765 - protein, 399 aa, Rhizobium meliloti
MTFKTLDDLTDIAGKRVLVRVDLNVPVKDGQVTDTTRIERVAPTIRELSEKGAKVVLLAHFGRPKGEPVADMSLKAIASAVEEILDQRVYFAADCIGDKAANAIAELNDGEVLLLENTRFHKGEEKNDSDFVTALAANGDIYVNDAFSAAHRAHASTEGLAHHLPAYAGRTMQAELEALEKGLGNPKRPVVAIVGGAKVSTKIDLLQNLVKKVDALVIGGGMANTFLAAQGVDVGKSLCEHDLAETAKAILAAASEAGCAIVLPVDGVVAREFKAGADNEVVDIKAIPADAMVLDVGPKSIEAINEWISRAETLVWNGPLGAFEIAPFDRATVAAAKHAAARTRAGSLVSVAGGGDTVAALNHAEVADDFTYVSTAGGAFLEWMEGKPLPGVDVLRQRN

SEQ ID NO: 10766 - DNA, 1194 bp, Rhodopirellula baltica
  CDS (1)..(1194)
atggccaagaaaaccattgatcaaatcgacgttcaagacaaaaccgttctcatgcgagtcgacttcaacgtgccgttggacgaatcgctcgccatcaccgatgaccgccgtattcgcatggcgttgcccagcatcaagagcgtcatcgaccgcggtggcaaagtgatcctgatgagccacctgggacgaccgactggtggtgaaggcgacgagaagtattccttggctccggccgcgaaacgtttgggtgaattgctcggcagcaccgttcacttcgcgaccgacactgtcggagacgacgcatcgagcaaagcaagctcgttggccgctggcgaagttttggtgctggaaaacttgcgtttcaatccaggcgagaagaaaggcgactcagagttcgctggcaagttggccgcgatggccgacgcctactgcaacgacgcattcggcacctgtcaccgcaaagacgcatcgatggtcgccgtccccgaagcgatggctggcaagcctcgcgtggttgggcatttggtcgccaaagaaatccagtacctcaccgatgcgatcagcaaacccgagcgacctttcgttgcgatcctgggtggagccaaggtcagcgacaagatcaacgtgatcaacaacttgctcggcatctgtgatgcggtcttgatcggtggtgcgatggcttacacgttttcgttagccagtggcggtaaagtcggcaagtcattggtcgagaaagacaaggtcgagttggcaaaggagttgatggcaaagggtggcgacaagctacagcttcccgtcgacacgcactgcggtgacgacttcggaaacatcgctggttgcaacaaaaaggttgttgctgcaggtgaaattcctgacgacatggaaggtttggacatcggtcctgaaacggcgaagaagtacgcagaggtcatcaagtcggccaagaccatcgtctggaacggaccgatgggcgtgtttgaaaaaccaccaatggatgaaggcaccaaagccgtcgctcaagcaatcgccgatggcgatgccgtcagcatcatcggtggtggtgacagcgctgctgctgttgatcaactcgggttcgccgacgatgtcagccacgtcagcaccggtggcggagccagcttggcaatgttggaaggccaagccttcgcagccgtcgatttgctcgacgaagcttga

SEQ ID NO: 10767 - protein, 397 aa, Rhodopirellula baltica
MAKKTIDQIDVQDKTVLMRVDFNVPLDESLAITDDRRIRMALPSIKSVIDRGGKVILMSHLGRPTGGEGDEKYSLAPAAKRLGELLGSTVHFATDTVGDDASSKASSLAAGEVLVLENLRFNPGEKKGDSEFAGKLAAMADAYCNDAFGTCHRKDASMVAVPEAMAGKPRVVGHLVAKEIQYLTDAISKPERPFVAILGGAKVSDKINVINNLLGICDAVLIGGAMAYTFSLASGGKVGKSLVEKDKVELAKELMAKGGDKLQLPVDTHCGDDFGNIAGCNKKVVAAGEIPDDMEGLDIGPETAKKYAEVIKSAKTIVWNGPMGVFEKPPMDEGTKAVAQAIADGDAVSIIGGGDSAAAVDQLGFADDVSHVSTGGGASLAMLEGQAFAAVDLLDEA

SEQ ID NO: 10768 - DNA, 1197 bp, Rhodopseudomonas palustris
  CDS (1)..(1197)
atgacaaagacattccgcaccctcgacgacgtcgatgtgaagggcaagcgcgtgctgctgcgcgtcgatctcaacgtgccgatggacgccggcaaggtgaccgacaccacccggctcgaacgcgtgatgccgaccatcaccgagctgtcgggcaagggcgccaaggtgatcctgctggcgcatttcggccggccgaagggccgcgacgacaagaactcgctcaagccggtcgctgctgcgctggccgacgtcatcaagaagccggtcggcttcgccgacgactgcatcggcgagcccgccgccaaggcgatcgccgcgatggccgacggcgacatcctgtgcctggaaaacacccgcttccatcccgaggaagagaagaacgatccggcgttcgtcgccaagctcgccgagctcggcgacatctgggtcaacgacgcgttctcggccgcgcaccgcgcccacgccaccaccgaaggcctcggccacaagctgccggcttacgcgggccgcaccatgcaggccgagctcgtcgcgctgaacaaggcgctggaagcgccggtgaagccggtgatcgcgatcgtcggcggcgccaaggtgtcgaccaagatcgacctgctcgaaaacctggtcaccaaggtgcaggcgctggtgatcggcggcggcatggccaacaccttcctgcacgcccagggcgtcaaggtcggaaagtctctgtgcgagaaggacctggctccgactgcgctgcgcatcctcgataaggccgaagctgccaactgcgccatcatcctgccggtcgacgccaccgtggcctatcacttcgaggccaacgcgccgtcgttcgcctacgggctcgacgccatcccggacgatgccatgatcctcgacgtcggcccgcgctcgatcgagcgcattcacgccgcgatcgacgatgccgcgaccctggtgtggaacggcccggtcggcgcgttcgagctgacgccgttcgacaagggcacggtcgaagccgccaagcacgccgccaagcgcaccaaggccggcaagctggtgtcggtcgccggcggcggcgacaccgtcgcggcgctcaaccatgccggcgtggccgacgacttcacctacatctcgaccgccggcggcgccttcctggaatggatggaaggcaagccgctgccgggcgtcgaagtgctccaggtcaagtga

SEQ ID NO: 10769 - protein, 398 aa, Rhodopseudomonas palustris
MTKTFRTLDDVDVKGKRVLLRVDLNVPMDAGKVTDTTRLERVMPTITELSGKGAKVILLAHFGRPKGRDDKNSLKPVAAALADVIKKPVGFADDCIGEPAAKAIAAMADGDILCLENTRFHPEEEKNDPAFVAKLAELGDIWVNDAFSAAHRAHATTEGLGHKLPAYAGRTMQAELVALNKALEAPVKPVIAIVGGAKVSTKIDLLENLVTKVQALVIGGGMANTFLHAQGVKVGKSLCEKDLAPTALRILDKAEAANCAIILPVDATVAYHFEANAPSFAYGLDAIPDDAMILDVGPRSIERIHAAIDDAATLVWNGPVGAFELTPFDKGTVEAAKHAAKRTKAGKLVSVAGGGDTVAALNHAGVADDFTYISTAGGAFLEWMEGKPLPGVEVLQVK

SEQ ID NO: 10770 - DNA, 1462 bp, Schistosoma mansoni
  CDS (4)..(1254)
gtgatgggtttgtcgaagcttagtatttcagatgttgaccttaaaggaaaacgtgttcttattcgagttgattttaacgtccctatgaaagatgggaaagtcactaacactcaaagaatagcagctgccataccaactattaaatatgctttggataagggggccaaaagtgtcgtcttaatgtcccatttaggtcggccagatgggcacaaagttgataagtattctctaaagcctgtgtgccctgaagtgtcaaagttgttaggcaaagaagttacgttcctcaatgattgtgttgggcctgacgtagttaacgcatgtgccaatcctgctcccggaagcgtttttttgctagagaatctacgctttcacgttgaagaggaaggaaaaggtgtctcaccaaccggcgaaaaaacaaaagccactgctgaccaaatcaaggctttcagtgagagtctaacaaaacttggtgatgtctacgtcaacgatgcctttgggacggcacatagagctcatgcttctatggtcggctgccaactaccacaaaaagcctgtggatttctcatgaataaagaattgacatacttcgccaaagctctggaaaatccagaacgccctttcttagctattttaggaggtgccaaggttagcgacaagatccagttgatcaataatatgcttgacaaagttaatgaattaatcatcggtggtgggatggcgtatacatttcttaagcaaatacacaatatgcatataggaaatagtttatttgatgcaccgggtgcagaaattgttcataaagtaatggaaactgcaaaggctaaaaatgttgcaattcacttaccggttgatttcgtaactgccgataaatttgctgatgatgcgaacaccgaaataagaactatacaatccggaattgccgatggttggatgggattagatattggtccaaaaacaattgaagaattcagtaaagtgattagtcgtgccaaaactattgtttggaacggtccgatgggtgtttttgaaatggacaaatttgcaacaggaacaaaagcagcaatggatgaagtagtcaaagctactaaaaatggtgctacaactattattggtggtggtgacaccgcaacatgctgcgccaaatgggacacagaagacaaagttagtcatgtcagtactggtggtggtgctagtcttgaacttctcgaaggtaaacaattacccggagttgttgcacttacggatgctcattaatacgttcggttataatatcccttaacttcataattaattataattagtgttcttaactttgaattgtcacaattgttcccagttttatggttactttttactgttatatatctgttcttgatttgacggatatattttctctttaatttctgtacgtgtagatgtatttctgccatatgcgcatttgctgccaatagaaatttcctgt

SEQ ID NO: 10771 - protein, 416 aa, Schistosoma mansoni
MGLSKLSISDVDLKGKRVLIRVDFNVPMKDGKVTNTQRIAAAIPTIKYALDKGAKSVVLMSHLGRPDGHKVDKYSLKPVCPEVSKLLGKEVTFLNDCVGPDVVNACANPAPGSVFLLENLRFHVEEEGKGVSPTGEKTKATADQIKAFSESLTKLGDVYVNDAFGTAHRAHASMVGCQLPQKACGFLMNKELTYFAKALENPERPFLAILGGAKVSDKIQLINNMLDKVNELIIGGGMAYTFLKQIHNMHIGNSLFDAPGAEIVHKVMETAKAKNVAIHLPVDFVTADKFADDANTEIRTIQSGIADGWMGLDIGPKTIEEFSKVISRAKTIVWNGPMGVFEMDKFATGTKAAMDEVVKATKNGATTIIGGGDTATCCAKWDTEDKVSHVSTGGGASLELLEGKQLPGVVALTDAH

SEQ ID NO: 10772 - DNA, 1176 bp, Shewanella oneidensis
  CDS (1)..(1176)
atggcaattatcaatatgtcagatttagatctccaaggtaagcgagtgcttattcgtgaagatctcaatgtgcctgtcagcaatggcgtcgtcaccagtgatgcgcgccttagagcctctctccccactatcgagttagcccttgccaaaggcgcggcggtaatggtgatgtctcacttgggtcgtccaaccgaaggtgagtacaacagcgaattttccatgcaacctgtggtcgattacttggccaaagccctgtcttgtcctgtgcgcttagcgaccgactacttagacggcgttgaagtggctgtaggtgaagtggtggtgtttgaaaacgttcgcttcaataaaggcgagaagaaaaacgacgaagcgttatctaagaagatggcagcgttatgtgatgtgtatgtgatggatgctttcggcacggctcaccgcgcagaagcctcaacgaatggcgttggtttatacgcgccaattgcttgtgctggtccattactggcgcaagagttagatgctttaggtaaggcgttagataatccagcgcgtccattagtggcaatcgttggtggctctaaagtgtcgactaagctcaccgtattagaaagcttatcaggcattgtggatcaattagtggttggtggtggtatcgctaacacctttatcgctgcggcgggccacaacgtgggtaaatccttatacgaagcggatttaattgatgaagctaagcgcttagtggcgaacgcgcaaagccgcggtggcgatattcccgtacctaccgatgtggttgtggcgggtgagtttagcccaacggcagctgctaccttaaaagcagtgagtgatgttggcgatagcgatatgattttcgacatcggccccgacagtgccgaagcgttagcgaaaatcattgagtctgctggcactatcgtatggaacggcccagttggtgtgttcgagtttgaccaattcggtgaaggcactaagcgcatcgctcacgcgattgcggattccaaagccttctctatcgctggcggtggtgacaccttggcggcggtcgataaatacggtatcgccgataaagtttcttatatctctacgggcggtggcgctttcctcgagttcctcgaaggtaaagagttacctgctgtagctatgctaaaaaaacgtggtgcttaa

SEQ ID NO: 10773 - protein, 391 aa, Shewanella oneidensis
MAIINMSDLDLQGKRVLIREDLNVPVSNGVVTSDARLRASLPTIELALAKGAAVMVMSHLGRPTEGEYNSEFSMQPVVDYLAKALSCPVRLATDYLDGVEVAVGEVVVFENVRFNKGEKKNDEALSKKMAALCDVYVMDAFGTAHRAEASTNGVGLYAPIACAGPLLAQELDALGKALDNPARPLVAIVGGSKVSTKLTVLESLSGIVDQLVVGGGIANTFIAAAGHNVGKSLYEADLIDEAKRLVANAQSRGGDIPVPTDVVVAGEFSPTAAATLKAVSDVGDSDMIFDIGPDSAEALAKIIESAGTIVWNGPVGVFEFDQFGEGTKRIAHAIADSKAFSIAGGGDTLAAVDKYGIADKVSYISTGGGAFLEFLEGKELPAVAMLKKRGA

SEQ ID NO: 10774 - DNA, 1239 bp, Spiroplasma citri
  CDS (1)..(1239): transl_table=4
atgacaaacaaaaaagaattaaaagatgttcaagttaaaggaaaaaaagttttagtccgtgttgattttaatgtgccaatgaaggatggtcaagttactgatgataatcgtattattgcagctttaccaacaattaaatatttgatagcacaagaagcaaaagtaattttattttctcatttagggaaagttaaaacagctgatgatttagaaaaacgtgatatggctccagtagcaaaggtattagaacaaaaattaggacaaccagttaaatttattaatgcctttgaaggaaaacaattggaagaagctattaacgaaatgcacaataaagaggtcattttatttcaaaatacacgctttgctgacattattaatagtaatggtcaaattagtgttgatagtgagggcaaagcagcggcaaaacgagaaagtaaaaatgattctgctttagggaaatattgagcaagtttaggagatgtttttgttaatgatgcatttggaactgcacatcgtgctcatgcttcaaatgttggtattgcagaaaatattactgaatcatgtttaggctttttagtggaaaaagaagtaaaaatgttatcacaatgcgtagacaatccagttaaaccatttgttgctattattggtggtgcaaaagtttcagataaaattggggtaattgaacatttattaacaaaagcagataagattctaattggtggtggaatggcatatactttttttgctgcacaaggtcacaaaattggaaactcattattagaagttgataaagttgaaattgctaaaacctttttagcaaaaggacaagggaaaattattttaccaattgatgcgttagaagcaccagaatttgctgatgttccagcaaaagttacaacaggttttgatattgatgatggttatatgggattagatattggtcccaaaacaattgaattgtttaaaaaagaattagcagatgcaaaaacagttacttgaaatgggccaatgggagtttttgaatttaaaaattatagtattggaacaaaagctgtttgtgaagcaattgctgaactaaaaggagcctttactttaattggaggaggagattcagcggcagcagcaattcaattagggtataaagataagtttacgcatatatcaactggtggtggtgctagcttagaatatatggaaggtaaaccgctacctggaattgaagctgttcaaagtaaataa

SEQ ID NO: 10775 - protein, 412 aa, Spiroplasma citri
MTNKKELKDVQVKGKKVLVRVDFNVPMKDGQVTDDNRIIAALPTIKYLIAQEAKVILFSHLGKVKTADDLEKRDMAPVAKVLEQKLGQPVKFINAFEGKQLEEAINEMHNKEVILFQNTRFADIINSNGQISVDSEGKAAAKRESKNDSALGKYWASLGDVFVNDAFGTAHRAHASNVGIAENITESCLGFLVEKEVKMLSQCVDNPVKPFVAIIGGAKVSDKIGVIEHLLTKADKILIGGGMAYTFFAAQGHKIGNSLLEVDKVEIAKTFLAKGQGKIILPIDALEAPEFADVPAKVTTGFDIDDGYMGLDIGPKTIELFKKELADAKTVTWNGPMGVFEFKNYSIGTKAVCEAIAELKGAFTLIGGGDSAAAAIQLGYKDKFTHISTGGGASLEYMEGKPLPGIEAVQSK

SEQ ID NO: 10776 - DNA, 1191 bp, Staphylococcus epidermidis
  CDS (1)..(1191)
atggctaaaaaaatcgtttcagacttagatttaaaaggtaaagttgttcttgagcgcgctgattttaacgttccaattaaagatggtgaaatcactaatgacaacagaattgttcaagcattaccaacaatcgaatatattattgaacaaggtggtaaattagttttattctctcacttaggtaaagttaaagaagagagtgataaagaaggactttcacttaagcctgttgctgaaaacttatctaagaaattaggtaaagaagttatattcgttcctgaaacacgtggcgaaaaactcgaaacagcaattgaaaacttaaatgaaggcgatgttttattagttgaaaatacacgtttcgaagatttagatggtaaaaaagaatctaaaaatgatcctgaattaggtaaatattgggcgtcattaggtgatgtatttgttaatgatgcatttggtacagcgcaccgtgaacatgcgtcaaacgtaggtatttctactcatctagaaacagcagctggttacttaatggaaaaagaaattaaatttattggtggcgtagtgaatgatccacaaaaaccagtagttgctattttaggtggcgctaaagtttcagataaaattaatgttatcaaaaatttagttaatatcgcagataaaatcttaatcggtggcggtatggcttatacatttattaaagcgcaaggtaaggaaataggtctttcattattggaagaagacaaaattgattttgctaaagacttgttagagaataatggcgatcaaatagtattacctgtagattgtaaaatcgctaaagaattttctaatgatgcaaaaatcactgaagtatctatcaatgaaatcccttcagatcaagaagcaatggatattggacctaaaacagtagaattatttaataaagaattacaaggtgcacatactgtagtatggaatggacctatgggtgtattcgaatttagtaattttgctaaaggtacaatcggtgtatgtgagtctattgctaaattggaagacgctactactattattggtggtggtgactctgccgcagcagcaatttcattaggtttcgaagatgactttacacacatctctactggtggaggagcatcattagaatacttagaaggtaaagaattacctggtataaaagctattaatgataaataa

SEQ ID NO: 10777 - protein, 396 aa, Staphylococcus epidermidis
MAKKIVSDLDLKGKVVLERADFNVPIKDGEITNDNRIVQALPTIEYIIEQGGKLVLFSHLGKVKEESDKEGLSLKPVAENLSKKLGKEVIFVPETRGEKLETAIENLNEGDVLLVENTRFEDLDGKKESKNDPELGKYWASLGDVFVNDAFGTAHREHASNVGISTHLETAAGYLMEKEIKFIGGVVNDPQKPVVAILGGAKVSDKINVIKNLVNIADKILIGGGMAYTFIKAQGKEIGLSLLEEDKIDFAKDLLENNGDQIVLPVDCKIAKEFSNDAKITEVSINEIPSDQEAMDIGPKTVELFNKELQGAHTVVWNGPMGVFEFSNFAKGTIGVCESIAKLEDATTIIGGGDSAAAAISLGFEDDFTHISTGGGASLEYLEGKELPGIKAINDK

SEQ ID NO: 10778 - DNA, 1212 bp, Streptomyces avermitilis
  CDS (1)..(1212)
atgaagacgatcgacgaacttctcgccgaaggcgtggacggcaagcgggtcttcgtccgcgccgacctgaacgtgccgctggccgacggcctcatcaccgacgacggccgcatccgcgccgtcctgccgacggtcaaggcgctggccgaggccggtgccaaggtggtcgtcgcctcgcacctgggccgccccaagggcgccccggacccggccttctccctgctgcccgcggcggagcggctcggtgaactcctcggcgcgcccgtcgcgttcgcccaggacaccgtgggccccgccgcccacgacgccgtgaacggcctccagcccggccaggtagcggtcatcgagaacctgcgcttcaacgcgggcgagacgtccaaggacgacgccgagcgcggcgcgttcgccgaccggctggcggccctggccgacatctacgtgggcgacggtttcggcgccgtgcaccgcaagcacgcctccgtgtacgacctcccggcacgcctgccgcactacgcgggctacctcatcgccaccgaggtcaacgtcctgaagaagctcaccgaggacgtcaagcgcccctacgtggtcgcactcggcggcgccaaggtctccgacaagctcgccgtcatcgaccagctgctcggcaaggccgaccgcctgctgatcggcggcggcatggcctacaccttcctcaaggccaagggctacgaggtcggcatctccctcctccaggaggaccagatcccgaccgtcaaggagtacatggagcgcgcggagaagaacggcgtcgagctggtcctccccgtcgacgtgctggtctccacggagttcccggacctcaagacgaaggccccggccaaccccaccaccgtcgccgcggacgccatcccggccgaccaggagggtctcgacatcggtcctgagacccgcaagctgtacgcatcgaagctcgccgacgcggccaccgtcttctggaacggccccatgggcgtcttcgagcaccccgactacgccgagggcaccaaggcggtcgcccaggccctcgtcgactcccaggccttcacggtcgtcggcggtggcgactccgccgcggccgtccgcatcctgggcttcgacgagacggcattcggccacatctcgaccggcggcggcgcctccctcgaatacctcgagggcaagacgctccccggccttgccgcactggaggactga

SEQ ID NO: 10779 - protein, 403 aa, Streptomyces avermitilis
MKTIDELLAEGVDGKRVFVRADLNVPLADGLITDDGRIRAVLPTVKALAEAGAKVVVASHLGRPKGAPDPAFSLLPAAERLGELLGAPVAFAQDTVGPAAHDAVNGLQPGQVAVIENLRFNAGETSKDDAERGAFADRLAALADIYVGDGFGAVHRKHASVYDLPARLPHYAGYLIATEVNVLKKLTEDVKRPYVVALGGAKVSDKLAVIDQLLGKADRLLIGGGMAYTFLKAKGYEVGISLLQEDQIPTVKEYMERAEKNGVELVLPVDVLVSTEFPDLKTKAPANPTTVAADAIPADQEGLDIGPETRKLYASKLADAATVFWNGPMGVFEHPDYAEGTKAVAQALVDSQAFTVVGGGDSAAAVRILGFDETAFGHISTGGGASLEYLEGKTLPGLAALED

SEQ ID NO: 10780 - DNA, 1500 bp, Streptococcus thermophilus
  CDS (301)..(1500)
agtataccatcaaaactaagtatttcctcatttatgggatatttataggaaaagagtgtttgtttaaaagtaagaaagaagaggaataagtgtaagtatgaggattatatttaaatcgaaattagcttttttctgaattttatttaggtgtttttttattgctattctgactttctattttgattatatgataaaagtagcctactagcaattagctagaaatccttctgattttgctatctcttttatgcattttgtgatataatgataacgtattaaaaaattaaggagtctgatcaaatggctaaattgactgttaaagatgttgagttgaaaggaaaaaaagttctcgttcgtgttgacttcaacgtacctgtaaaagatggcgtgatcactaacgacaaccgtatcactgctgcccttccaactatcaagtatatccttgaacaaggtggacgtgcaatcctcttctctcaccttggacgtgtaaaagaagaagctgataaagaaggtaaatcacttgctcctgtagctgctgacttggctgctaaattgggtcaagatgttaagtttattccaggtgttacacgtggtgctgaattggaagcagctgttaactctcttgaagatgggcaagttctcttggttgaaaacactcgttttgaagatgttgatggcaagaaagaatctaaaaatgatcctgaacttggtaaatactgggcatcacttggagatggtatcttcgtaaacgatgcattcggtacagctcaccgtgcacacgcatctaacgttggtatctcagcaaacgttgaaaaagctgttgctggattccttcttgaaaacgaaattgcatacatccaagaagcagttgaaaatccagaacgtccattcgtggctatccttggtggttcaaaagtttcagataagatcggtgttatcgaaaacttgcttgaaaaagctgataaagttcttatcggtggtgggatgacttacacatttttcaaagcgcaaggtatcgaaatcggtaactcacttgtggaagaagacaaattggatgtagcgaaagctcttcttgaaaaatcaaatggtaaattgatcttgccagttgactcaaaagaagcaaacgcatttgctgactacactgaagtgaaatatactgaaggtgaagcagtagacccaggtttccttggtcttgatatcggtccaaaatctatcgctaaattcgacgaagctttgactggtgctaaaacagttgtatggaatggacctatgggtgtatttgaaaaccctgacttccaggctggtacaatcggtgtgatggacgctatcgtgaaacaaccaggtgttaaatcaatcatcggtggtggtgactcagctgctgcagcaatcaaccttggatatgcagacaaattctcatggatctctactggtggtggtgcatctatggaactccttgaaggtaaagaacttccaggacttgcagctttgactgaaaaataa

SEQ ID NO: 10781 - protein, 399 aa, Streptococcus thermophilus
MAKLTVKDVELKGKKVLVRVDFNVPVKDGVITNDNRITAALPTIKYILEQGGRAILFSHLGRVKEEADKEGKSLAPVAADLAAKLGQDVKFIPGVTRGAELEAAVNSLEDGQVLLVENTRFEDVDGKKESKNDPELGKYWASLGDGIFVNDAFGTAHRAHASNVGISANVEKAVAGFLLENEIAYIQEAVENPERPFVAILGGSKVSDKIGVIENLLEKADKVLIGGGMTYTFFKAQGIEIGNSLVEEDKLDVAKALLEKSNGKLILPVDSKEANAFADYTEVKYTEGEAVDPGFLGLDIGPKSIAKFDEALTGAKTVVWNGPMGVFENPDFQAGTIGVMDAIVKQPGVKSIIGGGDSAAAAINLGYADKFSWISTGGGASMELLEGKELPGLAALTEK

SEQ ID NO: 10782 - DNA, 1248 bp, Sulfolobus tokodaii
  CDS (1)..(1248)
atgataaaagtagctgatcttaatattcctgttatagaagatttcgacataaatgggagaaaagttttactaagaatagatataaattcacccgtagaccgaaaaactggaaaattattagatgattccagaattaaagcccatgctgaaacaattagagaattactcgataagcaaaattctgtagtaataatttcccaccaaggtagaccaggagatgatgattttatttctttagaagaacactctaaaatcctatctaaatatgttggtagggaaattgagttcgtcgatgatgttataggtccttatgctagagaaaaaatatctaaactaggtaaaggggaagccatcttattagagaatgttagaatcgtatctgaagaattaatagaggctcctccacaacagcaatctaaaacttttttagtaagaaaattagccccattagtcgatttttacattaacgatgctttcgcaacagcacatagaagccaaccaagtctagtaggatttcctttagtaaaaccttcagctgcaggaagaataatggagaaagaagtttctgcattatctaagatctttaacaaggaagactctccaaaaatatttgttttgggaggaagtaaggttagtgatacattaaagataattgaacacctagcaaaaaatagagttgctgatagaatattaactggcggtttagtagcagaactatttgctgttgcgaaaggtataaatttaggtaagcctaatatgcaagttttagagaataagggtcttctgagcctaattccgagagctagaaaaatcttgctatctggtgcacctatagaaatccctgttgactttacagtggaaaaacctagtggagaattaagcaatgatccggagaataatgtgagtggtattataaaagatatagggaatactaccattgaaatttattcctcttttattaaggaaggcaaagtcattacattaagaggacctatgggagttattgaagatgaaagattcagaattggtactaaaagcttactgaaagcctctattgaaagcccgggatatgtaattattggtggcggtcatatgataagtatgcttgataaagacgtagaaataaatccaaataaaattcatgtatctaccggaggaggagcgttgcttttatttttagccggtgataagttaccggcattagaagctttacatatgtcatgggtgatgcaaagtggaaaaagttaa

SEQ ID NO: 10783 - protein, 415 aa, Sulfolobus tokodaii
MIKVADLNIPVIEDFDINGRKVLLRIDINSPVDRKTGKLLDDSRIKAHAETIRELLDKQNSVVIISHQGRPGDDDFISLEEHSKILSKYVGREIEFVDDVIGPYAREKISKLGKGEAILLENVRIVSEELIEAPPQQQSKTFLVRKLAPLVDFYINDAFATAHRSQPSLVGFPLVKPSAAGRIMEKEVSALSKIFNKEDSPKIFVLGGSKVSDTLKIIEHLAKNRVADRILTGGLVAELFAVAKGINLGKPNMQVLENKGLLSLIPRARKILLSGAPIEIPVDFTVEKPSGELSNDPENNVSGIIKDIGNTTIEIYSSFIKEGKVITLRGPMGVIEDERFRIGTKSLLKASIESPGYVIIGGGHMISMLDKDVEINPNKIHVSTGGGALLLFLAGDKLPALEALHMSWVMQSGKS

SEQ ID NO: 10784 - DNA, 1203 bp, Synechococcus elongatus
  CDS (1)..(1203)
atgtctaaaaaatccgtagcgcaattatccgctgccgacttagaaggaaagcgtgtcctcgtgcgggtggattttaatgtccccgtcgatgaaaagggcgtcatcaccgatgagactcgtatccgtgcggccctgcccaccattcaagacctgatcagcaaaggtgcaaaagtcattctggtcagccactttggccgtcccaagggcgtggatgagaagttgcgcctcacccctgtggcccagcggctctcagaactgctccacaaacccgtggccaagctcgatgactgcattggcgatgcggtgatcgcccacacccaagccatggccaacggggatgtctgcctactggagaatgtgcgcttccatccgggggaagaaaaaaacgatcccgaatttgccaagcaactggccgcctgtgcagaagtctatgtcaatgatgcctttggcactgcccaccgcgcccatgcctcaaccgctggggtgactcagtacctcagtccttgcgtggcgggctttttgatggagaaagaactggaatatctgcaaaatgccatcgaacatccccgccgtcccctggcggctattgtcgggggatcaaaagtctcttctaagattggtgtcattgaagcccttttagaaaaagtggataaattgctcattggcggcggcatgatcttcactttctataaagcgcgggggctcaatgttggcaagtctctcgtggaagaagacaaattggaactagccaagcacctggaaaccaaggcccaggagaaaggggtggagttgctcttgccaacagatgttgtcgtggcggataactttgccaacgatgccaatagccaagtggtcagtatcgaagcgattcctgacgactggatggggctagatattgggcctgcttctgtcaagcgcttccaagaggcactccaagattgcaaaacggtgatctggaacggcccaatgggggtgtttgagtttgatcaatttgccaaggggacagaggcgatcgcccgctatttggctgagcttaccagtcagggggtctgcacaattattggcggcggcgattctgtggctgctgtggaaaaagttggcgtcgccgatcgcatgagccacatttccaccggtggcggggcgagtcttgaactcctcgaaggcaaacaactgccaggtattgctgcccttgatgatgcctag

SEQ ID NO: 10785 - protein, 400 aa, Synechococcus elongatus
MSKKSVAQLSAADLEGKRVLVRVDFNVPVDEKGVITDETRIRAALPTIQDLISKGAKVILVSHFGRPKGVDEKLRLTPVAQRLSELLHKPVAKLDDCIGDAVIAHTQAMANGDVCLLENVRFHPGEEKNDPEFAKQLAACAEVYVNDAFGTAHRAHASTAGVTQYLSPCVAGFLMEKELEYLQNAIEHPRRPLAAIVGGSKVSSKIGVIEALLEKVDKLLIGGGMIFTFYKARGLNVGKSLVEEDKLELAKHLETKAQEKGVELLLPTDVVVADNFANDANSQVVSIEAIPDDWMGLDIGPASVKRFQEALQDCKTVIWNGPMGVFEFDQFAKGTEAIARYLAELTSQGVCTIIGGGDSVAAVEKVGVADRMSHISTGGGASLELLEGKQLPGIAALDDA

SEQ ID NO: 10786 - DNA, 1209 bp, Synechococcus sp
  CDS (1)..(1209)
atggcgaagcgttccctggccagccttaacgccggcgacctgagcggcaaacgcgttctcgtgcgggttgatttcaacgtgcccctgaacgaggccggtgcgatcaccgacgacacccgcatccgcgccgccctgcccacgatcaacgacctgatcggcaagggcgccaaggtcattctttctgctcacttcggccgccccaagggtcaggtgaacgacgccatgcgactcacccccgtggccgcccgcctgagcgaactgctgggcaagcccgtggccaagaccgacagctgcatcggccctgatgctgaagccaaggtgaacgccatggccgatggcgatgtggtgctgctggagaacgtgcgcttcttcgccgaggaggagaagaacgacgctgggttcgccgagaagcttgctggcttggctgaggtgtacgtgaacgatgccttcggcgccgcccaccgcgcccacgcctccaccgagggcgtgaccaagttcctcaagcccgcagtcgctggcttcctgatggaaaaggagcttcagtacctgcagggtgctgtggatgagcccaagcgtcctctcgctgccatcgtcggtggctccaaggtgagctccaagatcggcgtgctcgaggccctgatcgacaagtgcgacaaggtgctgatcggcggtggcatgatcttcaccttctacaaagcccgtggcctctcggtgggcaagagcctggtggaagaggacaagcttgaactggccaaggagctggaagccaaggccaaggccaagggcgttgagctgctgctgcccaccgatgtggtgctggccgacaacttcgcccccgatgccaacagccaggtggctgatgtcaccgccatccccgacggctggatgggtctggacatcggccctgatgcggtgaaggtgttccaggacgcccttggcgattgtcagaccgtgatctggaacggccccatgggcgtgttcgaattcgagaagttcgccaccggcaccaacgccatcgccacaaccctggcggagctcagcggcaagggctgctgcacgatcatcggcggtggtgactccgtggctgctgtggagaaggctggtctggccgacaagatgtcccacatctccaccggtggcggcgccagccttgaacttctagaaggcaaggtgctgcctggtgttgccgccctcaacgacgccgcctga

SEQ ID NO: 10787 - protein, 402 aa, Synechococcus sp
MAKRSLASLNAGDLSGKRVLVRVDFNVPLNEAGAITDDTRIRAALPTINDLIGKGAKVILSAHFGRPKGQVNDAMRLTPVAARLSELLGKPVAKTDSCIGPDAEAKVNAMADGDVVLLENVRFFAEEEKNDAGFAEKLAGLAEVYVNDAFGAAHRAHASTEGVTKFLKPAVAGFLMEKELQYLQGAVDEPKRPLAAIVGGSKVSSKIGVLEALIDKCDKVLIGGGMIFTFYKARGLSVGKSLVEEDKLELAKELEAKAKAKGVELLLPTDVVLADNFAPDANSQVADVTAIPDGWMGLDIGPDAVKVFQDALGDCQTVIWNGPMGVFEFEKFATGTNAIATTLAELSGKGCCTIIGGGDSVAAVEKAGLADKMSHISTGGGASLELLEGKVLPGVAALNDAA

SEQ ID NO: 10788 - DNA, 1206 bp, Synechocystis sp
  CDS (1)..(1206)
atgttgtctaagcaatcgatcgccaatttgacggaggcagacctcgcagggaaacgggtttttgtccgggtagattttaatgtgcccctagataacggcagcatcaccgacgacaccaggattcgggcagccttacccaccatcaaagacctgttgagcaaaggcgccaaagttattttgggcagtcattttggccgtcccaagggcaaagtagtggacagcatgcgcctcacccccgttggcgatcgcctaggggaattattgggccagccggtggtcaaatgcgacgattgcattggtgctgaagttacagccaaaattgctagcctacccaatggtggtgtggccctgttggaaaatctccgcttccatgccggggaagaaggtaacgatgctgaatttgccaaagctttagcggccaacgccgacctctacgttaacgatgcctttggtactgcccaccgggcccacgcttccaccgaaggggtcacccatttcctcagccccaacgttgctggttacctaatcgaaaaggaattacagttcctccaaggagccatcgaagcccccaaacgtcccctagtggcgatcgtgggaggttccaaagtgtccagtaaaatcggtgtgatcgaaaccctattggacaagtgcgataagttgatcatcggcggcggcatgattttcaccttctacaaagcccaaggtttaaacaccggcaaatccctggtggaagaagacaaattggacttggccaaatccctcatggctaaagccaaagaaaaaggcgtggaatttctcctgcccacggacgtagtagtggccgacaactttgcccccgatgccaatgcccaaaccgttggtgtcgatgcaattcccgatggttggatgggtctagacattggtcccgactccgtcaaaaccttccaggatgccctcgctggttgtggcactgtcatctggaacggccccatgggggtatttgaatttgacaaatttgccgttggtaccgaggcgatcgcctgcagcttggctgaattgaccgccagtggcactgtcaccatcatcggtggtggagattctgtcgccgcagtggaaaaagtgggagtggccgaaaaaatgagccatatttccaccggtgggggcgctagcctggaattgctagaaggtaaagttctgcccggcattgccgctttagatgaccgataa

SEQ ID NO: 10789 - protein, 401 aa, Synechocystis sp
MLSKQSIANLTEADLAGKRVFVRVDFNVPLDNGSITDDTRIRAALPTIKDLLSKGAKVILGSHFGRPKGKVVDSMRLTPVGDRLGELLGQPVVKCDDCIGAEVTAKIASLPNGGVALLENLRFHAGEEGNDAEFAKALAANADLYVNDAFGTAHRAHASTEGVTHFLSPNVAGYLIEKELQFLQGAIEAPKRPLVAIVGGSKVSSKIGVIETLLDKCDKLIIGGGMIFTFYKAQGLNTGKSLVEEDKLDLAKSLMAKAKEKGVEFLLPTDVVVADNFAPDANAQTVGVDAIPDGWMGLDIGPDSVKTFQDALAGCGTVIWNGPMGVFEFDKFAVGTEAIACSLAELTASGTVTIIGGGDSVAAVEKVGVAEKMSHISTGGGASLELLEGKVLPGIAALDDR

SEQ ID NO: 10790 - DNA, 1227 bp, Thermoplasma acidophilum
  CDS (1)..(1227)
atggatgagttcttcttgatgaattctttcgatcttgcgggaaaaacagtatacttgagggtggatataaatgcacccgtcaatccgctgaccggtgagataatgggtattgacaggttcagggcccacatagacacgataaggaatttgagaaattccaaggtcgtcatagttgcccatcagagcagacctggaaaggacgattttatctcactcagacagcatgcacagatactttcgcaccttctcaacaagagggtgcagttcgtggatcagctcttcggaagccaggtcaacagggcggtatccgaaatgtcagatggggacatagtgatgctggagaattcaaggttttattcggaggaggttgacctaaccacgatcgaaagcatggaatcatcaaacatagtgagaagcctgtctccgctgtttgactacttcatcatagatgcctttgctgcaatacacagggcacagacaactctagttggattccacaggataaaaccaaacatagccggcactctcatagaaagggaggtcagcatgatagaacgattcagaaagataagggaaaagccgaagattgcaatacttggcggggctaagatagaggattcaatagcagtctcggagaacttcctatctagagggttcgtggataaaattctaactggcggagtcgttgccaacgctttcctgtgggcatccggatttgatataggaaaaaagaacagggaattcataatgaagaataacggagattacgaaaagctgctcgacaaatgcagggcaatcctttcaaaatacggagataaactggttatgccgacggatttcgtgatgaatccatcgggtcagaggatatcgataaacgagaagatcccggacgaccagatactggctgacatagggctggataccattgtagaatattccgagataattgacggagcaagggccatattcatgaatggacctatgggtatgtacgaaatagaggattattcttccggtaccagggaagtgttcaccgctgttgcacattccaaggcattcaagcttgcaggaggcggacacacgctcagcgcccttgacaaactaggtctgaccaagatgatcgatcatgcatccaccggaggtggtgcgttgataagctatttaagtggtgaaacaatgcctgtccttgaggcattgaaggaaagcaaaaagctgtttgagggatga

SEQ ID NO: 10791 - protein, 408 aa, Thermoplasma acidophilum
MDEFFLMNSFDLAGKTVYLRVDINAPVNPLTGEIMGIDRFRAHIDTIRNLRNSKVVIVAHQSRPGKDDFISLRQHAQILSHLLNKRVQFVDQLFGSQVNRAVSEMSDGDIVMLENSRFYSEEVDLTTIESMESSNIVRSLSPLFDYFIIDAFAAIHRAQTTLVGFHRIKPNIAGTLIEREVSMIERFRKIREKPKIAILGGAKIEDSIAVSENFLSRGFVDKILTGGVVANAFLWASGFDIGKKNREFIMKNNGDYEKLLDKCRAILSKYGDKLVMPTDFVMNPSGQRISINEKIPDDQILADIGLDTIVEYSEIIDGARAIFMNGPMGMYEIEDYSSGTREVFTAVAHSKAFKLAGGGHTLSALDKLGLTKMIDHASTGGGALISYLSGETMPVLEALKESKKLFEG

SEQ ID NO: 10792 - DNA, 1173 bp, Thermus thermophilus
  CDS (1)..(1173)
atgcggacccttttggacctggaccccaagggcaagagggtcctggtgcgggtggactacaacgtccccgtccaagacgggaaggtccaggacgagacccggatcctggagagcctccccaccctccgccacctcctcgccgggggggcttccctcgtcctcctctcccacctgggccgccccaagggtcccgaccccaggtactccctggcccccgtgggggaggccttgagggcccacctcccggaggcccgcttcgcccccttccctccgggctcggaggaggcgaggcgggaggcggaggccctgaggcccggggaggtcctcctcctggagaacgtccgctttgagccgggggaggagaagaacgacccggagctttccgcccgctacgccaggctcggggaggccttcgtcctggacgccttcgggagcgcccaccgggcccacgccagcgtggtgggggtggcgaggctcctccccgcctacgccggcttcctcatggagaaggaggtcagggccctttcccgcctcctcaaggacccggaaaggccctacgccgtggtgctgggcggggccaaggtctcggacaagatcggggtcattgagagcctccttccccgcatagaccgcctcctcatcggcggggccatggccttcaccttcctcaaggccctagggggggaggtggggaagagcctggtggaggaggaccggctggacctggccaaggacctcttggggcgggccgaggccttgggggtcagggtctacctccccgaggacgtggtggcggcggagcgcatagaggcgggggtggagacccgggtcttcccggcccgggccatccccgtcccctacatgggcctggacatcggccccaagacccgggaggcctttgcccgggccctggaaggggcgaggacggtcttctggaacgggcccatgggggtctttgaggtgcctccctttgacgaggggaccttggccgtggggcgggccatcgccgccctcgagggcgccttcaccgtggtgggcgggggcgactcggtggcggcggtgaaccgcctgggccttaaggaccgcttcggccacgtctccaccgggggcggggcgagcctggagttcctggaaaagggcaccctgcccggcctcgaggtcctggaaggctaa

SEQ ID NO: 10793 - protein, 390 aa, Thermus thermophilus
MRTLLDLDPKGKRVLVRVDYNVPVQDGKVQDETRILESLPTLRHLLAGGASLVLLSHLGRPKGPDPRYSLAPVGEALRAHLPEARFAPFPPGSEEARREAEALRPGEVLLLENVRFEPGEEKNDPELSARYARLGEAFVLDAFGSAHRAHASVVGVARLLPAYAGFLMEKEVRALSRLLKDPERPYAVVLGGAKVSDKIGVIESLLPRIDRLLIGGAMAFTFLKALGGEVGKSLVEEDRLDLAKDLLGRAEALGVRVYLPEDVVAAERIEAGVETRVFPARAIPVPYMGLDIGPKTREAFARALEGARTVFWNGPMGVFEVPPFDEGTLAVGRAIAALEGAFTVVGGGDSVAAVNRLGLKDRFGHVSTGGGASLEFLEKGTLPGLEVLEG

SEQ ID NO: 10794 - DNA, 1185 bp, Thermoanaerobacter tengcongensis
  CDS (1)..(1185)
atgaaaaagaaaactgtgagagacatagacgttagcggaaaaagagttttagttagagtagattttaacgtgccgatggatgaaaataaaaacataacagatgacaggcgcataagagaagctcttcccaccattgagtatttaataaatcacaacgcaaaagtgatactggtatctcacctggggagacctaaggggaaattcaatccggattactctttaaagcctgttgcaaaaaggctgtctgagcttttgaaaaagcctgtaattatggcagaggatgtgattggagaagatgctaaggtaaaagctgctgccttaaaagaaggggaagttctccttttggaaaatgttagattccatgcagaagaggagaagaatgaccctgaatttgcaaaagagcttgcatctttagcagatatatacgtaaatgatgcttttggcactgctcacagggctcacgcttctactgcaggagttgccaagtatcttccagcagtggcaggttttttaattgaaaaagagctttctataatgggagaagcgttggagaatcctaagagaccttttgtggcgattttaggtggagctaaagtttctgataaaattggggttataacaaatcttctggaaaaagtggacagcctgttaattggcggtggaatggcttatacctttattaaggcgaagggctacgaaatagggaaatctcttttggaagaggataaaattgaactagcaaaggaaataatggaaaaagcaaagcagaagggcgtaaatttcatgcttcctgttgatacagttatcgcgaaagagttaaaatccggggtaccttatgaagtggttgacattgacaaaatgccagaagaccagataggagttgacattgggcctaaaacaatagaagagtattcaaaagtgataaagcatgccatgacagttgtatggaatggaccaatgggagtttttgaaatacctgaatttgccaaaggtacaaaagctatcgcaaaggctttgagcgagtgcaaaggtacaacaatagtaggaggaggagattctgcagctgccatagaacagcttggctatgctgataaagtcacccacatttcaactggaggcggtgcgtcactggaatttttagaggggaaagtcttgccgggaattgacattttgaatgataagtaa

SEQ ID NO: 10795 - protein, 394 aa, Thermoanaerobacter tengcongensis
MKKKTVRDIDVSGKRVLVRVDFNVPMDENKNITDDRRIREALPTIEYLINHNAKVILVSHLGRPKGKFNPDYSLKPVAKRLSELLKKPVIMAEDVIGEDAKVKAAALKEGEVLLLENVRFHAEEEKNDPEFAKELASLADIYVNDAFGTAHRAHASTAGVAKYLPAVAGFLIEKELSIMGEALENPKRPFVAILGGAKVSDKIGVITNLLEKVDSLLIGGGMAYTFIKAKGYEIGKSLLEEDKIELAKEIMEKAKQKGVNFMLPVDTVIAKELKSGVPYEVVDIDKMPEDQIGVDIGPKTIEEYSKVIKHAMTVVWNGPMGVFEIPEFAKGTKAIAKALSECKGTTIVGGGDSAAAIEQLGYADKVTHISTGGGASLEFLEGKVLPGIDILNDK

SEQ ID NO: 10796 - DNA, 1260 bp, Treponema denticola
  CDS (1)..(1260)
atgattaagactgtaaaagatgtaaatttaaaggataaacgcataataatgcgtgtagattttaacgttcctatgaaggacggagtagtgcaggatgatacgcggattagggcggctcttcctacaataaaatatatattggaacaaggagcaagaagccttgttttgatgagccatttgggtgatccttcaaaagatgcaaaaaaagccaaggaaaaggccgaaaaagacggaaaaccctttgatgaggaagcttatattaacggaaagcataggatgaaacctgttgcagaatacttatccggccttcttaaacttcctgttgattttgctccctcctgcatgggacagcttgaaagggtaaaagctcttccacagggcggaattctaatgcttgaaaacacccgcttccacaaagaagaaacttcaaaggaaaaggccgagcagcaaatcttggcaaaagaactcagcttgtacggtgatatctatgtaaatgatgcttttggaacggctcaccgctctcatgcttctacagccgaaattgccaactttgtcaatacaagggtagccggctttcttatggaaaaggaaattaaataccttgagccaatgttaaataatcctgcaaagccaatgacggcaattataggaggagcaaaggtttcttccaaaattgcagttttggaaagtcttttaaaaaatgcatcttctttaattataggaggaggaatggcctacaccttcttaaaggttcaaggaaaaaagatcggtaaatccttatttgaagaagattttatggatactgctaaaaatcttttggataaggctgaaaaacagggtgtaaagataatccttcctgttgatcatatctgttccgaaaccttttctcccaatgccgaagccgttttagttgaaagcacagatattcccgataatcttatgggaatggatgtaggccctaagaccttggctctttataaagagattattttgtcgtcaaagtccattgtctggaacggccccgtaggcgtttttgagtttgaggctttttcaaagggaacggaagaaactgcccgccttgtagcagctgcaacggaaaaaggtgcacttacaatcgtaggcggaggtgattcggttgctgccgtaaataagttcaatcttgccgataagatgagtcatgtttctaccggcggcggagcttccctcgaattccttgaaggaaaagttctccccggcattgcctgtcttgatactatttaa

SEQ ID NO: 10797 - protein, 419 aa, Treponema denticola
MIKTVKDVNLKDKRIIMRVDFNVPMKDGVVQDDTRIRAALPTIKYILEQGARSLVLMSHLGDPSKDAKKAKEKAEKDGKPFDEEAYINGKHRMKPVAEYLSGLLKLPVDFAPSCMGQLERVKALPQGGILMLENTRFHKEETSKEKAEQQILAKELSLYGDIYVNDAFGTAHRSHASTAEIANFVNTRVAGFLMEKEIKYLEPMLNNPAKPMTAIIGGAKVSSKIAVLESLLKNASSLIIGGGMAYTFLKVQGKKIGKSLFEEDFMDTAKNLLDKAEKQGVKIILPVDHICSETFSPNAEAVLVESTDIPDNLMGMDVGPKTLALYKEIILSSKSIVWNGPVGVFEFEAFSKGTEETARLVAAATEKGALTIVGGGDSVAAVNKFNLADKMSHVSTGGGASLEFLEGKVLPGIACLDTI

SEQ ID NO: 10798 - DNA, 1188 bp, Tropheryma whipplei
  CDS (1)..(1188)
atgagaactcttggcggtttcacctttccttgtgatgctcctgtttttgtccgggttgatttcaatgtgcctatggatgaggtcggcacaataacggatgatctgcgtataagagcttcccttccgactatagaaagcttgcttggccgtggcgcgccacttatattgatttctcatctcgggcgaccggttaaaaatgagcagcaaggattttccctaaaaccctgtgctgagcgactatcggaatatatcggagtcaatgtaccgcttgtggattttcttgatctagatacaaagctttatggtgaacttactaggcatctggacaagtctgggatagttctttttgaaaatatacgattttttgccgaggaaacttcaaaggcacaggctgatcgaaggattctggctgagcaacttgcgccttttgcgggtgcgtatgtcaatgatgcctttggtgcttcccacaggaggcatgctagtgtgtatgagcttgcacaggctttctcaaataaggcggcaggctttctcattgaatcagagatgcaggctttttcacatcttgccagcgaggccaagcgtccctataccgttattctcggcggggcaaaattatcggacaagctacggcttatagagaatatcctgccaacggttgatcgtctgttactgtgtggtggaatggcatttacatttctagcggcacaggggtgtgaaacaggcaaaagtctcctggaagagagttttatctcggaggcaaataaaatcattgattttgctaagcaaaataatgttgaacttatacttccggtagatgttattgaggcgcgaagcctaacttcaccccttggggttgtaagtaaagctgaatctatatcttatatgggtcttgatataggtcctgaaactcagagtatctttagaaatgtaatacaagattcgaaaactgttttttggaatggcccggctggtttatttgaaaacccaagcttttcaaacggaacacgtgcactgcttgatgcattgtcgtcttctagcgcgtttacatttatcggaggaggcgatacagcagcagctgtcagccttcttggttttgattatggagattttagtcatgtttcaacaggcggtggtgcctgccttgaactgctagagggaaaaatattgccagcattagaggttttgtaa

SEQ ID NO: 10799 - protein, 395 aa, Tropheryma whipplei
MRTLGGFTFPCDAPVFVRVDFNVPMDEVGTITDDLRIRASLPTIESLLGRGAPLILISHLGRPVKNEQQGFSLKPCAERLSEYIGVNVPLVDFLDLDTKLYGELTRHLDKSGIVLFENIRFFAEETSKAQADRRILAEQLAPFAGAYVNDAFGASHRRHASVYELAQAFSNKAAGFLIESEMQAFSHLASEAKRPYTVILGGAKLSDKLRLIENILPTVDRLLLCGGMAFTFLAAQGCETGKSLLEESFISEANKIIDFAKQNNVELILPVDVIEARSLTSPLGVVSKAESISYMGLDIGPETQSIFRNVIQDSKTVFWNGPAGLFENPSFSNGTRALLDALSSSSAFTFIGGGDTAAAVSLLGFDYGDFSHVSTGGGACLELLEGKILPALEVL

SEQ ID NO: 10800 - DNA, 1164 bp, Vibrio cholerae
  CDS (1)..(1164)
atgtctgtaatcaagatgattgacctggatcttgcaggtaaacgcgtatttatccgtgctgacctgaacgtaccagtaaaagacggcaaagtgacttctgatgcacgtatccttgcatcactacctaccattaagcactgcttggaagcgggcgcgaaagtaatggtcacttctcacctaggtcgtccaacggaaggtgagtacgctgaagagttctctctactgcctgtggttaactacctgaacgatgctctcgattgcgaagttcgcctagtgaaagactacctagacggcgttgaactgaacgcaggtgaactggttgttctggaaaacgttcgtttcaacaaaggcgaaaagaaaaacgaagaagcgctgtctaagaaatacgcggcactgtgtgacgtattcgtgatggatgcgtttggtactgcgcaccgtgctcaagcttctactcacggtgttggtatgtttgctcctattgcgtgtgcaggccctctactggctgacgaacttgaagcgctaggcaaagcgatggacaaaccagctcgcccaatggtggctatcgttggtggttcaaaagtatcaactaagctgactgtacttgagtcactgtcaaaaattgctgaccaactggtggttggcggtggtattgcgaacactttcatcgctgcagcgggtcacaacgtaggtaagtctctgtatgaagctgaccttgttgaaacagcgaaaaaactgatggaagagtgcgcgattcctgtggcgactgacgtagcttgtgccaaagctttcgatgagaacgcagaagccgaaatcaaacacgtttctgaagttcaagatgacgacatgattttcgacttgggtccaaactcaacggctgaactggctgagatcctgaaaaacgcgaaaactatcctgtggaacggcccagtaggcgtattcgaattcaagaactttgaagcgggtactcgtggtatcgcagaagcgatcgcacaatcagaaggcttctctgttgctggtggcggtgacacgctagcggcgatcgacaagtttggcatcaaagccgatgtttcttacatctctactggtggcggcgcgttccttgagttcgttgaaggcaaaaaactgcctgcagtagaaatgctggaagcacgcgctaaagcgtaa

SEQ ID NO: 10801 - protein, 387 aa, Vibrio cholerae
MSVIKMIDLDLAGKRVFIRADLNVPVKDGKVTSDARILASLPTIKHCLEAGAKVMVTSHLGRPTEGEYAEEFSLLPVVNYLNDALDCEVRLVKDYLDGVELNAGELVVLENVRFNKGEKKNEEALSKKYAALCDVFVMDAFGTAHRAQASTHGVGMFAPIACAGPLLADELEALGKAMDKPARPMVAIVGGSKVSTKLTVLESLSKIADQLVVGGGIANTFIAAAGHNVGKSLYEADLVETAKKLMEECAIPVATDVACAKAFDENAEAEIKHVSEVQDDDMIFDLGPNSTAELAEILKNAKTILWNGPVGVFEFKNFEAGTRGIAEAIAQSEGFSVAGGGDTLAAIDKFGIKADVSYISTGGGAFLEFVEGKKLPAVEMLEARAKA

SEQ ID NO: 10802 - DNA, 1161 bp, Vibrio parahaemolyticus
  CDS (1)..(1161)
atgtctgtaatcaagatgactgacctggatcttgcaggtaaacgtgtattcatccgtgctgacctaaacgtgccagtaaaagacggtaaagtaacttctgatgcacgtatcatcgcatctcttccaactattaagcactgcctagaagctggcgctaaagtaatggttacttctcacctaggtcgtccaactgaaggtgaatacgctgaagagttctctctacaaccagttgttaactacctaaacgacgcactagattgcgaagttaaacttgctaaagattacctagatggcctagaactaaacgctggtgagcttgttgttctagaaaacgttcgcttcaacaaaggcgagaagaaaaacgaagaagagctatctaagaaatacgcagcactatgtgacgtattcgtaatggatgcattcggtacggctcaccgtgctcaagcgtcaactcacggcgttggtatgcacgctcctgtagcttgtgctggtcctctactagcaaacgaactagaagctctaggcaaagcaatggacaagcctgctcgtccaatggttgctatcgtaggtggttcaaaagtttctactaagctaactgttcttgaatctctatctaaaatcgctgaccaacttgttgttggtggtggtattgctaacacattcatcgctgctgctggtcacaacgttggtaaatctctatacgaagctgacctagtagacactgctaagaagctaatggacgagtgtgcaattccagtggcaactgacgttgcatgtgcgaaagcattcgacgagaacgcagaagcagaaatcaaacacgtttctgaagtacaagacgacgacatgatcttcgaccttggtccagaatcaacagctgcactagctgaaatccttaaaaacgcgaaaactatcctatggaacggtcctgtaggtgtattcgaattcaagaacttcgaagccggtactaaaggtatctctgaagctatcgcagcttctgaaggtttctctgttgcaggtggtggtgacacgctagcagctatcgacaagttcggtatcaaagctgacgtatcgtacatctctactggcggcggcgctttccttgagttcgtagaaggtaaagttcttccagcagtagaaatgctagaagcacgcgctaagtaa

SEQ ID NO: 10803 - protein, 386 aa, Vibrio parahaemolyticus
MSVIKMTDLDLAGKRVFIRADLNVPVKDGKVTSDARIIASLPTIKHCLEAGAKVMVTSHLGRPTEGEYAEEFSLQPVVNYLNDALDCEVKLAKDYLDGLELNAGELVVLENVRFNKGEKKNEEELSKKYAALCDVFVMDAFGTAHRAQASTHGVGMHAPVACAGPLLANELEALGKAMDKPARPMVAIVGGSKVSTKLTVLESLSKIADQLVVGGGIANTFIAAAGHNVGKSLYEADLVDTAKKLMDECAIPVATDVACAKAFDENAEAEIKHVSEVQDDDMIFDLGPESTAALAEILKNAKTILWNGPVGVFEFKNFEAGTKGISEAIAASEGFSVAGGGDTLAAIDKFGIKADVSYISTGGGAFLEFVEGKVLPAVEMLEARAK

SEQ ID NO: 10804 - DNA, 1185 bp, Wigglesworthia glossinidia brevipalpis
  CDS (1)..(1185)
atgaaaataataaaagttacagatttaaatttaaaagacaaaaaagtgcttataaggtctgatcttaatgttcctattaaaaatggtaaaattatgtgtaatatgcgaataataaaatctttagaaactataaatttcgtaataaaaaatgaagctaaatgtgttattgtagcatcccaccttgggaatcctatagaagaaaagtacgactataatttttctctaacacacattgtaaatcatatgaaaaaaattataaaatatccaataagattaatacaaaattatttaaacggttttgaagcaaaagaaaaagaaattattgttttagaaaacgtaagattcaatccaggagaaagaaaaaatgacaaaaatttatcaaaaaaatatgctaatttatgtgatatattagtcatggattctttcggatcttctcatagatcagaatcatcaacaacaggtattattaagtttgcacctattagttgcataggacttctttttttaaaagaaataaaatatttaaaaaaagcattatttaattctaaaagaccaatagttacaatttttggaggatcaaaaatatcaactaaattaggagttatagaaaaattatctaacatttctgaaaatgttttagtaggaggaggaatagcaaatactattcttttttctaaaggacataatataggaaaatctttacacgataaaaataatataagtaaaattaaaaaatttttatataaaaaaaatataataattccaaaagattttatagttactgataatattaataaattttcttcgtacaaagaaaaatctataaaagaaataaaaaacgaggattatatagttgatatagggaaaaaatcctgcgaatgttttattaaaattataaaaaaagcaaaaacaatattttggaacgggcctctaggcttgatagagattaaacaatttagaaatggaactaaagaaatagctaattctgtaattcatagttcagcaaaatcaataataggaggaggagaaacagttcttgctatgagaatgttcaattttattgatcgtttttcatatatttctacaggaggaggagcatttttatcttttatagaaaaacaagaacttcctgttctatcagaattaaaaaaattcaaaaaatatacaaactttaaacaaaactaa

SEQ ID NO: 10805 - protein, 394 aa, Wigglesworthia glossinidia brevipalpis
MKIIKVTDLNLKDKKVLIRSDLNVPIKNGKIMCNMRIIKSLETINFVIKNEAKCVIVASHLGNPIEEKYDYNFSLTHIVNHMKKIIKYPIRLIQNYLNGFEAKEKEIIVLENVRFNPGERKNDKNLSKKYANLCDILVMDSFGSSHRSESSTTGIIKFAPISCIGLLFLKEIKYLKKALFNSKRPIVTIFGGSKISTKLGVIEKLSNISENVLVGGGIANTILFSKGHNIGKSLHDKNNISKIKKFLYKKNIIIPKDFIVTDNINKFSSYKEKSIKEIKNEDYIVDIGKKSCECFIKIIKKAKTIFWNGPLGLIEIKQFRNGTKEIANSVIHSSAKSIIGGGETVLAMRMFNFIDRFSYISTGGGAFLSFIEKQELPVLSELKKFKKYTNFKQN

SEQ ID NO: 10806 - DNA, 1197 bp, Wolbachia pipientis wMel
  CDS (1)..(1197)
atgaatatacctagtatagaaaattgtgatcttcacaataaaaccgtcttactcagagttgacttcaatgttcctataaaagatggagaaattcgtgacgtcactcgtattttgagagcattgcctactattcagtatttagtgaatgcgagtgcaaagattattattatatcacattttggacgcccaaaggccagagacaataatctgtcgctaaaaaatgtaattgacactttatcgcagttactaaataaaaaagtgaaattcattgacgattgctttggtgaaaaagtacaaagagcagtaagtgttatggatgcaggagatataatattactagagaatctaagattttataaagaggaagagcaaagtgactcaaattttgccaaacaactagcatctctagcggatatatatgtaaatgatgcattttcttgctctcacagagctcacgcttctatttcacgcattacagaatttttaccctcttatgcagggttttgcttgcaagatgagctaaagtatcttgaaaaagctgtatcgtttaaagctaaacctattactgcgatagttgggggagctaaaatatcaactaaaataaaagtgcttatgaagctaacagaaaaggttaattacctagttctaggtggtgcaatagccaataattttttgtcattcagcaaagtaaatatagggaaatctttctttcaaaatggtgttgacgaccttctgcataatattcttgaaacagcaaataaaaacaattgcaaaatagttgtgccagaagacgtgctggttgcagtaaactctgattacagcactagtatttcaagaagaactgagtccattttggacggtgatataattttggatatcggaccacaaactttgagtacaataagcagtataatagcaagcagtaagactctgctgtggaatggacctattggtgtttttgaacattcagcttttgcaagcggtacaataggggtaatgaaaatcgtaagtgacttaacgcacaaaggaaagttaaccagcataatagggggaggcgatagtctatctgcaataagcgctgcaggccttgccgataaggattttacatatgtttccactggtggaggagcatttttagattggttaagtggcgatgaaatgccgggagttgctgctctgcaaaaacgattagattaa

SEQ ID NO: 10807 - protein, 398 aa, Wolbachia pipientis wMel
MNIPSIENCDLHNKTVLLRVDFNVPIKDGEIRDVTRILRALPTIQYLVNASAKIIIISHFGRPKARDNNLSLKNVIDTLSQLLNKKVKFIDDCFGEKVQRAVSVMDAGDIILLENLRFYKEEEQSDSNFAKQLASLADIYVNDAFSCSHRAHASISRITEFLPSYAGFCLQDELKYLEKAVSFKAKPITAIVGGAKISTKIKVLMKLTEKVNYLVLGGAIANNFLSFSKVNIGKSFFQNGVDDLLHNILETANKNNCKIVVPEDVLVAVNSDYSTSISRRTESILDGDIILDIGPQTLSTISSIIASSKTLLWNGPIGVFEHSAFASGTIGVMKIVSDLTHKGKLTSIIGGGDSLSAISAAGLADKDFTYVSTGGGAFLDWLSGDEMPGVAALQKRLD

SEQ ID NO: 10808 - DNA, 1206 bp, Wolinella succinogenes
  CDS (1)..(1206)
atggtagcgggtatcaatttaatgcaggaaaccaaaagcatcagagatgttgagatcgaggggaagcgggtcttaatccgtgtcgatttcaacgtgcccatggatagtgattttaatatctccgacgacactcgaattagggaggcgattcctacgatcaatcattgcatcgacaatggcgccaaaagcattgtccttgtaagtcatctaggaagacccagaggaaaaagttcggagttttcactcaagcatatcctcaaacgcctagagcgcctgctcaatcgtagcgtgatttttgtcgagagccttgagggcgtctcttcggtaatggcaaccctgccccagaagagcgtgattttgcttgaaaatattcgattccttgagggggaagagaagaatgacgaaaagctctccaagaacctcgcatcgctttgtgacatctacatcaatgatgcttttggagcttcacaccgcaagcatgcttccacctatggtgtggcgaagtttgcccctgtgaaggtggcgggattgcttcttaaaaaggagatcgattcttttgccaaggcgctcgctagtccgcttaagcctgtgcttttgatcgtgggaggatccaaggtctcttctaaaatcactctccttagcaacatccttgatgtggtcgataagattgtgattggtggggcgatgagtaacaccttcttgaagtcgctaggctatgatatgcagcgatcactagtggaagatcctcttgttcctgaagcggccaaaatcctagggctcgccaagcaaaaaggggtgaaaatttatcttcccgtggatgtggtttgcaccgatgacattaaaaatcccaaagagattaaaatcacccccgcccaagatgttcctgaaaacttccttgccgcggatattggacctgcaagcgtgaagctctttggcgaggtgattagggattgcgagacgatcatctggaatggacctatgggggtctatgaggtgcaaaacttctctcgaggaaccttccaattggcgcatgtggtggctgacacctatgcctatagcgtcattggagggggagatacggccgatgcgattgatagggcaggtgagaaagacaatatgagtttcacctccacggggggtggggcgagtttggagcttcttgaagggaagattcttcctgcttttgaggtgctagagcgaaaatag

SEQ ID NO: 10809 - protein, 401 aa, Wolinella succinogenes
MVAGINLMQETKSIRDVEIEGKRVLIRVDFNVPMDSDFNISDDTRIREAIPTINHCIDNGAKSIVLVSHLGRPRGKSSEFSLKHILKRLERLLNRSVIFVESLEGVSSVMATLPQKSVILLENIRFLEGEEKNDEKLSKNLASLCDIYINDAFGASHRKHASTYGVAKFAPVKVAGLLLKKEIDSFAKALASPLKPVLLIVGGSKVSSKITLLSNILDVVDKIVIGGAMSNTFLKSLGYDMQRSLVEDPLVPEAAKILGLAKQKGVKIYLPVDVVCTDDIKNPKEIKITPAQDVPENFLAADIGPASVKLFGEVIRDCETIIWNGPMGVYEVQNFSRGTFQLAHVVADTYAYSVIGGGDTADAIDRAGEKDNMSFTSTGGGASLELLEGKILPAFEVLERK

SEQ ID NO: 10810 - DNA, 1176 bp, Xanthomonas campestris
  CDS (1)..(1176)
atgtccattgtccgcatgaccgacctcgatctttccggcaagcgcgtgctgatccgccaggatctcaacgtgccgatcgacaacggccagatcacctccgaacagcgcatcaccgcctcggtgcccaccatcaagctggcgctggaaaagggcgccgcggtgatggtgacctcgcacctgggccgcccgaaggaaggcacctggagcgaggaagattcgctggcgccggtggccgcgcgactgaccaccctgctgggcttggacgtgccgctggtgcgtgactgggtcgatggcgtggacgtggcgccgggccaggtggtgctgctggaaaattgccgcatgaacgtgggcgagggcaaggatgacgaagcgctcgcgcgtaagtacgccgcgctgtgcgatgtgtttgtcatggacgccttcggcaccgcgcatcgtgcgcaggcctccacgcatggcgtgatccggttcgcgccggtggcagccggtggcccgctgctgatggccgagctcgacgcgctggccaaggcgctggacaacccggccaagccgctgctggcgatcgtggccggcagcaaggtttcgaccaagctggaactgctctccaacctggtcaacaaggtcgaccagttgatcgtgggcggcggcatcgccaataccttcatcgccgcggccggccacgacgtgggcaagtcgctcagcgagccggacctgatcccgaccgccaaccagatcgtcgccgatgccaaggcacgcggcgcggagattccgttgcccaccgacgtggtggtggccaagcagttcctgcccgatgccgaggcgagcgtgaagtcgctcgaccaggtggatgccgacgatctgatcctggacatcggcccgcagaccgcggcgcactatgccgaactgattgccaatgccggcaccgtggtctggaacggcccggtcggcgtgttcgagttcgagcccttcagccatggcaccgagaccctggcgcgtgccattgccgcgtccaaggcgttctcgatcgccggtggtggtgacacgttggcggccgtggacaaatacgccatcgccaaggacgtcacctacatctccaccggcggcggcgcgttcctggaatttctggaaggcaaaaccttgccggcggttgccgcgctcgaggcccgcgggcagtga

SEQ ID NO: 10811 - protein, 391 aa, Xanthomonas campestris
MSIVRMTDLDLSGKRVLIRQDLNVPIDNGQITSEQRITASVPTIKLALEKGAAVMVTSHLGRPKEGTWSEEDSLAPVAARLTTLLGLDVPLVRDWVDGVDVAPGQVVLLENCRMNVGEGKDDEALARKYAALCDVFVMDAFGTAHRAQASTHGVIRFAPVAAGGPLLMAELDALAKALDNPAKPLLAIVAGSKVSTKLELLSNLVNKVDQLIVGGGIANTFIAAAGHDVGKSLSEPDLIPTANQIVADAKARGAEIPLPTDVVVAKQFLPDAEASVKSLDQVDADDLILDIGPQTAAHYAELIANAGTVVWNGPVGVFEFEPFSHGTETLARAIAASKAFSIAGGGDTLAAVDKYAIAKDVTYISTGGGAFLEFLEGKTLPAVAALEARGQ

SEQ ID NO: 10812 - DNA, 1360 bp, Xanthobacter flavus
  CDS (56)..(1249)
cgacacggccgtcgccatgggcaagctgggctgaccgggaaaagggggcgccatcatgatcgccttccgcaccctcgatgacgccgtggacctcgccgacaagcgggtcctcgtccgtgtcgacctcaacgttcccatggagagcgggcgcgtcaccgacgccacccgtctcaaggccatcctgcccaccattcgggacatcaccggcaagggcggcaaggccgtcctgctggcgcacttagggcggcccaagggccgcgacgaaagccagtcgctcgcccccgtcgccaaggccctcgagggtgaactcggccgcaaggtcgcgttcgcctctgattgcatcggcgacgaggcgaagagcgccgtctcccgcctcgcctccggcgaggtgatcgtgctggagaacacccgcttccatgcgggcgaggagaagaacgcgccggacttcatcgaagccctcgcgagcctcggcgatatctatgtcaacgatgccttttccaccgcccaccgcgcgcacgcctccaccgaggggctggcccgcaagctgccggcctatgccggccgctccatggaaagcgagatcgaggcgctgaccaaggccctcgaggcgccccagcgccccgtgctcgccgtggtcggcggctccaaggtgtccagcaagctcgaactgctcggcaacctcgtgaagaaggtggacatcctcgtcatcggcggcggcatggccaacaccttcctcgccgctctcggcaagaaggtgggcaagtcgctctgcgagcacgacctggccaacaccgcgcgggacatcctgaagaaggccgaggcggccggatgcgagatcgtcctgccggtggacgcggtggtcgccaccgagttcaaggccaatgccgcgcaccgcgtcaccagcgtcgatgacgtgaaggacgacgagatgatgctggacgccggtccggagacggtcggcatcgtcaagcagaagctcgacggggcgaagacggtggtctggaacgggccgttcggcgcgttcgagatgacgccgttcgatgcggcgacggtggccgtggcccgctatgtcggcgacctcacccacaaggggcggttgctgtcggttgcgggcggcggcgacacggtggccgcgctgaaccatgcggggacggcggagcgcttctcctacgtctcgacggccggcggtgccttcctcgagtggctcgagggcaaggcgcttccgggcgtggaggccctgcggcgctgatattgcgctgcgggataaaatgacgaagattgcgcccgcccggccctccgcggcgggcgcttttcgggtagggcaccggtcgggaacccggtgctggctccgggacttgca

SEQ ID NO: 10813 - protein, 397 aa, Xanthobacter flavus
MIAFRTLDDAVDLADKRVLVRVDLNVPMESGRVTDATRLKAILPTIRDITGKGGKAVLLAHLGRPKGRDESQSLAPVAKALEGELGRKVAFASDCIGDEAKSAVSRLASGEVIVLENTRFHAGEEKNAPDFIEALASLGDIYVNDAFSTAHRAHASTEGLARKLPAYAGRSMESEIEALTKALEAPQRPVLAVVGGSKVSSKLELLGNLVKKVDILVIGGGMANTFLAALGKKVGKSLCEHDLANTARDILKKAEAAGCEIVLPVDAVVATEFKANAAHRVTSVDDVKDDEMMLDAGPETVGIVKQKLDGAKTVVWNGPFGAFEMTPFDAATVAVARYVGDLTHKGRLLSVAGGGDTVAALNHAGTAERFSYVSTAGGAFLEWLEGKALPGVEALRR

SEQ ID NO: 10814 - DNA, 1176 bp, Xylella fastidiosa
  CDS (1)..(1176)
atgtccatcgtccgcatgactgatctcgctttatccggtaaacgcgtactgattcgtcaggacttgaatgtaccgattgatcagggtcgtattacttccgagcagcgcattattgcttcgcttccgacgatccgtgtagcgctggagcgtggtgcggcggtcatggtgacttcgcatctgggccgtccgaaggagggcgtgtggagtgaggaggattcattggcacccgtggcgaagcgtttgtctcaattgttggggattgaggttccgttgcgtcgcgattgggtggatggcgtgcaggttgcgccagggcagttggtgttattggaaaactgccgaatgaatgtcggcgaagctgagaatgacgaggcgttggcaaggaagtatgcggcgttatgtgatgtgttcgtgatggatgcgtttggcactgcgcaccgtgcccaggcatcaacgcatggggtgatctgttgtgctgcgattgctgccggcggtccgttgttgatggctgagttggatgctttgagccggggattgaagcatccggtgaagccgctgctggcgattgtggggggcagtaaggtatcgacgaaattggagttgctttccaatttggtgaataacgttgagcaattgattacggggggaggcattgccaatacgttccttgccgcagccggttaccccatcggtaagtcactgtatgaggcggatttgatcgagactgctcgggagattattactgtggcgaaagcgcgtggcgctgagattccgttacccacggatgtggttgttgccaagcagtttttgcctggagtcacggcaacggtgaagacggtggatgcaatcgttgccgatgatcttattttggacattggtccgcagacggcacggcactatgctgccttgattgaaacggcggctacggtggtctggaatggtccagtgggtgtgtttgagttcgatgccttcagcaaggggaccgaggtgttagcgcgggccgttgctgcctcgtctgcgttttcgattgccggtggcggcgataccttggctgctattgataagtatggtgttgcggaccagatcagttacatctccacaggcggcggtgcttttctggagtttttggaaggtaagacgttgccggcggtggctgcgttgcaggcgcgcagcggataa

SEQ ID NO: 10815 - protein, 391 aa, Xylella fastidiosa
MSIVRMTDLALSGKRVLIRQDLNVPIDQGRITSEQRIIASLPTIRVALERGAAVMVTSHLGRPKEGVWSEEDSLAPVAKRLSQLLGIEVPLRRDWVDGVQVAPGQLVLLENCRMNVGEAENDEALARKYAALCDVFVMDAFGTAHRAQASTHGVICCAAIAAGGPLLMAELDALSRGLKHPVKPLLAIVGGSKVSTKLELLSNLVNNVEQLITGGGIANTFLAAAGYPIGKSLYEADLIETAREIITVAKARGAEIPLPTDVVVAKQFLPGVTATVKTVDAIVADDLILDIGPQTARHYAALIETAATVVWNGPVGVFEFDAFSKGTEVLARAVAASSAFSIAGGGDTLAAIDKYGVADQISYISTGGGAFLEFLEGKTLPAVAALQARSG

SEQ ID NO: 10816 - DNA, 1899 bp, Brachydanio rerio
  CDS (36)..(1289)
cccgggagagttttgaggcacaaaccacaggcaaaatgtctctttcgaacaaacttcatttggacaaggtggacgtgaaaggaaagcgggtgatcatgagggtggacttcaatgtccctatgaagaacaatgtgatcacaaataaccagagaatcaaggctgcagtaccatctatccagcactgtttagataattgtgccaaagctgtggtcctgatgagccacttgggccggcctgatggagtccctatgccagacaaatactctctggagcctgtggctgcagaactcaagaacctgctgggaaaagacgttcagttcctgaaagactgtgtgggtccagatgtggagaaagcctgtgcagaccctcctgcaggatctgtcattctgctggagaatctgcgctttcatgtggctgaggagggcaagggcaaagatgcatcgggtaacaagaccaaagcaagtcaggcagagatcgatgctttccgagcctccctgtccaaactgggtgacgtatacgtcaacgatgctttcggaactgcacatagagctcacagctctatggttggagtgaatctccctcagaaggctgctggttttctgatgaagaaagagctagactactttgccatggcccttgagaaaccacagaggcctttcttggccatcctcggaggggccaaggtcaaagataagattcagctgatcaacaacatgttggacaaggtgaatgagatgatcattggtggaggaatggcctttaccttcctcaaggttctcaagaacatggagatcggcacttccctgtttgatgaagagggttccacaattgtgaaagatctcatggccaaagcagaaaagaatggtgtaaagatcacacttccagtcgactttatcactgcagacaaattcgatgagaaggcgacaacagggaccgcaacggtagcagaaggtattcctgctggctggatgggtctagactgtggtcctgagagctcaaagctctatgcagaggctgtggccagagccaagcagattgtgtggaacggacccgttggcgtgttcgagtgggacaactttgctcatggaaccaagaacatgatggacaaagttgtagaagcgaccaaaaatggctgcatcaccattatcggtgggggagacacagctacctgctgtgccaagtgggacactgaggacaaggtcagccatgtgagcacagggggcggagccagtctggagctgctggagggtaaagtgctgcccggtgtcgatgccctcagtaacgtataagtgctttaaggctcttctgccagaggttgagtgatcgtctcccaagaagctgtcatccttacttagcgctttgttcagcacttctgtcacctcttggggatgcaaatgacaactactccactctctatgaacggccaacagtacatgctagactctgacccatactctttcagtttgcttttcttctgtcaaattactttaagaagtttccatcggcaaatggctgacgttggcagcaattagttgtgatggctctatttgagagatgggtcgtttgttttaccggagtaagtgttaatgtgtgtcccactgtagtctgaatgtgcgctttcggtgtaaacggttgtgttgtaattctaaagtttattacctgatatttgtggccttcccacagatgttgagttgttgttgtaatactgtagacactttcctccccataatgcacttgtcatcctcgacctgcagcttgtgagatagatgtttcgcactggaattttaatgaggggctaatgttagacccagaccacctgtcgtaaagtaaaaactaaaataataataattaaaatacatattataaaaactgtcaaaaaaaaaaaaaaaaaaaaaaaaa

SEQ ID NO: 10817 - protein, 417 aa, Brachydanio rerio
MSLSNKLHLDKVDVKGKRVIMRVDFNVPMKNNVITNNQRIKAAVPSIQHCLDNCAKAVVLMSHLGRPDGVPMPDKYSLEPVAAELKNLLGKDVQFLKDCVGPDVEKACADPPAGSVILLENLRFHVAEEGKGKDASGNKTKASQAEIDAFRASLSKLGDVYVNDAFGTAHRAHSSMVGVNLPQKAAGFLMKKELDYFAMALEKPQRPFLAILGGAKVKDKIQLINNMLDKVNEMIIGGGMAFTFLKVLKNMEIGTSLFDEEGSTIVKDLMAKAEKNGVKITLPVDFITADKFDEKATTGTATVAEGIPAGWMGLDCGPESSKLYAEAVARAKQIVWNGPVGVFEWDNFAHGTKNMMDKVVEATKNGCITIIGGGDTATCCAKWDTEDKVSHVSTGGGASLELLEGKVLPGVDALSNV

SEQ ID NO: 10818 - DNA, 1296 bp, Methanococcus maripaludis
  CDS (1)..(1296)
atgttacaaagaacgaatttaaccaaatcgcgaaaaaacggaggaataataatgtttttaactcttgacgactttgaattggaaggaaaaacggttgcattgagagttgacattaatagccctattgatgttaatactggagatattttagatgatacaaggattaaggcatgcagtgatacgataaaaagtctttcagaaaaaggagcaaaggttgttattttagcacaccagagcaggcctggaaaaaaagattttacgactcttgaagctcacgcgaaaaaactgtccgaagtattaaatatggaagttacacacgtagatggattaatctgcgcgtctgcacgtgaagcaattcttgcaatggataatggggaaataatacttcttgaaaacgtaaggcttcttgcagaagaagttttatccgattggaagtcttgggaagaaattactccagaaaaacaggctaaaacagtcatgattaagaaattacatccttttttcgattattttgttaacgatgcatttgcagcagctcacagggctcaaccttctcttgttggattttcttactatgttccaatgttatgcggaagggtcatggaaaaagaattatttacacttacaaaagttctcaaaaaccctgaaagaccttgcgtgtttgcattgggtggtgcaaaagctgacgacagtattgaagtattgaaaaacgttcttgaaaaacagaccgccgatcaggttttaacaagtggtgttgttgcaaatatctttttagttgcaaaaggttacaaaatcgggccaaatgaaaatgtaattgctgacatgggatacaccaaccagatagaaattgcaaaagagttaatttcaaaatatggggacaaaatcgtggttccaatcgatgcagcattaaatgtcgatggtgaacgggttgaaaaagaactcgacttaaacgaagaaataacttaccctattcacgacatgggcgaaaaaaccatgaaactctacgaagaaattttaaaagatgcaaaaacggttgttgcaaacggacctgctggagttttcgaaaataaaaatttcttaaaaggaacagaagaacttttaaaaagcactgcaaattcaaaaggcttttcggttatcggtggaggacacctctcagcagctgccgaagttgtagggttggcaggaaaaatggaccacatcagcactggtggcggtgcatgtatcgaatttttagctggtaaaaaacttcctgtaattgaaatgctgtccaaatcttacgaaaaacataaactttaa

SEQ ID NO: 10819 - protein, 431 aa, Methanococcus maripaludis
MLQRTNLTKSRKNGGIIMFLTLDDFELEGKTVALRVDINSPIDVNTGDILDDTRIKACSDTIKSLSEKGAKVVILAHQSRPGKKDFTTLEAHAKKLSEVLNMEVTHVDGLICASAREAILAMDNGEIILLENVRLLAEEVLSDWKSWEEITPEKQAKTVMIKKLHPFFDYFVNDAFAAAHRAQPSLVGFSYYVPMLCGRVMEKELFTLTKVLKNPERPCVFALGGAKADDSIEVLKNVLEKQTADQVLTSGVVANIFLVAKGYKIGPNENVIADMGYTNQIEIAKELISKYGDKIVVPIDAALNVDGERVEKELDLNEEITYPIHDMGEKTMKLYEEILKDAKTVVANGPAGVFENKNFLKGTEELLKSTANSKGFSVIGGGHLSAAAEVVGLAGKMDHISTGGGACIEFLAGKKLPVIEMLSKSYEKHKL

SEQ ID NO: 10820 - DNA, 22 bp, artificial sequence
  primer
atgtctgtaattaagatgaccg

SEQ ID NO: 10821 - DNA, 23 bp, artificial sequence
  primer
ttacttcttagcgcgctcttcga

SEQ ID NO: 10822 - DNA, 2374 bp, Escherichia coli K12; identical to SEQ ID NO: 1805
  CDS (86)..(2281)

SEQ ID NO: 10823 - protein, 731 aa, Escherichia coli K12; identical to SEQ ID NO: 1806

SEQ ID NO: 10824 - DNA, 2961 bp, Hafnia alvei; identical to SEQ ID NO: 1807
  CDS (185)..(2404)

SEQ ID NO: 10825 - protein, 739 aa, Hafnia alvei; identical to SEQ ID NO: 1808

SEQ ID NO: 10826 - DNA, 4341 bp, Escherichia coli; identical to SEQ ID NO: 1809
  CDS (660)..(2858)

SEQ ID NO: 10827 - protein, 732 aa, Escherichia coli; identical to SEQ ID NO: 1810

SEQ ID NO: 10828 - DNA, 1850 bp, Bacillus subtilis; identical to SEQ ID NO: 1811
  CDS (312)..(1784)

SEQ ID NO: 10829 - protein, 490 aa, Bacillus subtilis; identical to SEQ ID NO: 1812

SEQ ID NO: 10830 - DNA, 3091 bp, Lactobacillus sp; identical to SEQ ID NO: 1813
  CDS (572)..(2767)

SEQ ID NO: 10831 - protein, 731 aa, Lactobacillus sp; identical to SEQ ID NO: 1814

SEQ ID NO: 10832 - DNA, 1449 bp, Bacillus halodurans; identical to SEQ ID NO: 1815
  CDS (1)..(1449)

SEQ ID NO: 10833 - protein, 482 aa, Bacillus halodurans; identical to SEQ ID NO: 1816

SEQ ID NO: 10834 - DNA, 2196 bp, Sinorhizobium meliloti; identical to SEQ ID NO: 1817
  CDS (1)..(2196)

SEQ ID NO: 10835 - protein, 731 aa, Sinorhizobium meliloti; identical to SEQ ID NO: 1818

SEQ ID NO: 10836 - DNA, 1380 bp, Listeria innocua; identical to SEQ ID NO: 1819
  CDS (1)..(1380)

SEQ ID NO: 10837 - protein, 459 aa, Listeria innocua; identical to SEQ ID NO: 1820

SEQ ID NO: 10838 - DNA, 2307 bp, Yersinia pestis; identical to SEQ ID NO: 1821
  CDS (1)..(2307)

SEQ ID NO: 10839 - protein, 768 aa, Yersinia pestis; identical to SEQ ID NO: 1822

SEQ ID NO: 10840 - DNA, 2145 bp, Salmonella enterica subsp. enterica serovar Typhi; identical to SEQ ID NO: 1823
  CDS (1)..(2145)

SEQ ID NO: 10841 - protein, 714 aa, Salmonella enterica subsp. enterica serovar Typhi; identical to SEQ ID NO: 1824

SEQ ID NO: 10842 - DNA, 1467 bp, Nostoc sp. PCC 7120; identical to SEQ ID NO: 1825
  CDS (1)..(1467)

SEQ ID NO: 10843 - protein, 488 aa, Nostoc sp. PCC 7120; identical to SEQ ID NO: 1826

SEQ ID NO: 10844 - DNA, 2163 bp, Yersinia pestis; identical to SEQ ID NO: 1827
  CDS (1)..(2163)

SEQ ID NO: 10845 - protein, 720 aa, Yersinia pestis; identical to SEQ ID NO: 1828

SEQ ID NO: 10846 - DNA, 2271 bp, Salmonella enterica subsp. enterica serovar Typhi; identical to SEQ ID NO: 1829
  CDS (1)..(2271)

SEQ ID NO: 10847 - protein, 756 aa, Salmonella enterica subsp. enterica serovar Typhi; identical to SEQ ID NO: 1830

SEQ ID NO: 10848 - DNA, 2148 bp, Escherichia coli; identical to SEQ ID NO: 1831
  CDS (1)..(2148)

SEQ ID NO: 10849 - protein, 715 aa, Escherichia coli; identical to SEQ ID NO: 1832

SEQ ID NO: 10850 - DNA, 2835 bp, Escherichia coli; identical to SEQ ID NO: 1833
  CDS (571)..(2712)

SEQ ID NO: 10851 - protein, 713 aa, Escherichia coli; identical to SEQ ID NO: 1834

SEQ ID NO: 10852 - DNA, 1446 bp, Clostridium acetobutylicum; identical to SEQ ID NO: 1835
  CDS (1)..(1446)

SEQ ID NO: 10853 - protein, 481 aa, Clostridium acetobutylicum; identical to SEQ ID NO: 1836

SEQ ID NO: 10854 - DNA, 1464 bp, Clostridium acetobutylicum; identical to SEQ ID NO: 1837
  CDS (1)..(1464)

SEQ ID NO: 10855 - protein, 487 aa, Clostridium acetobutylicum; identical to SEQ ID NO: 1838

SEQ ID NO: 10856 - DNA, 2256 bp, Pseudomonas aeruginosa; identical to SEQ ID NO: 1839
  CDS (1)..(2256)

SEQ ID NO: 10857 - protein, 751 aa, Pseudomonas aeruginosa; identical to SEQ ID NO: 1840

SEQ ID NO: 10858 - DNA, 2853 bp, Mycobacterium leprae; identical to SEQ ID NO: 1841
  CDS (1)..(2853)

SEQ ID NO: 10859 - protein, 950 aa, Mycobacterium leprae; identical to SEQ ID NO: 1842

SEQ ID NO: 10860 - DNA, 2202 bp, Vibrio cholerae; identical to SEQ ID NO: 1843
  CDS (1)..(2202)

SEQ ID NO: 10861 - protein, 733 aa, Vibrio cholerae; identical to SEQ ID NO: 1844

SEQ ID NO: 10862 - DNA, 2163 bp, Vibrio cholerae; identical to SEQ ID NO: 1845
  CDS (1)..(2163)

SEQ ID NO: 10863 - protein, 720 aa, Vibrio cholerae; identical to SEQ ID NO: 1846

SEQ ID NO: 10864 - DNA, 2163 bp, Haemophilus influenzae; identical to SEQ ID NO: 1847
  CDS (1)..(2163)

SEQ ID NO: 10865 - protein, 720 aa, Haemophilus influenzae; identical to SEQ ID NO: 1848

SEQ ID NO: 10866 - DNA, 2844 bp, Mycobacterium tuberculosis; identical to SEQ ID NO: 1849
  CDS (1)..(2844)

SEQ ID NO: 10867 - protein, 947 aa, Mycobacterium tuberculosis; identical to SEQ ID NO: 1850

SEQ ID NO: 10868 - DNA, 1476 bp, Streptococcus pneumoniae; identical to SEQ ID NO: 1851
  CDS (1)..(1476)

SEQ ID NO: 10869 - protein, 491 aa, Streptococcus pneumoniae; identical to SEQ ID NO: 1852

SEQ ID NO: 10870 - DNA, 1476 bp, Bacillus halodurans; identical to SEQ ID NO: 1853
  CDS (1)..(1476)

SEQ ID NO: 10871 - protein, 491 aa, Bacillus halodurans; identical to SEQ ID NO: 1854

SEQ ID NO: 10872 - DNA, 2349 bp, Sinorhizobium meliloti; identical to SEQ ID NO: 1855
  CDS (1)..(2349)

SEQ ID NO: 10873 - protein, 782 aa, Sinorhizobium meliloti; identical to SEQ ID NO: 1856

SEQ ID NO: 10874 - DNA, 1476 bp, Streptococcus pneumoniae; identical to SEQ ID NO: 1857
  CDS (1)..(1476)

SEQ ID NO: 10875 - protein, 491 aa, Streptococcus pneumoniae; identical to SEQ ID NO: 1858

SEQ ID NO: 10876 - DNA, 2271 bp, Escherichia coli; identical to SEQ ID NO: 1859
  CDS (1)..(2271)

SEQ ID NO: 10877 - protein, 756 aa, Escherichia coli; identical to SEQ ID NO: 1860

SEQ ID NO: 10878 - DNA, 1443 bp, Bacillus subtilis; identical to SEQ ID NO: 1861
  CDS (1)..(1443)

SEQ ID NO: 10879 - protein, 480 aa, Bacillus subtilis; identical to SEQ ID NO: 1862

SEQ ID NO: 10880 - DNA, 1452 bp, Synechocystis sp; identical to SEQ ID NO: 1863
  CDS (1)..(1452)

SEQ ID NO: 10881 - protein, 483 aa, Synechocystis sp; identical to SEQ ID NO: 1864

SEQ ID NO: 10882 - DNA, 2307 bp, Yersinia pseudotuberculosis IP 32953; identical to SEQ ID NO: 1865
  CDS (1)..(2307)

SEQ ID NO: 10883 - protein, 768 aa, Yersinia pseudotuberculosis IP 32953; identical to SEQ ID NO: 1866

SEQ ID NO: 10884 - DNA, 1467 bp, Symbiobacterium thermophilum; identical to SEQ ID NO: 1867
  CDS (1)..(1467)

SEQ ID NO: 10885 - protein, 488 aa, Symbiobacterium thermophilum; identical to SEQ ID NO: 1868

SEQ ID NO: 10886 - DNA, 1410 bp, Symbiobacterium thermophilum; identical to SEQ ID NO: 1869
  CDS (1)..(1410)

SEQ ID NO: 10887 - protein, 469 aa, Symbiobacterium thermophilum; identical to SEQ ID NO: 1870

SEQ ID NO: 10888 - DNA, 2154 bp, Erwinia carotovora; identical to SEQ ID NO: 1871
  CDS (1)..(2154)

SEQ ID NO: 10889 - protein, 717 aa, Erwinia carotovora; identical to SEQ ID NO: 1872

SEQ ID NO: 10890 - DNA, 2790 bp, Acinetobacter sp; identical to SEQ ID NO: 1873
  CDS (1)..(2790)

SEQ ID NO: 10891 - protein, 929 aa, Acinetobacter sp; identical to SEQ ID NO: 1874

SEQ ID NO: 10892 - DNA, 1482 bp, Bacillus thuringiensis; identical to SEQ ID NO: 1875
  CDS (1)..(1482)

SEQ ID NO: 10893 - protein, 493 aa, Bacillus thuringiensis; identical to SEQ ID NO: 1876

SEQ ID NO: 10894 - DNA, 1422 bp, Bacillus thuringiensis; identical to SEQ ID NO: 1877
  CDS (1)..(1422)

SEQ ID NO: 10895 - protein, 473 aa, Bacillus thuringiensis; identical to SEQ ID NO: 1878

SEQ ID NO: 10896 - DNA, 2358 bp, Rhodopseudomonas palustris; identical to SEQ ID NO: 1879
  CDS (1)..(2358)

SEQ ID NO: 10897 - protein, 785 aa, Rhodopseudomonas palustris; identical to SEQ ID NO: 1880

SEQ ID NO: 10898 - DNA, 2837 bp, Shigella boydii; identical to SEQ ID NO: 1881
  CDS (165)..(2435)

SEQ ID NO: 10899 - protein, 756 aa, Shigella boydii; identical to SEQ ID NO: 1882

SEQ ID NO: 10900 - DNA, 1380 bp, Listeria monocytogenes; identical to SEQ ID NO: 1883
  CDS (1)..(1380)

SEQ ID NO: 10901 - protein, 459 aa, Listeria monocytogenes; identical to SEQ ID NO: 1884

SEQ ID NO: 10902 - DNA, 1482 bp, Bacillus cereus; identical to SEQ ID NO: 1885
  CDS (1)..(1482)

SEQ ID NO: 10903 - protein, 493 aa, Bacillus cereus; identical to SEQ ID NO: 1886

SEQ ID NO: 10904 - DNA, 1422 bp, Bacillus cereus; identical to SEQ ID NO: 1887
  CDS (1)..(1422)

SEQ ID NO: 10905 - protein, 473 aa, Bacillus cereus; identical to SEQ ID NO: 1888

SEQ ID NO: 10906 - DNA, 1458 bp, Mycobacterium paratuberculosis; identical to SEQ ID NO: 1889
  CDS (1)..(1458)

SEQ ID NO: 10907 - protein, 485 aa, Mycobacterium paratuberculosis; identical to SEQ ID NO: 1890

SEQ ID NO: 10908 - DNA, 2853 bp, Mycobacterium paratuberculosis; identical to SEQ ID NO: 1891
  CDS (1)..(2853)

SEQ ID NO: 10909 - protein, 950 aa, Mycobacterium paratuberculosis; identical to SEQ ID NO: 1892

SEQ ID NO: 10910 - DNA, 2100 bp, Lactobacillus johnsonii; identical to SEQ ID NO: 1893
  CDS (1)..(2100)

SEQ ID NO: 10911 - protein, 699 aa, Lactobacillus johnsonii; identical to SEQ ID NO: 1894

SEQ ID NO: 10912 - DNA, 3625 bp, Vibrio parahaemolyticus; identical to SEQ ID NO: 1895
  CDS (1451)..(3625)

SEQ ID NO: 10913 - protein, 724 aa, Vibrio parahaemolyticus; identical to SEQ ID NO: 1896

SEQ ID NO: 10914 - DNA, 2142 bp, Shigella flexneri; identical to SEQ ID NO: 1897
  CDS (1)..(2142)

SEQ ID NO: 10915 - protein, 713 aa, Shigella flexneri; identical to SEQ ID NO: 1898

SEQ ID NO: 10916 - DNA, 2181 bp, Vibrio vulnificus; identical to SEQ ID NO: 1899
  CDS (1)..(2181)

SEQ ID NO: 10917 - protein, 726 aa, Vibrio vulnificus; identical to SEQ ID NO: 1900

SEQ ID NO: 10918 - DNA, 2307 bp, Photorhabdus luminescens; identical to SEQ ID NO: 1901
  CDS (1)..(2307)

SEQ ID NO: 10919 - protein, 768 aa, Photorhabdus luminescens; identical to SEQ ID NO: 1902

SEQ ID NO: 10920 - DNA, 1404 bp, Gloeobacter violaceus; identical to SEQ ID NO: 1903
  CDS (1)..(1404)

SEQ ID NO: 10921 - protein, 467 aa, Gloeobacter violaceus; identical to SEQ ID NO: 1904

SEQ ID NO: 10922 - DNA, 2259 bp, Chromobacterium violaceum; identical to SEQ ID NO: 1905
  CDS (1)..(2259)

SEQ ID NO: 10923 - protein, 752 aa, Chromobacterium violaceum; identical to SEQ ID NO: 1906

SEQ ID NO: 10924 - DNA, 1251 bp, Chromobacterium violaceum; identical to SEQ ID NO: 1907
  CDS (1)..(1251)

SEQ ID NO: 10925 - protein, 416 aa, Chromobacterium violaceum; identical to SEQ ID NO: 1908

SEQ ID NO: 10926 - DNA, 2352 bp, Fusobacterium nucleatum subsp; identical to SEQ ID NO: 1909
  CDS (1)..(2352)

SEQ ID NO: 10927 - protein, 783 aa, Fusobacterium nucleatum subsp; identical to SEQ ID NO: 1910

SEQ ID NO: 10928 - DNA, 2196 bp, Shigella flexneri; identical to SEQ ID NO: 1911
  CDS (1)..(2196)

SEQ ID NO: 10929 - protein, 731 aa, Shigella flexneri; identical to SEQ ID NO: 1912

SEQ ID NO: 10930 - DNA, 2271 bp, Bordetella pertussis; identical to SEQ ID NO: 1913
  CDS (1)..(2271)

SEQ ID NO: 10931 - protein, 756 aa, Bordetella pertussis; identical to SEQ ID NO: 1914

SEQ ID NO: 10932 - DNA, 2271 bp, Bordetella parapertussis; identical to SEQ ID NO: 1915
  CDS (1)..(2271)

SEQ ID NO: 10933 - protein, 756 aa, Bordetella parapertussis; identical to SEQ ID NO: 1916

SEQ ID NO: 10934 - DNA, 1422 bp, Bacillus cereus; identical to SEQ ID NO: 1917
  CDS (1)..(1422)

SEQ ID NO: 10935 - protein, 473 aa, Bacillus cereus; identical to SEQ ID NO: 1918

SEQ ID NO: 10936 - DNA, 1422 bp, Bacillus anthracis; identical to SEQ ID NO: 1919
  CDS (1)..(1422)

SEQ ID NO: 10937 - protein, 473 aa, Bacillus anthracis; identical to SEQ ID NO: 1920

SEQ ID NO: 10938 - DNA, 2271 bp, Shigella flexneri; identical to SEQ ID NO: 1921
  CDS (1)..(2271)

SEQ ID NO: 10939 - protein, 756 aa, Shigella flexneri; identical to SEQ ID NO: 1922

SEQ ID NO: 10940 - DNA, 2136 bp, Shigella flexneri; identical to SEQ ID NO: 1923
  CDS (1)..(2136)

SEQ ID NO: 10941 - protein, 711 aa, Shigella flexneri; identical to SEQ ID NO: 1924

SEQ ID NO: 10942 - DNA, 2127 bp, Escherichia coli; identical to SEQ ID NO: 1925
  CDS (1)..(2127)

SEQ ID NO: 10943 - protein, 708 aa, Escherichia coli; identical to SEQ ID NO: 1926

SEQ ID NO: 10944 - DNA, 1563 bp, Oryza sativa; identical to SEQ ID NO: 1927
  CDS (1)..(1563)

SEQ ID NO: 10945 - protein, 520 aa, Oryza sativa; identical to SEQ ID NO: 1928

SEQ ID NO: 10946 - DNA, 2181 bp, Vibrio parahaemolyticus; identical to SEQ ID NO: 1929
  CDS (1)..(2181)

SEQ ID NO: 10947 - protein, 726 aa, Vibrio parahaemolyticus; identical to SEQ ID NO: 1930

SEQ ID NO: 10948 - DNA, 4026 bp, Vibrio parahaemolyticus; identical to SEQ ID NO: 1931
  CDS (1779)..(3914)

SEQ ID NO: 10949 - protein, 711 aa, Vibrio parahaemolyticus; identical to SEQ ID NO: 1932

SEQ ID NO: 10950 - DNA, 1461 bp, Clostridium tetani; identical to SEQ ID NO: 1933
  CDS (1)..(1461)

SEQ ID NO: 10951 - protein, 486 aa, Clostridium tetani; identical to SEQ ID NO: 1934

SEQ ID NO: 10952 - DNA, 1416 bp, Clostridium tetani; identical to SEQ ID NO: 1935
  CDS (1)..(1416)

SEQ ID NO: 10953 - protein, 471 aa, Clostridium tetani; identical to SEQ ID NO: 1936

SEQ ID NO: 10954 - DNA, 2766 bp, Bradyrhizobium japonicum; identical to SEQ ID NO: 1937
  CDS (1)..(2766)

SEQ ID NO: 10955 - protein, 921 aa, Bradyrhizobium japonicum; identical to SEQ ID NO: 1938

SEQ ID NO: 10956 - DNA, 2517 bp, Bradyrhizobium japonicum; identical to SEQ ID NO: 1939
  CDS (1)..(2517)

SEQ ID NO: 10957 - protein, 838 aa, Bradyrhizobium japonicum; identical to SEQ ID NO: 1940

SEQ ID NO: 10958 - DNA, 2181 bp, Vibrio vulnificus; identical to SEQ ID NO: 1941
  CDS (1)..(2181)

SEQ ID NO: 10959 - protein, 726 aa, Vibrio vulnificus; identical to SEQ ID NO: 1942

SEQ ID NO: 10960 - DNA, 2109 bp, Vibrio vulnificus; identical to SEQ ID NO: 1943
  CDS (1)..(2109)

SEQ ID NO: 10961 - protein, 702 aa, Vibrio vulnificus; identical to SEQ ID NO: 1944

SEQ ID NO: 10962 - DNA, 2163 bp, Shewanella oneidensis; identical to SEQ ID NO: 1945
  CDS (1)..(2163)

SEQ ID NO: 10963 - protein, 720 aa, Shewanella oneidensis; identical to SEQ ID NO: 1946

SEQ ID NO: 10964 - DNA, 1419 bp, Oceanobacillus iheyensis; identical to SEQ ID NO: 1947
  CDS (1)..(1419)

SEQ ID NO: 10965 - protein, 472 aa, Oceanobacillus iheyensis; identical to SEQ ID NO: 1948

SEQ ID NO: 10966 - DNA, 2154 bp, Escherichia coli O6; identical to SEQ ID NO: 1949
  CDS (1)..(2154)

SEQ ID NO: 10967 - protein, 717 aa, Escherichia coli O6; identical to SEQ ID NO: 1950

SEQ ID NO: 10968 - DNA, 2271 bp, Escherichia coli O6; identical to SEQ ID NO: 1951
  CDS (1)..(2271)

SEQ ID NO: 10969 - protein, 756 aa, Escherichia coli O6; identical to SEQ ID NO: 1952

SEQ ID NO: 10970 - DNA, 2370 bp, Escherichia coli O6; identical to SEQ ID NO: 1953
  CDS (1)..(2370)

SEQ ID NO: 10971 - protein, 789 aa, Escherichia coli O6; identical to SEQ ID NO: 1954

SEQ ID NO: 10972 - DNA, 2136 bp, Escherichia coli O6; identical to SEQ ID NO: 1955
  CDS (1)..(2136)

SEQ ID NO: 10973 - protein, 711 aa, Escherichia coli O6; identical to SEQ ID NO: 1956

SEQ ID NO: 10974 - DNA, 2208 bp, Escherichia coli O6; identical to SEQ ID NO: 1957
  CDS (1)..(2208)

SEQ ID NO: 10975 - protein, 735 aa, Escherichia coli O6; identical to SEQ ID NO: 1958

SEQ ID NO: 10976 - DNA, 2142 bp, Escherichia coli O6; identical to SEQ ID NO: 1959
  CDS (1)..(2142)

SEQ ID NO: 10977 - protein, 713 aa, Escherichia coli O6; identical to SEQ ID NO: 1960

SEQ ID NO: 10978 - DNA, 1488 bp, Thermoanaerobacter tengcongensis; identical to SEQ ID NO: 1961
  CDS (1)..(1488)

SEQ ID NO: 10979 - protein, 495 aa, Thermoanaerobacter tengcongensis; identical to SEQ ID NO: 1962

SEQ ID NO: 10980 - DNA, 1419 bp, Thermoanaerobacter tengcongensis; identical to SEQ ID NO: 1963
  CDS (1)..(1419)

SEQ ID NO: 10981 - protein, 472 aa, Thermoanaerobacter tengcongensis; identical to SEQ ID NO: 1964

SEQ ID NO: 10982 - DNA, 2352 bp, Fusobacterium nucleatum; identical to SEQ ID NO: 1965
  CDS (1)..(2352)

SEQ ID NO: 10983 - protein, 783 aa, Fusobacterium nucleatum; identical to SEQ ID NO: 1966

SEQ ID NO: 10984 - DNA, 1431 bp, Clostridium perfringens; identical to SEQ ID NO: 1967
  CDS (1)..(1431)

SEQ ID NO: 10985 - protein, 476 aa, Clostridium perfringens; identical to SEQ ID NO: 1968

SEQ ID NO: 10986 - DNA, 1455 bp, Clostridium perfringens; identical to SEQ ID NO: 1969
  CDS (1)..(1455)

SEQ ID NO: 10987 - protein, 484 aa, Clostridium perfringens; identical to SEQ ID NO: 1970

SEQ ID NO: 10988 - DNA, 2280 bp, Ralstonia solanacearum; identical to SEQ ID NO: 1971
  CDS (1)..(2280)

SEQ ID NO: 10989 - protein, 759 aa, Ralstonia solanacearum; identical to SEQ ID NO: 1972

SEQ ID NO: 10990 - DNA, 2271 bp, Salmonella typhimurium; identical to SEQ ID NO: 1973
  CDS (1)..(2271)

SEQ ID NO: 10991 - protein, 756 aa, Salmonella typhimurium; identical to SEQ ID NO: 1974

SEQ ID NO: 10992 - DNA, 2136 bp, Salmonella typhimurium; identical to SEQ ID NO: 1975
  CDS (1)..(2136)

SEQ ID NO: 10993 - protein, 711 aa, Salmonella typhimurium; identical to SEQ ID NO: 1976

SEQ ID NO: 10994 - DNA, 2199 bp, Salmonella typhimurium; identical to SEQ ID NO: 1977
  CDS (1)..(2199)

SEQ ID NO: 10995 - protein, 732 aa, Salmonella typhimurium; identical to SEQ ID NO: 1978

SEQ ID NO: 10996 - DNA, 2142 bp, Salmonella typhimurium; identical to SEQ ID NO: 1979
  CDS (1)..(2142)

SEQ ID NO: 10997 - protein, 713 aa, Salmonella typhimurium; identical to SEQ ID NO: 1980

SEQ ID NO: 10998 - DNA, 2136 bp, Vibrio vulnificus; identical to SEQ ID NO: 1981
  CDS (1)..(2136)

SEQ ID NO: 10999 - protein, 711 aa, Vibrio vulnificus; identical to SEQ ID NO: 1982

SEQ ID NO: 11000 - DNA, 2163 bp, Pasteurella multocida; identical to SEQ ID NO: 1983
  CDS (1)..(2163)

SEQ ID NO: 11001 - protein, 720 aa, Pasteurella multocida; identical to SEQ ID NO: 1984

SEQ ID NO: 11002 - DNA, 2139 bp, Moritella japonica; identical to SEQ ID NO: 1985
  CDS (1)..(2139)

SEQ ID NO: 11003 - protein, 712 aa, Moritella japonica; identical to SEQ ID NO: 1986

SEQ ID NO: 11004 - DNA, 1479 bp, Streptomyces coelicolor; identical to SEQ ID NO: 1987
  CDS (1)..(1479)

SEQ ID NO: 11005 - protein, 492 aa, Streptomyces coelicolor; identical to SEQ ID NO: 1988

SEQ ID NO: 11006 - DNA, 2130 bp, Eikenella corrodens; identical to SEQ ID NO: 1989
  CDS (1)..(2130)

SEQ ID NO: 11007 - protein, 709 aa, Eikenella corrodens; identical to SEQ ID NO: 1990

SEQ ID NO: 11008 - DNA, 2271 bp, Escherichia coli; identical to SEQ ID NO: 1859
  CDS (4)..(2271)

SEQ ID NO: 11009 - protein, 755 aa, Escherichia coli; identical to SEQ ID NO: 1992

SEQ ID NO: 11010 - DNA, 2196 bp, Lactobacillus sp; identical to SEQ ID NO: 1993
  CDS (1)..(2196)

SEQ ID NO: 11011 - protein, 731 aa, Lactobacillus sp; identical to SEQ ID NO: 1814

SEQ ID NO: 11012 - DNA, 1482 bp, Bacillus anthracis; identical to SEQ ID NO: 1995
  CDS (1)..(1482)

SEQ ID NO: 11013 - protein, 493 aa, Bacillus anthracis; identical to SEQ ID NO: 1996

SEQ ID NO: 11014 - DNA, 1383 bp, Bacillus cereus; identical to SEQ ID NO: 1997
  CDS (1)..(1383)

SEQ ID NO: 11015 - protein, 460 aa, Bacillus cereus; identical to SEQ ID NO: 1998

SEQ ID NO: 11016 - DNA, 20 bp, Primer
atggggcagggttttccacc

SEQ ID NO: 11017 - DNA, 25 bp, Primer
ttacttcaacacataaccgtacaac

SEQ ID NO: 11018 - DNA, 2280 bp, Escherichia coli K12
  CDS (470)..(1951)
gctgcatcagcacgaaattcttaaagccctggttacgtaccagtgacataccgataactgacgtgaatataaccagcacgagggtcagcaatacccccaatacatgggcaacctgaataaagattgaaatctcaatatagacataaaggaaaatggcaataaaaggtaaccagcgcaaaggtttctcctgtaatagcagccggttaaccccggctacctgaatgggttgcgaatcgcgtttagcttatattgtggtcattagcaaaatttcaagatgtttgcgcaactatttttggtagtaatcccaaagcggtgatctatttcacaaattaataattaaggggtaaaaaccgacacttaaagtgatccagattacggtagaaatcctcaagcagcatatgatctcgggtattcggtcgatgcaggggataatcgtcggtcgaaaaacattcgaaaccacatatattctatgtgtttaaagcaaatcattggcagcttgaaaaagaaggttcacatgtcaaacaacattcgtatcgaagaagatctgttgggtaccagggaagttccagctgatgcctactatggtgttcacactctgagagcgattgaaaacttctatatcagcaacaacaaaatcagtgatattcctgaatttgttcgcggtatggtaatggttaaaaaagccgcagctatggcaaacaaagagctgcaaaccattcctaaaagtgtagcgaatgccatcattgccgcatgtgatgaagtcctgaacaacggaaaatgcatggatcagttcccggtagacgtctaccagggcggcgcaggtacttccgtaaacatgaacaccaacgaagtgctggccaatatcggtctggaactgatgggtcaccaaaaaggtgaatatcagtacctgaacccgaacgaccatgttaacaaatgtcagtccactaacgacgcctacccgaccggtttccgtatcgcagtttactcttccctgattaagctggtagatgcgattaaccaactgcgtgaaggctttgaacgtaaagctgtcgaattccaggacatcctgaaaatgggtcgtacccagctgcaggacgcagtaccgatgaccctcggtcaggaattccgcgctttcagcatcctgctgaaagaagaagtgaaaaacatccaacgtaccgctgaactgctgctggaagttaaccttggtgcaacagcaatcggtactggtctgaacacgccgaaagagtactctccgctggcagtgaaaaaactggctgaagttactggcttcccatgcgtaccggctgaagacctgatcgaagcgacctctgactgcggcgcttatgttatggttcacggcgcgctgaaacgcctggctgtgaagatgtccaaaatctgtaacgacctgcgcttgctctcttcaggcccacgtgccggcctgaacgagatcaacctgccggaactgcaggcgggctcttccatcatgccagctaaagtaaacccggttgttccggaagtggttaaccaggtatgcttcaaagtcatcggtaacgacaccactgttaccatggcagcagaagcaggtcagctgcagttgaacgttatggagccggtcattggccaggccatgttcgaatccgttcacattctgaccaacgcttgctacaacctgctggaaaaatgcattaacggcatcactgctaacaaagaagtgtgcgaaggttacgtttacaactctatcggtatcgttacttacctgaacccgttcatcggtcaccacaacggtgacatcgtgggtaaaatctgtgccgaaaccggtaagagtgtacgtgaagtcgttctggaacgcggtctgttgactgaagcggaacttgacgatattttctccgtacagaatctgatgcacccggcttacaaagcaaaacgctatactgatgaaagcgaacagtaatcgtacagggtagtacaaataaaaaaggcacgtcagatgacgtgccttttttcttgtgagcagtaacttaaaaataacaatctaatatcaacttgttaaaaaacaaggaaggctaatatgctagttgtagaactcatcatagttttgctggcgatcttcttgggcgccagattggggggaataggtattggttttgcaggcggattgggggtgctggttcttgccgctattggcgttaaacccggtaacatcccgttcgatgtcatctccattatcatggcggttatcgccgctatttctgccatgcaggttgctggcggtctggacta

SEQ ID NO: 11019 - protein, 493 aa, Escherichia coli K12
MCLKQIIGSLKKKVHMSNNIRIEEDLLGTREVPADAYYGVHTLRAIENFYISNNKISDIPEFVRGMVMVKKAAAMANKELQTIPKSVANAIIAACDEVLNNGKCMDQFPVDVYQGGAGTSVNMNTNEVLANIGLELMGHQKGEYQYLNPNDHVNKCQSTNDAYPTGFRIAVYSSLIKLVDAINQLREGFERKAVEFQDILKMGRTQLQDAVPMTLGQEFRAFSILLKEEVKNIQRTAELLLEVNLGATAIGTGLNTPKEYSPLAVKKLAEVTGFPCVPAEDLIEATSDCGAYVMVHGALKRLAVKMSKICNDLRLLSSGPRAGLNEINLPELQAGSSIMPAKVNPVVPEVVNQVCFKVIGNDTTVTMAAEAGQLQLNVMEPVIGQAMFESVHILTNACYNLLEKCINGITANKEVCEGYVYNSIGIVTYLNPFIGHHNGDIVGKICAETGKSVREVVLERGLLTEAELDDIFSVQNLMHPAYKAKRYTDESEQ

SEQ ID NO: 11020 - DNA, 1770 bp, Arabidopsis thaliana
  CDS (84)..(1559)
gtcgccacgcgccgacttgatccgtcgtcttctctcagtctccatctccgtcttccaagttttactgtcaggcagaagaatccatgtcgatttacgtcgcgtcggcactctccggcggaacaactgtgacggcgctgcgttatgccacctctctgagatcttattcgacctcgtttagggaggagagggacaccttcgggccgattcaagttccttccgataaattgtggggagcccagacgcagagatcgctgcagaacttcgaaatcggtggtgagcgcgagcgcatgcctgaaccaattgtccgcgcttttggcgtcttgaagaaatgcgctgccaaggttaacatggaatacggtcttgatccgacgattgggaaagcaattatgcaagctgctcaggaagtagctgagggaaagctcaatgatcatttcccccttgttgtctggcaaactggtagtgggactcagagtaatatgaatgctaatgaggtcattgctaatagagcagctgagattcttggtcgcaaacgtggtgagaaatgtgtgcacccaaatgaccatgtgaacagatcacaatcttctaacgacacttttcctaccgtcatgcacattgcagctgcaaccgagattaattcgaggctcatccctagtttaaaaactttgcatcgcactttggaatctaagtccttcgagttcaaagatattgtgaaaattggaagaactcacactcaagatgctacacctttgacactaggacaggaatttggtggctatgctactcaagttaagtacggactaaatagagtcacctgcactcttcctcgcctctatcagcttgcacaaggtggaactgcggttgggacaggattaaacactaagaaagggtttgatgtaaagatagctgctgcagtagctgaagaaacaaacttgccatttgtcactgcagaaaacaagtttgaagctctggctgcacacgatgcttgtgttgaaaccagtgggtcacttaacacaatcgccacatcgctgatgaagatcgccaatgatatacgttttcttggaagtggcccaagatgtggtcttggtgaacttgtactacctgaaaatgagccaggaagcagtatcatgcctgggaaggtaaatcctacacagtgtgaggccttgactatggtttgtgcacaggttatgggaaaccatgtagctgtgacagttggtgggtcaaatggtcatttcgaattgaatgtattcaagccggtgacgtcgagtgctcttttacattccgtcagattaatagcagatgcttcagcttcgttcgagaaaaactgtgtgaggggcattgaggccaacagagaaaggatctcaaagctattgcacgagtctcttatgcttgtgacatcattgaatcggaaaatcgggtgtgacaatgctgcagcagttgccaagaaagctcacaaagaaggatgtacattgaaggaagcggctctgaatttaggcgtgcttactgcggaagagtttgatacacttgttgttcctgagaagatgattggtccctccgattgatagttgtttttggagccaaagcttcaagtaccattattcttctgatgcttttatttaggttataataaaaatgagcaaatccagaaacaattcaaattttcttgggagggcaacattgttcttcatcttacggctaaactatgatcttctttatgtatcaattttttttttgtgttgaataagagagtgagtactcagcgagaagaatttc

SEQ ID NO: 11021 - protein, 491 aa, Arabidopsis thaliana
MSIYVASALSGGTTVTALRYATSLRSYSTSFREERDTFGPIQVPSDKLWGAQTQRSLQNFEIGGERERMPEPIVRAFGVLKKCAAKVNMEYGLDPTIGKAIMQAAQEVAEGKLNDHFPLVVWQTGSGTQSNMNANEVIANRAAEILGRKRGEKCVHPNDHVNRSQSSNDTFPTVMHIAAATEINSRLIPSLKTLHRTLESKSFEFKDIVKIGRTHTQDATPLTLGQEFGGYATQVKYGLNRVTCTLPRLYQLAQGGTAVGTGLNTKKGFDVKIAAAVAEETNLPFVTAENKFEALAAHDACVETSGSLNTIATSLMKIANDIRFLGSGPRCGLGELVLPENEPGSSIMPGKVNPTQCEALTMVCAQVMGNHVAVTVGGSNGHFELNVFKPVTSSALLHSVRLIADASASFEKNCVRGIEANRERISKLLHESLMLVTSLNRKIGCDNAAAVAKKAHKEGCTLKEAALNLGVLTAEEFDTLVVPEKMIGPSD

SEQ ID NO: 11022 - DNA, 1512 bp, Arabidopsis thaliana
  CDS (1)..(1479)
atgtcgatttacgtcgcgtcgcgacggctctccggcggaacaactgtgacggcgctgcgttatgccacctctctgagatcttattcgacctcgtttagggaggagagggacaccttcgggccgattcaagttccttccgataaattgtggggagcccagacgcagagatcgctgcagaacttcgaaatcggtggtgagcgcgagcgaatgcctgaaccaattgtccgcgcttttggcgtcttgaagaaatgcgctgccaaggttaacatggaatacggtcttgatccgacgattgggaaagcaattatgcaagctgctcaggaagtagctgagggaaagctcaatgatcatttcccccttgttgtctggcaaactggtagtgggactcagagtaatatgaatgctaatgaggtcattgctaatagagcagctgagattcttggtcgcaaacgtggtgagaaatgtgtgcacccaaatgaccatgtgaacagatcacaatcttctaacgacacttttcctaccgtcatgcacattgcagctgcaaccgagattaattcgaggctcatccctagtttaaaaactttgcatagcactttggaatctaagtccttcgagttcaaagatattgtgaaaattggaagaactcacactcaagatgctacacctttgacactaggacaagaatttggtggctatgctactcaagttaagtatggactaaatagagtcacctgcactcttcctcgcctctatcagcttgcacaaggtggaactgcggttgggacaggattaaacactaagaaagggtttgatgtaaagatagctgctgcagtagctgaagaaacaaacttgccatttgtcactgcagaaaacaagtttgaagctctggctgcacacgatgcttgtgttgaaaccagtgggtcacttaacacaatcgccacatcgctgatgaagatcgccaatgatatacgttttcttggaagtggcccaagatgtggtcttggtgaacttgtactacctgaaaatgagccaggaagcagtatcatgcctgggaaggtaaatcctacacagtgtgaggccttgactatggtttgtgcacaggttatgggaaaccatgtagctgtgacagttggtgggtcaaatggtcatttcgaattgaatgtattcaagccggtgatcgcgagtgctcttttacattccgtcagattaatagcagatgcttcagcttcgttcgagaaaaactgtgtgaggggcattgaggccaacagagaaagaatctcaaagctattgcacgagtctcttatgcttgtgacatcattgaatccgaaaatcgggtatgacaatgctgcagcagttgccaagaaagctcacaaagaaggatgtacattgaaggaagcggctctgaatttaggcgtgcttactgcggaagagtttgatacacttgttgttcctgagaagatgattggtccctccgattgatagttgtttttggagccaaagcttcaagtacca

SEQ ID NO: 11023 - protein, 492 aa, Arabidopsis thaliana
MSIYVASRRLSGGTTVTALRYATSLRSYSTSFREERDTFGPIQVPSDKLWGAQTQRSLQNFEIGGERERMPEPIVRAFGVLKKCAAKVNMEYGLDPTIGKAIMQAAQEVAEGKLNDHFPLVVWQTGSGTQSNMNANEVIANRAAEILGRKRGEKCVHPNDHVNRSQSSNDTFPTVMHIAAATEINSRLIPSLKTLHSTLESKSFEFKDIVKIGRTHTQDATPLTLGQEFGGYATQVKYGLNRVTCTLPRLYQLAQGGTAVGTGLNTKKGFDVKIAAAVAEETNLPFVTAENKFEALAAHDACVETSGSLNTIATSLMKIANDIRFLGSGPRCGLGELVLPENEPGSSIMPGKVNPTQCEALTMVCAQVMGNHVAVTVGGSNGHFELNVFKPVIASALLHSVRLIADASASFEKNCVRGIEANRERISKLLHESLMLVTSLNPKIGYDNAAAVAKKAHKEGCTLKEAALNLGVLTAEEFDTLVVPEKMIGPSD

SEQ ID NO: 11024 - DNA, 1500 bp, Arabidopsis thaliana
  CDS (1)..(1500)
atggccgctttgacaatgcagtttgaaggagagaagaaaaacgtatccgaagttgcagacgtaaccctcaagcaagaagatgaacaacaagaacgtagatcttattcgacgccgtttagggaagagagagacacctttggcccgatccaagttccttccgataaattatggggagcacagacgcagagatcgcttcagaacttcgagattggtggtgaccgcgagcgaatgcccgaaccaatcgtccgagcttttggtgtcttgaagaaatgtgctgccaaggttaacatggagtatggtcttgatccaatgattggggaagccataatggaagctgcacaagaagtagcagaaggaaagctcaatgatcatttccctcttgttgtatggcaaactggtagtgggacgcagagtaatatgaatgctaatgaggtcattgccaatagagcagctgagattcttggtcacaaacgtggtgaaaaaattgtgcacccaaatgaccatgtgaacagatcacaatcttctaatgacacttttccaactgtcatgcacattgcagctgcaaccgagattacttcgaggctaatccctagtttgaaaaatttgcatagctctttggaatctaagtccttcgagtttaaagatatagtgaaaatcggaagaactcatactcaagatgctacacctttgacattaggacaagaatttggtggctatgctactcaagttgagtatggacttaatagagtcgcatgtactctaccccgcatctatcagcttgcacaaggtggaactgctgttgggaccggattaaacactaagaaagggtttgatgtaaagatcgctgctgcagtagctgaagaaacaaacttgccattcgtcaccgcagaaaacaagtttgaagctctggctgcacacgatgcttgtgttgaaacaagtggatctcttaacacaatcgccacatcattgatgaagattgccaatgatatacgttttcttggaagtggtccaagatgtggtcttggtgaactttctctgcctgagaatgaaccaggaagcagtattatgcctggaaaggtaaatcctacacagtgtgaggccttgactatggtttgtgctcaagttatgggaaaccatgtagccgtgacaattggtgggtcgaatggtcattttgaattgaatgtattcaagccggttatcgcaagcgctctcttacattccattagactaatagcagatgcttcagcttcatttgagaaaaactgtgttagaggcattgaggccaacagagaaaggatctcaaagctattgcacgagtctcttatgcttgtgacatcattgaatcctaaaattggctatgacaatgctgcagcagtagccaaaagagctcacaaagaaggatgcacattaaagcacgcagctatgaagttaggtgttcttacttcggaagagtttgatactcttgttgttcccgagaagatgattggtccatctgattaa

SEQ ID NO: 11025 - protein, 499 aa, Arabidopsis thaliana
MAALTMQFEGEKKNVSEVADVTLKQEDEQQERRSYSTPFREERDTFGPIQVPSDKLWGAQTQRSLQNFEIGGDRERMPEPIVRAFGVLKKCAAKVNMEYGLDPMIGEAIMEAAQEVAEGKLNDHFPLVVWQTGSGTQSNMNANEVIANRAAEILGHKRGEKIVHPNDHVNRSQSSNDTFPTVMHIAAATEITSRLIPSLKNLHSSLESKSFEFKDIVKIGRTHTQDATPLTLGQEFGGYATQVEYGLNRVACTLPRIYQLAQGGTAVGTGLNTKKGFDVKIAAAVAEETNLPFVTAENKFEALAAHDACVETSGSLNTIATSLMKIANDIRFLGSGPRCGLGELSLPENEPGSSIMPGKVNPTQCEALTMVCAQVMGNHVAVTIGGSNGHFELNVFKPVIASALLHSIRLIADASASFEKNCVRGIEANRERISKLLHESLMLVTSLNPKIGYDNAAAVAKRAHKEGCTLKHAAMKLGVLTSEEFDTLVVPEKMIGPSD

SEQ ID NO: 11026 - DNA, 1865 bp, Solanum tuberosum
  CDS (66)..(1547)
ctcagactcagcatcaacattcccaccaactcgcatacaggcggcggcgcattgactgctgagatatggcgatgttaaatgcggctcgtcgattatcagctggatcagctttatcagattcactgcgttatacttcttcctggaggtttttctctacgtctttcagggaggaaagagatacgtttggtcctattctcgttccatcggacaagttatggggggctcaaactcaaagatcattgcagaattttgaaattgggggtgatcgtgaaagaatgcctgagccaatcatacgtgcattcggtattattaaaaagtgtgcagccaaggtgaacatggactatggccttgaccaatctattggaaaagcaataatgcaagcagctgaagaggttgcagaaggaaaattaaatgaccattttcctttggtggtttggcagactggcagtggcactcaaagtaacatgaatgctaacgaggttattgcaaatcgagcagctgaaatacttggccataaccgcggagacaaacatgtgcatccaaatgaccatgtaaataaatcgcaatcttcaaatgatactttctctacggtgatgcacattgctgcagcaatggagctaaataaaagattagtaccaaaccttgaaacagttgcatactcactaaattcaaagtcagtcgaattcaaggacattatcaagattgggcgaacccacacacaagatgcaacacctttgactcttggacaagagtttagtggctatgcaactcaagtgaaatatggaatcgatagagtcttatgcacgcttcagcgcatgtatcagctcgcacaagggggcacagcagtagggacaggattgaatacaaagaaagggtttgacataaaaattgctgcagcagttgcagaggaaacaaatttcccatttgttacagctgaaaacaagtttgaagcattggctgctcatgatgcatttgctgaaactagtggagccttaaataccctggctgcttcccttatgaagattgggaatgatatacgcttcttgggaagtggtccccgctgtggtcttggcgagctcagtcttcctgaaaatgaacccggaagcagtataatgcctggcaaggtaaatcctactcagtgtgaggctctcaccatggtctgtgctcaggttatggggaatcatgtggctgttactgttggtgcatcaaatggccattttgagctgaatgtcttcaagccgatgattgctaatgctctcctacattcagtaagattgctaggcgatgcatctgcttcctttgaaaagaattgtgtgagggatatccaagctaacagagacagaattgctaaattgttgcacgagtcactcatgctcgttacatgtttgaacccaaaaattggttatgataatgctgctgcagttgccaagaaagcccacaaggagggaaccagtttgaaggaagctgctctcaatctaggagtcctcaccagtgaagagtttgatcaacttgtagtccctgagaaaatgattggtccaactgactgatctgattcattagctcttcgaaatgagaaagaggaccatggctagcttcttctgtccatcagattcgaacgagggaaataaacatttgacacaattcttgaggttttcttattcctggtaatttatcagtgttttttactgtgagaatgcctccatttttttttttgtaatgagtccctggagcgatagccaagtaaataatgaactgaattagtattttttatgaggttgggccatgaataatgagggagaaaatcatcttttatgaaatggagacggggaaatgatcaaaatggtcttatgtatgggttttgattc

SEQ ID NO: 11027 - protein, 493 aa, Solanum tuberosum
MAMLNAARRLSAGSALSDSLRYTSSWRFFSTSFREERDTFGPILVPSDKLWGAQTQRSLQNFEIGGDRERMPEPIIRAFGIIKKCAAKVNMDYGLDQSIGKAIMQAAEEVAEGKLNDHFPLVVWQTGSGTQSNMNANEVIANRAAEILGHNRGDKHVHPNDHVNKSQSSNDTFSTVMHIAAAMELNKRLVPNLETVAYSLNSKSVEFKDIIKIGRTHTQDATPLTLGQEFSGYATQVKYGIDRVLCTLQRMYQLAQGGTAVGTGLNTKKGFDIKIAAAVAEETNFPFVTAENKFEALAAHDAFAETSGALNTLAASLMKIGNDIRFLGSGPRCGLGELSLPENEPGSSIMPGKVNPTQCEALTMVCAQVMGNHVAVTVGASNGHFELNVFKPMIANALLHSVRLLGDASASFEKNCVRDIQANRDRIAKLLHESLMLVTCLNPKIGYDNAAAVAKKAHKEGTSLKEAALNLGVLTSEEFDQLVVPEKMIGPTD

SEQ ID NO: 11028 - DNA, 1616 bp, Arabidopsis thaliana
  CDS (44)..(1576)
acacgtttaataggcccgaagttgctatctagcagttgtagccatggccgctttgacaatgcagtttgaaggagagaagaaaaacgtatccgaagttgcagacgtaaccctcaagcaagaagatgaacaacaagaacgtagatcttattcgacgccgtttagggaagagagagacacctttggcccgatccaagttccttccgataaattatggggagcacagacgcagagatcgcttcagaacttcgagattggtggtgaccgcgagcgaatgcccgaaccaatcgtccgagcttttggtgtcttgaagaaatgtgctgccaaggttaacatggagtatggtcttgatccaatgattggggaagccataatggaagctgcacaagaagtagcagaaggaaagctcaatgatcatttccctcttgttgtatggcaaactggtagtgggacgcagagtaatatgaatgctaatgaggtcattgccaatagagcagctgagattcttggtcacaaacgtggtgaaaaaattgtgcacccaaatgaccatgtgaacagatcacaatcttctaatgacacttttccaactgtcatgcacattgcagctgcaaccgagattacttcgaggctaatccctagtttgaaaaatttgcatagctctttggaatctaagtccttcgagtttaaagatatagtgaaaatcggaagaactcatactcaagatgctacacctttgacattaggacaagaatttggtggctatgctactcaagttgagtatggacttaatagagtcgcatgtactctaccccgcatctatcagcttgcacaaggtggaactgctgttgggaccggattaaacactaagaaagggtttgatgtaaagatcgctgctgcagtagctgaagaaacaaacttgccattcgtcaccgcagaaaacaagtttgaagctctggctgcacacgatgcttgtgttgaaacaagtggatctcttaacacaatcgccacatcattgatgaagattgccaatgatatacgttttcttggaagtggtccaagatgtggtcttggtgaactttctctgcctgagaatgaaccaggaagcagtattatgcctggaaaggtaaatcctacacagtgtgaggccttgactatggtttgtgctcaagttatgggaaaccatgtagccgtgacaattggtgggtcgaatggtcattttgaattgaatgtattcaagccggttatcgcaagcgctctcttacattccattagactaatagcagatgcttcagcttcatttgagaaaaactgtgttagaggcattgaggccaacagagaaaggatctcaaagctattgcacgagtctcttatgcttgtgacatcattgaatcctaaaattggctatgacaatgctgcagcagtagccaaaagagctcacaaagaaggatgcacattaaaggtaaacaataaactattaacgttttcatcactaaataaatcggaatttaaacccatttttagcaagagaaaacatgttcatgtttgttacaatatatttgttgttctattttggatttaaaccttctccagtgaaaattatataatacaatacctttgag

SEQ ID NO: 11029 - protein, 510 aa, Arabidopsis thaliana
MAALTMQFEGEKKNVSEVADVTLKQEDEQQERRSYSTPFREERDTFGPIQVPSDKLWGAQTQRSLQNFEIGGDRERMPEPIVRAFGVLKKCAAKVNMEYGLDPMIGEAIMEAAQEVAEGKLNDHFPLVVWQTGSGTQSNMNANEVIANRAAEILGHKRGEKIVHPNDHVNRSQSSNDTFPTVMHIAAATEITSRLIPSLKNLHSSLESKSFEFKDIVKIGRTHTQDATPLTLGQEFGGYATQVEYGLNRVACTLPRIYQLAQGGTAVGTGLNTKKGFDVKIAAAVAEETNLPFVTAENKFEALAAHDACVETSGSLNTIATSLMKIANDIRFLGSGPRCGLGELSLPENEPGSSIMPGKVNPTQCEALTMVCAQVMGNHVAVTIGGSNGHFELNVFKPVIASALLHSIRLIADASASFEKNCVRGIEANRERISKLLHESLMLVTSLNPKIGYDNAAAVAKRAHKEGCTLKVNNKLLTFSSLNKSEFKPIFSKRKHVHVCYNIFVVLFWI

SEQ ID NO: 11030 - DNA, 1416 bp, Nostoc sp. PCC 7120
  CDS (1)..(1416)
atgactacaaatacagattttcgtattgaacgcgattcgatgggcgatcgccaaattgctagtgatgtttattacggtattcaaactctccgagccgttgaaaatttccccattagtggtcttaagcccttacctacttacgtagatgctggtcttttaattaaaaaagctacagcaattgtcaatggagaactaggttgtattccccaagatattagccaagcgattgtgcaagcaaccgatgaaattctggcagggaagttaagagatcagttcgtcgttgatgtctatcaagctggtgcaggcacatcccaccacatgaacattaacgaagtcctagcaaatcgggctttggaaattttgggtgcagaaaagggcaattaccaacgagttagccctaatgatcatgtgaactacgggcagtctaccaacgatgttattcccacagcaattcgcatcggtggcttattggcactgaccaaaacattacagccagcattagaaaaagcgatcgccgccttagaacacaaagctgtagaatttcaagatattgtcaaatctggcagaacccatttacaggatgccgttcccgtccgcttgggtgataatttcgccgcttgggcgcatatcctctcagaacatcaaaaccgcatttacactgcctctggagacttgatggtactcggtttaggtggtagtgcggcgggaacaggcttaaacacccatcctcaataccgcgcccgtgtggtggaagtactggcagaattactaaacttaccactccaacccgccccccatctcatggctgccatgcagagtatgtccccatttgtgaacgtttccggggcgatacgcaacctagcccaagacttagcgaaaatttcccacgacttgaggctgatggactccgggccaaaaactggtttaaaagaaattcaactacccccagtccaacccggttcctcaatcatgccaggcaaatataaccccgttatggcagagatgacatcgatggtgtgtttccaggtgatgggttacgatcaggcgatcgctcttgcagcccaagccggacaattagaattaaacgtgatgatgccgttgattgcctatgatttgatccacagcatcgaaattctggggtcaaccatcgccgcccttacagaacgctgcattcaaggaattaccgccaacaaagaacgctgtttagcctacgccgaaggcagtttagctttagttaccgccctcaacactcacattggttatttaaatgccgcagatgtcgccaaagaatccttaaacacaggaaaatctctaaggcagattgtgttagaaaaaggactgatgagcgaagcagagttagccaccgtgttaaatctagaagaaatgagtagtatattgccactccaaacagagtaa

SEQ ID NO: 11031 - protein, 471 aa, Nostoc sp. PCC 7120
MTTNTDFRIERDSMGDRQIASDVYYGIQTLRAVENFPISGLKPLPTYVDAGLLIKKATAIVNGELGCIPQDISQAIVQATDEILAGKLRDQFVVDVYQAGAGTSHHMNINEVLANRALEILGAEKGNYQRVSPNDHVNYGQSTNDVIPTAIRIGGLLALTKTLQPALEKAIAALEHKAVEFQDIVKSGRTHLQDAVPVRLGDNFAAWAHILSEHQNRIYTASGDLMVLGLGGSAAGTGLNTHPQYRARVVEVLAELLNLPLQPAPHLMAAMQSMSPFVNVSGAIRNLAQDLAKISHDLRLMDSGPKTGLKEIQLPPVQPGSSIMPGKYNPVMAEMTSMVCFQVMGYDQAIALAAQAGQLELNVMMPLIAYDLIHSIEILGSTIAALTERCIQGITANKERCLAYAEGSLALVTALNTHIGYLNAADVAKESLNTGKSLRQIVLEKGLMSEAELATVLNLEEMSSILPLQTE

SEQ ID NO: 11032 - DNA, 1437 bp, Salmonella enterica subsp. enterica serovar Typhi
  CDS (1)..(1437)
atgtcaaacaacattcgtatcgaagaagatctgttgggtaccagggaagttccagctgaagcctactatggtgttcacactctgagagcgattgaaaacttctacattagcaataacaaaatcagcgacatccctgaatttgtgcgtggcatggttatggtaaaaaaagcggcggcgctggccaacaaagagctgcaaaccattcctaagagtgtggcgaatgccatcattgccgcatgtgatgaagtccttaacaacggtaagtgcatggaccagttcccggtagatgtctaccagggcggcgcgggcacttccgtcaacatgaataccaacgaagtgctggccaacatcgggctggaactgatgggtcatcagaaaggtgaatatcagtacctgaacccgaacgaccacgtgaataaatgtcaatccactaacgacgcctatccgacaggcttccgtgtagcggtttacgcctctatcgtcaaactgatcgatgccatcaaccagttgcgtgaaggtttcgaacgtaaagcggttgaattccaggacatcctgaaaatgggtcgtacccagttgcaggacgccgtaccgatgacgcttggtcaagaattccgtgcgttcagcattctgctgaaagaagaagtgaaaagcatcgagcgtactgctgagctgctgctggaagtcaaccttggcgcaacggcaatcggtactggtctgaacacgccgaaagaatactctccgctggcggtgaaaaaactggctgaagtcactggtttcgcctgtgttccggctgaagatctgattgaggcgacatctgactgtggcgcgtatgttatggttcacagcgcgctgaaacgtctggcagtgaagatgtccaaaatctgtaacgacctgcgcttgctctcttctggtcctcgtgccggcctgaacgagatcaacctgccggaactgcaggcgggctcttccatcatgccagccaaagtgaacccggtagtaccggaagtcgtaaaccaggtatgctttaaagtcatcggtaacgacaccaccgttacgatggcggcggaagccggtcagttgcagttgaacgttatggagccggttatcggtcaggcgatgttcgaatccatccacattctgagcaacgcgtgctacaacctgctggaaaaatgcgttaacggcattaccgcgaataaagaagtgtgcgaagggtacgtttataactccatcggtatcgtcacttacctcaacccgttcatcggccaccacaacggcgacatcgtcggtaaaatctgtgctgaaaccggtaagagcgtacgtgaagttgtgctagagcgcggcctgttaacggaagccgagctggacgatattttctccgtacagaacttgatgcacccggcttataaagctaaacgttatactgatgaaagcgaacagtaa

SEQ ID NO: 11033 - protein, 478 aa, Salmonella enterica subsp. enterica serovar Typhi
MSNNIRIEEDLLGTREVPAEAYYGVHTLRAIENFYISNNKISDIPEFVRGMVMVKKAAALANKELQTIPKSVANAIIAACDEVLNNGKCMDQFPVDVYQGGAGTSVNMNTNEVLANIGLELMGHQKGEYQYLNPNDHVNKCQSTNDAYPTGFRVAVYASIVKLIDAINQLREGFERKAVEFQDILKMGRTQLQDAVPMTLGQEFRAFSILLKEEVKSIERTAELLLEVNLGATAIGTGLNTPKEYSPLAVKKLAEVTGFACVPAEDLIEATSDCGAYVMVHSALKRLAVKMSKICNDLRLLSSGPRAGLNEINLPELQAGSSIMPAKVNPVVPEVVNQVCFKVIGNDTTVTMAAEAGQLQLNVMEPVIGQAMFESIHILSNACYNLLEKCVNGITANKEVCEGYVYNSIGIVTYLNPFIGHHNGDIVGKICAETGKSVREVVLERGLLTEAELDDIFSVQNLMHPAYKAKRYTDESEQ

SEQ ID NO: 11034 - DNA, 1452 bp, Brucella melitensis
  CDS (1)..(1452)
atgacaaccctggaaaatattcatcccctgacacggcgcgagcaggattcccttggggagcgcgatattcccatggatgcctatttcggcatccagaccctacgggcagttgaaaacttctcgctttccgatgttgcgctgaaccatattcctgccctcgttcgcgcccttgcaatggtcaagaaagcggctgccaccgccaattacaagctgcggcagctgccggagcccaaatatgcggccatcgtcgccgcctgcgacaacatcattgacgggcttttgatggagcaattcgtcgtggatgtgtttcagggcggcgcgggcacctcaagcaatatgaacgcaaatgaggttatcgcaaaccgcgcccttgaacatctggggcggccgcgaggcgactaccagacgatccatcccaatgatgacgtcaacatgtcgcagtccaccaatgatgtgtatccaaccgcggtaaggctggcgcttcttctcagccagaaccaggttcagacggcgctgcaccggctgattgccgcctttgaagcaaaggggcgggaattcgcgacggtcatcaagatcgggcgcacacagttgcaggatgcggttccgatcactcttggacaggagttcgaggcatttgccgcaacgttgcgggaggacacagcccggctggaggaggttgccgcgcttttccgcgaagtaaacctcgatggaaccgctatcggcacgcgcatcaacgcctcgcacgcctatgccgaacaggccatcgcggaactttcgcagatttccggtatcgaactgaaagccgccggcaatctcgtggaagcgagctgggataccggtgcgttcgtcaccttttccgggatattgcgccggatcgcagtcaagctttccaagatcgccaacgatctgcggctactctcaagcgggccgcgaagcggccttggtgaaatccgcctgcctgcggttcagccgggatcgtcgatcatgccgggaaaggtcaatccggtcataccggaatcggtcaatcaggtctgctatcaggtgatcggcaatgacctaactgtaaccatggcagccgaaagcgggcaattgcagctcaacgcgttcgagccgctgatcgtctacaatatcctcagttccatgcgactgctcggccgcgccatgaccaatctggccgaacgttgcgtcgacggaatcgaagccaatgtggaacgctgtcgcgcaggcgcggaggaaagcatttcgcttgcaaccgccctcgtcccggtcgtgggctatgccagggcggcagagatcgccaagcaggcgcttgcctcagggcagaccgtcatggaagtggcgatttccaaggggctggacgcatctgcgctcacgataatgcttgaccccttgagaatggcattcccgccggaaacgcacgacaaggaggcacatcatgcatctgtcggctaa

SEQ ID NO: 11035 - protein, 483 aa, Brucella melitensis
MTTLENIHPLTRREQDSLGERDIPMDAYFGIQTLRAVENFSLSDVALNHIPALVRALAMVKKAAATANYKLRQLPEPKYAAIVAACDNIIDGLLMEQFVVDVFQGGAGTSSNMNANEVIANRALEHLGRPRGDYQTIHPNDDVNMSQSTNDVYPTAVRLALLLSQNQVQTALHRLIAAFEAKGREFATVIKIGRTQLQDAVPITLGQEFEAFAATLREDTARLEEVAALFREVNLDGTAIGTRINASHAYAEQAIAELSQISGIELKAAGNLVEASWDTGAFVTFSGILRRIAVKLSKIANDLRLLSSGPRSGLGEIRLPAVQPGSSIMPGKVNPVIPESVNQVCYQVIGNDLTVTMAAESGQLQLNAFEPLIVYNILSSMRLLGRAMTNLAERCVDGIEANVERCRAGAEESISLATALVPVVGYARAAEIAKQALASGQTVMEVAISKGLDASALTIMLDPLRMAFPPETHDKEAHHASVG

SEQ ID NO: 11036 - DNA, 1416 bp, Bacillus halodurans
  CDS (1)..(1416)
atgacagactatcgtgtagagcgagatttaattggtgaaaagaaagtaccgaaagaggcatattatggaattcaaacgatgagagcgagggaaaacttccccattacagggtatccccctcatgaggaattgattcgcgcctttggctttgtcaaaaaggctgctgcgatggcgaatcgggatgtaggggtgttgccagctaacattgtcgatgcgatcattaccgcagcagacgaagtgatcgaaggaacgttcaacgatcaatttatcgttgatgcgatccaaggtggtgcaggtacttcttttaatatgaatgcaaatgaagtgattgccaatcgtgcgattgaaatccttggaggagagaagggggaatacctccgcgtaagcccaaatactcacgtgaacatggcgcaatcgacaaacgatgctttcccgacagctattcatattgcctgtctttatttagccaaaggattaattcaatcactagaagacctgattgcagccattaaggaaaaggaacaacagtttgacgatgtgttaaaaatggggcgaacccatttacaggatgcagttccgatacggatgggacaagaatttggcgcttaccgccgcgtgctcactcgtgatttgggacgaatccgcagctcaattgatcatatgcatgaaattaatatgggggcgacagcagtagggacaggacttaacgcaaagcctgaatatatggaaaaagtggttgcctatttaagtgacattactgaatttccgttccgccatgcagcagatttagtggacgcgacgcaaaatacggatgcttacacagaattatcgagtgcgctgaaaattttggcgatcaatttatcaaaaatggcgaatgacatccgcttgatgagctctgggccacgcacggggttaaatgaaatcaaccttccaccgcgtcaaccagggtcgtcgatcatgccaggaaaggtaaatccagtaatggctgaagtgatcaaccaaatttcgttccaagtcatcggcaatgaccatacgattagcttagcgtcagaagctgggcagcttgaactaaacgttatggagccggttctcgtctttaacttacttcaatcgttatcgatcctgcaaaacgggatgaaggtgttccgtcagcacgcgattgaaggaatgacggccaacgtagagcgctgcaaagaaatggtggagagcagtgttgggatcattactgcgatcaacccccatgtaggatatgaaacagcctctcgaatcgcaaaggaagcgatccaaacagggcgtccagtacgagaaatttgtctagaacgagggattttaacagaagaggaactaaacgaaattttggatccgaaagaaatgacgaagcctggtattgctggggcaaggttcatttacggataa

SEQ ID NO: 11037 - protein, 471 aa, Bacillus halodurans
MTDYRVERDLIGEKKVPKEAYYGIQTMRARENFPITGYPPHEELIRAFGFVKKAAAMANRDVGVLPANIVDAIITAADEVIEGTFNDQFIVDAIQGGAGTSFNMNANEVIANRAIEILGGEKGEYLRVSPNTHVNMAQSTNDAFPTAIHIACLYLAKGLIQSLEDLIAAIKEKEQQFDDVLKMGRTHLQDAVPIRMGQEFGAYRRVLTRDLGRIRSSIDHMHEINMGATAVGTGLNAKPEYMEKVVAYLSDITEFPFRHAADLVDATQNTDAYTELSSALKILAINLSKMANDIRLMSSGPRTGLNEINLPPRQPGSSIMPGKVNPVMAEVINQISFQVIGNDHTISLASEAGQLELNVMEPVLVFNLLQSLSILQNGMKVFRQHAIEGMTANVERCKEMVESSVGIITAINPHVGYETASRIAKEAIQTGRPVREICLERGILTEEELNEILDPKEMTKPGIAGARFIYG

SEQ ID NO: 11038 - DNA, 1428 bp, Haemophilus influenzae
  CDS (1)..(1428)
atgattacaatgactcaatttagaaaagaagtagatttacttggcgaacgtgatgtgcctgcagaagcatattgggggattcatacattaagagcggtagaaaatttcaatatttctaacgtaaccatttctgacgtgcctgagtttgtgcgtggtatggtaatggtaaaaaaagcaacagctttagccaatggcgaattaggtgcaattccaagtgatattgcaaaagcgattgtagcagcttgtgatgaaattcttaccactggaaaatgcttagatcaattcccatcagacgtatatcaaggtggtgcaggtacgtctgtcaatatgaatactaatgaagtggttgctaatcttgcccttgaaaaaattggtcataaaaaaggcgaatataacgtgattaatccgatggatcacgttaatgcaagccaatcgaccaacgatgcgtatcctaccggtttccgtattgcggtgtacaacagcatcttaaaattgatcgataaaattcaatatttacacgacagttttgataataaagcaaaagagtttgcaaatatcttaaaaatgggtcgtacccaattgcaagatgcggtgccaatgactgttggtcaagaattcaaagctttcgccgtattacttgaagaagaagtgcgtaacttaaaacgtacagcaggtttattacttgaagtaaaccttggtgcaacggcaatcggtactggtttaaatacgccacaaggctatacagaattagttgtaaaacatcttgctgaagtgactggattagcttgtgtaccagcagaaaacttaattgaagcaacatctgactgtggtgcttatgtcatggttcacggtgcattaaaacgtactgcagtgaaactttctaaagtatgtaatgacttacgtttactttcttctggcccacgtgcaggtttaaaagaaattaatcttcctgaattacaagcgggttcttctattatgccagcaaaagtaaacccagttgttccagaggtggtaaaccaagtgtgctttaaagtaattggtaacgataccactgtgaccttcgcatctgaagcaggtcaattacaattaaacgtaatggaaccagtgattggtcaagcaatgtttgaatctatcgatatcttaaccaatgcttgtgtgaacttacgcgataaatgtgtggatggcatcactgtaaacaaagaaatttgtgaaaactacgtgtttaattcaattggtattgtgacttacttgaatccatttatcggtcaccacaacggcgacttagtgggtaaaatctgtgcacaaacaggcaaaggcgtacgtgaagttgtgttagaaaaaggtttattaacagaagaacaattagatgacattctttctgtagaaaacttaatgaatccaacttacaaagcgaaattaaataaataa

SEQ ID NO: 11039 - protein, 475 aa, Haemophilus influenzae
MITMTQFRKEVDLLGERDVPAEAYWGIHTLRAVENFNISNVTISDVPEFVRGMVMVKKATALANGELGAIPSDIAKAIVAACDEILTTGKCLDQFPSDVYQGGAGTSVNMNTNEVVANLALEKIGHKKGEYNVINPMDHVNASQSTNDAYPTGFRIAVYNSILKLIDKIQYLHDSFDNKAKEFANILKMGRTQLQDAVPMTVGQEFKAFAVLLEEEVRNLKRTAGLLLEVNLGATAIGTGLNTPQGYTELVVKHLAEVTGLACVPAENLIEATSDCGAYVMVHGALKRTAVKLSKVCNDLRLLSSGPRAGLKEINLPELQAGSSIMPAKVNPVVPEVVNQVCFKVIGNDTTVTFASEAGQLQLNVMEPVIGQAMFESIDILTNACVNLRDKCVDGITVNKEICENYVFNSIGIVTYLNPFIGHHNGDLVGKICAQTGKGVREVVLEKGLLTEEQLDDILSVENLMNPTYKAKLNK

SEQ ID NO: 11040 - DNA, 1398 bp, Neisseria meningitidis
  CDS (1)..(1398)
atgactgtccgtatcgaacacgatttattgggcgaccgcgagattcccgccgaagtgtattggggcatccacaccctgcgcgccattgaaaactttaaaatctccacacaaaaaatttctgacgtgccgcagtttgtccgcagtatggtgatggtgaaaaaggcgacggcacaggcaaacggtgagttgggcgcggtcaagcccgaaatcgccgccgccattgaaaaagcctgcgacgaagttctgctgaacaaccgctgcctcgaccaattcccgtccgacgtgtatcagggcggtgcgggtacttcggtcaatatgaacaccaacgaagtcatcgccaacctcgcattggaagtcttgggatacgaaaaaggccgctacgacatcgtcaatccgatggatcacgtcaatgccagccaatcgaccaacgatgcctatcccacgggcttccgccttgccgtgtattacagcatcggcgaattgctcgacaaactgactgtcctgaaaaacgcctttgccgccaaagccgaagaatttaaagacgttttgaaaatgggccgcacccagcttcaagatgccgtgccgatgactgccggccaagaattccaatctttccaagtgttgttggaagaagaaatcctcaacctcgaccgcacccgccaactgctgttggaagtcaatttgggcgcaacggcaatcggcacgggcgtgaacacgcccaaaggctacgccgaactggtggtcaaaaaactctccgaagtcagcggcttgccttgcaaactgaccgaaaacctgattgaggcgacctccgactgcggcgcatatgtgatggtacacggcgcattgaagcgcacggcggtcaaactctccaaaatctgcaacgacttgcgcctgctctcttccggcccgcgtgccggcttgaaagaaatcaacctgcccgaattgcaggccggttcttccataatgcccgccaaagtcaatcccgtgattcccgaagtggtcaaccaagtctgcttcaaagtcatcggcaacgacacgacgattaccttcgccgccgaagccgggcaactgcaattaaacgtgatggagccggtcatcgcccaatgtatgtttgaaaccatttccctcttgggcaatgccgcagtcaacctgtccgacaaatgcgtcaaaggcattacggtcaaccgcgaaatctgcgaacgttacgttttcaactccatcggtttggtgacttatctgaatccgtatatcggacaccacaacggcgatttggtcggcaaaatctgcgcccaaaccggcaaaggcgtgcgcgaggttgtcttggaacgcgggctgttgagcgaagaagaactcaaccgcatcctctctcccgagaacctgatgaacccccatctgtaa

SEQ ID NO: 11041 - protein, 465 aa, Neisseria meningitidis
MTVRIEHDLLGDREIPAEVYWGIHTLRAIENFKISTQKISDVPQFVRSMVMVKKATAQANGELGAVKPEIAAAIEKACDEVLLNNRCLDQFPSDVYQGGAGTSVNMNTNEVIANLALEVLGYEKGRYDIVNPMDHVNASQSTNDAYPTGFRLAVYYSIGELLDKLTVLKNAFAAKAEEFKDVLKMGRTQLQDAVPMTAGQEFQSFQVLLEEEILNLDRTRQLLLEVNLGATAIGTGVNTPKGYAELVVKKLSEVSGLPCKLTENLIEATSDCGAYVMVHGALKRTAVKLSKICNDLRLLSSGPRAGLKEINLPELQAGSSIMPAKVNPVIPEVVNQVCFKVIGNDTTITFAAEAGQLQLNVMEPVIAQCMFETISLLGNAAVNLSDKCVKGITVNREICERYVFNSIGLVTYLNPYIGHHNGDLVGKICAQTGKGVREVVLERGLLSEEELNRILSPENLMNPHL

SEQ ID NO: 11042 - DNA, 1425 bp, Pseudomonas aeruginosa
  CDS (1)..(1425)
atgtcccccgttgcatcttcccgtatcgagaaagacctgctcggcaccctcgaagtgcccgctgacgcctactacggcatccagaccctgcgcgccgtgaacaacttccgcctctccggggtgccgctgtcgcactacccgaagctggtcgttgccctggccatggtcaagcaggccgccgccgacgccaaccgtcagctcggccatctcccggaagacaagcacgccgccatcagcgaggcctgcgcccgcctgatccgcggcgatttccacgagcagttcgtggtggacatgatccagggcggcgccggcacctccaccaacatgaacgcgaacgaagtgatcgcgaacatcgcgctggaagccatgggccacaccaagggtgagtacaagtacctgcacccgaacaacgatgtgaacatggcgcagtcgaccaacgacgcctacccaaccgccatccgcctgggcctgctgctcggccacgacaccctgctggccagcctcgacagcctgatccaggccttcgccgccaagggcgtcgaattcgccggcgtactgaagatgggccgcacccagttgcaggacgccgtgccgatgaccctcggccaggaattccacgctttcgccaccaccctcggcgaagacctcgaccgcctgcgtcgcctggcgccggagctgctcaccgaagtgaacctcggtggcaccgccatcggcaccggcatcaacgccgaccccggctaccagaagctcgccgtcgagcgcctggccgccatcagcgggcagccgctgaagccggccgccgacctgatcgaagccacctccgacatgggcgccttcgtgctgttctccggcatgctcaagcgcaccgcggtcaagctgtcgaagatctgcaacgacctgcgcctgctctccagcggcccgcgcaccggcatcaacgagatcaacctgccgccgcgccagccgggcagttcgatcatgccgggcaaggtcaacccggtgatcccggaagcggtcaaccaggtcgccttcgaagtgatcggcaacgacctcgccctgaccctggcggccgaaggcggccagttgcaactgaacgtgatggagccgctgatcgcctacaagatcttcgactcgatccgcctgctgcaacgcgccatggacatgctccgcgagcactgcatcaccggcatcaccgccaacgtcgagcgctgccacgaactggtcgagcacagcatcggtctggtcaccgcgctgaacccgtacatcggctacgagaactccacgcggatcgccaagaccgccctggagagcggccgcggcgtcctggaactggtacgcgaggaaaagctgctggacgaagccaccctggccgacatcctgctgccggaaaacatgatcgcgccgcgcctgattccgctgcgcgcctga

SEQ ID NO: 11043 - protein, 474 aa, Pseudomonas aeruginosa
MSPVASSRIEKDLLGTLEVPADAYYGIQTLRAVNNFRLSGVPLSHYPKLVVALAMVKQAAADANRQLGHLPEDKHAAISEACARLIRGDFHEQFVVDMIQGGAGTSTNMNANEVIANIALEAMGHTKGEYKYLHPNNDVNMAQSTNDAYPTAIRLGLLLGHDTLLASLDSLIQAFAAKGVEFAGVLKMGRTQLQDAVPMTLGQEFHAFATTLGEDLDRLRRLAPELLTEVNLGGTAIGTGINADPGYQKLAVERLAAISGQPLKPAADLIEATSDMGAFVLFSGMLKRTAVKLSKICNDLRLLSSGPRTGINEINLPPRQPGSSIMPGKVNPVIPEAVNQVAFEVIGNDLALTLAAEGGQLQLNVMEPLIAYKIFDSIRLLQRAMDMLREHCITGITANVERCHELVEHSIGLVTALNPYIGYENSTRIAKTALESGRGVLELVREEKLLDEATLADILLPENMIAPRLIPLRA

SEQ ID NO: 11044 - DNA, 1398 bp, Clostridium acetobutylicum
  CDS (1)..(1398)
atggattttaggattgagagtgattccataggtgataagaaggttcctaaggaggtatactatggagttcaaacattgagaggtgcggataattttaaaataacaggacttaggttaaatgaagagtttataaagagtgttgttcaaataaaaaaagcagctgcaattactaatttagaaattggagagctagaggttaacataggaaaagccataattaaagcctgtgatgaggtgatagctgggaagtttaatgaagactttataatagaccctattcaaggtggagcaggaacatctataaatatgaatgccaatgaggttattgcaaatagagctatagaaattttaggatatgaaaaaggaaattatagaattgtacatccaaacgatcatgtcaatatgggacaatcaactaatgatgttataccaacagcaggaaagataactgcattaagacttgtgatcaagaatttagacaaactcaaagaattaagcaatgcctttagtgagaaagcagaacaattcaaagatgtaattaaaatgggtagaacacagcttcaagatgctgtacctataacgttgggacaagaatttagtgcttacagtgcggttgtaaaaagagatatcgctaggattcaaaaagctcaagatgagctgaaagttgtaaatataggtggaactgcggttgggacaggtattaatgcagatagcagatatgtggatagaatagttccaaggctttcttttgtttctggattaaatttaaaaaaagctgacgatttaatcgatggtacacagaatttggatagctttgctagtttatccgcaacaataaaaacctgtgctttaaatctatctaaaatagccaatgacttaaggcttatgtcttctggaccaaggacggggttaggggagatcaatcttcctgcaaagcaaaatggatcatcaataatgcctggaaaagttaatcctgtaatacctgaagttataaatcaaatagcctttaatattgcaggaaatgatgtagctatttctatggctgttgaggcagggcagctagaactaaatgcttttgagccagttatattttataatatatttgaatctatccaaactttaacaaatggtgtagatacatttattaaaaattgtattctagatattactgcaaatgaagagatatgtagtgaatacgtaaataatagtgttggaatagttacagcactctgtccttatataggttatgcagaatcagcaaagatagcgaagatggctataaaaagtggagagtcaataaaaaaagtagttttaagagaaggcgttctcaaggaaaaggaacttaatagtattattaatccactaaaaatgactaaaccagggattgtaggaaaatag

SEQ ID NO: 11045 - protein, 465 aa, Clostridium acetobutylicum
MDFRIESDSIGDKKVPKEVYYGVQTLRGADNFKITGLRLNEEFIKSVVQIKKAAAITNLEIGELEVNIGKAIIKACDEVIAGKFNEDFIIDPIQGGAGTSINMNANEVIANRAIEILGYEKGNYRIVHPNDHVNMGQSTNDVIPTAGKITALRLVIKNLDKLKELSNAFSEKAEQFKDVIKMGRTQLQDAVPITLGQEFSAYSAVVKRDIARIQKAQDELKVVNIGGTAVGTGINADSRYVDRIVPRLSFVSGLNLKKADDLIDGTQNLDSFASLSATIKTCALNLSKIANDLRLMSSGPRTGLGEINLPAKQNGSSIMPGKVNPVIPEVINQIAFNIAGNDVAISMAVEAGQLELNAFEPVIFYNIFESIQTLTNGVDTFIKNCILDITANEEICSEYVNNSVGIVTALCPYIGYAESAKIAKMAIKSGESIKKVVLREGVLKEKELNSIINPLKMTKPGIVGK

SEQ ID NO: 11046 - DNA, 1446 bp, Agrobacterium tumefaciens
  CDS (1)..(1446)
atggaggaaaaagtgagtgtgacgcgcagggagcatgatttgctcgggacgaaggaaattccggctgatgtctattggggcgtgcacaccgcgcgcgccgtggaaaacttcaagatcaccggggtaaccattggccataacccttatctcgtcaggggactggcctatgtgaaggaggcagccgcacgcgcaaatcacgaactcggcctgctcgacaaggagcgcatggaagcgatcgcggaagcctgccgcgaaatccgcgccggcgcgctgcacgagcaattcgtggtcgacgagatccaggggggagccggcacttccactaacatgaacgccaacgaggtcatttccaaccgtgcgctggaactgctcggccacgaaaaaggcgattattcccgtcttcacccgaatgaccatgtcaatctcagccagtccaccaacgacgcctatccaacggcgatcaatgtcgggctgatcgaggcgatcgacgatctggcggtctccatgggcgtgctgaaagacgctttcgaccgcaaggcgcaggaatttgccggcttcatcaagatcggtcgcacccagctgcaggatgccgtgccgatgacgctcggccaggaattccgcactttcgtggtgatgctcggcgaagatcaggctcgcctgatcgaatccgccgcactgctgcacgaaatcaatctcggcgccaccgccatcggcaccggtctcaatgcgccgcgcggttatgccgagcttgcctgccagcatctggctaagctgaccggacggccactggtgacggcagcagacctgatcgaagccacacaggatcccggtgccttcgtgcacctttccggcgtgctgaagcgcgttgccgtcaagctgtccaagacctgcaacgaccttcgcctgctctcctccggtccgcgcgccggcatcggcgagatcaccctgccctccgttcaggcgggttccagcatcatgcctggcaagatcaacccggtcattcccgaagtggtcaaccaggtcgcctatgcggtgatcggcaacgacatcaccatcaccatggcggccgaagccgggcagctgcaattgaacgcctttgaacccatcatcgtgcgggcattgtcgcagagcatcagccagctcagcgccgcctgccgcacattggcggaacgctgcgttgagggcatcgtcgcaaaccccggcatcatggcgcagcgcgtggaagaatcgatcggtctcgccaccgcgctcaatccgctgatcggttattacgccgcgacggaagtggcgaaggaagcgcttgccagcggccgcaccgtgccgcaggtcgttctggaacggggttatctgacggaaacgcaattgcagcaggcgctcagcccgcgtcatcttgccaacctgcccgcggttaccgttacggctggcgaagccgatcttcgccgatga

SEQ ID NO: 11047 - protein, 481 aa, Agrobacterium tumefaciens
MEEKVSVTRREHDLLGTKEIPADVYWGVHTARAVENFKITGVTIGHNPYLVRGLAYVKEAAARANHELGLLDKERMEAIAEACREIRAGALHEQFVVDEIQGGAGTSTNMNANEVISNRALELLGHEKGDYSRLHPNDHVNLSQSTNDAYPTAINVGLIEAIDDLAVSMGVLKDAFDRKAQEFAGFIKIGRTQLQDAVPMTLGQEFRTFVVMLGEDQARLIESAALLHEINLGATAIGTGLNAPRGYAELACQHLAKLTGRPLVTAADLIEATQDPGAFVHLSGVLKRVAVKLSKTCNDLRLLSSGPRAGIGEITLPSVQAGSSIMPGKINPVIPEVVNQVAYAVIGNDITITMAAEAGQLQLNAFEPIIVRALSQSISQLSAACRTLAERCVEGIVANPGIMAQRVEESIGLATALNPLIGYYAATEVAKEALASGRTVPQVVLERGYLTETQLQQALSPRHLANLPAVTVTAGEADLRR

SEQ ID NO: 11048 - DNA, 1377 bp, Thermotoga maritima
  CDS (1)..(1377)
atgagaaaggaacgcgattacctcgggaaactggagatagaaggcgaagtctactatggaatacacacaaagagagccctcatgaacttcccatccacgggtgaaaagctcgacgaaactttcatctgggcctatttcatggtgaaaaaagcctgcgcccttttgaacacagagcttggttatctggacgaacgaacaggaaacgccattgtgaaagcctgtgacgaatgggaagacctgaaaaaacacgtggttgtggatccactctctggtggggctggaacttccataaacatgaacgtaaacgaagtgatcgcaaacagggctacggaaatactcggtggaaagaaaggagaatacctggtcgatcccatagaccacgtgaacctgcaccagtccacaaacgataccttcccaacgagtgcgaaaatcgccaccatcgtgaaactcagaagactcatagatgaagtgataaaccttcaggagaagattcaggagaaagagaaggagttctactccatcagaaaaccgggaagaacacagctcatggatggaccgcccatcatgttagggcaggaattcggtgccttcgcggatgccctcgcgagagacagatggaggctctacaaagtcgaagaaagaataagaagtgtaaacatcgggggaacggccatcggaacgggagttggggcgccgaaagactacatcctcaagatcgtggaaaaggtgagagaagtgacgaaagtgaagattgctaaagcagaaaacctcatagacgccacgcagaactgggacgtttttgccgaggttcatggtcttttgaaatcccttgctgtgaacctctacaagatttcaaacgacatcagactgctgggaagcggaccaaacaccgtgatcggggaactgattcttccagctgtgcaggcgggaagctccatcatgccaggaaaaataaacccggttgtttccgagtacgtaatgcaaatctgtcatatggttttcggtcacgacatgatcctgaaccatgcctgcgcgcttgggaatttagaactcaaccagttcgctcctctgatagttcacctcacactgaaatctctcacactcctcacaaacgcctgtagatcactcgccagctacatctcaaaaataaaagcgaacaacgagcggtgtgaggaacaccttcgaaggtctgtttcgaacctcacacctttgataaagttgtttggatacgaagcggtctctgaagcaataaaaaaagcgaattgggacataaagaaagccgttgaaattctatcccaggagaaaaacattcctgtcgaagagatactgaaggttctcaacctcaaaaagatgacggggcttggctactccttgtaa

SEQ ID NO: 11049 - protein, 458 aa, Thermotoga maritima
MRKERDYLGKLEIEGEVYYGIHTKRALMNFPSTGEKLDETFIWAYFMVKKACALLNTELGYLDERTGNAIVKACDEWEDLKKHVVVDPLSGGAGTSINMNVNEVIANRATEILGGKKGEYLVDPIDHVNLHQSTNDTFPTSAKIATIVKLRRLIDEVINLQEKIQEKEKEFYSIRKPGRTQLMDGPPIMLGQEFGAFADALARDRWRLYKVEERIRSVNIGGTAIGTGVGAPKDYILKIVEKVREVTKVKIAKAENLIDATQNWDVFAEVHGLLKSLAVNLYKISNDIRLLGSGPNTVIGELILPAVQAGSSIMPGKINPVVSEYVMQICHMVFGHDMILNHACALGNLELNQFAPLIVHLTLKSLTLLTNACRSLASYISKIKANNERCEEHLRRSVSNLTPLIKLFGYEAVSEAIKKANWDIKKAVEILSQEKNIPVEEILKVLNLKKMTGLGYSL

SEQ ID NO: 11050 - DNA, 1407 bp, Campylobacter jejuni
  CDS (1)..(1407)
atgggaacaagaaaagaacatgattttattggggaattggaaatctctgatgaggtttattatggagtgcaaacttttagagctgttgaaaattttgatatttctcatgatagattaaaagattttcctcgctttgttagggctttggctagagtaaaaaaagctgcagctatggcaaatcatgaattaggtcttttggataaaaatatccaagatgcgattattaaagcgtgtgataaaattttagaaggtgggtattatgatcaatttgtagtagatatgatccaaggaggtgctggaacaagtacaaatatgaatgctaatgaagttatagcaaacataggacttgaacttatgggtcataaaaaaggtgaataccaatatcttcatccaaatgatcatgttaatttaagccaaagtactaatgatgcttatcctacagctttacaccttgccttgcatgattatttaagtgatttggcaaaagctatggaacatctaaaaaaagcttatgagagaaaagctgaagaatttaaagatgttcttaaaatgggtagaacccaactgcaagatgctgtacctatgactttaggtcgtgaatttaaaacttttgccgtaatgataggtgaagatatacaaagagtattagaagctagaaaattgattttagagatcaatttgggtggaactgctattggaacaggaattaattctcatcctgattatccgaaggttgtagaaagaaaaataagagaagtgacaggttttgaatatactgtggctgaggatttaatcgaggcgactcaagatacgggagcttatgtacaaatttcaggtgttttaaaacgtgttgcaacaaaactttctaaagtatgtaatgacttaagacttttaagtagtggtccaaaatgtggtcttaatgagattaatcttccaaaaatgcaaccaggtagttctatcatgccaggtaaggtaaatcctgttattcctgaagtagttaatcaagtttgttattttgttattggagcagacgtaactgtaacttttgcttgtgagggtggacaattacaacttaatgtttttgaaccagttgtagcatatagcttatttaattctgttgtaatgctagaaaaagcaatgtatactttagctgataaatgtatagatggtattaccgcaaatgaaaaaatttgttcagactttgtctataattcagtaggtatagtaacagctttaaatccttatattggttatgaaaattcagcttctatagccaaagaggcaatgaacactggaaaaagagtggctgatattgcgcttgaaagagggcttttaagcaaagaacaaattgatgaaattttaactccatcaaatatgctaaatcctcacatggaagctaaaaaatag

SEQ ID NO: 11051 - protein, 468 aa, Campylobacter jejuni
MGTRKEHDFIGELEISDEVYYGVQTFRAVENFDISHDRLKDFPRFVRALARVKKAAAMANHELGLLDKNIQDAIIKACDKILEGGYYDQFVVDMIQGGAGTSTNMNANEVIANIGLELMGHKKGEYQYLHPNDHVNLSQSTNDAYPTALHLALHDYLSDLAKAMEHLKKAYERKAEEFKDVLKMGRTQLQDAVPMTLGREFKTFAVMIGEDIQRVLEARKLILEINLGGTAIGTGINSHPDYPKVVERKIREVTGFEYTVAEDLIEATQDTGAYVQISGVLKRVATKLSKVCNDLRLLSSGPKCGLNEINLPKMQPGSSIMPGKVNPVIPEVVNQVCYFVIGADVTVTFACEGGQLQLNVFEPVVAYSLFNSVVMLEKAMYTLADKCIDGITANEKICSDFVYNSVGIVTALNPYIGYENSASIAKEAMNTGKRVADIALERGLLSKEQIDEILTPSNMLNPHMEAKK

SEQ ID NO: 11052 - DNA, 1452 bp, Vibrio cholerae
  CDS (1)..(1452)
atggctaccctatctgaagcgcctaaaacagcgactccggctacccgcgttgaagaagatctgttaggtcaacgtcacgttcctgctgatgcttactacggtattcatacccttcgcgctgtcgaaaacttcaacatctctaacgttacgatctctgacgtgcctgaatttgtacgcggcatgatcatgaccaaaaaagcggccactctggcaaacaaagagctgggcgtgattcctaaagatgtggcgaactacatccttcaagcgtgtgatttgattcttgaaacaggtaagtgcatggatcaattcccgtcagatgtattccaaggtggtgcgggcacgtcagtgaacatgaacaccaacgaagtgattgctaacgttgcactcgagctgatgggcaaacaaaaaggtcaatacgagttcatcaaccccaatgaccacgtaaacaagagccaatcaaccaactgtgcatacccaacgggtttccgcatcgcggtttacaacagcatcctgaaagtgattgatgcgattgaatacctaaaaggctcattcgaacttaaagcggctgagtacaaaaacatcctgaaaatgggtcgtactcagttgcaagacgctgtacctatgaccgtaggtcaagaattccacgcatgggctgtgacgctgaatgaagagatccgcgcgctgcaatacacttcaaaactgcttttggaagtgaacttgggcgcaaccgcgatcggtactggcctgaacgccgctccgggttaccaagagctggccgtgaaatatctggcgcaagtgacaggtttagaaaccgttccagcagaagatctgattgaagccacctctgactgtggtgcttacgtgatgactcacggcgcgttgaaacgtctagcgatgaagctctctaagatctgtaacgatctacgtctgctctcttctggtccacgtgcaggtctgaatgaaatcaacttgcctgaactgcaagcgggttcgtccatcatgccagcgaaagtaaacccagtaatcccagaagtggtgaaccaagtttgctttaaagtattcggtaacgacaacaccattacattcgccgcagaagcgggtcaactgcagttgaacgtcatggagcctgtgattgctcaagcgatgtttgagtctatctctctgctgactaacgcctgtgtcaacctacgcgacaagtgcattgatggcatcacagtcaacaaagaaatctgtgaaaacttcgtgtttaactctatcggtatcgtgacttacttaaacccatacattggccaccatgagggtgacattgtcggtaagatctgtgccgaaaccggtaagagcgtacgcgaagtggtacttgagcgcggcttgctaactgaagagcagctcgatgacatcttctcggttgagaacctgatgcatcctcagtacaaagcaaaacgttacgaataa

SEQ ID NO: 11053 - protein, 483 aa, Vibrio cholerae
MATLSEAPKTATPATRVEEDLLGQRHVPADAYYGIHTLRAVENFNISNVTISDVPEFVRGMIMTKKAATLANKELGVIPKDVANYILQACDLILETGKCMDQFPSDVFQGGAGTSVNMNTNEVIANVALELMGKQKGQYEFINPNDHVNKSQSTNCAYPTGFRIAVYNSILKVIDAIEYLKGSFELKAAEYKNILKMGRTQLQDAVPMTVGQEFHAWAVTLNEEIRALQYTSKLLLEVNLGATAIGTGLNAAPGYQELAVKYLAQVTGLETVPAEDLIEATSDCGAYVMTHGALKRLAMKLSKICNDLRLLSSGPRAGLNEINLPELQAGSSIMPAKVNPVIPEVVNQVCFKVFGNDNTITFAAEAGQLQLNVMEPVIAQAMFESISLLTNACVNLRDKCIDGITVNKEICENFVFNSIGIVTYLNPYIGHHEGDIVGKICAETGKSVREVVLERGLLTEEQLDDIFSVENLMHPQYKAKRYE

SEQ ID NO: 11054 - DNA, 1413 bp, Clostridium acetobutylicum
  CDS (1)..(1413)
atgtttgatttgccttctgattttagaatagaaaaagacttacttggagaaaaaaacttacctaaagagtcctactacggaataaactctctaagagcctttgaaaactttaatataagcaataaaaaagtaaatttaaatttaatatatgcagtggtaattgtaaaaaaagcggctgctttagctcataaaaaactcaaggaacttaaagatgaaaaagcagatgctataataagcgcttgtgatgacatattaagtggaaaatttgacgatgagttcattacaaattctcttcaaggcggtgctggaacctcaaccaacatgaatgtaaatgaagtcattgcaaacagagctattgaattacttaatggctcaaagggtgactactctataatccacccaattgaagatgttaatatgtctcagtcaaccaatgatgtatacccaactgctcttagaattgcagctataaaacttctaaggcctttatctgatgctttaagtaaacttcaagaatcctttcaaataaaagaaaatgatttttcagatatacttatgcttggaaggacagaacttatggatgccttacctatgatggtaggtcagggctttggagcttatgcaaaagcctttgctagggatagatggcgaatatataaggttgaagagagacttcgtgagataaatattggaggaaatgccataggaactggaataaatgcttcctatgattatattttcactgttactgacatacttcaagatttaacaggactcgggcttgcaagaagtgattacccaatggatgtaacacaaaacatggatgtatttgtagaggtgtcaggtcttttaaaatcctgcgctgttaatcttataaaaatttcaaatgacataagacttttaaatagcggccctgtaggtggtataggagaatttattgttgaagaggttcaagctggttcatcaattatgccaggaaaagtaaaccctgttatatgtgaaatgacagctcaaacttctatgaaggttatggcaaacgatactgctatctccctcgcctcatcttttggacagcttcaattaaatgctttttctcctctaattgctgaaagccttttagaatctcttgaaatacttactaatgcagttaatgtgttcagggaaaaatgcatagattcaataaaaattaatgaagaaaaatgtcttgagaatttagaagcttctacagcactcgttacagccttagttcattatataggttatgataaagcatctattatagcaaaaaaagctctaaaagaaaaaaaatccatacgggaattactccttttagaaaaaattttaacaaaagaagaaatagataaaatacttaatccttatgagattacaaaacctggcataccaggactatag

SEQ ID NO: 11055 - protein, 470 aa, Clostridium acetobutylicum
MFDLPSDFRIEKDLLGEKNLPKESYYGINSLRAFENFNISNKKVNLNLIYAVVIVKKAAALAHKKLKELKDEKADAIISACDDILSGKFDDEFITNSLQGGAGTSTNMNVNEVIANRAIELLNGSKGDYSIIHPIEDVNMSQSTNDVYPTALRIAAIKLLRPLSDALSKLQESFQIKENDFSDILMLGRTELMDALPMMVGQGFGAYAKAFARDRWRIYKVEERLREINIGGNAIGTGINASYDYIFTVTDILQDLTGLGLARSDYPMDVTQNMDVFVEVSGLLKSCAVNLIKISNDIRLLNSGPVGGIGEFIVEEVQAGSSIMPGKVNPVICEMTAQTSMKVMANDTAISLASSFGQLQLNAFSPLIAESLLESLEILTNAVNVFREKCIDSIKINEEKCLENLEASTALVTALVHYIGYDKASIIAKKALKEKKSIRELLLLEKILTKEEIDKILNPYEITKPGIPGL

SEQ ID NO: 11056 - DNA, 1407 bp, Helicobacter pylori
  CDS (1)..(1407)
atgcgtattgagcatgatttcattgggcaaatggaaattagcgatgaagtttattacgggattcaaactttaagggcgagtgaaaattttttcatcaccaacgacaagctttgcagttatcctgtttttatcaaatcttttgctcaagtcaaaaaagcggccgctttagcgaacgcgcaattaggcttgattgatgaaaagcttaaaattgcgatttgccatgcgtgcgatttgttggttgatggcaaataccatgatcaattcattgtggatatgattcaagggggggctggcacaagcacgaacatgaacatgaatgaagtgattgctaatttggctttagaatacatggggcatcaaaagggcgagtatcaattttgccacccaaacgaccatgtcaaccgctctcaatccaccaatgacgcctatcctagcgcgttaaaaatcgcgatttatgagcgcttgagcaatctagttgcccccatgaaagccttaagggacgctttcgctcaaaaggctaaggaattcgctcatgtgattaaaatggggcgcacccagcttcaagacgctgtgcctatgactttagggcaagagtttgaaacttatgcgttgatggttgatagggatattgagcaggttttagacgctaggaattgggtaagagagcttaatttaggcggcacggttattggcacagggatcaattcgcacccggattatcgcagtttgattgaaaagaaaatccaagaagtaacgggccgcccctttgtcatggctaacaacttgatagaagccactcaaagcacgggggcgtatgtgcaagtgagcggggtgttaaagcgtattgcggtgaaactttctaaggtttgtaacgatttaaggctgctcagttcaggccctagagccgggttgaatgaaatcaatttgcctaaaatgcagccgggtagctctatcatgcccggtaaagtcaatccggtgatccctgaagtggtcaatcaagtgtgctttgcggtgattgggaacgatttgagcgtggcgttagccgcagaaggagggcaattgcaactcaatgtgtttgagccggttatcgcttacaagcttttccattcctttgtgattttagggcgcgcgattgaaactttaacgactaaatgcgtggaaggcatcacggctaatgaaaagatttgccacgattatgtttttaacagcattggcattgttaccgcgctcaaccctcatatcggctatgaaaaatccgctatgatcgccaaagaagccttaaaaagcgatcgctctatctatgatatcgctttagaaaagaaaatcttaaccaaagagcaactggacgatattttcaagccagaaaacatgctaagccctcacgctttcaaaaagcataaagactga

SEQ ID NO: 11057 - protein, 468 aa, Helicobacter pylori
MRIEHDFIGQMEISDEVYYGIQTLRASENFFITNDKLCSYPVFIKSFAQVKKAAALANAQLGLIDEKLKIAICHACDLLVDGKYHDQFIVDMIQGGAGTSTNMNMNEVIANLALEYMGHQKGEYQFCHPNDHVNRSQSTNDAYPSALKIAIYERLSNLVAPMKALRDAFAQKAKEFAHVIKMGRTQLQDAVPMTLGQEFETYALMVDRDIEQVLDARNWVRELNLGGTVIGTGINSHPDYRSLIEKKIQEVTGRPFVMANNLIEATQSTGAYVQVSGVLKRIAVKLSKVCNDLRLLSSGPRAGLNEINLPKMQPGSSIMPGKVNPVIPEVVNQVCFAVIGNDLSVALAAEGGQLQLNVFEPVIAYKLFHSFVILGRAIETLTTKCVEGITANEKICHDYVFNSIGIVTALNPHIGYEKSAMIAKEALKSDRSIYDIALEKKILTKEQLDDIFKPENMLSPHAFKKHKD

SEQ ID NO: 11058 - DNA, 2867 bp, Serratia marcescens
  CDS (787)..(2223)
gaattcgccgtcgaaggtattgccgttggcggcgtcgccgcccgtccaaccgccggggcgatacaccgacaggtgcggcatcagtttcagcgtcagcgatttttgcaccggcggcagcagcagcaacaggccgaggaaatcggtgaagaaacccggtatcagcagcaggaagcccgccagcaccagcgaaacgcttttcaccatttccgccgccgggctttcgccggccgccagtttttgctgcatctgcacgaaggttttcatgccctgattgcgcaccagcgaaatgccgacgcaggagctgaacaccaccagcagcagggtgacagccacgccgagcacggcggcgactttgataaagatggatatttctatgtaagccagcagaaatatcagcagtagcggtaaccagcgcacctggttctcctatcggtaggtaaggcacggccgccacggggcgacggcgcgaaaaaagaggccgtaaacggccgacactattacaatgagggcatccccccaccatttcaaccgagagccggtttttattgctaaagttcacaaacgtgaaagaagtcacagaaccgaaaaagggcatatccttaaacaccataaggtgatctggattcagtcatttcttaccaaccagcatatgatctgggcagctacgggcgatttggttaatcgtttcacgccccaagccttcggcaatattaatttaggctgtgcccttactagccttgacctgacaaattattaattcggcagcaacacatagagaaggttctcatgtcaaacaacattcgtatcgaagaagacctgttaggaacacgtgaagtccccgcagacgcttactacggagttcacactctgcgtgcgattgaaaacttctacatcagcaacagcaaaatcagcgatgtccccgagttcgttcgcggcatggtgatggtgaaaaaggccgcggcgatggccaacaaagaactcaaaaccatcccgcgcaaaatcgccgacgtgatcatccaggcctgcgacgaggtgctggataaaggcaagtgcatggatcagttcccggtggacgtattccagggcggcgcgggcacctcgctgaacatgaacaccaacgaagtgctggcgaacatcggcctggagctgatgggccatcaaaaaggcgaataccagtacctgaacccgaacgatcacctcaataagtgtcagtccaccaacgacgcctacccgaccgggttccgcatcgcggtgtacgcctccaaccagaaactgatcgacgccatcaaccagctgcgcgaaggcttcgatcgcaaggcgaaagagttcgaaaccatcctgaaaatgggccgcacccagctgcaggacgcggtgccgatgaccctaggccaggaattccacgccttcagcgtgctgctgaacgaagagacccgcaatctgcaccgcaccgcgacgctgctgctggaagtgaacctcggcgccaccgccatcggcaccgcgctcaacaccccggaaggctaccagccgctggcggtgcaaaaactggcggaagtcagcggcctgccggtggtgccggcagaagacctgatcgaagccacctccgactgcggcgcctacgtgatggtgcacagcgcgctcaaacgcctggcggtgaaactgtccaaaatctgtaacgacctgcgcctgctctcctccggcccgcgcgccggcctgaacgaaatcaacttgccggagctgcaggcgggatcgtccatcatgccggccaaagtgaatccggtggtgccggaagtggtcaatcaggtgtgtttcaaggtgattggcaacgacacttgcgttaccatggcggccgaagcgggccagctgcagctgaacgtgatggagccggtgatcggccaggcgatgttcgagtcgatccacatcctgaccaacgcctgctacaacctgctggaaaaatgcattaacggcatcaccgcgaataaagaagtctgcgaacactacgtcttcaactcgatcggtatcgtcacctatctgaacccgttcatcggccaccataacggtgacatcgtcgggaagatctgcgccgaaaccggcaagagcgtgcgcgaagtggtgctggaacgcggcctgctgaccgaagccgagctggatgacatcttctccgtggagaacctgatgcacccggcctataaagccaaacgctatacggatgaaaatgaacaataacagacctacccggtagccctgaaaggcacgctaaatcctctggatagcgtgcctttttacttttaggtgcccacaaaattttaacgttttattttcaatttacaccctaaatcattgggactgcatcaaggcggcaagagcgcaagtccccaggagcttactcaagtaagtgactggggtgagcgctcgcagccaacaccgatgcagtttcaaggatgacgggaaatctcattttaaggagtaaacactatgctagccgtagaattggttatcgttctgctggccatctttttaggggccaggttgggcggtatcggtatcgggttcgcggggggactgggcgtattggcgctggcgctgatcggcgtcaaaccgggcaacattcccttcgacgtcatctccatcatcatggcggtgattgcggcgatctccgccatgcaggtcgccggggggatggactacctggtgcaacagaccgaaaaactgctgcgcaagaaccccaagcacatcaccattctcgcccctatcgtcacctacttcctgaccatcttcgccggcaccggcaacatctcgctctcggcgctgccggtgatcgccgaggtggcgaaagaacagggcatcaagccttgccgcccgctgtcgac

SEQ ID NO: 11059 - protein, 478 aa, Serratia marcescens
MSNNIRIEEDLLGTREVPADAYYGVHTLRAIENFYISNSKISDVPEFVRGMVMVKKAAAMANKELKTIPRKIADVIIQACDEVLDKGKCMDQFPVDVFQGGAGTSLNMNTNEVLANIGLELMGHQKGEYQYLNPNDHLNKCQSTNDAYPTGFRIAVYASNQKLIDAINQLREGFDRKAKEFETILKMGRTQLQDAVPMTLGQEFHAFSVLLNEETRNLHRTATLLLEVNLGATAIGTALNTPEGYQPLAVQKLAEVSGLPVVPAEDLIEATSDCGAYVMVHSALKRLAVKLSKICNDLRLLSSGPRAGLNEINLPELQAGSSIMPAKVNPVVPEVVNQVCFKVIGNDTCVTMAAEAGQLQLNVMEPVIGQAMFESIHILTNACYNLLEKCINGITANKEVCEHYVFNSIGIVTYLNPFIGHHNGDIVGKICAETGKSVREVVLERGLLTEAELDDIFSVENLMHPAYKAKRYTDENEQ

SEQ ID NO: 11060 - DNA, 1428 bp, Bacillus subtilis
  CDS (1)..(1428)
atgttaaacggccaaaaagaatatcgcgtggaaaaagacttccttggggaaaaacaaattgaagcagatgtttattacggaattcagacgctccgtgcttctgaaaattttccgatcacaggatacaaaatccatgaggaaatgattaacgcactggcgattgtgaaaaaagctgcggctcttgccaacatggacgtgaaacggctgtatgaaggaattggccaagctatcgtacaagccgctgacgagattctggaaggcaagtggcacgatcagtttatcgtcgatccgattcagggcggtgccggaacttctatgaacatgaacgcgaatgaggttatcggaaaccgggcgcttgaaatcatgggacataaaaagggagattatatccatttaagtccaaacacacatgtgaacatgtcacagtctcagaacgatgtgttcccgactgctatccatatttccacattgaagctcttagaaaaactgctgaaaacaatggaagatatgcatagtgtgtttaaacaaaaagcacaggagtttcactctgttattaaaatgggccggacacaccttcaagatgcggttccgatccgtcttggccaggaattcgaagcttacagccgtgttctcgagcgtgatatcaaacgaatcaagcaatcgcgccagcacctgtatgaagtcaacatgggcgcaactgctgttggtacagggctgaacgctgatcctgaatatatcaaacaggtagtaaagcaccttgctgatattagcgggcttcctcttgtcggcgctgatcatcttgttgatgcgacacaaaatacagatgcctatacagaggtatcagcttcattaaaagtctgcatgatgaacatgtcgaagatcgcaaacgacctgcgcttaatggcgtcgggaccgcgcgccggacttgcggaaatttctctgcctgcacgtcagccgggttcatctattatgccggggaaagtcaatccggttatggcggagctgatcaaccaaattgcgttccaggttatcggaaatgacaatacaatctgccttgcttcagaagccggccagcttgagttgaacgtcatggagcccgtgcttgtctttaatttgcttcaatccatcagcatcatgaacaacggcttccgttcgttcactgacaactgcttaaaaggcattgaagccaacgaaaagcgtatgaagcaatacgtagaaaaaagcgcaggcgtgatcacagctgtcaatccgcatcttgggtatgaagcggcagctagaattgccagggaagcaattatgacagggcaatctgtccgggatctttgtctgcagcatgatgtgctgactgaagaagaattggatattattttaaacccatatgagatgaccaaaccaggtatcgcagggaaagaactattagaaaaataa

SEQ ID NO: 11061 - protein, 475 aa, Bacillus subtilis
MLNGQKEYRVEKDFLGEKQIEADVYYGIQTLRASENFPITGYKIHEEMINALAIVKKAAALANMDVKRLYEGIGQAIVQAADEILEGKWHDQFIVDPIQGGAGTSMNMNANEVIGNRALEIMGHKKGDYIHLSPNTHVNMSQSQNDVFPTAIHISTLKLLEKLLKTMEDMHSVFKQKAQEFHSVIKMGRTHLQDAVPIRLGQEFEAYSRVLERDIKRIKQSRQHLYEVNMGATAVGTGLNADPEYIKQVVKHLADISGLPLVGADHLVDATQNTDAYTEVSASLKVCMMNMSKIANDLRLMASGPRAGLAEISLPARQPGSSIMPGKVNPVMAELINQIAFQVIGNDNTICLASEAGQLELNVMEPVLVFNLLQSISIMNNGFRSFTDNCLKGIEANEKRMKQYVEKSAGVITAVNPHLGYEAAARIAREAIMTGQSVRDLCLQHDVLTEEELDIILNPYEMTKPGIAGKELLEK

SEQ ID NO: 11062 - DNA, 2066 bp, Pseudomonas fluorescens
  CDS (323)..(1759)
gttgaccagcgtcagccccaacgcggcttccaggctgcggatacgccgactgaacgccggctgggtgacaaagcgccgctcagccgcctgggaaaaactacgcgtcgccgccagggcgctgaagtcttccaaccacttgctctcaaggttcatcactgcctcccacggaatgcaccattttggcacacacgcccgccaagataaccgggtcacatccacattatgccgtttgtgcataggccagtgtttaacagcattggcccaaaaagtcctacaagcctagcattcgcagcgttccggccagtcccgggtccatattgagatgatctccgtcatgtcctctgctgcatctttccgtaccgaaaaagacctgcttggcgtactcgaagtaccggctcaagcgtattacggcatccagaccctgcgagcggtgaataacttccgcctctcgggcgttccgatttcgcattacccgaaattggtggtcggtctggcaatggtcaagcaagcagcggctgacgccaaccgcgagttgggccagctcagcgaacgcaagcacgctgccatcagcgaagcctgcgctcgtctgatccgcggcgatttccacgaagagttcgtggtggacatgattcaaggcggcgctggcacttcaaccaacatgaatgccaacgaagtcatcgccaacatcgcgctggaggccatgggtcaccagaagggcgaataccagtacctgcaccccaacaacgacgtgaacatggcgcagtcgaccaacgacgcctacccgaccgcgatccgcctgggtctgctgctgggccatgacgcgctgctggccagcctcgacagcctgatccaggcgttcgccgccaaaggcgccgagttcagccatgtgctgaaaatgggccgcacacaattgcaagacgccgtgccgatgaccctcggccaggaattccgcgcgttcgccaccaccctgggtgaagacctggcccgcctgaaaaccctggcgccagagctgctgaccgaagtgaacctgggcggaaccgcgatcggtaccggcatcaacgccgacccgcgctaccaggccctcgccgtacaacgcctggccaccatcagcggtcagccgctggtaccggcggccgacctgatcgaagccacctccgacatgggcgctttcgtactgttctccggcatgctcaagcgtactgccgtgaagctgtccaagatctgcaacgacctgcgcctgctgtccagcggcccacgcaccggcatcaacgagatcaacctgccggctcgccagccaggcagctcgatcatgcccggcaaggtcaacccggtcatcccggaagcggtcaaccaggtagcgttccaagtcatcggtaacgacctggccctgaccatggcagccgaaggcggccaactgcagttgaacgtgatggagccgctgatcgccttcaagatcttcgactcgatccgcctgctgcaacgcgccatggacatgctgcgcgagcactgcatcgtcggcatcaccgccaacgaagcccgctgccgcgaactggtggaacattccatcggcctggtcaccgcgctgaacccatacatcggctatgaaaacgccacccgcattgcgcgtatcgcgcttgaaagcgggcgcggcgtgctggaactggtgcgtgaagaaggcttgctcgacgacgccatgctcgacgacatcctgcgccccgaaaacatgattgccccacgcttggtcccgctgaaggcctaagcgtttgttgcaccgctcaccaggctgagggactagacacctctcaccttttgagggcttgaagactcgttcttcaggcccttttttttgctcgtaattcctctccttatataaagcgctgttagtgcgtttcacctataaaacatcacgcctgcggcgttacttgaaaaagcattcattcattgcaaattcccattgcgtgcacaaacggtgtgcagtttcgtgccatataaaaacaatggtttcatatatgaaacgctcaataagtaaccttaatctcgcaactaattaatttaaaagggaattc

SEQ ID NO: 11063 - protein, 478 aa, Pseudomonas fluorescens
MISVMSSAASFRTEKDLLGVLEVPAQAYYGIQTLRAVNNFRLSGVPISHYPKLVVGLAMVKQAAADANRELGQLSERKHAAISEACARLIRGDFHEEFVVDMIQGGAGTSTNMNANEVIANIALEAMGHQKGEYQYLHPNNDVNMAQSTNDAYPTAIRLGLLLGHDALLASLDSLIQAFAAKGAEFSHVLKMGRTQLQDAVPMTLGQEFRAFATTLGEDLARLKTLAPELLTEVNLGGTAIGTGINADPRYQALAVQRLATISGQPLVPAADLIEATSDMGAFVLFSGMLKRTAVKLSKICNDLRLLSSGPRTGINEINLPARQPGSSIMPGKVNPVIPEAVNQVAFQVIGNDLALTMAAEGGQLQLNVMEPLIAFKIFDSIRLLQRAMDMLREHCIVGITANEARCRELVEHSIGLVTALNPYIGYENATRIARIALESGRGVLELVREEGLLDDAMLDDILRPENMIAPRLVPLKA

SEQ ID NO: 11064 - DNA, 1437 bp, Bacillus cereus
  CDS (1)..(1437)
atggcaacattaactgaagttaaaaatggtgttcgaattgaaaaagattttttaggtgaaaaagaagtaccaaactatgcatactacggtgtacaaacaatgcgtgcagttgaaaacttcccaattacaggatacaaaattcatgaaggtttaattagagcgttcgcagttgtaaaaaaagctgcagcgcttgcgaatacagatgtaggaagattggaattgaacaagggcggcgcaatcgcagaagctgctcaagaaattcttgacgggaaatggcatgatcatttcatcgtagacccaatccaaggcggagcaggtacttcaatgaacatgaatgcaaatgaagtcattgccaatcgtctcttgattattaggaatggaaagggagactatcattatattagtccaaatagtcatgtaaacatggcgcaatccacaaacgatgcattcccaacggcgattcatatcgctacattaaacgcattagaaggtttattacaaacgatgggctatatgcacgatgtatttgaattaaaagcagaacagttcgatcatgtgattaaaatgggtcgtacacatttacaagacgctgttccaattcgtcttggacaagaatttaaagcatactctcgcgtacttgaacgtgatatgaaacgaattcagcagtcacgtcaacacttatatgaagtgaacatgggagcaactgcagttggtacaggcttaaatgcagatccagaatatattcaagctgttgtaaaacatttagctgcaattagtgaactaccacttgttggtgcggaagacttagtagatgcaacgcaaaatacggatgcatatacagaagtatcagcagcactgaaagtatgtatgatgaatatgtctaaaattgccaatgaccttcgcttaatggcatcaggtccacgtgttggtttagcagaaattatgttaccggctcgtcaaccaggttcatctattatgccagggaaagtaaaccctgttatgccagaggtaattaatcaaattgcgttccaagtaattggtaatgaccatacaatttgtcttgcttcagaagcaggtcaattagaattgaacgttatggaaccagtactagttttcaacttacttcaatcaattagcattatgaataacggtttccgtgcctttacagataattgcttaaaaggaattgaagcgaatgaagatcgcttaaaagagtatgttgagaagagtgtaggaattattacagccgtgaaccctcatatcggttatgaagcagcagctcgcgttgcgaaagaagcaatcgcgacagggcaatccgttcgagaactttgtgtgaaaaatggtgtactgtcacaagaagacttagaattaattctagatccattcgaaatgacgcacccagggattgcaggagcaactcttttaaagaaaaattaa

SEQ ID NO: 11065 - protein, 478 aa, Bacillus cereus
MATLTEVKNGVRIEKDFLGEKEVPNYAYYGVQTMRAVENFPITGYKIHEGLIRAFAVVKKAAALANTDVGRLELNKGGAIAEAAQEILDGKWHDHFIVDPIQGGAGTSMNMNANEVIANRLLIIRNGKGDYHYISPNSHVNMAQSTNDAFPTAIHIATLNALEGLLQTMGYMHDVFELKAEQFDHVIKMGRTHLQDAVPIRLGQEFKAYSRVLERDMKRIQQSRQHLYEVNMGATAVGTGLNADPEYIQAVVKHLAAISELPLVGAEDLVDATQNTDAYTEVSAALKVCMMNMSKIANDLRLMASGPRVGLAEIMLPARQPGSSIMPGKVNPVMPEVINQIAFQVIGNDHTICLASEAGQLELNVMEPVLVFNLLQSISIMNNGFRAFTDNCLKGIEANEDRLKEYVEKSVGIITAVNPHIGYEAAARVAKEAIATGQSVRELCVKNGVLSQEDLELILDPFEMTHPGIAGATLLKKN

SEQ ID NO: 11066 - DNA, 1419 bp, Acinetobacter sp
  CDS (1)..(1419)
atgaacgctgaaattcaaactcgtacagaaaaggatttactgggtctacgtgaagtaccaaatcaattttacttcggtatccaaactttacgagcaattgaaaacttcaatctaagctctaataaaatcaatcaatatccaaatttgatcaaatcattagcgatggtgaagcatgcatgtgcagaagcaaaccatactttgggtaaattaagtgatttaaaatttaatgcaatcaaatatagctgtgatcagttaattcaaggtttttaccacgaacagttccccattgacctcattcagggtggtgcgggtacctctaccaacatgaatgccaatgaagtaattgcaaatattgcattagagcatttgggtcataaaaaaggtgaatacaactttttacatccaaacaatgatgtgaatatgtctcaatcgaccaatgacgtttatccaactgcaattcgcttaggtttattattcagcttagatgatttaaatacgccttttgaaaatttgattgctagcctacgccgtaagggtgatgaatttgcacatattttgaaaatgggccgtactcagcttcaagacgccgttccaatgactttgggtcaagaatttaatgcttttgcttctacacttgaaaaagatttgatcaagattagagaaatcgcgcctcaaactctaaattatatgaatcttggcggtactgcgattggtacaggaatcaatacagaacaaaaatatacccaacttgccattgatgcacttgcgacaattagccagaaagatatcaagtctgctcccgatttaatcgaagcgacttcagatatgggtgattttgtattgttgtcaggattacttaaacgtacagcaactaaactctcaaaaatcgccaatgatctacgtttactttcaagtggtccacgtactgggatcaatgaaattaatctagagccgcgccaacctggcagctcaatcatgccaggtaaagtaaacccagttattccagaggcaatgaatcttgtatgtttccagattattgcgaatgatttggctgtaactttatctgctgaagcgggtcaattacaattaaatgcaatggaacccctgattgcattcaaactgtttgaatcaattgagttacttggtaatgcgctcgtcatgttccaaaccaagtgtatcgataccgtgactgcaaacgaacaacattgtaaagcacttgtcgataattccattggaattgtgactgctctgaatccttatcttggatatgaaaccacaacacgtattgctaaaactgcaaatgaaagtggtttaagcgtattgagtctgatcaaatctgaaaacctgttgtctgatgatcaactttcagaaattttagcggttgacaatatggtgcaaccgaaagctgaaatggtttaa

SEQ ID NO: 11067 - protein, 472 aa, Acinetobacter sp
MNAEIQTRTEKDLLGLREVPNQFYFGIQTLRAIENFNLSSNKINQYPNLIKSLAMVKHACAEANHTLGKLSDLKFNAIKYSCDQLIQGFYHEQFPIDLIQGGAGTSTNMNANEVIANIALEHLGHKKGEYNFLHPNNDVNMSQSTNDVYPTAIRLGLLFSLDDLNTPFENLIASLRRKGDEFAHILKMGRTQLQDAVPMTLGQEFNAFASTLEKDLIKIREIAPQTLNYMNLGGTAIGTGINTEQKYTQLAIDALATISQKDIKSAPDLIEATSDMGDFVLLSGLLKRTATKLSKIANDLRLLSSGPRTGINEINLEPRQPGSSIMPGKVNPVIPEAMNLVCFQIIANDLAVTLSAEAGQLQLNAMEPLIAFKLFESIELLGNALVMFQTKCIDTVTANEQHCKALVDNSIGIVTALNPYLGYETTTRIAKTANESGLSVLSLIKSENLLSDDQLSEILAVDNMVQPKAEMV

SEQ ID NO: 11068 - DNA, 1431 bp, Bacillus anthracis str
  CDS (1)..(1431)
atggcaatgacaaacaagaacgtgcgaatggagaaggattttttgggaggaaaggaattacctattgaggcatattacggaattcagactttacgtgctgttgaaaattttccgattacagggtataaaattcatgaaagtttaattagagcgttcgcagttgtaaaaaaagctgcagcgcttgcgaatacagatgtaggaagattggaattgaacaagggcggcgcgatcgcagaagctgctcaagaaattcttgatggaaaatggcatgatcatttcatcgtagatccaatccaaggcggagcaggtacttcaatgaacatgaatgcaaatgaagtcattgccaatcgtgcgcttgaattattagggatggaaaagggagactatcattatattagtccaaatagtcatgtaaacatggcacaatcaacaaacgatgcattcccaacggcgattcatatcgcaacattaaacgcattagaaggtttattacaaacgatgggttatatgcacgatgtatttgaattaaaagcagaacagttcgatcatgtgattaaaatggggcgtacacatttacaagacgctgtgccaattcgtcttggacaagaatttaaagcatactctcgcgtacttgaacgtgatatgaaacgaattcagcaatcgcgtcaacatttatatgaagtaaatatgggagcaactgcagttggtacaggcttaaatgcagatccagaatatattgaagcagttgtaaaacatttagctgcaattagtgaactgccacttgttggtgcagaagatttagtagatgcaacgcaaaatacggatgcatacacagaagtatcagcagcacttaaagtatgtatgatgaatatgtctaaaattgcgaatgaccttcgcttaatggcatcaggtccacgtgttggcttagcggaaattatgctacctgctcgtcaaccaggttcttctattatgccagggaaagtaaaccctgttatgccagaagtaattaatcaaattgcattccaagtaattggtaacaaccatacaatttgtcttgcttcagaagcaggtcaattagaattaaacgtgatggaaccagtacttgttttcaacttactacaatcaattagcattatgaataacggtttccgtgcctttacagataattgcttaaaaggaattgaagcgaatgaagatcgcttaaaagagtatgttgagaagagtgtaggaattattacagccgtgaaccctcatatcggttatgaagcagcagctcgcgttgcgaaagaagcaatcgcgacagggcaatccgttcgagaactttgtgtgaaaaatggtgtattgtcacaagaagatttagagttaattttagatccatttgaaatgacacacccagggattgcaggagcaactcttttaaagaaaaattaa

SEQ ID NO: 11069 - protein, 476 aa, Bacillus anthracis str
MAMTNKNVRMEKDFLGGKELPIEAYYGIQTLRAVENFPITGYKIHESLIRAFAVVKKAAALANTDVGRLELNKGGAIAEAAQEILDGKWHDHFIVDPIQGGAGTSMNMNANEVIANRALELLGMEKGDYHYISPNSHVNMAQSTNDAFPTAIHIATLNALEGLLQTMGYMHDVFELKAEQFDHVIKMGRTHLQDAVPIRLGQEFKAYSRVLERDMKRIQQSRQHLYEVNMGATAVGTGLNADPEYIEAVVKHLAAISELPLVGAEDLVDATQNTDAYTEVSAALKVCMMNMSKIANDLRLMASGPRVGLAEIMLPARQPGSSIMPGKVNPVMPEVINQIAFQVIGNNHTICLASEAGQLELNVMEPVLVFNLLQSISIMNNGFRAFTDNCLKGIEANEDRLKEYVEKSVGIITAVNPHIGYEAAARVAKEAIATGQSVRELCVKNGVLSQEDLELILDPFEMTHPGIAGATLLKKN

SEQ ID NO: 11070 - DNA, 1461 bp, Photobacterium profundum
  CDS (1)..(1461)
atgtctcagatgattgatcttgaaaagaatgaagcaactctaaatgttgctactcgcattgaagaagatttacttggtgaacgtcacgttcctgctgacgcttactggggtatccacacacttcgcgctgttgaaaacttcaacatctcaaacactacaatttctgacgttcctgattttgttcgcggtatggttttcactaagaaagcagctgcaatggcgaacaaagagctaggcgctattccttcagaagttggtaactacatcatccaagcatgtgatttaattctagacactggtaagtgtatggatcaattcccgtctgatgtttaccaaggcggtgctggtacgtcagtgaacatgaacacaaacgaagttattgccaaccttgctcttgaactgatgggcaaagacaaaggcgaatacgacgtcgttaaccctaatgatcacgtaaacaaatcgcaatcaactaactgtgcgtacccaacaggcttccgtgttgctgtatacaacagcatcatgacaatgattgaagctattgattacctaaaaggtgctttcgacgcgaaagataaagaattcgcaggcgttctaaagatgggtcgtactcagcttcaagatgctgtaccaatgactgttggtcaagagttccacgcgtactcagttcttcttaaagaagaaatcaaaaaccttaagtacacagcagatcttctacttgaagtgaacttaggtgcaacagctatcggtactggcttaaacgcagcgactggttaccaagaacttgctgttcagcgtcttgctgaaatcactggtctaccatgtacaccagcagaagatttaatcgaagcaacgtctgactgtggcgcatacgtaatgatccacggtgctcttaagcgtactgcagttaaactgtctaagatttgtaacgacttacgtctactttcttctggtcctcgtacaggtttgaacgaactaaacctaccagaaatgcaggctggttcttctatcatgccagctaaagtaaacccagtaattcctgaagtagttaaccaagtttgcttcaaggttattggtaacgacacaacaattactttcgcagcagaagctggtcagcttcagttgaacgtaatggaacctgttatcggtcaagcactgttcgaatctatttcacttctgaaaaacgcttgtgtaactctacgtgataagtgcgtatcgggtatcacagtgaataaagaagtatgtgaaagttacgtatttaactcaatcggtatcgtgacttacctaaacccattcattggccaccacgaaggtgacattgttggtaagatttgtgctgaaacaggtaaaaacgtacgcgaagttgtacttgagcgtggtcttctaacggaagagcaactagacgacatcttctcggtacaaaacctaatgcacccagaatacaaagcgaagcgttataactaa

SEQ ID NO: 11071 - protein, 486 aa, Photobacterium profundum
MSQMIDLEKNEATLNVATRIEEDLLGERHVPADAYWGIHTLRAVENFNISNTTISDVPDFVRGMVFTKKAAAMANKELGAIPSEVGNYIIQACDLILDTGKCMDQFPSDVYQGGAGTSVNMNTNEVIANLALELMGKDKGEYDVVNPNDHVNKSQSTNCAYPTGFRVAVYNSIMTMIEAIDYLKGAFDAKDKEFAGVLKMGRTQLQDAVPMTVGQEFHAYSVLLKEEIKNLKYTADLLLEVNLGATAIGTGLNAATGYQELAVQRLAEITGLPCTPAEDLIEATSDCGAYVMIHGALKRTAVKLSKICNDLRLLSSGPRTGLNELNLPEMQAGSSIMPAKVNPVIPEVVNQVCFKVIGNDTTITFAAEAGQLQLNVMEPVIGQALFESISLLKNACVTLRDKCVSGITVNKEVCESYVFNSIGIVTYLNPFIGHHEGDIVGKICAETGKNVREVVLERGLLTEEQLDDIFSVQNLMHPEYKAKRYN

SEQ ID NO: 11072 - DNA, 1431 bp, Bdellovibrio bacteriovorus
  CDS (1)..(1431)
atggagttagtgatggaaaagttccgcgtagaaaaagatttgctgggtgaaaagaaagtccctgcggaagcttattacggcattcataccctgcgggcgatggagaactttcagatctcgggcatccctgtcggagccaatcaaagtttcgtgcgtggtctggcactggtgaaaaaagcctgcgcgttggccaatggtgaactgggcacaatcccggcggatgtttccaagtccttggttgaagcctgtgacatcgttttgcaggacccgaaaaaatggggtcagcagttcccatccgacgtttatcagggcggcgcggggacttcgatcaacatgaatgccaacgaagtgattgccaatatcgcattggaaaaacgcggtctgcaaaaaggcacctacgcggtgatcaaccctaatgatcacgtgaataagtgccagtccacgaatgatgcttatccgaccgctttccgagtggcgctgtatgaacacctgaacggaactttggcggcgctggattctttggctttggccttcgagaaaaaaggcaaagaattccagagcgttttgaaaatgggccgcacgcagttgcaggatgcagttcccatgtctttggggcaggagtttaacgcttttgccactttactaaaagaagacggtcgtctgatccgcactgttcagaaattcatgctggaagtgaacttgggggccaccgcgattgggactggcatcaacacacctccgggttatgcgtctttggcggtgcaaaagctggctgaggtcaccgggcatccgtttgttcagtcggaagattacatcgaagccaccagcgactgtggtgcctacatcattatctctggcgcactgaaacgcacggcagtgaaactttcgaaaatctgcaacgacttgcgcttgcttagttctggtccgcgtgcgggcttgaaagaaatcaacctgcctgaaatgcaggcgggttcttccatcatgccggcaaaagtgaatccggtgattccggaagttgtgaatcaggtcagcttcaaaatcatcggcaatgacctggcgatcaccctggcggccgaagcagggcagctgcagctgaatgtgatggaacctgtgatcgcctccagtctgtttgagtctttggatcttttgaagaatgcctgtgaaaccctggaacataaatgtgtgaagggtattacggccaatgcagaacgctgccgggactacgtcatgaacagcatcggtattgtgacttatctggatccgatcatcggtcacgatgaaggcgaccgtatcggaaaaatctgtgcggagaccggtcgcaacgtggctgaagtggccctggagcgaggcgtggtgactcaggcgcaactggatgaactgttctcaatggaaaatctgctgaacccgaaatacgtcggcaagaagcactag

SEQ ID NO: 11073 - protein, 476 aa, Bdellovibrio bacteriovorus
MELVMEKFRVEKDLLGEKKVPAEAYYGIHTLRAMENFQISGIPVGANQSFVRGLALVKKACALANGELGTIPADVSKSLVEACDIVLQDPKKWGQQFPSDVYQGGAGTSINMNANEVIANIALEKRGLQKGTYAVINPNDHVNKCQSTNDAYPTAFRVALYEHLNGTLAALDSLALAFEKKGKEFQSVLKMGRTQLQDAVPMSLGQEFNAFATLLKEDGRLIRTVQKFMLEVNLGATAIGTGINTPPGYASLAVQKLAEVTGHPFVQSEDYIEATSDCGAYIIISGALKRTAVKLSKICNDLRLLSSGPRAGLKEINLPEMQAGSSIMPAKVNPVIPEVVNQVSFKIIGNDLAITLAAEAGQLQLNVMEPVIASSLFESLDLLKNACETLEHKCVKGITANAERCRDYVMNSIGIVTYLDPIIGHDEGDRIGKICAETGRNVAEVALERGVVTQAQLDELFSMENLLNPKYVGKKH

SEQ ID NO: 11074 - DNA, 1575 bp, Corynebacterium diphtheriae
  CDS (1)..(1575)
atggcttcccaagctaaaaacacaaagggctcgaaaaacgccgaggtaaccaatgatgttctcgacggaaaaaccgaaggcaccgcggagaaagtaaacgatgcccccattgcatcagatgtaacaacaaagcacgccactaagaaagctgcaccaggattccgtatcgaagaagacctcttgggtgagatggaagttcccgacgaggtttattatggcgtccatactcttcgtgccatcgacaattacaagatctctagcaccaccattaatgatgtgccagagttcattcgtggcatggttcaggtaaaaaaggccaccgcgcttgccaaccgacgactccatactctgccgaaagacaagtgcgatgccattgtatgggcttgcgatcaaatcttggatcacggtcgttgcatggatcagttcccaatcgatgtgttccaaggaggcgctggcacaagcgtcaacatgaacactaatgaggtaatcgccaacctcgcactggagcatctgggtaagccaaagggatcctatgacatcatcaacccaaacgatgacgtcaacatgagccaatcaactaacgatgcctacccaactggattccgtttgggtgtctatgaggcgatgcaggaactgatcactcgtattgacaatctacagttcgcattccatgccaaaggtgatgagttcaccgatattctgaagatgggtcgcacacagctccaagatgctgtaccgatgactttaggcgaggaattccaggcattcgctcataacttggctgaggagcaaagcgttctgcgtatggcttccgaccggctcaaggaagttaacttgggcgcaaccgctatcggtactggcttgaacaccccagccggttaccgttatcaggttgtagccgcattgtccgagtgcaccggcttggaaattaagtctgcacgcgatcttattgaagctacttcagacactggtgcgtatgtccttgcccatgcagctgttaagcgtactgcgatgaagctttctaagatctgcaatgatcttcgactgctcagctccggaccacgcgcaggtctcaacgagattaatcttcccgctcgagctgcaggttcatcgatcatgccggcaaaggtcaacccagttatccctgaggttgttaaccaggtttgcttcaaggtttttggtaacgatcttactgtcaccatggcggcagaagctggccagctccagctcaatgtgatggaaccggttatcggccaagccttgtttgagtcgattcgaattctcggtaatgctgcagtcacccttcagcacaagtgtgtcgaagggattaccgcaaatgctgacgtatgtcgcgcctacgtagataattccattggtatcgttacctatctcaaccctttcattggtcaccatatgggtgacgtgattggcaaggaagctgctgagaccggcaagtccgtacgtgagcttgtattggaaaagggactaatggatgaagagactttgaaccaaatcctgtccaaggaaaatctaatgcacccttcgtttcgtggaaccctctacctagataactag

SEQ ID NO: 11075 - protein, 524 aa, Corynebacterium diphtheriae
MASQAKNTKGSKNAEVTNDVLDGKTEGTAEKVNDAPIASDVTTKHATKKAAPGFRIEEDLLGEMEVPDEVYYGVHTLRAIDNYKISSTTINDVPEFIRGMVQVKKATALANRRLHTLPKDKCDAIVWACDQILDHGRCMDQFPIDVFQGGAGTSVNMNTNEVIANLALEHLGKPKGSYDIINPNDDVNMSQSTNDAYPTGFRLGVYEAMQELITRIDNLQFAFHAKGDEFTDILKMGRTQLQDAVPMTLGEEFQAFAHNLAEEQSVLRMASDRLKEVNLGATAIGTGLNTPAGYRYQVVAALSECTGLEIKSARDLIEATSDTGAYVLAHAAVKRTAMKLSKICNDLRLLSSGPRAGLNEINLPARAAGSSIMPAKVNPVIPEVVNQVCFKVFGNDLTVTMAAEAGQLQLNVMEPVIGQALFESIRILGNAAVTLQHKCVEGITANADVCRAYVDNSIGIVTYLNPFIGHHMGDVIGKEAAETGKSVRELVLEKGLMDEETLNQILSKENLMHPSFRGTLYLDN

SEQ ID NO: 11076 - DNA, 1407 bp, Desulfovibrio vulgaris
  CDS (1)..(1407)
atggaatacaggacagaacgtgacagcctcggagaaaaacgggttcctgccggtgtctactacggcgtgcagacattgcgtgccttggagaatttccagataacggccatgccggtggcgacgtttccgcggttcatacaggcactcgccgccgtcaagaaggctgcggccctcgccaacatggaactcggtctgcttgatgcgggcgtcggtgaagccatcgtcaatgcctgccgcgacgtgcgcgcgggcaggttcgacgaccagtttcccgtggatgtcatccagggcggggcgggaacctcggtgaacatgaacgccaacgaggtcatcgccaaccgggcgctggaactcctggggcacccgaaagggcgctatgaggtcataagccctctcaatcacgtgaacctctcgcagtcgaccaacgatgtctatccgacggcgctacgcatcgccctcgtctggtatgcacgcgagttgtcaacggcgctgcgcgacctgcgggccgccttcgacgcgaaaggtgacgagtttgccggggtcatcaagatggcgcgcacccagttgcaggacgcggtccccatcacgctgggtgccgaattcgcggcatggggcgtcaccatcggcgaggacatcgacaggcttgatgacgctgcgcgtctgctgtgcgaggtgaacataggtgccacggccgtcggcaccggcatcaacagtgtgccgggatatgcctcgctggtacgtgaacgtctcgcggatatatgcggtctgcctctggtcaccgccgccaacctcgtggaggcgaccagtgacgcaggtgcctatgtcatgctgtccggtctgctcaaacgcgtggccgtgaagctgtcgaagatatgcaacgacctgcggctgcttgcttccgggccgttcaccggtctgcatgaaatcaacctgccacccatgcagccggggtcgagcatcatgccgggcaaggtcaaccccgtcattcccgaagtggtcaatcaggtctgctatcaggtgatcggcaacgacctcacggtgaccttcgccgccgagggggggcagcttgaactcaatgtctttctgcctgtcatcgccctcaacctcttccagtcgttgcagatgctcacgaaggcgtcgcgcaccctgcgcgagcggtgtgttgtcggcatcaccgccaaccccgaacggtgcctcgagcttgtgcggcattctctcggggtcgtcacggcgcttgctccggtgataggctatgagaccgccgcccgactggccaaggaggcgcaggagagcgggcgttccgtgcccgaggtgctgcaggccgagggcatcatgacgccggaggagttcgaagagcttctggaccctgccaagatgctctccccacgcgatgttcgccggaggtga

SEQ ID NO: 11077 - protein, 468 aa, Desulfovibrio vulgaris
MEYRTERDSLGEKRVPAGVYYGVQTLRALENFQITAMPVATFPRFIQALAAVKKAAALANMELGLLDAGVGEAIVNACRDVRAGRFDDQFPVDVIQGGAGTSVNMNANEVIANRALELLGHPKGRYEVISPLNHVNLSQSTNDVYPTALRIALVWYARELSTALRDLRAAFDAKGDEFAGVIKMARTQLQDAVPITLGAEFAAWGVTIGEDIDRLDDAARLLCEVNIGATAVGTGINSVPGYASLVRERLADICGLPLVTAANLVEATSDAGAYVMLSGLLKRVAVKLSKICNDLRLLASGPFTGLHEINLPPMQPGSSIMPGKVNPVIPEVVNQVCYQVIGNDLTVTFAAEGGQLELNVFLPVIALNLFQSLQMLTKASRTLRERCVVGITANPERCLELVRHSLGVVTALAPVIGYETAARLAKEAQESGRSVPEVLQAEGIMTPEEFEELLDPAKMLSPRDVRRR

SEQ ID NO: 11078 - DNA, 1413 bp, Desulfovibrio vulgaris
  CDS (1)..(1413)
atgtctttgtctgatcaggacgccatccgcatcgagcacgacttgctcggcgactgtgcggttccccgcacggccttgcacggtgcgcatacgcaacgggcgctctccaatgtcgccctcagcggccgcccgttgcacccggaaatcatcagggcattcggggccgtgaagcgtgcctgtgcacgtaccaacatgaacctcggccacctctcccgtgaggtggccgaggccatcatcatggcatgtgatgagcttgaagatggcgggttgggcgagcacatcgtggtcgacgcactgcaaggcggcgctggcacctccgccaacatgaacgtcaacgaagtgctggcgaaccgcgccgaagagatgctgggcggcacgcgaggccagtaccagcttgtcgacccgctggcgcacgtcaatctgcatcagtccaccaacgatgtgttccccacggcagtgcggattgcggcattgcgtctgctggcgcgactcgaaccggcgattgccgcactccagtccgcattccagacgcacgaggcatcgttcgcgcaggtggtgcggctggggcgcacccagttgcaggatgccgtgcccatgacattcggggcagcctgtggcgcgtgggccgaagccctttcgcgggacaggtggcgcgtgttcaagtgttcggagagactgcgcgtcgtcaatctgggaggaaccgccatcggcaccggcatcgcagccccccgaagctacatcctctctgtcgtggacaggttgcgtgaagacacgggcctgcctctcgcaagagcagaaaacctcatggacgccacacagaatgtcgatgcgttcgtcgaggtgtctggcatactcaaggcccacgcctcgaatctgctcaagctttcctccgacctgcgcctgctggcgtcggggccgggtggcggcatcggcgaggtcgtactcccgcccgtccaggccgggtcgagcatcatgcccggcaaggtcaacccggtcgtgtgcgagaccgtggcacaggcggccatgcaggcaacggccaacgaccttgccatcaccctgtccgcccagcacggtcagcttgaactgaacgccttcatgccgctcatcgctgatgcgctgctgcatggcatcgagcttctcacgaatgcctgcgacctgttccgtacgcgctgtgtcgaagggttacaccctgatacggaaacctgcgcccggcacgtttccacatcgacagccacgcttacggcactcgttcctgaaatcggctacgccgccgcctctgaaatggcccgccacatgcgcgaacacggcacggacgtcttcggggctgccaaagcgacaggactcatcgacgaagaccggcttgcaaggctgctttctcctgaacgtctcgtggcactggggtacagaggatga

SEQ ID NO: 11079 - protein, 470 aa, Desulfovibrio vulgaris
MSLSDQDAIRIEHDLLGDCAVPRTALHGAHTQRALSNVALSGRPLHPEIIRAFGAVKRACARTNMNLGHLSREVAEAIIMACDELEDGGLGEHIVVDALQGGAGTSANMNVNEVLANRAEEMLGGTRGQYQLVDPLAHVNLHQSTNDVFPTAVRIAALRLLARLEPAIAALQSAFQTHEASFAQVVRLGRTQLQDAVPMTFGAACGAWAEALSRDRWRVFKCSERLRVVNLGGTAIGTGIAAPRSYILSVVDRLREDTGLPLARAENLMDATQNVDAFVEVSGILKAHASNLLKLSSDLRLLASGPGGGIGEVVLPPVQAGSSIMPGKVNPVVCETVAQAAMQATANDLAITLSAQHGQLELNAFMPLIADALLHGIELLTNACDLFRTRCVEGLHPDTETCARHVSTSTATLTALVPEIGYAAASEMARHMREHGTDVFGAAKATGLIDEDRLARLLSPERLVALGYRG

SEQ ID NO: 11080 - DNA, 1434 bp, Bacillus cereus
  CDS (1)..(1434)
atgatagcaacgaaggatatacgtatagaaaaagattttttaggtgaaaaggaagtaccaagtagagcttattatggtgtacaaacattacgtgcggtagaaaatttcccgattacagggtatcgcattcatccatcactcattacggcaatggcaattgtgaaaaaagcggcggcacttgcaaatatggatactggttacttagcgaaagacattggacacgaaattgcagaggcagcacaagaaattgttgatgggaaatttcatgatcaatttattgtagatccaattcagggcggtgctggaacttctattaatatgaatacaaatgaagtaatcgctaatcgagcgttagaacgtatgggatatgaaaaaggcgagtatgcaaaaattagcccaaatacgcatgtaaacatggctcagtcaacgaatgatgcgtttccaacaggaattcatattgcaactcttatgatgttagaagaacttcttattacaatggaagaacttcatgctgctttccttgcaaaagcaaaagagttcgatcacgtcattaaaatgggacgtacgcatttacaagatgctgttccgattcgtcttggacaagaatttgaagcgtatagcagagtgcttgcgcgtgatataaaaagaattaaacaatctcgccaacatttatatgaagtgaatatgggggcgacagctgttggtacgggattaaatgcaaaccctacctacattgaacaagtggttaaacacttacgaacatttagcggattcccacttgttggtgcagagcatttagttgatgcaacacaaaatacagatgcatacacagaagtatctgcagcattaaaagtatgtatgatgaatatgtctaaaattgcgaacgaccttcgtattatggcatctggtccacgtgttggattggcggaaattcaattaccagctcgtcaaccaggttcatctattatgccaggtaaagtaaatcctgttatggcagaagtaattaatcaagtcgctttccaagtaattggtaatgatcacacaatttgcttagcgtcagaagcaggacaactggagctcaacgtaatggagcctgtgcttgtatttaatttaattcaatctatcagtattatgaataacggattccgtgtattccgtgaatattgtattaaaggaattacagcaaatgaagaactgctgaagcaatatgttgagaaaagtgttggaattattacagcagttaaccctcatattggttatgaagtagcatcacgtattgcacgtgaagcaattgaaacaggaaaatctgttcgggagttatgtttagaacatggtgtactgacagaagaagaattagatattattttagatccattcgaaatgacgcatcctgaaattgctggtgcttctttactaaagaataagaagatgtaa

SEQ ID NO: 11081 - protein, 477 aa, Bacillus cereus
MIATKDIRIEKDFLGEKEVPSRAYYGVQTLRAVENFPITGYRIHPSLITAMAIVKKAAALANMDTGYLAKDIGHEIAEAAQEIVDGKFHDQFIVDPIQGGAGTSINMNTNEVIANRALERMGYEKGEYAKISPNTHVNMAQSTNDAFPTGIHIATLMMLEELLITMEELHAAFLAKAKEFDHVIKMGRTHLQDAVPIRLGQEFEAYSRVLARDIKRIKQSRQHLYEVNMGATAVGTGLNANPTYIEQVVKHLRTFSGFPLVGAEHLVDATQNTDAYTEVSAALKVCMMNMSKIANDLRIMASGPRVGLAEIQLPARQPGSSIMPGKVNPVMAEVINQVAFQVIGNDHTICLASEAGQLELNVMEPVLVFNLIQSISIMNNGFRVFREYCIKGITANEELLKQYVEKSVGIITAVNPHIGYEVASRIAREAIETGKSVRELCLEHGVLTEEELDIILDPFEMTHPEIAGASLLKNKKM

SEQ ID NO: 11082 - DNA, 1392 bp, Treponema denticola
  CDS (1)..(1392)
atgcgaagggaacatgacttactcggagaattggatattccggaagatgcttattatggaattcaaacattccgcagtgttgaaaattttcaaattacaggattaaggctctgtgattttcccgattttattaagggtcttgcttatacaaagcaggctgcagccgaagccaaccatgaactcggctatttaagcgatgaagtttacaaggctatgattcaggcttgtaaagaagttgccgaaggcaaattcgataaggaatttgtagtcgatatgattcagggcggagcaggaacttctaccaatatgaatgcaaatgaagttatcgccaaccgcgcaaacgaaatcttaggaaaggccaagggaacttattcgccctgccatcccaataatcacgtaaactttgctcaatctacaaacgacgcttatcctacagctgcaaagctcggcatctcgttaaatacaccggctcttatagatgaactcaaatctcttgttgcttcttttagaaaaaaggcccaagaacttggagaaaatatcaagatgggaagaacccagcttcaagatgccgtacccatgaccctcggccaagagtttgaatcctatgccgcttctttggaaaacgaaattcctcagattcagtttgcaagggaaaatcttcacaccataaacatgggagctaccgctatcggaacaggtatcaactcggatcctaactatacaccgaaagtaacctctcatctggcaaaaatttcgggtcttgatctaaaggctgcaaaaaacatgatagctgccacgaacgatacatccgactttgtaacatattcttcacaattaaagcgcctttctgcaaagctttcaaagatatgcagcgatttacgccttctttcttcgggccccagaacaggactttacgatataagtcttcctccgatgcagcccggttcttctatcatgcccggaaaggtaaacccggttattcctgaggttgtcaatcaggtttgctacagggttatcggaaatgatactgccgttatcttggctgcagaatcaggccagcttgaactcaacgtttttgaacccgttataatttattctatctttgagtcgattaagcttcttataaatgcaatgaagactttgagggaacgatgcgttacgggcattgtaggaaactatgagcattgtaaggaaagcgttcaccgaagtatcggcttggttacggccttaaatcccgtcatcggttatgaggcttcttccgatattgcaaagactgccttgcgcgataaccgcagcgtttatgaccttgttttggaaagagggcttctttcaaaagaaaaattggatgaggttttaaaacccgaaaacatgacaaagcccagaaagctttag

SEQ ID NO: 11083 - protein, 463 aa, Treponema denticola
MRREHDLLGELDIPEDAYYGIQTFRSVENFQITGLRLCDFPDFIKGLAYTKQAAAEANHELGYLSDEVYKAMIQACKEVAEGKFDKEFVVDMIQGGAGTSTNMNANEVIANRANEILGKAKGTYSPCHPNNHVNFAQSTNDAYPTAAKLGISLNTPALIDELKSLVASFRKKAQELGENIKMGRTQLQDAVPMTLGQEFESYAASLENEIPQIQFARENLHTINMGATAIGTGINSDPNYTPKVTSHLAKISGLDLKAAKNMIAATNDTSDFVTYSSQLKRLSAKLSKICSDLRLLSSGPRTGLYDISLPPMQPGSSIMPGKVNPVIPEVVNQVCYRVIGNDTAVILAAESGQLELNVFEPVIIYSIFESIKLLINAMKTLRERCVTGIVGNYEHCKESVHRSIGLVTALNPVIGYEASSDIAKTALRDNRSVYDLVLERGLLSKEKLDEVLKPENMTKPRKL

SEQ ID NO: 11084 - DNA, 1392 bp, Geobacter sulfurreducens
  CDS (1)..(1392)
atgacgttccgggtcgagaaggataccctcggtgaggtgcgggttccggcggacgcctactacggcgcccagacggtccgggccgtggagaatttccccatctccgggctgcggccccatccggccctcgtccgggcgacggtgctcgtcaaaatgtgtgcggcccgggccaacatggccacgggcaggctcgattcccggcttggagacgctatcgtccgggcggccgacgagtgcctggccggtgcctttgatgcccacttcgtggtggacccgtttcaagccggcgccggcacctcccacaacatgaacgtgaacgaggtcctcgccaaccgggccaatgaactgctgggagaggagcggggcaggtatgctcccgtccatcccaacgaccacgtgaacatggcccagtccaccaacgacgtcttccccacggccatgcgtctggcggcccttcgggtggcgggggatctccggccggccctagagggactcgttgccgcgcttcggaaaaagtccgctgaattcgacggcattctcaagagcggccggactcacctgcaggatgcggtgccgatccgtctcggccaggagttcgaggcgtgggccgtggcgctggagaagaacctggccgccatcgagggggcggtgccgggccttgcggaactgggtatcggcggcaccgcggcaggtaccggcatgaacgccgagccggcctacatcgatcttgtggtggcagagctcgcccgggaaaccggctttcccctcgtacggggtgcgaacctggttgagcggatgcagaacatggaccccttcgtggccctctcctccgctctcaagggacttgccgtaaacctcgcccgtatcgccaacgacctgcggctcctttcctctggcccccggaccgggctggccgagatcgcgctgccggcgctgcagcccggctcctctatcatgccggggaaggtcaacccggtcatggccgaggtgaccgacatggtcgcctttcaagtgatgggtgcggacacgacaatcatgctcgccgcccaggcagggcagctggagcttaacgtcatgatgccggtcatcgcgttcaaccttctgttcagccttgaaatcctgaagaacacggtgcccaagctggctgatgcctgcatcgccggcatcactgcggaccgggagcgctgcctccggtacctggagcagtcggtaggactggccacggtgctcgcgccctacatcggctatgccgcggccgcggaggtggccaaggaatcgactgccacgggccggagtatccggcagatcgtggaagaccggcagctcctgtcggccgggcgtctggcggagatcctcgaccccttccctctcaccagccctggcgttccgtga

SEQ ID NO: 11085 - protein, 463 aa, Geobacter sulfurreducens
MTFRVEKDTLGEVRVPADAYYGAQTVRAVENFPISGLRPHPALVRATVLVKMCAARANMATGRLDSRLGDAIVRAADECLAGAFDAHFVVDPFQAGAGTSHNMNVNEVLANRANELLGEERGRYAPVHPNDHVNMAQSTNDVFPTAMRLAALRVAGDLRPALEGLVAALRKKSAEFDGILKSGRTHLQDAVPIRLGQEFEAWAVALEKNLAAIEGAVPGLAELGIGGTAAGTGMNAEPAYIDLVVAELARETGFPLVRGANLVERMQNMDPFVALSSALKGLAVNLARIANDLRLLSSGPRTGLAEIALPALQPGSSIMPGKVNPVMAEVTDMVAFQVMGADTTIMLAAQAGQLELNVMMPVIAFNLLFSLEILKNTVPKLADACIAGITADRERCLRYLEQSVGLATVLAPYIGYAAAAEVAKESTATGRSIRQIVEDRQLLSAGRLAEILDPFPLTSPGVP

SEQ ID NO: 11086 - DNA, 1437 bp, Yersinia pestis
  CDS (1)..(1437)
atgtcaaataacattcgtattgaagaagacctgttaggtacacgagaagtccccgcagaggcttactacggtgttcataccctgcgtgcgattgaaaacttctatatcagtaacagtaaaatcagtgacgtgccggaatttgtacgtggcatggtcatggtaaaaaaagcggcggcaatggctaacaaagagttgcataccatcccgcgtaaaattgcagacatcattattcaggcatgtgatgaagttctggataaagggaaatgtatggatcagttccccgttgatgtgttccagggcggcgcaggtacctctctcaatatgaacaccaacgaggtcttggccaatattggcctggagctgatgggccaccaaaaaggggaatatcagtaccttaaccctaacgaccatctgaacaaatgccagtccaccaacgatgcctacccaaccggtttccgcattgcggtctacgcctccatcctcaagttgatcgatgctatcaaccaattaggcgaaggtttcggtagaaaatctaaagaattcgagaaaattctgaaaatgggccgtacccaattacaggatgccgtacccatgactctgggccaggaattccgcgctttccaggtgttattgaatgaagaaaccaagaacctgcaacggaccgccgagttgctattggaagtcaacctgggtgccactgccatcggcactgcgctgaatacaccagaaggttattcacaacttgccgtgcagaaactggcagaaatcagcggattagcctgtgttcctgccgaagatttgatcgaagcgacctctgattgcggcgcttacgtgatggtacacagcgccctgaaacgcctggctgttaagatgtcaaaaatctgtaacgacctacgtttgctctcatctggcccacgtactggtttgaatgaaatcaacctgccagaattgcaggcgggctcttctatcatgcctgcaaaagtgaacccggtgatccctgaagttgtaaatcaggtttgttttaaggtgatcggcaacgatacttgcattactatggcggctgaagcgggtcagcttcagttaaacgtgatggaaccggtaattggtcaggccatgtttgagtctatccatatcctgactaatgcgtgttacaacctgttagagaagtgcatcaatggcattaccgctaacaaagaggtctgcgagcgctacgtctttaactccataggcatcgtcacttatcttaacccgttcattggccaccataatggtgacattgtgggtaaaatctgtgcggaaaccggtaaaaatgtgcgggaagtggttctggagcgcggtttgttaactgaagccgaactggacgacattttctctgttgaaaacctgatgcacccagcctataaagcgaaacgttataccgatgaaaatgaacaataa

SEQ ID NO: 11087 - protein, 478 aa, Yersinia pestis
MSNNIRIEEDLLGTREVPAEAYYGVHTLRAIENFYISNSKISDVPEFVRGMVMVKKAAAMANKELHTIPRKIADIIIQACDEVLDKGKCMDQFPVDVFQGGAGTSLNMNTNEVLANIGLELMGHQKGEYQYLNPNDHLNKCQSTNDAYPTGFRIAVYASILKLIDAINQLGEGFGRKSKEFEKILKMGRTQLQDAVPMTLGQEFRAFQVLLNEETKNLQRTAELLLEVNLGATAIGTALNTPEGYSQLAVQKLAEISGLACVPAEDLIEATSDCGAYVMVHSALKRLAVKMSKICNDLRLLSSGPRTGLNEINLPELQAGSSIMPAKVNPVIPEVVNQVCFKVIGNDTCITMAAEAGQLQLNVMEPVIGQAMFESIHILTNACYNLLEKCINGITANKEVCERYVFNSIGIVTYLNPFIGHHNGDIVGKICAETGKNVREVVLERGLLTEAELDDIFSVENLMHPAYKAKRYTDENEQ

SEQ ID NO: 11088 - DNA, 1401 bp, Bradyrhizobium japonicum USDA 110
  CDS (1)..(1401)
atgagccgtacggagcaggatttcctcggacagcgtgagatcgccgacgatatttactacggcgtccagaccatccgcgggaaggagaacttccacatcaccggcattccgatgaaccaggagccttacttcgtgaaggcgctgggttacgtgaagaaggccgcggcgatggccaatcgcgatctcggcgtgatcgacgccagggtggccgatgcgatcatcctcggctgcgaccgcgtgattgccggcgacatgatggatcaattcgtcaccgacttcatccagggcggcgccggcacctcgaccaacatgaacgccaacgaggtgatcgccaacctcgcgctggaatcgctgggcttcaagaagggcgactaccagcacgtcagcccgaacgatcatgtgaactacggccagtcgaccaacgacacctatccgaccgcctttcgcctcgcgctgatcctgcggctcgagagctacatgacggcgctgcgccagctccaggaggcgttcttcgccaagggccgtgagttcgatcgcgtgctgaagatgggccgtacgcatcttcaggacgccgtgccgatgtcgctcggcgccgaattccgcggctggggtaccaccatgggcgaggaggtcgatcgtatctccgaggcacgggcgctgctgcgcgagatcaatctcggcgcgaccgcgatcggcacctccgtcaccgcggcgcacggctatcccaagctcgccgtccggcatctgagcgcgctgaccggcatcgacttcattctcgccggcgacctcgtcgaagcgacctcggacaccggtgcctatgtgcagctctccggcgtgctcaagcgcacggcgagcaagctgacaaaaatctgcaacgacatccggttgctggcttcgggcccgcgcgccggcttcaacgagatcaacctgccgcagctccagccgggctcctcgatcatgccggggaaggtcaatcccgtgatccccgaggtcgtcaaccagaccagcttccttgtcatcggcctcgacaccacggtgacgcttgccgcgtccgccggccagctccaactcaatgtgatggaaccggtgatctcgttcgcgctgttcttctcgatccgcaccatggagcgcgcggtcaacagcctgcgcgagaactgcgtcgtcggcatcaccgccaacgcggagcacacccgcaacatggtgctgaactcgctcggtatcgtcacggtgctgaagccgctgctcggctacaagcaatgcgccgagatcgcgcgcgagggttacaagagcggcaagtcgctgcaccagatcgtggtggtcgagcgcaagctgctgacgcaggagaagtgggacgagatgttctcgttcgagcggctgatcaatccggacctgattgcgtga

SEQ ID NO: 11089 - protein, 466 aa, Bradyrhizobium japonicum USDA 110
MSRTEQDFLGQREIADDIYYGVQTIRGKENFHITGIPMNQEPYFVKALGYVKKAAAMANRDLGVIDARVADAIILGCDRVIAGDMMDQFVTDFIQGGAGTSTNMNANEVIANLALESLGFKKGDYQHVSPNDHVNYGQSTNDTYPTAFRLALILRLESYMTALRQLQEAFFAKGREFDRVLKMGRTHLQDAVPMSLGAEFRGWGTTMGEEVDRISEARALLREINLGATAIGTSVTAAHGYPKLAVRHLSALTGIDFILAGDLVEATSDTGAYVQLSGVLKRTASKLTKICNDIRLLASGPRAGFNEINLPQLQPGSSIMPGKVNPVIPEVVNQTSFLVIGLDTTVTLAASAGQLQLNVMEPVISFALFFSIRTMERAVNSLRENCVVGITANAEHTRNMVLNSLGIVTVLKPLLGYKQCAEIAREGYKSGKSLHQIVVVERKLLTQEKWDEMFSFERLINPDLIA

SEQ ID NO: 11090 - DNA, 1416 bp, Wolinella succinogenes
  CDS (1)..(1416)
atggcatctacacgaatagaacacgatcttattggggacttagagctaagtaacgactgctattatggagttcaaactgctagagcgaaagagaacttccacatctcaggcgtcctactctcaagcatgcccactttcattgcttcactcgctaaagtcaaaaaagccgctgcactcgccaactttgagcttgggctcttggatgagaagatcaaaaacgccatctgcgaagcgtgcgatctcatcatcgctggaaaatatcacgaccaattcgtcgtggatgccatccaaggaggcgctggaacttccaccaacatgaacgccaatgaagtgatcgccaacgtcgcacttgagctcatgggacataaaaagggtgaatataaacattgccaccccaacaaccacgtcaacctctcacaatctactaatgatgcctatcctacggcattccgcgttgccctgtatgaaaaactcatcgagctcaccgtctccatgggaatcctaagagactcttttgccaaaaaggccgaggaattcaaagatatcatcaagatgggtcgaacccagctccaagacgctgtgcccatgaccctaggtcaagagtttaaaacctacgccgtcatgatgaccgaagatatcgatcgcgtgctagaggctagaaaccttgttcgagagatgaaccttggggcaaccgcgattggaacaggaatcaactctcaccctgactacgctacgcttgtagagaaaaaacttcaagaggtcacaggccgaccctttatcaccgccagcgatcttgttgaggcgactcaagacacaggggcttatgtccaaatctctggtgttcttaagcgtgtctccaccaaagtctccaaaatctgcaacgatctaagactccttagctcaggcccaagagcgggacttagcgagatcaatcttccccctatgcagcctggtagctccattatgcctggaaaggttaatcctgtgattcccgaagtggtcaatcaggtctgctaccacgttattggcgccgacatgactgtaactattgcctctgaagggggtcagcttcagctcaacgtttttgagcccgtcatcgcctttagcctctttagctctatcaacatgatgagaagagcttttgaaactttggctgaaaaatgcgtgaatggaatcaccgccaacgctgacaactgccgcgactatgtccttaagagcatcggactcgtcacagcgctcaacccctacatcggatatgagaactccacttcagtggccaaagaggcgctagagtcaggcaagtccgtccacgatatcgtcctagagcgcaaacttcttagcaaagaagagctagaagagattattcgacccgaaaacatgatcaagcccaaagtcgtcactctaacaaaaaaataa

SEQ ID NO: 11091 - protein, 471 aa, Wolinella succinogenes
MASTRIEHDLIGDLELSNDCYYGVQTARAKENFHISGVLLSSMPTFIASLAKVKKAAALANFELGLLDEKIKNAICEACDLIIAGKYHDQFVVDAIQGGAGTSTNMNANEVIANVALELMGHKKGEYKHCHPNNHVNLSQSTNDAYPTAFRVALYEKLIELTVSMGILRDSFAKKAEEFKDIIKMGRTQLQDAVPMTLGQEFKTYAVMMTEDIDRVLEARNLVREMNLGATAIGTGINSHPDYATLVEKKLQEVTGRPFITASDLVEATQDTGAYVQISGVLKRVSTKVSKICNDLRLLSSGPRAGLSEINLPPMQPGSSIMPGKVNPVIPEVVNQVCYHVIGADMTVTIASEGGQLQLNVFEPVIAFSLFSSINMMRRAFETLAEKCVNGITANADNCRDYVLKSIGLVTALNPYIGYENSTSVAKEALESGKSVHDIVLERKLLSKEELEEIIRPENMIKPKVVTLTKK

SEQ ID NO: 11092 - DNA, 1452 bp, Vibrio vulnificus
  CDS (1)..(1452)
atggctaccctaactgaagctccaaaagcatcaactccggccactcgtattgaagaagatctattaggccaacgtcacgttccggctgacgcttactacggtattcacacgctgcgcgccatcgaaaacttcaacatctcaaatgtcactatttctgacgtaccagaattcgttcgtggcatggttatgaccaaaaaagccgctgcgcttgctaacaaagaattgggcgcaattcctaagaatgtcgcggattacatcattcaagcgtgtgacctaatgttggaaactggcaaatgcatggatcagttcccatcagacgtattccaaggcggtgcgggcacttctgtgaacatgaacaccaacgaagtacttgccaacattgctctagaattaatgggcaaagagaaaggcgattacgacgtggtgaacccaaacgatcacgtgaacaagagccaatcaaccaactgtgcctacccaacaggcttccgtatcgcggtttacaacagcatccataaattgatggaagcgattgaatacctaaaaggtgcgtttgagctgaaatctcaagagtttaacgacatcctaaaaatgggccgtactcagttgcaagatgcagttccaatgactgtcggtcaagagttccacgcttgggcagtgacactaaacgaagagatccgtgcgctagactacacctcgaagctacttcttgaagtgaacctaggtgcaacggcaatcggtactggcttaaacacacctcctggttaccaagcacttgccgtgaaacacctagcggaagtaactggcctagaagtggttccagcagaagaccttatcgaagcaacttcagactgtggtgcttacgtaatggcacacggcgctctaaaacgcctagcggtgaaattgtctaagatctgtaacgacttgcgtctgctttcttctggtcctcgcgctggtttgaacgaacttaacttgccagaaatgcaagccggttcttcaatcatgccagcaaaagttaacccagttatcccagaagtggttaaccaagtgtgtttcaaagtactgggtaacgacaacacgatttctttcgcagccgaaggcggtcagctacagctgaacgtaatggagcctgtgattggtcaagcgatgtttgaatcgatttcactactacaaaacgcgtgtgtgaacctacgtgacaagtgtatcgacggcatcactgtgaacaaagagatctgtgaaaactacgtttacaactctatcggtatcgttacttacctaaacccatacatcggccaccacgaaggtgacatcgttggtaagatctgtgcggaaaccggtaagagcgtccgtgaagtagtgcttgagcgtggcttgctgacatctgaagagttggatgacatcctgtctgtgcagaacttcatgcacccaacttacaaagcaaaacgttacgaataa

SEQ ID NO: 11093 - protein, 483 aa, Vibrio vulnificus
MATLTEAPKASTPATRIEEDLLGQRHVPADAYYGIHTLRAIENFNISNVTISDVPEFVRGMVMTKKAAALANKELGAIPKNVADYIIQACDLMLETGKCMDQFPSDVFQGGAGTSVNMNTNEVLANIALELMGKEKGDYDVVNPNDHVNKSQSTNCAYPTGFRIAVYNSIHKLMEAIEYLKGAFELKSQEFNDILKMGRTQLQDAVPMTVGQEFHAWAVTLNEEIRALDYTSKLLLEVNLGATAIGTGLNTPPGYQALAVKHLAEVTGLEVVPAEDLIEATSDCGAYVMAHGALKRLAVKLSKICNDLRLLSSGPRAGLNELNLPEMQAGSSIMPAKVNPVIPEVVNQVCFKVLGNDNTISFAAEGGQLQLNVMEPVIGQAMFESISLLQNACVNLRDKCIDGITVNKEICENYVYNSIGIVTYLNPYIGHHEGDIVGKICAETGKSVREVVLERGLLTSEELDDILSVQNFMHPTYKAKRYE

SEQ ID NO: 11094 - DNA, 1428 bp, Porphyromonas gingivalis W83
  CDS (1)..(1428)
atggaattaaaaaagactacacgtatcgaaagcgatcttatcggagaacgcgagatacccggccatattctatatggcgtacagacgctgcgtggtatagaaaacttccccatcagcaattttcatctgaacgattaccccctgtttatcaatggcttggccatgacgaaatgggcggctgcagtggccaatcatcggctcggtctcttgaccgatgcccagaaagacggcatcgtgaaagcctgcaaggaaatcctcgaaggcaagcaccacgagcatttccccgtggatatgatccaaggcggtgcaggaacgaccacgaatatgaacgccaacgaggtgatttgcaaccgtgccttgcagatcatgggacacgaggcaggcgaatttgcccacctctcccccaatgatcacgtgaactgctcgcagagcaccaacgatgcttatccgacagctatccacctcggcctttacgctacatatctgaagttccgcccccatcttctggatctcatcgagtcgctgcgtgccaagagccgcgaatttgcccatgtactcaagatgggacgtactcagctcgaagatgctgtgcctatgtctctgggacagacgttcggcggatttgcttccatcttgcaggatgaaatcaaaaatctggactttgccgccgaagagttcctgaccgtgaatatgggtgctacggctatcggcacgggtatctgcgcccagccgaactatgccgaatactgcatagaggctcttcgtgaagtcaccggctgggacattcgtctcagtgccgatctggtaggggcaacgagcgacacttccgtgatggtaggatattcgtctgccttgcgccgtatctgtgtgaaggtgaacaagatttgcaacgacctgcgtctccttgccagcggtcctcgttgcggtttgcacgaattcaatctgcctgccatgcagccgggttcgtccatcatgccgggtaaggtgaatcctgtgattccggaagtaatgaatcagatctgctataaggtgatgggcaacgacctgaccgtaacgatggcaggcgatgcagcccaaatggagctgaacgctatggagcctgtgatggcacaatgctgcttcgaaagttcggatctgctcatgaacggattcgatacgctgcgtacactctgtatcgatggcatcacggccaacgaggacgaatgccgtgggtatatccgcaacagcatcggtatcgttacggctctgaatccgatcatcggctataagaattcgaccaagatcgccaaggaagcgatggaaacgggacgtggcgtttacgacctcgttttggaacacgacatcctgtcgaaagaggatctggatacgatactctcaccggagaatatgatcaagccggtcaagctcgacatcaaaccgcgtcgctga

SEQ ID NO: 11095 - protein, 475 aa, Porphyromonas gingivalis W83
MELKKTTRIESDLIGEREIPGHILYGVQTLRGIENFPISNFHLNDYPLFINGLAMTKWAAAVANHRLGLLTDAQKDGIVKACKEILEGKHHEHFPVDMIQGGAGTTTNMNANEVICNRALQIMGHEAGEFAHLSPNDHVNCSQSTNDAYPTAIHLGLYATYLKFRPHLLDLIESLRAKSREFAHVLKMGRTQLEDAVPMSLGQTFGGFASILQDEIKNLDFAAEEFLTVNMGATAIGTGICAQPNYAEYCIEALREVTGWDIRLSADLVGATSDTSVMVGYSSALRRICVKVNKICNDLRLLASGPRCGLHEFNLPAMQPGSSIMPGKVNPVIPEVMNQICYKVMGNDLTVTMAGDAAQMELNAMEPVMAQCCFESSDLLMNGFDTLRTLCIDGITANEDECRGYIRNSIGIVTALNPIIGYKNSTKIAKEAMETGRGVYDLVLEHDILSKEDLDTILSPENMIKPVKLDIKPRR

SEQ ID NO: 11096 - DNA, 1425 bp, Photorhabdus luminescens subsp
  CDS (1)..(1425)
atgtcaaacaacattcgtatcgaagaagacctgttaggtaaacgagaagtccctgctgaagcctattatggtattcacaccttacgtgcgattgaaaacttccatatcagtaacaacaccattaatgatgtacccgaattcatccgtggcatggtgatggtaaaaaaagccgcagccttagctaacaaagagctacaaactattcctaaaaaaattgctgacatcatcatcaaagcatgtgacgaagtgctctataccggcagatgcatggatcagtttccggtcgatgtgtttcaaggcggtgccggtacttcactcaacatgaataccaatgaggttctggcaaacattggtctggaactgttaggccataaaaaaggcgaatatgagtacctgaatcccaatgaccatctgaataaaagccagtcaactaacgacgcctacccaactggcttccgcatcgcggtttataactccatcctgaaactgatcgagtctattgagctgttaattgtgggtttcgataaaaaatccagagaatttaatgacattctaaaaatgggtcgtacccaattacaggatgctgttcccatgacactggggcaggaattcaacgcattctctatcctgttgaaagaagaagttaaaaacctcaaccgaacctctgaattactgctggaaattaaccttggcgctactgctatcggtacccgcttgaatacagcaccaggttatcagaaattggcggttgaaaaactggcggaagtttcaggtttaccttgcgtaccagccgaagacctgattgaagccacttctgactgtggggcttacgttatggtccacggtgctctgaagcgcctggctgtcaaactgtctaaaatttgtaatgacctgcgtttgctttcttctggccctcgtgctggcctgaatgaaatcaacctaccagaattacaggcaggctcttctattatgccggcaaaagtgaacccggttattccagaagttgtgaatcaggtttgcttcaaagttattggtaacgatatttgtgttactatggcgtccgaagcaggccagttacagctcaatgtaatggaacctgctatcggtcaggccatgtttgaatctatctccctgctaagcaacgcttgccgcaacctggtagaaaaatgcgttaatggcatcacggctaacaaagaagtttgcgaaaatttcgtattcaactcgatcggtatcgtgacatatctgaacccattcatcggtcaccataatggtgacattgttggtaaaatttgtgctgaaaccggtaaaagtgttcgtgaagtcgttctggaacgaggcttactgaccgaaactcaattggatgacatcttctctgtagagaacctaaaatgcccatcttacaaggcaaaacgttttgacgattaa

SEQ ID NO: 11097 - protein, 474 aa, Photorhabdus luminescens subsp
MSNNIRIEEDLLGKREVPAEAYYGIHTLRAIENFHISNNTINDVPEFIRGMVMVKKAAALANKELQTIPKKIADIIIKACDEVLYTGRCMDQFPVDVFQGGAGTSLNMNTNEVLANIGLELLGHKKGEYEYLNPNDHLNKSQSTNDAYPTGFRIAVYNSILKLIESIELLIVGFDKKSREFNDILKMGRTQLQDAVPMTLGQEFNAFSILLKEEVKNLNRTSELLLEINLGATAIGTRLNTAPGYQKLAVEKLAEVSGLPCVPAEDLIEATSDCGAYVMVHGALKRLAVKLSKICNDLRLLSSGPRAGLNEINLPELQAGSSIMPAKVNPVIPEVVNQVCFKVIGNDICVTMASEAGQLQLNVMEPAIGQAMFESISLLSNACRNLVEKCVNGITANKEVCENFVFNSIGIVTYLNPFIGHHNGDIVGKICAETGKSVREVVLERGLLTETQLDDIFSVENLKCPSYKAKRFDD

SEQ ID NO: 11098 - DNA, 1410 bp, Gloeobacter violaceus PCC 7421
  CDS (1)..(1410)
atgcaaccaagaaccgagcgcgactcgatgggcgagcgcaccctggaggccggagcctattacggcatccagaccctgcgcgccgtcgagaatttcccgattagcggcatcggcccgctgcccgacttcgtgcgcgcctgcaccctcatcaaacgggccgccgcccgggtgaacgccgagcttgaatgcatccccaaagacgtggcccaggcgatcattggcgcctcggacgaggtgctggcgggccagtggagcgatcagttcgtggtcgatatctttcaggcgggcgccggcacctcccaccacatgaatatcaacgaggtgctcgccaaccgcgccctcgagctgctgggttacgcgcggggcgactacaagcaggtcaaccccaacgatcacgtcaactacggccagtccaccaacgacgtgatccccactgccatccgtctgggagcgctctttgcaagcgcgccgctgttggaggcgctaagcaccctgcaacaaagtttcgaggccaagggcaacgagtttttgcccatcgtcaaatccgggcgcacccacctgcaggacgcggtgcccataaggcttggggatgaatttctggcctatgcccagatcgtcggcgagcaccgcgcccgcatcgaaaccgcctgccgcgagctattggtgctgggcctggggggcagcgccgccggtaccggcctcaacacccatccccagtaccgggtgcgcgtcgtcgccgaactggcccggctgacagggcaccccctcacccccgccccccgaccgatggcggcaatgcagagcatggcgcccttcgtggccgtctccggcagcctgcgcaatctggcccaggatctggtcaagatcgcgggcgatctgcgcctgatggattccggccccaagacgggcctgcgtgagatcgaactgccgccggtgcagccgggttcgtcgatcatgcccggcaagtacaacccggtgctgtgcgagatgctcacgatggtcgcctttcaggtgatgggctacgaccaggcgattgccttggccgcccaggcgggccaactggaattgaacgtgatgatgccgctgatcgcctacgacttgctccacagcttcacgatcctcaccaacgccctcacggtctttcgagcgcgctgcatcgacggcatccaggcccaacccgagcgctgcctggcctacgccgagggctcgatcgccctggtgaccgctctcaatccccacatcggctatctcaacgccgccgccgtcgccaaagaatcgctcgcgaccggccgctccctgcgcgagatcgttctcgagcgggggctactgaccgaagcgcaactcgccgagatcctcgaccttgaagcgatgagccggttgccggagacgcaggccgcctcagaccggtag

SEQ ID NO: 11099 - protein, 469 aa, Gloeobacter violaceus PCC 7421
MQPRTERDSMGERTLEAGAYYGIQTLRAVENFPISGIGPLPDFVRACTLIKRAAARVNAELECIPKDVAQAIIGASDEVLAGQWSDQFVVDIFQAGAGTSHHMNINEVLANRALELLGYARGDYKQVNPNDHVNYGQSTNDVIPTAIRLGALFASAPLLEALSTLQQSFEAKGNEFLPIVKSGRTHLQDAVPIRLGDEFLAYAQIVGEHRARIETACRELLVLGLGGSAAGTGLNTHPQYRVRVVAELARLTGHPLTPAPRPMAAMQSMAPFVAVSGSLRNLAQDLVKIAGDLRLMDSGPKTGLREIELPPVQPGSSIMPGKYNPVLCEMLTMVAFQVMGYDQAIALAAQAGQLELNVMMPLIAYDLLHSFTILTNALTVFRARCIDGIQAQPERCLAYAEGSIALVTALNPHIGYLNAAAVAKESLATGRSLREIVLERGLLTEAQLAEILDLEAMSRLPETQAASDR

SEQ ID NO: 11100 - DNA, 1404 bp, Chromobacterium violaceum ATCC 12472
  CDS (1)..(1404)
atgtccacccgtatcgaacacgacctgctcggcaaccgcgacgtgccggccgacgcctactggggcgtgcacacgctgcgcgccatcgaaaacttcccgatcaccggccagaccatcgccggctacggcgacctgatccgcgcgctggcctgcatcaagcaagccgccgcccaggccaaccgcgatctcggcattctcgaccccaagctggcccaggccatcgtcgacgcctgcgaggagatccgcgccggcaagctgcacgaccagttcgtcgtcgacgtgatccagggcggcgccggcacttccaccaatatgaacgccaacgaggtgatcgccaaccgcgcgctggagctgctgggccacgccaagggcgagtaccagcatctgcacccgaacgagcacgtcaacctgtgccagagcaccaacgacgtctacccgaccgcgctgcgcctggccgccttctggggcgtgctgaagctggtgtcgcggatggaaacgctgcgcaaggccttcgaggacaaggccgaggaattcaaggacatcctgaagatgggccgcacccagctgcaggacgcggtgccgatgacgctgggccaggagttccagacctatgctgtgatgctgggcgaggacgagcagcgtctgaaggaagccagcgccctgatgctggagatcaacctcggcgccaccgcgatcggcaccggcatcaccgcccacccggactacgccaagctggtgtgcctgcatctgtccgagctggtgggcagccagctgatcaccgcgcccaacctgatcgaggccacccaggactgcggcgccttcgtccagctgtccggcgtgatcaagcgcgcggcggtcaaactgtccaagacctgcaacgacctgcgcctgctgtcgtccggcccgcgcgcaggcttcggcgagatcaatctgccggcgcgccaggccggctcgtccatcatgccgggcaaggtcaatccggtgattccggaagtggtgagccaggtggcgtatgaagtcatcggcaacgacgtcaccatcaccatggcggccgaggccggccagctgcagctgaacgccttcgagccggtgatcgcctacagcctgttccgcagcgccggccacctggccaacgcctgcgacacgctgaccgagcactgcgtcaagggcatcaccgccaaccgcgagcggctgcgcctgagcgtggaaagctcgatcggcctggtcaccgcgctgaacccggtgatcggctacgaggccgccacccgcgtcgccgccgaagcccacgccaacggcagcagcgtcgccgacgtggtgctggcccatggcctgctcacccgcgagcagctggacgacatcctgcagccggagaccctgacccggccgcgctgggtgacgctgtaa

SEQ ID NO: 11101 - protein, 467 aa, Chromobacterium violaceum ATCC 12472
MSTRIEHDLLGNRDVPADAYWGVHTLRAIENFPITGQTIAGYGDLIRALACIKQAAAQANRDLGILDPKLAQAIVDACEEIRAGKLHDQFVVDVIQGGAGTSTNMNANEVIANRALELLGHAKGEYQHLHPNEHVNLCQSTNDVYPTALRLAAFWGVLKLVSRMETLRKAFEDKAEEFKDILKMGRTQLQDAVPMTLGQEFQTYAVMLGEDEQRLKEASALMLEINLGATAIGTGITAHPDYAKLVCLHLSELVGSQLITAPNLIEATQDCGAFVQLSGVIKRAAVKLSKTCNDLRLLSSGPRAGFGEINLPARQAGSSIMPGKVNPVIPEVVSQVAYEVIGNDVTITMAAEAGQLQLNAFEPVIAYSLFRSAGHLANACDTLTEHCVKGITANRERLRLSVESSIGLVTALNPVIGYEAATRVAAEAHANGSSVADVVLAHGLLTREQLDDILQPETLTRPRWVTL

SEQ ID NO: 11102 - DNA, 1440 bp, Helicobacter hepaticus ATCC 51449
  CDS (1)..(1440)
atgggcaaacgagtagaacacgattttattggcgaactagagattgccgatgatatgtattatggtgtgcaaacctttagagcattacaaaatttcaatattacaggcgataagctaagtagctatccaagctttatcaaggcttttgcgcaagtaaaaaaagctgcttgtttggcaaattatgaacttaaattgcttgatgagcaaaaaaaagatgctatttgcaaagcttgtgataggcttattgcaggcgagctaagagagcaatttgtagtagatatgcttcaaggtggagctggaacaagcacaaatatgaacacaaatgaagttgtagcaaatttggcattagagattatgggacataaaaaaggtgaatatcaatactgccacccaaatgaccacgtcaatctctcacaatctacaaatgattcatatcccactgctattcacgtagcactatatgacgagctttcagctcttgccaaagatatggaagtgctaaaagaatcttttaataaaaaatctcaagaatttaaagatgtgcttaaaatggggcgaactcaacttcaagatgctgtgcctatgactttaggacaagagtttcacacttttgcagtgatgatgggagaagatattgcgcgtgtgcttgaagcaagaaaccttgtaactgaaatcaatatgggtgggaccgcaattgggacaggcataaactcacaccctgattatcctaaaattgtccaaaagaaactctgtgaggttacaggacaccctttcaaaactgcagatgacctcattgaggccacacaagatacaggtgcgtatgtgcaagtaagtggtgtgcttaaaagagtagctgtgaaactctctaaagtctgtaatgacttacgactactaagctctggaccaagagcggggcttaatgaaatcaacctccccaaaatgcagcccggaagctccattatgcccggtaaagtaaatcctgtaatccctgaagttgttaatcaagtatgctatgcagtgattggtaatgatgtaactgtgagctttgcaagtgagggcggacaattgcagcttaatgtatttgagcctgtgattgcttatggattatttaactctatttctatgatgagaaatgctatgcttacacttgcaagcaaatgtattgacggaatcactgcaaatgaaaagatttgtagtgattttgtttataatagcattggtattgttacagctcttaatccttatattggctatgagaattctgcatcaattgctaaagaatctttacaaacaggcaaacctgttaaagaaattgcattagaaagaaagcttttaagcgaagagcaactcaatgagatttttcaaccaaaaaatatgctcaatccacatatgagcgcagaagataaggcgaaattccaaaaaaattcgccttttgcataa

SEQ ID NO: 11103 - protein, 479 aa, Helicobacter hepaticus ATCC 51449
MGKRVEHDFIGELEIADDMYYGVQTFRALQNFNITGDKLSSYPSFIKAFAQVKKAACLANYELKLLDEQKKDAICKACDRLIAGELREQFVVDMLQGGAGTSTNMNTNEVVANLALEIMGHKKGEYQYCHPNDHVNLSQSTNDSYPTAIHVALYDELSALAKDMEVLKESFNKKSQEFKDVLKMGRTQLQDAVPMTLGQEFHTFAVMMGEDIARVLEARNLVTEINMGGTAIGTGINSHPDYPKIVQKKLCEVTGHPFKTADDLIEATQDTGAYVQVSGVLKRVAVKLSKVCNDLRLLSSGPRAGLNEINLPKMQPGSSIMPGKVNPVIPEVVNQVCYAVIGNDVTVSFASEGGQLQLNVFEPVIAYGLFNSISMMRNAMLTLASKCIDGITANEKICSDFVYNSIGIVTALNPYIGYENSASIAKESLQTGKPVKEIALERKLLSEEQLNEIFQPKNMLNPHMSAEDKAKFQKNSPFA

SEQ ID NO: 11104 - DNA, 1428 bp, Haemophilus ducreyi 35000HP
  CDS (1)..(1428)
atgagtaatgtgcgtattgaagtggatttactcggcgaaagagaagtgccaaatcaggtctattggggaattcatactttaagagcggttgaaaattttaatatttctaacaatactatttcagatatacctgaatttgtccgtggtatggttatggtgaaaaaagccaccgcattagcaaatggcgaattaggtgcaattcccaaaaaagtggcacaggctattgtgcaagcgtgtgatgaaattttagtgaatggtcgttgtatggatcaatttccgtcagatgtttatcaaggcggtgccggtacctcggttaatatgaacactaatgaggttattgctaacttagcgcttgaaatgctagggcataaaaaaggggaatatcatattattgatccaatggatcacgttaatgctagtcaatcaacgaatgatgcttatcctacaggattccgcattgctgtgtataacagcttaatgcatttaattgaacaagtcctttatttacaacagggctttgaagagaaagcggtcgaatttgccaatgttcttaaaatggggcggacacagttgcaagatgcagtgcctatgacagttggtcaagaatttaaagcatttgcggtgttattagcagaagaagtacgtaatttaaaacgtactgctcaattattacttgaggttaacttaggcgcaactgcaattggcacggggttaaatacaccggcaggttattcagaattagcggtaaaatatttatcagaagtaacaggtttagcttgtgttttatcagaaaatttaattgaagcaacttcagattgtggtgcttatgtaatggtacacggtgcgttgaaacgtactgcggttaagttatctaaagtatgtaatgatttacgcttactttcatctggacctagagcgggtttgaatgaaattaatctgccggaattgcaagcgggttcttctattatgccagctaaagtaaatccagtggtacctgaggtggttaatcaagtatgctttaaagtgataggtaatgatacaaccgttacttttgcagcagaagcggggcagttacaattgaatgtaatggagccggtgattggacaggcaatgtttgaatctattgccattttagcaaatgcgtgtgtcaatttacgtgataaatgcgtcgatggcatcagtgtcaataaagaaatctgcgaaaattttgtgtttaattcaattgggattgtcacttatcttaatccatttattggccatcataatggcgatattgtgggtaagatttgtgctgaaacggggaaaggtgtacgtgaagtcattctcgaaaaaggattgctcaccgaagctcagttagatgatattctttcagtggaaaatttaatgcacccaatttataaagcaaaacggtttacggaagatgaataa

SEQ ID NO: 11105 - protein, 475 aa, Haemophilus ducreyi 35000HP
MSNVRIEVDLLGEREVPNQVYWGIHTLRAVENFNISNNTISDIPEFVRGMVMVKKATALANGELGAIPKKVAQAIVQACDEILVNGRCMDQFPSDVYQGGAGTSVNMNTNEVIANLALEMLGHKKGEYHIIDPMDHVNASQSTNDAYPTGFRIAVYNSLMHLIEQVLYLQQGFEEKAVEFANVLKMGRTQLQDAVPMTVGQEFKAFAVLLAEEVRNLKRTAQLLLEVNLGATAIGTGLNTPAGYSELAVKYLSEVTGLACVLSENLIEATSDCGAYVMVHGALKRTAVKLSKVCNDLRLLSSGPRAGLNEINLPELQAGSSIMPAKVNPVVPEVVNQVCFKVIGNDTTVTFAAEAGQLQLNVMEPVIGQAMFESIAILANACVNLRDKCVDGISVNKEICENFVFNSIGIVTYLNPFIGHHNGDIVGKICAETGKGVREVILEKGLLTEAQLDDILSVENLMHPIYKAKRFTEDE

SEQ ID NO: 11106 - DNA, 1413 bp, Streptomyces avermitilis
  CDS (1)..(1413)
atgaccgccgcagcccaccgcagcgaacacgacctgctcggagaccgcgacgtccccgccgaggcgtactggggcatccactccctgcgcgccaaggagaacttccccatcacggggacgccgatctccacgtacccgcatctgatcgacgccctcgccgccgtgaaggaggccgccgccctcgccaacgaggaactcggcctgctggagccgaagaaggccgcggccatcgtggccgcctgccgggagatccgggacggcaagctgcacgaccagttcgtcgtcgacgtcatccagggcggcgcgggcacctcgacgaacatgaacgccaacgaggtcatcgccaaccgggcccttgaactgctcggccacgccaagggcgagtaccggcacctgcaccccaacgaggacgtcaacctcggccagtcgaccaacgacgtctacccgaccgccgtgaagatcgcgaccgtgttcgcggtgcgcggtctgctcaaggccatggcggtgctccaggacgccttcgcccgcaaggccgtcgagttccgtgacgtgctgaagatgggccgcacccagctccaggacgcggtgcccatgacgctggggcaggagttctccgcgtacgccgtcatgctcgacgaggaccgcagccggctcgccgaggccgtcgaactgatccacgagatcaacctgggcgccacggcgatcggcaccggactcaacgcgcccgccggatacgccgagtcggcccgccgccagctcgccgccctcaccgggctgccgctggtcaccgccgccaacctggtcgaggccacccaggactgcggtgccttcgtccagatgtcgggggtgctcaagcggatcgccgtcaagctctccaagagctgcaacgacctgcggctgctgtcgtccgggccgcgcgcggggctcaacgagatcaacctgccgccggtacaggccggttcgagcatcatgcccggcaaggtcaacccggtcatccccgaggtcgtcaaccaggtcgccttcgaggtcatcggcaacgacgtcgcgatcaccatggccgccgaggcggggcagctccagctcaacgccttcgagccgatcatcctgcactcgctgtccgagagcatcacgcatctgcgggccgcctgcctgacgctcgccgagcggtgcgtcgacgggatcacggccaacaccgaggaactgcgcgccgccgtggagaactccatcggcctggtgaccgccctcaacccgcacatcgggtacacggcggccaccgccatcgccaaggaggccctcgccaccgggcgcggggtcgccgaactcgtcctggagaagggcctgttgccggccgaccggctcgcgtcgctgctgcggcccgaggtgctcgcgggcagcggctccccgcagatctga

SEQ ID NO: 11107 - protein, 470 aa, Streptomyces avermitilis
MTAAAHRSEHDLLGDRDVPAEAYWGIHSLRAKENFPITGTPISTYPHLIDALAAVKEAAALANEELGLLEPKKAAAIVAACREIRDGKLHDQFVVDVIQGGAGTSTNMNANEVIANRALELLGHAKGEYRHLHPNEDVNLGQSTNDVYPTAVKIATVFAVRGLLKAMAVLQDAFARKAVEFRDVLKMGRTQLQDAVPMTLGQEFSAYAVMLDEDRSRLAEAVELIHEINLGATAIGTGLNAPAGYAESARRQLAALTGLPLVTAANLVEATQDCGAFVQMSGVLKRIAVKLSKSCNDLRLLSSGPRAGLNEINLPPVQAGSSIMPGKVNPVIPEVVNQVAFEVIGNDVAITMAAEAGQLQLNAFEPIILHSLSESITHLRAACLTLAERCVDGITANTEELRAAVENSIGLVTALNPHIGYTAATAIAKEALATGRGVAELVLEKGLLPADRLASLLRPEVLAGSGSPQI

SEQ ID NO: 11108 - DNA, 1395 bp, Eikenella corrodens
  CDS (1)..(1395)
atgacaacccgaaccgaacacgacttcttcggcgaacgcgaaatccccgcaaccgcttattggggtatccacaccctgcgcgcagtggaaaacttccaaatctccgggcagaagatttccgacgtaccccagtttgtgcgcagcatggtgatggtgaaaaaagccgctgcccaggccaacggcgagctgggcgcactcaagcccgaaatcgccgccgccattgcccaagcttgcgacgaggtgctgctcaaaggccgttgcctcgaccagttcccatccgacgtattccaaggcggcgccggcacttcggtgaacatgaacaccaacgaagtgatcgccaacctcgccttggaagccttaggccaagccaaaggccgctacgacatcgtcaatcccatggatcatgtgaacgccagccaatttaccaacgacgcttaccctaccggcttccggctggctgtatacaccagcatcggcgaactgctagacaaactggcatacctgaaaaacacctttgctgccaaagctgatgaattcaaagacatattaaaaatgggccgcacccagctgcaagatgccgtgcccatgactgccggccaagaattccaatccttccaagtgctgctggcagaagaggaaaccaacctcgaacgcacccgccaactgctgctggaagtgaacctcggcgccacagccatcggcacaggcatcaatacgccgcaaggctacgcgccgctggccgtacaaaaactctccgaaatcagcggcctgccctgcaagctcaccgaaaacctgattgaagccacttccgactgcggtgcctatgtgatggtgcacggcgccctcaagcgcaccgccgtgaagctctccaaaatctgcaacgacctgcgcctactctcctccggcccgcgtgccggcctgaaagaaatcaacctgccggaaatgcaggccggctcatcgattatgcccgccaaggtgaatcccgtgattcccgaagtggtgaaccaagtttgtttcaaagtaatcggcaacgacaccaccatcaccttcgccgccgaagccggccagctccatcaacgtgatggagccggttatccgcaatccatgtttgaaagcatctcgcttttaggcaacgccgccattacgttggccgacaaatgcgtgcgcggcatcacggtaaaccgcgaaatctgcgaacgctacgtcttcaactccatcggcctggtaacctatctcaacccctatatcggccacgaaaacggcgacctggtgggcaaaatctgcgctcaaaccggcaaaaccgtgcgcgaagtggtactggagcgccagctcttgagcgaagcggagctcgaccgtatcctgtcgccacaaaacttggccaatccgcatttgtaa

SEQ ID NO: 11109 - protein, 464 aa, Eikenella corrodens
MTTRTEHDFFGEREIPATAYWGIHTLRAVENFQISGQKISDVPQFVRSMVMVKKAAAQANGELGALKPEIAAAIAQACDEVLLKGRCLDQFPSDVFQGGAGTSVNMNTNEVIANLALEALGQAKGRYDIVNPMDHVNASQFTNDAYPTGFRLAVYTSIGELLDKLAYLKNTFAAKADEFKDILKMGRTQLQDAVPMTAGQEFQSFQVLLAEEETNLERTRQLLLEVNLGATAIGTGINTPQGYAPLAVQKLSEISGLPCKLTENLIEATSDCGAYVMVHGALKRTAVKLSKICNDLRLLSSGPRAGLKEINLPEMQAGSSIMPAKVNPVIPEVVNQVCFKVIGNDTTITFAAEAGQLHQRDGAGYPQSMFESISLLGNAAITLADKCVRGITVNREICERYVFNSIGLVTYLNPYIGHENGDLVGKICAQTGKTVREVVLERQLLSEAELDRILSPQNLANPHL

SEQ ID NO: 11110 - DNA, 1452 bp, Vibrio parahaemolyticus
  CDS (1)..(1452)
atggctaccctatctgatgctccaaaaacagcaaaccaagccactcgtattgaagaagatctattaggtcaacgtcatgtccctgctgatgcgtactacggcattcataccctacgtgcgatcgaaaacttcaacatctctaacgtaactatttctgacgtacctgagttcgtacgcggcatggtgatgacgaagaaagcagcggcgttggcgaacaaagaacttggcgctattcctaaagaagttgctaactacatcctagaagcgtgtgatttgatcctagaaacaggcaagtgtatggatcagttcccttcagacgtattccaaggcggcgcgggtacttccgttaacatgaacactaacgaagttatcgcgaacgttgcacttgaactaatgggcaaagaaaaaggccaatacgagttcatcaacccgaacgaccacgttaacaagagccaatctactaactgtgcgtacccaactggtttccgtatcgcggtttacaacagcgtacacaaactaatggaagcgattgaatacctaaaaggcgcattcgatcttaaagcaactgaattcaaagacgtattgaagatgggtcgtactcagcttcaagacgcggtaccaatgactgttggtcaagagttccacgcttgggctgtaacgctaaacgaagagattcgtgctctagattacacatctaaactcctactagaaatcaacctaggtgcaaccgcaatcggtactggtcttaacacaccaactggttaccaagctctagcagtaaaacacctagcggaagtaactggccttgacgttgtgcctgcagaagacctaatcgaagcgacttctgactgtggtgcatacgtaatgactcacggcgcgctaaaacgtctagcagtgaaactatcgaagatctgtaacgaccttcgtctactttcttctggtcctcgcgcgggtctaaacgaattgaacctacctgaaatgcaagcaggttcttcaatcatgccagcgaaagtaaacccagttatcccagaagtagtaaaccaagtttgcttcaaagttctaggtaacgacaacacggtttctttcgcagcagaaggcggtcagctacagctaaacgtaatggaaccagttatcgcacaaagcatgtttgagtctatctctctactacacaatgcgtgtgtgaacctacgtgataaatgtatcgacggcatcactgtaaacaaagaaatctgtgagaactacgtttacaactcaatcggtatcgtaacttacctaaacccatacattggccaccacgaaggtgacattgtcggtaagatttgtgcagaaactggtaagagtgttcgtgaagtcgtgcttgagcgcggcctgctaactgcagaagaacttgatgaaatcttaacagttgaaaacttcatgcatcctacttacaaagcgaaacgctacgagtaa

SEQ ID NO: 11111 - protein, 483 aa, Vibrio parahaemolyticus
MATLSDAPKTANQATRIEEDLLGQRHVPADAYYGIHTLRAIENFNISNVTISDVPEFVRGMVMTKKAAALANKELGAIPKEVANYILEACDLILETGKCMDQFPSDVFQGGAGTSVNMNTNEVIANVALELMGKEKGQYEFINPNDHVNKSQSTNCAYPTGFRIAVYNSVHKLMEAIEYLKGAFDLKATEFKDVLKMGRTQLQDAVPMTVGQEFHAWAVTLNEEIRALDYTSKLLLEINLGATAIGTGLNTPTGYQALAVKHLAEVTGLDVVPAEDLIEATSDCGAYVMTHGALKRLAVKLSKICNDLRLLSSGPRAGLNELNLPEMQAGSSIMPAKVNPVIPEVVNQVCFKVLGNDNTVSFAAEGGQLQLNVMEPVIAQSMFESISLLHNACVNLRDKCIDGITVNKEICENYVYNSIGIVTYLNPYIGHHEGDIVGKICAETGKSVREVVLERGLLTAEELDEILTVENFMHPTYKAKRYE

SEQ ID NO: 11112 - DNA, 1425 bp, Pseudomonas syringae pv
  CDS (1)..(1425)
atgtcctcgcctgcatcatcgcgcatcgaaaaagacctgctaggtgttctcgaagtacctgccaacgcttattacggcatccagaccctgcgagcggtgaacaactttcacctttcgggcgtaccgctttcgcactatccgaaactggtagtagcgctggccatggtcaagcaggcggcagccgatgcaaaccatcagcttgggcacctcaacgataccaagcattcagcgatcagcgaggcgtgcgcccggctgatccgcggcgacttccatgaccagttcgtggtcgacatgattcagggcggcgctggcacttcgaccaacatgaatgccaacgaagtcatcgccaacatcgcgctggaaaccatgggtttcgagaagggcgaatacaaacacctgcaccccaacaacgacgtgaacatggcgcagtccaccaacgacgcctacccgaccgcgatccgcctgggtctgctgctgggtcatgacgcccttctcgccagccttgccagcctgatccaggcgttcgccgccaaaggcgaagaattcaaccatgtgctgaagatgggtcgtacccagttgcaggacgccgttccaatgactctgggccaggaattccgcgcctttgccaccacgctgaccgaagacctcaaccgtctgcgcagcctggcacccgaactgttgaccgaagtcaacctgggcggcacggccatcggtaccggcatcaacgccgaccccggctaccagaagcttgctgtcgaccgtttggcgctgatcagcggtcagccgctggtgccggcagccgacctgatcgaagcgacctccgacatgggcgcgttcgtactgttctcgggcatgctcaaacgcaccgcggtcaagctgtcgaagatctgcaacgacctgcgcctgttgtccagcggcccgcgcaccggcatcaacgaaatcaacctgccggcgcgccagccaggcagctctatcatgcccggcaaggtcaacccggtaatcccggaagcggtcaatcaggtggccttcgagatcatcggcaacgacctgtcgctgaccatggcagccgaaggtggccagttgcagctcaacgtcatggagccgctgatcgcctacaagatcttcgactcgatccgcttgctgcagcgcgccatggacatgctgcgcgaacactgcatcgtcggcatcaccgccaacgaacagcgctgccgcgaactggtcgagcactcgatcggtctggtcaccgcactgaacccgtacatcgggtatgaaaactccacccgtatcgcccgtatcgcgctggaaaccggccgtggcgtactggaactggtccgcgaagaaggtctgctcgacgacgccatgctcgacgacattctgcgaccggaaaacatgatcgctccacgtctggcccccttgaaggcctga

SEQ ID NO: 11113 - protein, 474 aa, Pseudomonas syringae pv
MSSPASSRIEKDLLGVLEVPANAYYGIQTLRAVNNFHLSGVPLSHYPKLVVALAMVKQAAADANHQLGHLNDTKHSAISEACARLIRGDFHDQFVVDMIQGGAGTSTNMNANEVIANIALETMGFEKGEYKHLHPNNDVNMAQSTNDAYPTAIRLGLLLGHDALLASLASLIQAFAAKGEEFNHVLKMGRTQLQDAVPMTLGQEFRAFATTLTEDLNRLRSLAPELLTEVNLGGTAIGTGINADPGYQKLAVDRLALISGQPLVPAADLIEATSDMGAFVLFSGMLKRTAVKLSKICNDLRLLSSGPRTGINEINLPARQPGSSIMPGKVNPVIPEAVNQVAFEIIGNDLSLTMAAEGGQLQLNVMEPLIAYKIFDSIRLLQRAMDMLREHCIVGITANEQRCRELVEHSIGLVTALNPYIGYENSTRIARIALETGRGVLELVREEGLLDDAMLDDILRPENMIAPRLAPLKA

SEQ ID NO: 11114 - DNA, 1437 bp, Pseudomonas putida
  CDS (1)..(1437)
atgatatacatcatgtcctctgctgcatcgttccgcgtcgaaaaagacttgttgggtacccttgaagttcctgcagatgcctactacggcatccagaccctgcgcgctgccaacaacttccacctctccggtgttccgctgtcgcactacccgaagctggtcgtggccctggccatggtcaagcaggccgctgccgacgccaaccgtgagctgggtcacctgagcgatgccaagcacgctgccatttccgcagcctgcgcccgcctgatcaaaggcgatttccacgaccagttcgtggtagacatgatccagggcggcgctggtacttctaccaacatgaacgccaacgaagtcattgccaacgttgcgctggaggccatgggccaccagaagggtgagtaccagtacctgcaccctaacaacgacgtgaacatggcgcagtcgaccaacgacgcctacccgaccgcaatccgcctgggcctgctgctgggccacgacgcgctgctggccagccttgatagcctgatccaggccttcgctgccaagggtaaagaattcgaccacgtactgaagatgggccgtacccagctgcaggacgccgtaccgatgaccctgggccaggaattccgcgccttcgccaccaccatgactgaagacctgcagcgcctgcgctcgctggctccggaactgctgaccgaaatcaacctgggcggtaccgccatcggtactggcatcaacgccgaccctggctaccaggccttggccgtacagcgcctggccaccatcagcggccacccgctggtaccggctgccgacctgatcgaagccacctccgacatgggcgccttcgtgctgttctccggcatgctcaagcgcaccgcggtcaagctgtcgaagatctgcaacgacctgcgcctgctgtccagcggcccacgcaccggcatcaacgagatcaacctgccagcgcgtcagccaggcagctcgatcatgccaggcaaggtcaacccggttattccagaagctgtgaaccaggtggccttcgccatcatgggcaacgacctggccctgaccgtcgccgccgaaggtggtcagctgcagctgaacgtgatggagccgctgatcgcctacaagatcttcgactcgatccgcctgctgcaacgcgccatggacatgctgcgcgagcactgcatcgtcggcatcaccgccaacgaacagcgctgccgtgaactggtcgagcactcgatcggcctggttaccgcactgaacccgtacatcggctacgaaaacgccacccgtattgcccgcgttgccctggaaagcggccgcggcgtactggaactggtgcgcgaagagaagctgctggacgacgcgatgctcgacgacatcctgcgtccggaaaacatgatcgctccacgtctggttccgctgaaggcgtaa

SEQ ID NO: 11115 - protein, 478 aa, Pseudomonas putida
MIYIMSSAASFRVEKDLLGTLEVPADAYYGIQTLRAANNFHLSGVPLSHYPKLVVALAMVKQAAADANRELGHLSDAKHAAISAACARLIKGDFHDQFVVDMIQGGAGTSTNMNANEVIANVALEAMGHQKGEYQYLHPNNDVNMAQSTNDAYPTAIRLGLLLGHDALLASLDSLIQAFAAKGKEFDHVLKMGRTQLQDAVPMTLGQEFRAFATTMTEDLQRLRSLAPELLTEINLGGTAIGTGINADPGYQALAVQRLATISGHPLVPAADLIEATSDMGAFVLFSGMLKRTAVKLSKICNDLRLLSSGPRTGINEINLPARQPGSSIMPGKVNPVIPEAVNQVAFAIMGNDLALTVAAEGGQLQLNVMEPLIAYKIFDSIRLLQRAMDMLREHCIVGITANEQRCRELVEHSIGLVTALNPYIGYENATRIARVALESGRGVLELVREEKLLDDAMLDDILRPENMIAPRLVPLKA

SEQ ID NO: 11116 - DNA, 1401 bp, Lactobacillus plantarum WCFS1
  CDS (1)..(1401)
atgcgaattgaagctgattgtattggtaagttagctgttccggatgatgctttgtatggaattcatacgttacgtgccgttcataattttccgattacgacggaattgatgcatccactgatcatgcaaagtcttgttcaaatcaagaaagcggcggccagtgtgaatgcggctgccggaactttgtctaatgataaggcacacgccattattgcggcatgtaatcagttactactggggcgttacgcggataacttcattgtgccagcgattcaggggggtgctgggacctcggctaacatgaacgtcaatgaagtggtggctaatttggctcaccggttgatgccggcagtcgccgttcatcccaatgatgatgttaatcaatcacaatcaaccaatgatacttttccaacggccggtaaaatggcgctttgcatgcaactcccaggactattaacggcactcagccggttggtacaaacgttactggttaaatcgcagcgttatcaagatgccatcaaagttggccgaactcagcttgaagatgcggtaccgacgacgtacgggcgaacctttcatgcttattaccaattattcaagcgtgatttgacccgtgtacggcaggcgggcgaacatctccgaatcgtaaatttgggtgggactgcaatcggtaccggcatcaacgcgactcacacgtatcaacagcagattttagtgaaattaaatcaaaatactgatttagatttagtagccgcaccagacttgatcgatgcaacgcaaaactgcgatttgttcgtggaattctctgcggccatgaagacgttagccgttgacctttccaagtttagcaatgacttaagattgctggcgagcggcccacaagctggctttggtgaattgaatttgcccgcgcagcaagcaggctcttctattatgccaggtaaaatcaatccggttattccggaggttgttaaccaagttgcgtttgaagtgattggtcacgacacgacggtaacaatggcagcggaagcgggccaattggaattaaacgcttttgagccaattatgttacgggcattgctagccagtgagcagcatttacagcaggccttgactacattagtcgatcactgtgtgcggcaattgacggtcaatcgccaacgctgtgcagatcaagtggcacattcggccattacggcaactgttttggcgccataccttggttacgagacgactaccgcgctgattaaagaagcgctcaccactaaccaagcaattcctgaattattacatcgacgtcgcttgcttagcgatgatttggtcgagcagctgttttcaccggccggactaactcagccacgtccagaggttattgaacaactacgagcggttgcaaagtag

SEQ ID NO: 11117 - protein, 466 aa, Lactobacillus plantarum WCFS1
MRIEADCIGKLAVPDDALYGIHTLRAVHNFPITTELMHPLIMQSLVQIKKAAASVNAAAGTLSNDKAHAIIAACNQLLLGRYADNFIVPAIQGGAGTSANMNVNEVVANLAHRLMPAVAVHPNDDVNQSQSTNDTFPTAGKMALCMQLPGLLTALSRLVQTLLVKSQRYQDAIKVGRTQLEDAVPTTYGRTFHAYYQLFKRDLTRVRQAGEHLRIVNLGGTAIGTGINATHTYQQQILVKLNQNTDLDLVAAPDLIDATQNCDLFVEFSAAMKTLAVDLSKFSNDLRLLASGPQAGFGELNLPAQQAGSSIMPGKINPVIPEVVNQVAFEVIGHDTTVTMAAEAGQLELNAFEPIMLRALLASEQHLQQALTTLVDHCVRQLTVNRQRCADQVAHSAITATVLAPYLGYETTTALIKEALTTNQAIPELLHRRRLLSDDLVEQLFSPAGLTQPRPEVIEQLRAVAK

SEQ ID NO: 11118 - DNA, 1413 bp, Clostridium tetani E88
  CDS (1)..(1413)
atgcaatacagattagaaagtgattcagtaggtgaaaaaagaataccaaaggatgcttattatggtgtgcaaagtcttagagcacaagagaattttatgataacaggaaaaaaagtccacacggaaatgataaaagcattagcagaggtaaaaaaagcaacagctatgacaaatatgcaagtggaacttttaagtaaaaaagcaggtaacgccattgtaaaagcttgtgatgaaataattgaaggaaatttacaagaacagtttataactgatcctatacaaggtggcgcaggaacatctatgaacatgaatttaaacgaagtaattgctaatagagcagtagaaatattaggtggggaaaagggagattatagtatagttcatcctaatgatcatgtaaatatgggacaatctactaacgatgttattcctacagggggaaaaatagcaactataagacttttagatagagcattaatgtcattagaaaatttagtagatgcacttacaaataaatctaaggaatttgatcatattataaaaatggggagaactcaaatgcaagatgctgtaccaataagattaggacaagaatttaaggcatattcaaatgctataaaaagggacatagttagaattaagagagcaaaagaagaattatatcatgtaagtattggggctacagctataggtacaggtataaatgctgatgaggagtatgtaaaaaatataacaccaaatttatcaaaagtaacaacacttagcctaattcaatgtgaagatttagtagatggaactcaaaatctagattgttttgcttcagtatcatcaaatttaaaggtttgtgctttaagtttatctaaaatagctaatgatttaagacttatgtcctcaggacctagaaccggttttggagaaataaatcttccagcaaaacaaaatgggtcatctataatgccaggaaaagtaaatccagtaatagctgaagttgtaaaccaagttgcatttagtattgtaggaaatgatgtaactattagcatggctgttgaagcaggacaattagaattaaacgcatttgagccggtgttatattataagttatttgaatctattgaaatattgaaaaatggtgtggatacatttattcataattgtataaatggtataacagcaaatgaggaaagatgtaaaaagttagtggataatagtgttggaataattactgcaatatgtccacatgtaggatataaaaaagcagctaaagtagcaaaaactgctatacagactggagaatctgtaaaggagcttgtattaaaagaaaatttattatcagaaaaagaattggatacaatacttgacccatttggaatgactaaaccaggaatatctgggaaagagctgttaaaaaagtaa

SEQ ID NO: 11119 - protein, 470 aa, Clostridium tetani E88
MQYRLESDSVGEKRIPKDAYYGVQSLRAQENFMITGKKVHTEMIKALAEVKKATAMTNMQVELLSKKAGNAIVKACDEIIEGNLQEQFITDPIQGGAGTSMNMNLNEVIANRAVEILGGEKGDYSIVHPNDHVNMGQSTNDVIPTGGKIATIRLLDRALMSLENLVDALTNKSKEFDHIIKMGRTQMQDAVPIRLGQEFKAYSNAIKRDIVRIKRAKEELYHVSIGATAIGTGINADEEYVKNITPNLSKVTTLSLIQCEDLVDGTQNLDCFASVSSNLKVCALSLSKIANDLRLMSSGPRTGFGEINLPAKQNGSSIMPGKVNPVIAEVVNQVAFSIVGNDVTISMAVEAGQLELNAFEPVLYYKLFESIEILKNGVDTFIHNCINGITANEERCKKLVDNSVGIITAICPHVGYKKAAKVAKTAIQTGESVKELVLKENLLSEKELDTILDPFGMTKPGISGKELLKK

SEQ ID NO: 11120 - DNA, 1461 bp, Bacteroides thetaiotaomicron VPI
  CDS (1)..(1461)
atgtgttattgttataaaacaaccgatatggaacagaaattatcaaaaaaaactcgtacagagagcgacttgataggtagtcgtgaagtgccggaaagtgcattgtatggagtacagacactccgtggtattgaaaactttcgcatcagcaagtttcatttgaatgagtatcccctgtttattcaggcattggccatcactaaaatgggagctgccgttgccaaccgtgaactggatttattgactgaggaacagacggatgccatactgaaggcttgtaaagaaatactggaaggaaaacatcatgaccaattccctgtagatatgatacagggtggagccggaaccaccaccaatatgaatgccaatgaagtgattgccaaccgtgcactggaactgatgggacatgcacgcggagagtatcactactgctcgcctaacgatcacgtcaatcgttcgcaatctaccaatgatgcgtatcctacagccattcacattggtctgtattatacccatcttaaattggtgaaacactttgcaacactgatcgaggctttccgaaagaaaggagcggagtttgcacacatcatcaagatgggacgtacccaactggaagatgccgtaccgatgacactaggacaaacctttaatggattcgcaagtattttggaacatgaactgaagaatctcgattttgccgcacaggattttctgacggtcaacatgggtgcgacagccatcggaaccggaattaccgccgaaccggaatatgcggaaaagtgcattgctgccctgcgcaagattacaggactggatatcaaactggcagatgacctgataggcgctacttcggatacttcctgcatggtaggatattcttcggccatgcggcgtgtagctgtcaagatgaacaagatttgtaatgatctgaggctattggcttccggtcctcgttgcggactgggagaaatcaatctgcctgccatgcagccgggctcttccattatgccgggaaaggtgaatcctgtcattccggaagtcatgaatcaggtctcttataaagtgataggaaacgacctttgtgtggctatgagtggagaggctgcgcagatggaactgaatgcgatggaacctgtcatggcacaatgctgttttgaatctgcggatttgttgatgaacggttttgatacattgcgtaccttatgtattgatggtatcacagccaatgaagaaaaatgccgtcgggatgtacacaacagtatcggagtagtgaccgcactgaatcccgtaattggctataaacattctacaaagatagcgaaggaggctctggaaacgggtaaaggagtgtatgagctggtgctggaacataacattctttccaaagaagacctggatacgatcttgaaaccggaaaatatgattaaaccggtgaaactggatattcatccgaatcattga

SEQ ID NO: 11121 - protein, 486 aa, Bacteroides thetaiotaomicron VPI
MCYCYKTTDMEQKLSKKTRTESDLIGSREVPESALYGVQTLRGIENFRISKFHLNEYPLFIQALAITKMGAAVANRELDLLTEEQTDAILKACKEILEGKHHDQFPVDMIQGGAGTTTNMNANEVIANRALELMGHARGEYHYCSPNDHVNRSQSTNDAYPTAIHIGLYYTHLKLVKHFATLIEAFRKKGAEFAHIIKMGRTQLEDAVPMTLGQTFNGFASILEHELKNLDFAAQDFLTVNMGATAIGTGITAEPEYAEKCIAALRKITGLDIKLADDLIGATSDTSCMVGYSSAMRRVAVKMNKICNDLRLLASGPRCGLGEINLPAMQPGSSIMPGKVNPVIPEVMNQVSYKVIGNDLCVAMSGEAAQMELNAMEPVMAQCCFESADLLMNGFDTLRTLCIDGITANEEKCRRDVHNSIGVVTALNPVIGYKHSTKIAKEALETGKGVYELVLEHNILSKEDLDTILKPENMIKPVKLDIHPNH

SEQ ID NO: 11122 - DNA, 1440 bp, Wigglesworthia glossinidia brevipalpis
  CDS (1)..(1440)
atgttaaattctattcgaatcgaacaagatatgattggaatacgtgaaatttcaaatgaattttattatggcattcatactcttagagctatagaaaatttcaaaattagtaaaaatactattaacgattatcctgaattaatcaagggaatggtgatggtgaaaaaagcatctgctcttgcaaacaaacatttaaaagttttatcagaaaaaaacgcaaaaattatagtaagagcttgtgattgtattttaaaaaaacaaaatatttatcttgatcaatttccagtagacgcttttcaaggaggagctggaacatctgtaaatatgaatgttaatgaagttttgactaatattggattagaaataatgggtaagaaaaaaggagattataagtttcttaatccaaatgatcatttaaatttaagtcaatccacaaacgatgcatatccaactggacttcgtttatcaatatataaatctatatacaaattaattaaatcaatcatattaattgaagatagtttttataaaaaatcaaaagaattttctaaaataataaaaatgggtagaacgcaattacaagatgctgtcccaatgacattgggtcaagaattttatgcttttaaaacatctttaaaaaaagaaagaataaatttaattaatacatctaaattattattagatattaatcttggaggaacagcaataggaactaaattaaatactcctaaaggatatcaaaaagtagttgtaaaacaattatcaattgttagcggaatacagttcaatccagtaaaagatcttatagaatctacatatgattgtggaatatatactattgtgcatggaaatttaaaaaatttagctattagattatctaaaatttgtaatgatttaagattattgtcatctgggccaagagctgggttaaatgaaataaatttacctgaacttcaagctggatcttcgataatgcctgctaaagttaacccagttttaccagaagtagttaatcaggtatgttttaaggtatgtggaaatgatatttgcgtaatgatggcagcagagtcaggtcaattacaattaaatgctatggaaccagtaataagtcaatctatatttgaatcaataaatattctcaaaaatgctattttatctttaaaagaaaaatgtatagatggaatcacagcaaataaaaaaatttgtgaatcttatgtattaaattctataggaatagttgcatatttaaatccttttattggtcatcataacggagatataatcggaaaaatttgttctaaaagcggtagaagtgtaaaagaagttgtattggaaaaaggatttttaacagaaaaagaacttaatgatattttttcatttaataatttaatacatccaaaatataaaaataaaaatagttctgaagatttatcaatctaa

SEQ ID NO: 11123 - protein, 479 aa, Wigglesworthia glossinidia brevipalpis
MLNSIRIEQDMIGIREISNEFYYGIHTLRAIENFKISKNTINDYPELIKGMVMVKKASALANKHLKVLSEKNAKIIVRACDCILKKQNIYLDQFPVDAFQGGAGTSVNMNVNEVLTNIGLEIMGKKKGDYKFLNPNDHLNLSQSTNDAYPTGLRLSIYKSIYKLIKSIILIEDSFYKKSKEFSKIIKMGRTQLQDAVPMTLGQEFYAFKTSLKKERINLINTSKLLLDINLGGTAIGTKLNTPKGYQKVVVKQLSIVSGIQFNPVKDLIESTYDCGIYTIVHGNLKNLAIRLSKICNDLRLLSSGPRAGLNEINLPELQAGSSIMPAKVNPVLPEVVNQVCFKVCGNDICVMMAAESGQLQLNAMEPVISQSIFESINILKNAILSLKEKCIDGITANKKICESYVLNSIGIVAYLNPFIGHHNGDIIGKICSKSGRSVKEVVLEKGFLTEKELNDIFSFNNLIHPKYKNKNSSEDLSI

SEQ ID NO: 11124 - DNA, 1617 bp, Corynebacterium efficiens YS
  CDS (1)..(1617)
atgtcgaacgaggataagaaggtgtccgaggacacgtccagcgagcaggcggagcaggtggaccagacggaccagaccggaaacccggaggattccgcggtggacggggaggccctggtgaccaccacggagaccacctccaccggtgagaagaccgcggcggcgaaggccgcggaaaaccgcaggaagatcaagaggaatttccgtgtggaatccgacctgctgggggagatggagatcccggccgatgcctactacggtgtccacaccctgcgtgccgtggagaacttccagatctcacgcaccaccatcaaccacgtcccggagttcatccgcggcatggtgcaggtgaagaaggccgccgccctggccaaccgccgcctgcacaccctgcccgccgacaaggccaaggcgatcatctgggcctgtgatcagatcctcgtcgagggccgctgcatggaccagttcccgatcgacgtgttccagggcggggcgggcaccagcaccaacatgaacaccaatgaggtggtggccaacctggcgctggagtacatggggtacgagaagggacgctacgacatcctgcaccccatggatgacgtgaacatgtcccagtccaccaatgatgcctatcccacgggtttccgactcggcatctatgctgcgatgaccaacctcatcgcggagatcgaacagctccaggtcgccttccgggagaagggcaatgagttcatcgacatcatcaagatgggccgcacccagctccaggatgcggtgccgatgagcctgggtgaggagttccaggccttcgccgcgaacctggccgaggaacagtccgtgctgcgcgcctccatggaccgtctcctcgaggtcaacctcggtgccaccgccatcggtaccggcgtgaacaccccggccggataccggcaccaggtggtcgcctccctctccgaggtcaccggcctggagatcaaatccgcccgtgatctcatcgaggccacctcggacaccggtgcctacgtcctggcgcattccgcggtcaagcgtgcagccatgaaactgtccaagatctgcaacgatctgcgcctgctgtcctccggcccgcgcgccggactcaacgagatcaacctcccgccgcgtcaggccggatcctccatcatgccggcgaaggtcaacccggtcatccccgaggtggtcaaccaggtctgcttcaaggtcttcggcaatgacctcaccgtggccatggccgccgaggccggtcagctgcagctcaatgtgatggaaccggtcatcggggagtcgctgttccagtcgatccgtatcctgggcaatgcgagcaagaccctgcgggagaagtgcgtggtgggcatcaccgcgaatgcggatgtctgccggtcctatgtggagaactccatcggcatcatcacctacctcaacccgtttttgggccatgacatcggtgatgccatcggtaaggaggccgcggagacgggccggtccgtccgggagctgatcctggagaagaacctcatggatgcggcgaccctggataccgtgttgtccaaggagaacctgatgcacccgatcttccggggcaagctgtacctggatcagtag

SEQ ID NO: 11125 - protein, 538 aa, Corynebacterium efficiens YS
MSNEDKKVSEDTSSEQAEQVDQTDQTGNPEDSAVDGEALVTTTETTSTGEKTAAAKAAENRRKIKRNFRVESDLLGEMEIPADAYYGVHTLRAVENFQISRTTINHVPEFIRGMVQVKKAAALANRRLHTLPADKAKAIIWACDQILVEGRCMDQFPIDVFQGGAGTSTNMNTNEVVANLALEYMGYEKGRYDILHPMDDVNMSQSTNDAYPTGFRLGIYAAMTNLIAEIEQLQVAFREKGNEFIDIIKMGRTQLQDAVPMSLGEEFQAFAANLAEEQSVLRASMDRLLEVNLGATAIGTGVNTPAGYRHQVVASLSEVTGLEIKSARDLIEATSDTGAYVLAHSAVKRAAMKLSKICNDLRLLSSGPRAGLNEINLPPRQAGSSIMPAKVNPVIPEVVNQVCFKVFGNDLTVAMAAEAGQLQLNVMEPVIGESLFQSIRILGNASKTLREKCVVGITANADVCRSYVENSIGIITYLNPFLGHDIGDAIGKEAAETGRSVRELILEKNLMDAATLDTVLSKENLMHPIFRGKLYLDQ

SEQ ID NO: 11126 - DNA, 1473 bp, Bifidobacterium longum
  CDS (1)..(1473)
atgctggcgtttccaacccacgcacaggaagatggaagcatgagcgaaacatcgaacaagacccgtctggaacatgactgcatcggccagatggaggtgccggcgaacgtctactggggtattcacacccagcgcgctatcggcaacttcccggtctccggcatcaccgatagccaacatcccgagctgattcgcgcctatgccacggtcaagcgcgcctgcgccatcgccaatgaggaattaggcctgatcgacccagccaaggccgaggccattcgcgccgcctgcctagaaattgaggccggcaaactggccgatcagttcccggtcgatgtgatgcagggcggtgccggcacctcgtcgaacatgaacatgaacgaggtgatcgccaaccgtgcgttggaaatcgccggccgccagcgcggcgattacacatacatccatccgaacgacgacgtcaacaagtcgcagtccacgaacgacacctacccggccgcctgcaaactcgcgcttatcgacgcgatcgggccgctcgccgagtccaccaagaaactcgccaaggccttccacgatctggccgacaaacatatcaatgacgtgacgattggccgcacgcagctgcaggacgccgtaccaatgacctatggtcaggaatttcatgcgtttgccacgctgttgaagtctgatttggctgcattcgatcgcgtggtgccgctgctggcccagctcaacctcggtgccaccgccatcggtaccggcatttgcgcggatctgcgattccgcaagtccgctatcaagcatctggcgcaaatcaccgggctgccggtcaccgccgcgcccgatccggtggccgccatgacggatatgggcgcgtacgtggccacgtcggctgccatcaagagcctcgccgtgcacctgaagaaggccgccgacgatttgcgactgctcaattccgggccgcgctgcggtttcaacgatctcaacgtgccggctcgccaggccggatcgtcgatcatgccggccaaagtgaaccctgtgatccccgaatgcgtcaaccagtgctgcttcacgattttcggcatggacgtgactgtgaactgggctgtggccgagggacagttgcagctgaacgccttcgacccggtgatggtgcatgagctgctgaccggcatggcgttgctgacgcacgccatggagacgttccgcgtcaactgcgtggaaggcatcgaaatcaatgctgacctggggcgttcatacgctcagtcctcaccgtcgatttccgccgcgctcaaccactacatcggctacgagcacgcggccgacatcgccgccgaagccgtacataccggccgtaccgtgcgcgaggtggccggcgaacgcaccgacctgcccgccgagcagttggacgagattctcgatccgattcgactggcccgaggcctcggccagacctgccgcgagcaccaggagtag

SEQ ID NO: 11127 - protein, 490 aa, Bifidobacterium longum
MLAFPTHAQEDGSMSETSNKTRLEHDCIGQMEVPANVYWGIHTQRAIGNFPVSGITDSQHPELIRAYATVKRACAIANEELGLIDPAKAEAIRAACLEIEAGKLADQFPVDVMQGGAGTSSNMNMNEVIANRALEIAGRQRGDYTYIHPNDDVNKSQSTNDTYPAACKLALIDAIGPLAESTKKLAKAFHDLADKHINDVTIGRTQLQDAVPMTYGQEFHAFATLLKSDLAAFDRVVPLLAQLNLGATAIGTGICADLRFRKSAIKHLAQITGLPVTAAPDPVAAMTDMGAYVATSAAIKSLAVHLKKAADDLRLLNSGPRCGFNDLNVPARQAGSSIMPAKVNPVIPECVNQCCFTIFGMDVTVNWAVAEGQLQLNAFDPVMVHELLTGMALLTHAMETFRVNCVEGIEINADLGRSYAQSSPSISAALNHYIGYEHAADIAAEAVHTGRTVREVAGERTDLPAEQLDEILDPIRLARGLGQTCREHQE

SEQ ID NO: 11128 - DNA, 1410 bp, Cytophaga sp
  CDS (1)..(1410)
atgggatcaacaagaaaagaacatgattttttaggggaattagatattcctaatcatttatattatggtatccaaactttcagagctgtagagaatttcaatattacaggaattccaatttcaaaagagcctttatttataaaagctttgggatatgtaaaaaaagcagcggctttagcgaacaaagattgcggacgacttgaccctaaaattgccgaagcaatctgttacggaagtgatcaggttattgccggtaaatttgatcaggaatttgtaagcgatttgattcagggaggagcaggaacatccgttaatatgaacgccaatgaagtgattgctaatattggtttagaatatctgggacataaaaaaggagattataacttcttgcacccgaataatcatgttaactgttctcaatctacaaacgatgcttatccatcagcttttagaattgcactttaccttaaaatggaaagttttattaaaacactggaaggtttagaagttgcatttgttgctaatggagaagaatttaaaagtgttttgaaaatgggaagaacgcaattgcaagatgcggttcctatgactttagggcaagaattcagatcttacgcaacaactataggcgaggatgtaagaaggttaaaagaagcgcaaagcctggtgttagaaatcaacatgggagcaacagcaattgggacaagagtaaacgcaccggaaggatatcctgaaatttgtgtgaactatttagcaaaagaagttgggattcctttaacgctttcgccggatttaattgaagctactgttgataccggagcttacgttcagattatggggacattgaaaagaactgctgtaaaaatttctaaaatctgtaatgatttaaggttattgagttcaggaccaagaactggtttcaacgaaatcaatttgccggcacgtcagccaggatcttctattatgccgggaaaagtaaatcctgtaattccggaagtcgtaaaccagacttgtttttatgttattggtcaggatttaacagttactatggctgctgaagcgggacaattgcaattgaatgtaatggagcctgtaattgcttttgccatgtttacctcattagattatctttctaatgcaattcagactttaattgataaatgtatcatcggaatcacagctaatgtagatcattgctataatatggtgatgaacagtattggtattgtaacgcaattaaaccctattttaggttacgaaataagtgccagtattgccggtgaagccttaaaaatgaataaaagcgttcacgaaattgttgtggtggaaagaaaattaatcactcaggaaaaatgggatgaaatttattctttagacaacttaataaatcctaagtttatcacgaaataa

SEQ ID NO: 11129 - protein, 469 aa, Cytophaga sp
MGSTRKEHDFLGELDIPNHLYYGIQTFRAVENFNITGIPISKEPLFIKALGYVKKAAALANKDCGRLDPKIAEAICYGSDQVIAGKFDQEFVSDLIQGGAGTSVNMNANEVIANIGLEYLGHKKGDYNFLHPNNHVNCSQSTNDAYPSAFRIALYLKMESFIKTLEGLEVAFVANGEEFKSVLKMGRTQLQDAVPMTLGQEFRSYATTIGEDVRRLKEAQSLVLEINMGATAIGTRVNAPEGYPEICVNYLAKEVGIPLTLSPDLIEATVDTGAYVQIMGTLKRTAVKISKICNDLRLLSSGPRTGFNEINLPARQPGSSIMPGKVNPVIPEVVNQTCFYVIGQDLTVTMAAEAGQLQLNVMEPVIAFAMFTSLDYLSNAIQTLIDKCIIGITANVDHCYNMVMNSIGIVTQLNPILGYEISASIAGEALKMNKSVHEIVVVERKLITQEKWDEIYSLDNLINPKFITK

SEQ ID NO: 11130 - DNA, 1386 bp, Thermoanaerobacter tengcongensis
  CDS (1)..(1386)
atgccgcgtattgaaaaagatttcttgggtgaattaacacttgaagataatgaactttatggaattcatacaaaacgagctttgaaaaacttctctgtatcttcacaaaagattgatatagatcttgtacgagcaattgtgatggtcaaaaaagcatgcgcaattgcaaattttgaggttggaaacctcgatgaaaaaataaaagatgcaattgtctttgcatgtgatgagattttagccggcaaatacaccgagcaatttgtggtagacaaattccaaggcggtgctggaacatctacaaatatgaacgtaaatgaagtaattgccaacatagcactcatttatcttggcaaaaaaccaggagagtatcaatacatccatcctatagaccatgttaatatgtcacaatcgacaaatgatgtctacccaaccgctttgaggattgcaacaatatggaatgtgagagaactttctgaagagtgtgcagaactccaaaaaagcttgcaaaaaaaagagcatgagtttgaaggtgtaattaaggctgggcgcactcaacttcaagatgcccttcccatcaccttagggcaagagtttggggcgtatgcacaggcgatatcacgcgatagatggcgaatatataaaattgaagaaagattaagagtggtaaacttgggcgcaacagctgttggaacaggagtgaatgcaagcttaaaatatatgtttaaagtgatagaacttttgcgcgattttactaaaataggcttggctcggtctgattacctcatggatgcaacacaaaatgcagatgtatttgtggaatgctcgggtcttttaaaagccttggcggtgaatctatcaaaaattgcaaatgacttaaggctcttatcatctggtccaaacacgggtttaaacgagataaacttacctgctgcacaagcaggttcaagcattatgcctggtaaagtaaatcctgtcatacctgaacttataaacaccatatcattccaggttatgtcaaatgatgttgcaataaccttagcagcccaagcaggtcagcttgagctaaatgcattcttgcctttaattgcaaacaatttgcttgaaagcctcaaaattctcaaaaacggaatcaggatattcagaaaacagtgcattgatggaataacagcaaacaaagaaagatgtcttgagtttgccaaaaagactccttctattgccgctgcattgattgataaaatagggtatgacaaggcaagtgaaattgctaaaaaagccattgccgagaataaggaaataattgaggtggtaaaggaattgaagatcttaaatgagaatgaggctgaagcactactaaatccttttgaatttgtaaagtttaaagagtaa

SEQ ID NO: 11131 - protein, 461 aa, Thermoanaerobacter tengcongensis
MPRIEKDFLGELTLEDNELYGIHTKRALKNFSVSSQKIDIDLVRAIVMVKKACAIANFEVGNLDEKIKDAIVFACDEILAGKYTEQFVVDKFQGGAGTSTNMNVNEVIANIALIYLGKKPGEYQYIHPIDHVNMSQSTNDVYPTALRIATIWNVRELSEECAELQKSLQKKEHEFEGVIKAGRTQLQDALPITLGQEFGAYAQAISRDRWRIYKIEERLRVVNLGATAVGTGVNASLKYMFKVIELLRDFTKIGLARSDYLMDATQNADVFVECSGLLKALAVNLSKIANDLRLLSSGPNTGLNEINLPAAQAGSSIMPGKVNPVIPELINTISFQVMSNDVAITLAAQAGQLELNAFLPLIANNLLESLKILKNGIRIFRKQCIDGITANKERCLEFAKKTPSIAAALIDKIGYDKASEIAKKAIAENKEIIEVVKELKILNENEAEALLNPFEFVKFKE

SEQ ID NO: 11132 - DNA, 1419 bp, Pasteurella multocida
  CDS (1)..(1419)
atgacagtaacaagaaaagaagtggatttactcggagaacgtgaagtaccagcagacgcatactggggaattcataccttaagagcggtagaaaattttaatatttcgaatgccgttatctcagatgtgcctgattttgtacgcggtatggtgatggtgaaaaaggcgaccgccttagcaaacggtgaattaggggcgattcctgataaaattgcaaaagcgattgtagctgcttgtgatgaaatcttaaccacaggcaaatgcttagatcaattcccgtcagatatttatcaaggcggtgcaggtacctcagtgaatatgaataccaatgaggttgtggcgaatttggcgttagagttattaggacataagaaaggggaataccaatatttagatccaatggatcatgttaacgctagccaatcaaccaatgacgcctatccaacaggtttccgtattgctgtctataacagtattatgaagctcgtggcaaaagtgctttatttacaacaaggttttgaaaataaagcaaaagaattttcgcacattcttaaaatgggacgcacgcaattacaagatgctgtgccaatgacagtaggacaagaatttaaagccttctctgttttattagatgaagaagttcgcaatttaacacgtacagcagaatacttattagaagttaatttaggtgcgacagcaattggtacgggcttaaatacaccaaaagggtatgcgccattagcggtcaaatacctgtctgaagtcacaggattaccttgtgtattagctgaaaacttaatcgaagctacctcggattgtggggcgtatgtgatggtacacggtgcattaaaacgtactgcggtgaaactatcaaaagtatgtaatgacttacgtctattatcttcaggtccgcgtgcagggttaaatgagattaatttgcctgaattacaagcgggttcatcgattatgccagcaaaagtcaacccagtggtacccgaagtggttaaccaagtttgctataaagtgatggggaacgatactaccattacctttgccgcagaggctggacaattacaattaaatgtcatggagccagtgattgcacaagcgatgtttgagtctattgatattttaaccaatgcttgtgtgaacttacgcgataaatgtattgatggcattacggtgaataaagaaacttgtgaaaactatgtctttaattctatcggtatcgtgacttatttaaatccatttattggacaccataatggtgacttagtcggtaaaatctgtgcgaaaacagggcgcggagtgaaagaggtcgtactcgaaaaaggactcctcacagaagcagaattagatgatattctctcagtggagaacttaatgaatccaacctataaagcgaagttgaataaataa

SEQ ID NO: 11133 - protein, 472 aa, Pasteurella multocida
MTVTRKEVDLLGEREVPADAYWGIHTLRAVENFNISNAVISDVPDFVRGMVMVKKATALANGELGAIPDKIAKAIVAACDEILTTGKCLDQFPSDIYQGGAGTSVNMNTNEVVANLALELLGHKKGEYQYLDPMDHVNASQSTNDAYPTGFRIAVYNSIMKLVAKVLYLQQGFENKAKEFSHILKMGRTQLQDAVPMTVGQEFKAFSVLLDEEVRNLTRTAEYLLEVNLGATAIGTGLNTPKGYAPLAVKYLSEVTGLPCVLAENLIEATSDCGAYVMVHGALKRTAVKLSKVCNDLRLLSSGPRAGLNEINLPELQAGSSIMPAKVNPVVPEVVNQVCYKVMGNDTTITFAAEAGQLQLNVMEPVIAQAMFESIDILTNACVNLRDKCIDGITVNKETCENYVFNSIGIVTYLNPFIGHHNGDLVGKICAKTGRGVKEVVLEKGLLTEAELDDILSVENLMNPTYKAKLNK

SEQ ID NO: 11134 - DNA, 1374 bp, Thermoplasma acidophilum
  CDS (1)..(1374)
atgaggacagaaagggatgttatcggggaggtgcagctgcccgacaatgtattttatggcataaacacggcaagggcaagggagaacttcaggatcaccgggctgaccgctgattctgatcacatcgtatcaattgcgcaggtcaagaaggctgcagcgcttgcaaatgccgacggaggcgcactggataaggagaaggcagattacatttcaaaggcatgcgacgagataatcggcgggaagtaccatgaccagttcgtgatagacgtctaccaggctggcgcaggaacatcctacaacatgaacgcaaatgaggtcatagccaacgttgcgctgacactgatgggcaagaataagggagagtactcggtgatacatccaaacgaccacgtgaacatgagccagtctacgaacgatgtttatccgacgatgatgcgattaacagtctccaagaagatcaggaagctcaaggatgcactcaacgaactcatagagagcttagaggcaaagagcagggaattcagggggatcgcaaagcccgggaggacccatctccaggatgctgcgcctgtaacgcttgggcttgagttcggagcctacgcctacgccatgaagaaggaccgtgatgagataatagatgcctcggactacataatggagctgaacataggggggacagcggttggcacggggataaacactgcgaagaactatcaggaaaacgtggtgaagcacataaacgagataacgaaggagaacttcaggaaaagcacgaatctgctcggcataatgcagttcatgacggatttctccagggtcatgaatgcggtcacgaacctcgccctggatgttgagaagatagcaaacgacataaggctgctttactccggccctggcgcaggcatccatgagataataattccagctgtacagcagggatcatccataatgccgggcaagataaacccgtccatcgccgaggccatgaacatgatctgccactcagtcataggagcgcagcaggcggttaatatgagcgttcaggcagggcagcttgagctgaacgtgatgatgcccaacatcgactacgagctgacgagatccatagacataatgacaaacggcctgaagatgttcaagcagaaactcatagacggcatcaaagctaacgttcctgtatgcagagaacacctggcgaacagcttcggttcagcagcgctccttaacccctatctcggatacgataacgttgcaaagatagtgagagaggccgttgaaactgggaaatcaataaaaagcctagtactcgcaaccggaaaactgacagaagagcagtacatgaagataatggacagtggggttccaaaggactga

SEQ ID NO: 11135 - protein, 457 aa, Thermoplasma acidophilum
MRTERDVIGEVQLPDNVFYGINTARARENFRITGLTADSDHIVSIAQVKKAAALANADGGALDKEKADYISKACDEIIGGKYHDQFVIDVYQAGAGTSYNMNANEVIANVALTLMGKNKGEYSVIHPNDHVNMSQSTNDVYPTMMRLTVSKKIRKLKDALNELIESLEAKSREFRGIAKPGRTHLQDAAPVTLGLEFGAYAYAMKKDRDEIIDASDYIMELNIGGTAVGTGINTAKNYQENVVKHINEITKENFRKSTNLLGIMQFMTDFSRVMNAVTNLALDVEKIANDIRLLYSGPGAGIHEIIIPAVQQGSSIMPGKINPSIAEAMNMICHSVIGAQQAVNMSVQAGQLELNVMMPNIDYELTRSIDIMTNGLKMFKQKLIDGIKANVPVCREHLANSFGSAALLNPYLGYDNVAKIVREAVETGKSIKSLVLATGKLTEEQYMKIMDSGVPKD

SEQ ID NO: 11136 - DNA, 2106 bp, Bacillus sp
  CDS (349)..(1755)
tctacagcaggaatccctgtattcactgtaaataaaccgatggaaccaaaaatggccatactaactgacagtttaatcatagcagatacattcatttgacttccctcaaaactatattaatatcctataattttccgaaaactctgaaataaaacaatatagaatctattaaataacatttatgtgaatttggcaatactattacaaaatattattaggaaacagggctctttttatattttctatgatagaatagtgtaggatttaataaagaaactctaatacaagttcgacaatgtaaacgtttgcttagagcttcgatagaaagaaaaggagattgtttttattatgaataccgatgttcgtattgagaaagactttttaggagaaaaggagattccgaaagacgcttattatggcgtacaaacaattcgggcaacggaaaattttccaattacaggttatcgtattcatccagaattaattaaatcactagggattgtaaaaaaatcagccgcattagcaaacatggaagttggcttactcgataaagaagttgggcaatatatcgtaaaagctgctgacgaagtgattgaaggaaaatggaatgatcaatttattgttgacccaattcaaggcggggcaggaacttccattaatatgaatgcaaatgaagtgattgctaaccgcgcattagaattaatgggagaggaaaaaggaaactattcaaaaattagtccaaactcccatgtaaatatgtctcaatcaacaaacgatgctttccctactgcaacgcatattgctgtgttaagtttattaaatcaattaattgaaactacaaaatacatgcaacaagaattcatgaaaaaagcagatgaattcgctggcgttattaaaatgggaagaacgcacttgcaagacgctgttcctattttattaggacaagagtttgaagcatatgctcgtgtaattgcccgcgatattgaacgtattgccaatacgagaaacaatttatacgacatcaacatgggtgcaacagcagtcggcactggcttaaatgcagatcctgaatatataagcatcgtaacagaacatttagcaaaattcagcggacatccattaagaagtgcacaacatttagtggacgcaactcaaaatacagactgctatacagaagtttcttctgcattaaaagtttgcatgatcaacatgtctaaaattgccaatgatttacgcttaatggcatctggaccacgcgcaggcttatcagaaatcgttcttcctgctcgacaacctggatcttctatcatgcctggtaaagtgaatcctgttatgccagaagtgatgaaccaagtggcattccaagtgttcggtaatgatttaacaattacatctgcttctgaagcaggccaatttgaattaaatgtgatggaacctgtgttattcttcaatttaattcaatcgatttcgattatgactaatgtctttaaatcctttacagaaaactgcttaaaaggtattaaggcaaatgaagaacgcatgaaagaatatgttgagaaaagcattggaatcattactgcaattaacccacatgtaggctatgaaacagctgcaaaattagcacgtgaagcatatcttacaggggaatccatccgtgaactttgcattaagtatggcgtattaacagaagaacagttaaatgaaatcttaaatccatatgaaatgacacatccgggaattgctggaagaaaataatgctacttttttaggcgaagggtactattgaggtgctctttgccttttattttttgagttacaacatgctcatcttgatgaagtgtaatcgaaatctgcaatgttcgataatagccaaaatcgtggagataatagtcaatcaagtaaggataatagtcaaactcgggcagataatagccaatggaagaaaaaggtgcttagcgaaattcgatattagtcaaaatcaagaagataatagtcaaccaagcaaggataatagtcaaacttgggaacataatagccaacggaagaaaaagttgcctcgcccctcggcaagataatagccaatggaagaaaaagttgcctcgcccg

SEQ ID NO: 11137 - protein, 468 aa, Bacillus sp
MNTDVRIEKDFLGEKEIPKDAYYGVQTIRATENFPITGYRIHPELIKSLGIVKKSAALANMEVGLLDKEVGQYIVKAADEVIEGKWNDQFIVDPIQGGAGTSINMNANEVIANRALELMGEEKGNYSKISPNSHVNMSQSTNDAFPTATHIAVLSLLNQLIETTKYMQQEFMKKADEFAGVIKMGRTHLQDAVPILLGQEFEAYARVIARDIERIANTRNNLYDINMGATAVGTGLNADPEYISIVTEHLAKFSGHPLRSAQHLVDATQNTDCYTEVSSALKVCMINMSKIANDLRLMASGPRAGLSEIVLPARQPGSSIMPGKVNPVMPEVMNQVAFQVFGNDLTITSASEAGQFELNVMEPVLFFNLIQSISIMTNVFKSFTENCLKGIKANEERMKEYVEKSIGIITAINPHVGYETAAKLAREAYLTGESIRELCIKYGVLTEEQLNEILNPYEMTHPGIAGRK

SEQ ID NO: 11138 - DNA, 1428 bp, Rhizobium etli
  CDS (1)..(1428)
atgacgacatccgatatgaccactattcgcgttgagcacgacctgatcggcgaccgcgacgtgccggcctcggcctattacggcgtgcatacggtgcgcgcggttgagaattttccaattaccggtcagacgctgaaggaatcggcggatctgatcgcctccctggcggcgatcaagcaggcggcggccgaggtcaatgttagcctcggccttctggatcagcagcgggccgacgccatcgtcgcggcttgcatcgaaatccgcgacggcgcgctgcacgaccagttcgtcgtcgatctgatccagggcggggcgggaacctcgaccaacatgaacgccaatgaggtgatcgcgaacagggcgctggaaatactggggcaccgccgcggcgagtaccagcacctgcatccgaacgagcacgtcaatctctcgcaatccaccaacgacgtctatccgacggcactgaagctcgccgcatggatcggcgttcaccgcctcgtcgacgccatggcgatcctgcgtcgcgcattcgcggccaaggcggtcgagtttgccgacgtgctgaagatgggccgcacccagttgcaggatgccgtgccgatgacgctcggccaggaattcggaacctacgcgctgatgctggcggaggacgaggcgcgcctcttggaagcggtctccttgatccgtgagatcaatctcggcgcgaccgcgatcggcaccggcatcaccgcccatcctcattatgccgcgctggtgcgcgagcgtctttcggccattgttggcatcgatctggtgacgtcacctgacctggtggaggcgacgcaggattgcggctccttcgtgcagctttcgggggttctcaagcgcgtggcggtcaagctttccaagacctgcaacgatctgcggctgctatcctccggcccgcgcgccggcttgaatgagatcaatctgccggcgcgccaggccggctcctcaatcatgcctggaaaggtaaaccctgttatccccgaggtcgtcaaccaggtcgccttcgaagtgatcggcaatgacgtgacgatcaccatggccgccgaggcaggccaactgcagctgaacgccttcgagccggtgatcttctacagcctctatcgcagtctcagccacctgaccaatgcctgcctgacgctagaggcgaattgcattcgagggattaccgccaaccgcgaccggctgcggcagacggtcgagcaatcgatcggcatcgtaacagcgctcaacccctatatcggctaccgcaacgccacagaggttgcgctggaagcgcatcattcgggacggggggtctatgaaatccttctcgagcgcggcctgatgcagaaggagcatctcgatgcggtgctgcgcccggaaacgctgacccggccgagcgagaagctgtccttctcgtaa

SEQ ID NO: 11139 - protein, 475 aa, Rhizobium etli
MTTSDMTTIRVEHDLIGDRDVPASAYYGVHTVRAVENFPITGQTLKESADLIASLAAIKQAAAEVNVSLGLLDQQRADAIVAACIEIRDGALHDQFVVDLIQGGAGTSTNMNANEVIANRALEILGHRRGEYQHLHPNEHVNLSQSTNDVYPTALKLAAWIGVHRLVDAMAILRRAFAAKAVEFADVLKMGRTQLQDAVPMTLGQEFGTYALMLAEDEARLLEAVSLIREINLGATAIGTGITAHPHYAALVRERLSAIVGIDLVTSPDLVEATQDCGSFVQLSGVLKRVAVKLSKTCNDLRLLSSGPRAGLNEINLPARQAGSSIMPGKVNPVIPEVVNQVAFEVIGNDVTITMAAEAGQLQLNAFEPVIFYSLYRSLSHLTNACLTLEANCIRGITANRDRLRQTVEQSIGIVTALNPYIGYRNATEVALEAHHSGRGVYEILLERGLMQKEHLDAVLRPETLTRPSEKLSFS

SEQ ID NO: 11140 - DNA, 1581 bp, Corynebacterium glutamicum
  CDS (1)..(1581)
atgtctaagacgagcaacaagtcttcagcagactcaaagaatgacgcaaaagccgaagacattgtgaacggcgagaaccaaatcgccacgaatgagtcgcagtcttcagacagcgctgcagtttcggaacgtgtcgtcgaaccaaaaaccacggttcagaaaaagttccgaatcgaatcggatctgcttggtgaacttcagatcccatcccacgcatattacggggtgcacacccttcgtgcggtggacaacttccaaatctcacgaaccaccatcaaccacgtcccagatttcattcgcggcatggtccaggtgaaaaaggccgcagctttagcaaaccgccgactgcacacacttccagcacaaaaagcagaagcaattgtctgggcttgtgatcagatcctcattgaggaacgctgtatggatcagttccccatcgatgtgttccagggtggcgcaggtacctcactgaacatgaacaccaacgaggttgttgccaaccttgcacttgagttcttaggccatgaaaagggcgagtaccacatcctgcaccccatggatgatgtgaacatgtcccagtccaccaacgattcctacccaactggtttccgcctgggcatttacgctggactgcagaccctcatcgctgaaattgatgagcttcaggttgcgttccgccacaagggcaatgagtttgtcgacatcatcaagatgggccgcacccagttgcaggatgctgttcccatgagcttgggcgaagagttccgagcattcgcgcacaacctcgcagaagagcagaccgtgctgcgtgaagctgccaaccgtctcctcgaggtcaatcttggtgcaaccgcaatcggtactggtgtgaacactccagcaggctaccgccaccaggttgtcgctgctctgtctgaggtcaccggactggaactaaagtccgcacgtgatctcatcgaggctacctctgacaccggtgcatatgttcatgcgcactccgcaatcaagcgtgcagccatgaaactgtccaagatctgtaacgatctacgtctgctgtcttctggtcctcgtgctggcttgaacgaaatcaacctgccaccacgccaggctggttcctccatcatgccagccaaggtcaacccagtgatcccagaagtggtcaaccaggtctgcttcaaggtcttcggtaacgatctcaccgtcaccatggctgcggaagctggccagttgcagctcaacgtcatggagccagtcattggcgaatccctcttccagtcactgcgcatcctgggcaatgcagccaagactttgcgtgagaagtgcgtcgtaggaatcaccgccaacgctgatgtttgccgtgcttacgttgataactccatcgggattatcacttacctgaacccattcctgggccacgacattggagatcagatcggtaaggaagcagccgaaactggtcgaccagtgcgtgaactcatcctggaaaagaagctcatggatgaaaagacgctcgaggcagtcctgtccaaggagaacctcatgcacccaatgttccgcggaaggctctacttggagaactaa

SEQ ID NO: 11141 - protein, 526 aa, Corynebacterium glutamicum
MSKTSNKSSADSKNDAKAEDIVNGENQIATNESQSSDSAAVSERVVEPKTTVQKKFRIESDLLGELQIPSHAYYGVHTLRAVDNFQISRTTINHVPDFIRGMVQVKKAAALANRRLHTLPAQKAEAIVWACDQILIEERCMDQFPIDVFQGGAGTSLNMNTNEVVANLALEFLGHEKGEYHILHPMDDVNMSQSTNDSYPTGFRLGIYAGLQTLIAEIDELQVAFRHKGNEFVDIIKMGRTQLQDAVPMSLGEEFRAFAHNLAEEQTVLREAANRLLEVNLGATAIGTGVNTPAGYRHQVVAALSEVTGLELKSARDLIEATSDTGAYVHAHSAIKRAAMKLSKICNDLRLLSSGPRAGLNEINLPPRQAGSSIMPAKVNPVIPEVVNQVCFKVFGNDLTVTMAAEAGQLQLNVMEPVIGESLFQSLRILGNAAKTLREKCVVGITANADVCRAYVDNSIGIITYLNPFLGHDIGDQIGKEAAETGRPVRELILEKKLMDEKTLEAVLSKENLMHPMFRGRLYLEN

SEQ ID NO: 11142 - DNA, 26 bp, Primer
atgtgtttaaagcaaatcattggcag

SEQ ID NO: 11143 - DNA, 25 bp, Primer
ttactgttcgctttcatcagtatag

SEQ ID NO: 11144 - DNA, 1791 bp, Saccharomyces cerevisiae; identical to SEQ ID NO: 7248
  CDS (2)..(1504)

SEQ ID NO: 11145 - protein, 500 aa, Saccharomyces cerevisiae; identical to SEQ ID NO: 7249

SEQ ID NO: 11146 - DNA, 1461 bp, Vibrio cholerae; identical to SEQ ID NO: 7250
  CDS (1)..(1461)

SEQ ID NO: 11147 - protein, 486 aa, Vibrio cholerae; identical to SEQ ID NO: 7251

SEQ ID NO: 11148 - DNA, 1455 bp, Chlamydophila pneumoniae, Chlamydia pneumoniae; identical to SEQ ID NO: 7252
  CDS (1)..(1455)

SEQ ID NO: 11149 - protein, 484 aa, Chlamydophila pneumoniae, Chlamydia pneumoniae; identical to SEQ ID NO: 7253

SEQ ID NO: 11150 - DNA, 1419 bp, Clostridium acetobutylicum; identical to SEQ ID NO: 7254
  CDS (1)..(1419)

SEQ ID NO: 11151 - protein, 472 aa, Clostridium acetobutylicum; identical to SEQ ID NO: 7255

SEQ ID NO: 11152 - DNA, 1413 bp, Yersinia pestis; identical to SEQ ID NO: 7256
  CDS (1)..(1413)

SEQ ID NO: 11153 - protein, 470 aa, Yersinia pestis; identical to SEQ ID NO: 7257

SEQ ID NO: 11154 - DNA, 1413 bp, Salmonella enterica subsp. enterica serovar Typhi; identical to SEQ ID NO: 7258
  CDS (1)..(1413)

SEQ ID NO: 11155 - protein, 470 aa, Salmonella enterica subsp. enterica serovar Typhi; identical to SEQ ID NO: 7259

SEQ ID NO: 11156 - DNA, 1758 bp, Listeria innocua; identical to SEQ ID NO: 7260
  CDS (1)..(1758)

SEQ ID NO: 11157 - protein, 585 aa, Listeria innocua; identical to SEQ ID NO: 7261

SEQ ID NO: 11158 - DNA, 1431 bp, Nostoc sp. PCC 7120; identical to SEQ ID NO: 7262
  CDS (1)..(1431)

SEQ ID NO: 11159 - protein, 476 aa, Nostoc sp. PCC 7120; identical to SEQ ID NO: 7263

SEQ ID NO: 11160 - DNA, 1440 bp, Agrobacterium tumefaciens; identical to SEQ ID NO: 7264
  CDS (1)..(1440)

SEQ ID NO: 11161 - protein, 479 aa, Agrobacterium tumefaciens; identical to SEQ ID NO: 7265

SEQ ID NO: 11162 - DNA, 1770 bp, Nostoc sp. PCC 7120; identical to SEQ ID NO: 7266
  CDS (1)..(1770)

SEQ ID NO: 11163 - protein, 589 aa, Nostoc sp. PCC 7120; identical to SEQ ID NO: 7267

SEQ ID NO: 11164 - DNA, 1401 bp, Thermotoga maritima; identical to SEQ ID NO: 7268
  CDS (1)..(1401)

SEQ ID NO: 11165 - protein, 466 aa, Thermotoga maritima; identical to SEQ ID NO: 7269

SEQ ID NO: 11166 - DNA, 1377 bp, Aeropyrum pernix; identical to SEQ ID NO: 7270
  CDS (1)..(1377)

SEQ ID NO: 11167 - protein, 458 aa, Aeropyrum pernix; identical to SEQ ID NO: 7271

SEQ ID NO: 11168 - DNA, 1449 bp, Deinococcus radiodurans; identical to SEQ ID NO: 7272
  CDS (1)..(1449)

SEQ ID NO: 11169 - protein, 482 aa, Deinococcus radiodurans; identical to SEQ ID NO: 7273

SEQ ID NO: 11170 - DNA, 1446 bp, Vibrio cholerae; identical to SEQ ID NO: 7274
  CDS (1)..(1446)

SEQ ID NO: 11171 - protein, 481 aa, Vibrio cholerae; identical to SEQ ID NO: 7275

SEQ ID NO: 11172 - DNA, 1740 bp, Halobacterium sp. NRC-1; identical to SEQ ID NO: 7276
  CDS (1)..(1740)

SEQ ID NO: 11173 - protein, 579 aa, Halobacterium sp. NRC-1; identical to SEQ ID NO: 7277

SEQ ID NO: 11174 - DNA, 1437 bp, Haemophilus influenzae; identical to SEQ ID NO: 7278
  CDS (1)..(1437)

SEQ ID NO: 11175 - protein, 478 aa, Haemophilus influenzae; identical to SEQ ID NO: 7279

SEQ ID NO: 11176 - DNA, 1434 bp, Borrelia burgdorferi (Lyme disease spirochete); identical to SEQ ID NO: 7280
  CDS (1)..(1434)

SEQ ID NO: 11177 - protein, 477 aa, Borrelia burgdorferi (Lyme disease spirochete); identical to SEQ ID NO: 7281

SEQ ID NO: 11178 - DNA, 1413 bp, Vibrio cholerae; identical to SEQ ID NO: 7282
  CDS (1)..(1413)

SEQ ID NO: 11179 - protein, 470 aa, Vibrio cholerae; identical to SEQ ID NO: 7283

SEQ ID NO: 11180 - DNA, 1755 bp, Bacillus halodurans; identical to SEQ ID NO: 7284
  CDS (1)..(1755)

SEQ ID NO: 11181 - protein, 584 aa, Bacillus halodurans; identical to SEQ ID NO: 7285

SEQ ID NO: 11182 - DNA, 1443 bp, Buchnera sp; identical to SEQ ID NO: 7286
  CDS (1)..(1443)

SEQ ID NO: 11183 - protein, 480 aa, Buchnera sp; identical to SEQ ID NO: 7287

SEQ ID NO: 11184 - DNA, 1344 bp, Methanococcus jannaschii; identical to SEQ ID NO: 7288
  CDS (1)..(1344)

SEQ ID NO: 11185 - protein, 447 aa, Methanococcus jannaschii; identical to SEQ ID NO: 7289

SEQ ID NO: 11186 - DNA, 1413 bp, Escherichia coli; identical to SEQ ID NO: 7290
  CDS (1)..(1413)

SEQ ID NO: 11187 - protein, 470 aa, Escherichia coli; identical to SEQ ID NO: 7291

SEQ ID NO: 11188 - DNA, 1434 bp, Pseudomonas aeruginosa; identical to SEQ ID NO: 7292
  CDS (1)..(1434)

SEQ ID NO: 11189 - protein, 477 aa, Pseudomonas aeruginosa; identical to SEQ ID NO: 7293

SEQ ID NO: 11190 - DNA, 1509 bp, Lactococcus lactis subsp. lactis; identical to SEQ ID NO: 7294
  CDS (1)..(1509)

SEQ ID NO: 11191 - protein, 502 aa, Lactococcus lactis subsp. lactis; identical to SEQ ID NO: 7295

SEQ ID NO: 11192 - DNA, 1431 bp, Caulobacter crescentus; identical to SEQ ID NO: 7296
  CDS (1)..(1431)

SEQ ID NO: 11193 - protein, 476 aa, Caulobacter crescentus; identical to SEQ ID NO: 7297

SEQ ID NO: 11194 - DNA, 1452 bp, Pseudomonas aeruginosa; identical to SEQ ID NO: 7298
  CDS (1)..(1452)

SEQ ID NO: 11195 - protein, 483 aa, Pseudomonas aeruginosa; identical to SEQ ID NO: 7299

SEQ ID NO: 11196 - DNA, 1437 bp, Pyrococcus horikoshii; identical to SEQ ID NO: 7300
  CDS (1)..(1437)

SEQ ID NO: 11197 - protein, 478 aa, Pyrococcus horikoshii; identical to SEQ ID NO: 7301

SEQ ID NO: 11198 - DNA, 1443 bp, Campylobacter jejuni; identical to SEQ ID NO: 7302
  CDS (1)..(1443)

SEQ ID NO: 11199 - protein, 480 aa, Campylobacter jejuni; identical to SEQ ID NO: 7303

SEQ ID NO: 11200 - DNA, 1446 bp, Chlamydia muridarum, Chlamydia trachomatis MoPn; identical to SEQ ID NO: 7304
  CDS (1)..(1446)

SEQ ID NO: 11201 - protein, 481 aa, Chlamydia muridarum, Chlamydia trachomatis MoPn; identical to SEQ ID NO: 7305

SEQ ID NO: 11202 - DNA, 1704 bp, Arabidopsis thaliana (mouse-ear cress); identical to SEQ ID NO: 7306
  CDS (1)..(1704)

SEQ ID NO: 11203 - protein, 567 aa, Arabidopsis thaliana (mouse-ear cress); identical to SEQ ID NO: 7307

SEQ ID NO: 11204 - DNA, 1758 bp, Staphylococcus aureus; identical to SEQ ID NO: 7308
  CDS (1)..(1758)

SEQ ID NO: 11205 - protein, 585 aa, Staphylococcus aureus; identical to SEQ ID NO: 7309

SEQ ID NO: 11206 - DNA, 1758 bp, Bacillus subtilis; identical to SEQ ID NO: 7310
  CDS (1)..(1758)

SEQ ID NO: 11207 - protein, 585 aa, Bacillus subtilis; identical to SEQ ID NO: 7311

SEQ ID NO: 11208 - DNA, 1419 bp, Mycobacterium tuberculosis; identical to SEQ ID NO: 7312
  CDS (1)..(1419)

SEQ ID NO: 11209 - protein, 472 aa, Mycobacterium tuberculosis; identical to SEQ ID NO: 7313

SEQ ID NO: 11210 - DNA, 1458 bp, Chlamydia trachomatis; identical to SEQ ID NO: 7314
  CDS (1)..(1458)

SEQ ID NO: 11211 - protein, 485 aa, Chlamydia trachomatis; identical to SEQ ID NO: 7315

SEQ ID NO: 11212 - DNA, 1437 bp, Pyrococcus abyssi; identical to SEQ ID NO: 7316
  CDS (1)..(1437)

SEQ ID NO: 11213 - protein, 478 aa, Pyrococcus abyssi; identical to SEQ ID NO: 7317

SEQ ID NO: 11214 - DNA, 1473 bp, Neisseria meningitidis; identical to SEQ ID NO: 7318
  CDS (1)..(1473)

SEQ ID NO: 11215 - protein, 490 aa, Neisseria meningitidis; identical to SEQ ID NO: 7319

SEQ ID NO: 11216 - DNA, 1506 bp, Streptococcus pneumoniae; identical to SEQ ID NO: 7320
  CDS (1)..(1506)

SEQ ID NO: 11217 - protein, 501 aa, Streptococcus pneumoniae; identical to SEQ ID NO: 7321

SEQ ID NO: 11218 - DNA, 1422 bp, Clostridium acetobutylicum; identical to SEQ ID NO: 7322
  CDS (1)..(1422)

SEQ ID NO: 11219 - protein, 473 aa, Clostridium acetobutylicum; identical to SEQ ID NO: 7323

SEQ ID NO: 11220 - DNA, 1359 bp, Sulfolobus solfataricus; identical to SEQ ID NO: 7324
  CDS (1)..(1359)

SEQ ID NO: 11221 - protein, 452 aa, Sulfolobus solfataricus; identical to SEQ ID NO: 7325

SEQ ID NO: 11222 - DNA, 1428 bp, Mycoplasma pulmonis; identical to SEQ ID NO: 7326
  CDS (1)..(1428): transl_table=4

SEQ ID NO: 11223 - protein, 475 aa, Mycoplasma pulmonis; identical to SEQ ID NO: 7327

SEQ ID NO: 11224 - DNA, 1533 bp, Solanum tuberosum (potato); identical to SEQ ID NO: 7328
  CDS (1)..(1533)

SEQ ID NO: 11225 - protein, 510 aa, Solanum tuberosum (potato); identical to SEQ ID NO: 7329

SEQ ID NO: 11226 - DNA, 2083 bp, Bacillus psychrophilus; identical to SEQ ID NO: 7330
  CDS (271)..(2031)

SEQ ID NO: 11227 - protein, 586 aa, Bacillus psychrophilus; identical to SEQ ID NO: 7331

SEQ ID NO: 11228 - DNA, 2054 bp, Bacillus licheniformis; identical to SEQ ID NO: 7332
  CDS (132)..(1889)

SEQ ID NO: 11229 - protein, 585 aa, Bacillus licheniformis; identical to SEQ ID NO: 7333

SEQ ID NO: 11230 - DNA, 1617 bp, Trichoderma reesei; identical to SEQ ID NO: 7334
  CDS (1)..(1617)

SEQ ID NO: 11231 - protein, 538 aa, Trichoderma reesei; identical to SEQ ID NO: 7335

SEQ ID NO: 11232 - DNA, 1725 bp, Rattus norvegicus (Norway rat); identical to SEQ ID NO: 7336
  CDS (1)..(1725)

SEQ ID NO: 11233 - protein, 574 aa, Rattus norvegicus (Norway rat); identical to SEQ ID NO: 7337

SEQ ID NO: 11234 - DNA, 1596 bp, Trypanosoma brucei; identical to SEQ ID NO: 7338
  CDS (59)..(1558)

SEQ ID NO: 11235 - protein, 499 aa, Trypanosoma brucei; identical to SEQ ID NO: 7339

SEQ ID NO: 11236 - DNA, 1581 bp, Aspergillus niger; identical to SEQ ID NO: 7340
  CDS (1)..(1581)

SEQ ID NO: 11237 - protein, 526 aa, Aspergillus niger; identical to SEQ ID NO: 7341

SEQ ID NO: 11238 - DNA, 1636 bp, Bacillus stearothermophilus; identical to SEQ ID NO: 7342
  CDS (114)..(1598)

SEQ ID NO: 11239 - protein, 494 aa, Bacillus stearothermophilus; identical to SEQ ID NO: 7343

SEQ ID NO: 11240 - DNA, 1581 bp, Emericella nidulans, Aspergillus nidulans; identical to SEQ ID NO: 7344
  CDS (1)..(1581)

SEQ ID NO: 11241 - protein, 526 aa, Emericella nidulans, Aspergillus nidulans; identical to SEQ ID NO: 7345

SEQ ID NO: 11242 - DNA, 1847 bp, Nicotiana tabacum (common tobacco); identical to SEQ ID NO: 7346
  CDS (45)..(1571)

SEQ ID NO: 11243 - protein, 508 aa, Nicotiana tabacum (common tobacco); identical to SEQ ID NO: 7347

SEQ ID NO: 11244 - DNA, 2243 bp, Nicotiana tabacum (common tobacco); identical to SEQ ID NO: 7348
  CDS (318)..(2006)

SEQ ID NO: 11245 - protein, 562 aa, Nicotiana tabacum (common tobacco); identical to SEQ ID NO: 7349

SEQ ID NO: 11246 - DNA, 2044 bp, Xenopus sp. (clawed frog); identical to SEQ ID NO: 7350
  CDS (29)..(1612)

SEQ ID NO: 11247 - protein, 527 aa, Xenopus sp. (clawed frog); identical to SEQ ID NO: 7351

SEQ ID NO: 11248 - DNA, 2146 bp, Mus musculus (house mouse); identical to SEQ ID NO: 7352
  CDS (30)..(1625)

SEQ ID NO: 11249 - protein, 531 aa, Mus musculus (house mouse); identical to SEQ ID NO: 7353

SEQ ID NO: 11250 - DNA, 1596 bp, Homo sapiens (man); identical to SEQ ID NO: 7354
  CDS (1)..(1596)

SEQ ID NO: 11251 - protein, 531 aa, Homo sapiens (man) [sequence omitted]

SEQ ID NO: 11252 - DNA, 2113 bp, Saccharomyces cerevisiae; identical to SEQ ID NO: 7356
  CDS (437)..(1957)

SEQ ID NO: 11253 - protein, 506 aa, Saccharomyces cerevisiae; identical to SEQ ID NO: 7357

SEQ ID NO: 11254 - DNA, 1527 bp, Mycoplasma pneumoniae; identical to SEQ ID NO: 7358
  CDS (1)..(1527): transl_table=4

SEQ ID NO: 11255 - protein, 508 aa, Mycoplasma pneumoniae; identical to SEQ ID NO: 7359

SEQ ID NO: 11256 - DNA, 1452 bp, Synechocystis sp; identical to SEQ ID NO: 7360
  CDS (1)..(1452)

SEQ ID NO: 11257 - protein, 483 aa, Synechocystis sp; identical to SEQ ID NO: 7361

SEQ ID NO: 11258 - DNA, 1776 bp, Synechocystis sp; identical to SEQ ID NO: 7362
  CDS (1)..(1776)

SEQ ID NO: 11259 - protein, 591 aa, Synechocystis sp; identical to SEQ ID NO: 7363

SEQ ID NO: 11260 - DNA, 1494 bp, Arabidopsis thaliana (mouse-ear cress); identical to SEQ ID NO: 7364
  CDS (1)..(1494)

SEQ ID NO: 11261 - protein, 497 aa, Arabidopsis thaliana (mouse-ear cress); identical to SEQ ID NO: 7365

SEQ ID NO: 11262 - DNA, 2115 bp, Ricinus communis (castor bean); identical to SEQ ID NO: 7366
  CDS (118)..(1869)

SEQ ID NO: 11263 - protein, 583 aa, Ricinus communis (castor bean); identical to SEQ ID NO: 7367

SEQ ID NO: 11264 - DNA, 2022 bp, Ricinus communis (castor bean); identical to SEQ ID NO: 7368
  CDS (46)..(1527)

SEQ ID NO: 11265 - protein, 493 aa, Ricinus communis (castor bean); identical to SEQ ID NO: 7369

SEQ ID NO: 11266 - DNA, 1548 bp, Caenorhabditis elegans; identical to SEQ ID NO: 7370
  CDS (1)..(1548)

SEQ ID NO: 11267 - protein, 515 aa, Caenorhabditis elegans; identical to SEQ ID NO: 7371

SEQ ID NO: 11268 - DNA, 1437 bp, Streptomyces coelicolor; identical to SEQ ID NO: 7372
  CDS (1)..(1437)

SEQ ID NO: 11269 - protein, 478 aa, Streptomyces coelicolor; identical to SEQ ID NO: 7373

SEQ ID NO: 11270 - DNA, 1530 bp, Schizosaccharomyces pombe; identical to SEQ ID NO: 7374
  CDS (1)..(1530)

SEQ ID NO: 11271 - protein, 509 aa, Schizosaccharomyces pombe; identical to SEQ ID NO: 7375

SEQ ID NO: 11272 - DNA, 1584 bp, Arabidopsis thaliana (mouse-ear cress); identical to SEQ ID NO: 7376
  CDS (40)..(1584)

SEQ ID NO: 11273 - protein, 514 aa, Arabidopsis thaliana (mouse-ear cress); identical to SEQ ID NO: 7377

SEQ ID NO: 11274 - DNA, 1533 bp, Arabidopsis thaliana (mouse-ear cress); identical to SEQ ID NO: 7378
  CDS (1)..(1533)

SEQ ID NO: 11275 - protein, 510 aa, Arabidopsis thaliana (mouse-ear cress); identical to SEQ ID NO: 7379

SEQ ID NO: 11276 - DNA, 1479 bp, Arabidopsis thaliana (mouse-ear cress); identical to SEQ ID NO: 7380
  CDS (1)..(1479)

SEQ ID NO: 11277 - protein, 492 aa, Arabidopsis thaliana (mouse-ear cress); identical to SEQ ID NO: 7381

SEQ ID NO: 11278 - DNA, 1572 bp, synthetic construct; identical to SEQ ID NO: 7382
  CDS (1)..(1572)

SEQ ID NO: 11279 - protein, 523 aa, synthetic construct; identical to SEQ ID NO: 7383

SEQ ID NO: 11280 - DNA, 2795 bp, Corynebacterium glutamicum; identical to SEQ ID NO: 7384
  CDS (740)..(2173)

SEQ ID NO: 11281 - protein, 477 aa, Corynebacterium glutamicum; identical to SEQ ID NO: 7385

SEQ ID NO: 11282 - DNA, 2264 bp, Bacillus subtilis; identical to SEQ ID NO: 7386
  CDS (258)..(2012)

SEQ ID NO: 11283 - protein, 584 aa, Bacillus subtilis; identical to SEQ ID NO: 7387

SEQ ID NO: 11284 - DNA, 2569 bp, Zymomonas mobilis; identical to SEQ ID NO: 7388
  CDS (137)..(1564)

SEQ ID NO: 11285 - protein, 475 aa, Zymomonas mobilis; identical to SEQ ID NO: 7389

SEQ ID NO: 11286 - DNA, 1701 bp, Homo sapiens; identical to SEQ ID NO: 7390
  CDS (1)..(1701)

SEQ ID NO: 11287 - protein, 566 aa, Homo sapiens; identical to SEQ ID NO: 7391

SEQ ID NO: 11288 - DNA, 1515 bp, Debaryomyces hansenii; identical to SEQ ID NO: 7392
  CDS (1)..(1515)

SEQ ID NO: 11289 - protein, 504 aa, Debaryomyces hansenii; identical to SEQ ID NO: 7393

SEQ ID NO: 11290 - DNA, 1443 bp, Erwinia carotovora subsp; identical to SEQ ID NO: 7394
  CDS (1)..(1443)

SEQ ID NO: 11291 - protein, 480 aa, Erwinia carotovora subsp; identical to SEQ ID NO: 7395

SEQ ID NO: 11292 - DNA, 1179 bp, Mycoplasma arthritidis; identical to SEQ ID NO: 7396
  CDS (1)..(1179): transl-table=4

SEQ ID NO: 11293 - protein, 392 aa, Mycoplasma arthritidis; identical to SEQ ID NO: 7397

SEQ ID NO: 11294 - DNA, 1437 bp, Mesoplasma florum L1; identical to SEQ ID NO: 7398
  CDS (1)..(1437): transl_table=4

SEQ ID NO: 11295 - protein, 478 aa, Mesoplasma florum L1; identical to SEQ ID NO: 7399

SEQ ID NO: 11296 - DNA, 1506 bp, Candida glabrata; identical to SEQ ID NO: 7400
  CDS (1)..(1506)

SEQ ID NO: 11297 - protein, 501 aa, Candida glabrata; identical to SEQ ID NO: 7401

SEQ ID NO: 11298 - DNA, 1527 bp, Candida glabrata; identical to SEQ ID NO: 7402
  CDS (1)..(1527)

SEQ ID NO: 11299 - protein, 508 aa, Candida glabrata; identical to SEQ ID NO: 7403

SEQ ID NO: 11300 - DNA, 1071 bp, Bacillus thuringiensis serovar konkukian str; identical to SEQ ID NO: 7404
  CDS (1)..(1071)

SEQ ID NO: 11301 - protein, 356 aa, Bacillus thuringiensis serovar konkukian str; identical to SEQ ID NO: 7405

SEQ ID NO: 11302 - DNA, 1960 bp, Zea mays; identical to SEQ ID NO: 7406
  CDS (144)..(1673)

SEQ ID NO: 11303 - protein, 509 aa, Zea mays; identical to SEQ ID NO: 7407

SEQ ID NO: 11304 - DNA, 1452 bp, Mycoplasma mobile; identical to SEQ ID NO: 7408
  CDS (1)..(1452)

SEQ ID NO: 11305 - protein, 483 aa, Mycoplasma mobile; identical to SEQ ID NO: 7409

SEQ ID NO: 11306 - DNA, 1668 bp, Picrophilus torridus; identical to SEQ ID NO: 7410
  CDS (1)..(1668)

SEQ ID NO: 11307 - protein, 555 aa, Picrophilus torridus; identical to SEQ ID NO: 7411

SEQ ID NO: 11308 - DNA, 1536 bp, Plasmodium falciparum; identical to SEQ ID NO: 7412
  CDS (1)..(1536)

SEQ ID NO: 11309 - protein, 511 aa, Plasmodium falciparum; identical to SEQ ID NO: 7413

SEQ ID NO: 11310 - DNA, 1458 bp, Photobacterium profundum; identical to SEQ ID NO: 7414
  CDS (1)..(1458)

SEQ ID NO: 11311 - protein, 485 aa, Photobacterium profundum; identical to SEQ ID NO: 7415

SEQ ID NO: 11312 - DNA, 1413 bp, Photobacterium profundum; identical to SEQ ID NO: 7416
  CDS (1)..(1413)

SEQ ID NO: 11313 - protein, 470 aa, Photobacterium profundum; identical to SEQ ID NO: 7417

SEQ ID NO: 11314 - DNA, 1344 bp, Methanococcus maripaludis; identical to SEQ ID NO: 7418
  CDS (1)..(1344)

SEQ ID NO: 11315 - protein, 447 aa, Methanococcus maripaludis; identical to SEQ ID NO: 7419

SEQ ID NO: 11316 - DNA, 1797 bp, Parachlamydia sp; identical to SEQ ID NO: 7420
  CDS (1)..(1797)

SEQ ID NO: 11317 - protein, 598 aa, Parachlamydia sp; identical to SEQ ID NO: 7421

SEQ ID NO: 11318 - DNA, 1488 bp, Bdellovibrio bacteriovorus; identical to SEQ ID NO: 7422
  CDS (1)..(1488)

SEQ ID NO: 11319 - protein, 495 aa, Bdellovibrio bacteriovorus; identical to SEQ ID NO: 7423

SEQ ID NO: 11320 - DNA, 1437 bp, Mycoplasma mycoides; identical to SEQ ID NO: 7424
  CDS (1)..(1437): transl_table=4

SEQ ID NO: 11321 - protein, 478 aa, Mycoplasma mycoides; identical to SEQ ID NO: 7425

SEQ ID NO: 11322 - DNA, 1434 bp, Rhodopseudomonas palustris; identical to SEQ ID NO: 7426
  CDS (1)..(1434)

SEQ ID NO: 11323 - protein, 477 aa, Rhodopseudomonas palustris; identical to SEQ ID NO: 7427

SEQ ID NO: 11324 - DNA, 1422 bp, Corynebacterium diphtheriae; identical to SEQ ID NO: 7428
  CDS (1)..(1422)

SEQ ID NO: 11325 - protein, 473 aa, Corynebacterium diphtheriae; identical to SEQ ID NO: 7429

SEQ ID NO: 11326 - DNA, 3179 bp, Lactobacillus casei; identical to SEQ ID NO: 7430
  CDS (1307)..(3070)

SEQ ID NO: 11327 - protein, 587 aa, Lactobacillus casei; identical to SEQ ID NO: 7431

SEQ ID NO: 11328 - DNA, 1341 bp, Onion yellows phytoplasma; identical to SEQ ID NO: 7432
  CDS (1)..(1341)

SEQ ID NO: 11329 - protein, 446 aa, Onion yellows phytoplasma; identical to SEQ ID NO: 7433

SEQ ID NO: 11330 - DNA, 2023 bp, Oryza sativa; identical to SEQ ID NO: 7434
  CDS (324)..(1688)

SEQ ID NO: 11331 - protein, 454 aa, Oryza sativa; identical to SEQ ID NO: 7435

SEQ ID NO: 11332 - DNA, 1410 bp, Desulfovibrio vulgaris; identical to SEQ ID NO: 7436
  CDS (1)..(1410)

SEQ ID NO: 11333 - protein, 469 aa, Desulfovibrio vulgaris; identical to SEQ ID NO: 7437

SEQ ID NO: 11334 - DNA, 1425 bp, Thermus thermophilus; identical to SEQ ID NO: 7438
  CDS (1)..(1425)

SEQ ID NO: 11335 - protein, 474 aa, Thermus thermophilus; identical to SEQ ID NO: 7439

SEQ ID NO: 11336 - DNA, 1317 bp, Leptospira interrogans; identical to SEQ ID NO: 7440
  CDS (1)..(1317)

SEQ ID NO: 11337 - protein, 438 aa, Leptospira interrogans; identical to SEQ ID NO: 7441

SEQ ID NO: 11338 - DNA, 1758 bp, Bacillus cereus; identical to SEQ ID NO: 7442
  CDS (1)..(1758)

SEQ ID NO: 11339 - protein, 585 aa, Bacillus cereus; identical to SEQ ID NO: 7443

SEQ ID NO: 11340 - DNA, 1059 bp, Bacillus cereus; identical to SEQ ID NO: 7444
  CDS (1)..(1059): n means a or g or c or t/u, w means a or t/u

SEQ ID NO: 11341 - protein, 352 aa, Bacillus cereus; identical to SEQ ID NO: 7445
  Xaa in position 224 is unknown

SEQ ID NO: 11342 - DNA, 1416 bp, Treponema denticola; identical to SEQ ID NO: 7446
  CDS (1)..(1416)

SEQ ID NO: 11343 - protein, 471 aa, Treponema denticola; identical to SEQ ID NO: 7447

SEQ ID NO: 11344 - DNA, 1419 bp, Mycobacterium paratuberculosis; identical to SEQ ID NO: 7448
  CDS (1)..(1419)

SEQ ID NO: 11345 - protein, 472 aa, Mycobacterium paratuberculosis; identical to SEQ ID NO: 7449

SEQ ID NO: 11346 - DNA, 1443 bp, Geobacter sulfurreducens; identical to SEQ ID NO: 7450
  CDS (1)..(1443)

SEQ ID NO: 11347 - protein, 480 aa, Geobacter sulfurreducens; identical to SEQ ID NO: 7451

SEQ ID NO: 11348 - DNA, 1770 bp, Lactobacillus johnsonii; identical to SEQ ID NO: 7452
  CDS (1)..(1770)

SEQ ID NO: 11349 - protein, 589 aa, Lactobacillus johnsonii; identical to SEQ ID NO: 7453

SEQ ID NO: 11350 - DNA, 1506 bp, Ashbya gossypii; identical to SEQ ID NO: 7454
  CDS (1)..(1506)

SEQ ID NO: 11351 - protein, 501 aa, Ashbya gossypii; identical to SEQ ID NO: 7455

SEQ ID NO: 11352 - DNA, 1461 bp, Leptospira interrogans; identical to SEQ ID NO: 7456
  CDS (1)..(1461)

SEQ ID NO: 11353 - protein, 486 aa, Leptospira interrogans; identical to SEQ ID NO: 7457

SEQ ID NO: 11354 - DNA, 1519 bp, Bombyx mori; identical to SEQ ID NO: 7458
  CDS (130)..(1341)

SEQ ID NO: 11355 - protein, 403 aa, Bombyx mori; identical to SEQ ID NO: 7459

SEQ ID NO: 11356 - DNA, 1437 bp, Pyrococcus kodakaraensis; identical to SEQ ID NO: 7460
  CDS (1)..(1437)

SEQ ID NO: 11357 - protein, 478 aa, Pyrococcus kodakaraensis; identical to SEQ ID NO: 7461

SEQ ID NO: 11358 - DNA, 1503 bp, Streptococcus pyogenes; identical to SEQ ID NO: 7462
  CDS (1)..(1503)

SEQ ID NO: 11359 - protein, 500 aa, Streptococcus pyogenes; identical to SEQ ID NO: 7463

SEQ ID NO: 11360 - DNA, 1476 bp, Vibrio vulnificus; identical to SEQ ID NO: 7464
  CDS (1)..(1476)

SEQ ID NO: 11361 - protein, 491 aa, Vibrio vulnificus; identical to SEQ ID NO: 7465

SEQ ID NO: 11362 - DNA, 1449 bp, Vibrio vulnificus; identical to SEQ ID NO: 7466
  CDS (1)..(1449)

SEQ ID NO: 11363 - protein, 482 aa, Vibrio vulnificus; identical to SEQ ID NO: 7467

SEQ ID NO: 11364 - DNA, 1410 bp, Photorhabdus luminescens; identical to SEQ ID NO: 7468
  CDS (1)..(1410)

SEQ ID NO: 11365 - protein, 469 aa, Photorhabdus luminescens; identical to SEQ ID NO: 7469

SEQ ID NO: 11366 - DNA, 1443 bp, Photorhabdus luminescens; identical to SEQ ID NO: 7470
  CDS (1)..(1443)

SEQ ID NO: 11367 - protein, 480 aa, Photorhabdus luminescens; identical to SEQ ID NO: 7471

SEQ ID NO: 11368 - DNA, 1527 bp, Mycoplasma gallisepticum; identical to SEQ ID NO: 7472
  CDS (1)..(1527)

SEQ ID NO: 11369 - protein, 508 aa, Mycoplasma gallisepticum; identical to SEQ ID NO: 7473

SEQ ID NO: 11370 - DNA, 1818 bp, Gloeobacter violaceus; identical to SEQ ID NO: 7474
  CDS (1)..(1818)

SEQ ID NO: 11371 - protein, 605 aa, Gloeobacter violaceus; identical to SEQ ID NO: 7475

SEQ ID NO: 11372 - DNA, 1422 bp, Gloeobacter violaceus; identical to SEQ ID NO: 7476
  CDS (1)..(1422)

SEQ ID NO: 11373 - protein, 473 aa, Gloeobacter violaceus; identical to SEQ ID NO: 7477

SEQ ID NO: 11374 - DNA, 1407 bp, Chromobacterium violaceum; identical to SEQ ID NO: 7478
  CDS (1)..(1407)

SEQ ID NO: 11375 - protein, 468 aa, Chromobacterium violaceum; identical to SEQ ID NO: 7479

SEQ ID NO: 11376 - DNA, 1662 bp, Giardia lamblia ATCC 50803; identical to SEQ ID NO: 7480
  CDS (1)..(1662)

SEQ ID NO: 11377 - protein, 553 aa, Giardia lamblia ATCC 50803; identical to SEQ ID NO: 7481

SEQ ID NO: 11378 - DNA, 1536 bp, Plasmodium yoelii yoelii; identical to SEQ ID NO: 7482
  CDS (1)..(1536)

SEQ ID NO: 11379 - protein, 511 aa, Plasmodium yoelii yoelii; identical to SEQ ID NO: 7483

SEQ ID NO: 11380 - DNA, 1584 bp, Neurospora crassa; identical to SEQ ID NO: 7484
  CDS (1)..(1584)

SEQ ID NO: 11381 - protein, 527 aa, Neurospora crassa; identical to SEQ ID NO: 7485

SEQ ID NO: 11382 - DNA, 1455 bp, Synechococcus sp; identical to SEQ ID NO: 7486
  CDS (1)..(1455)

SEQ ID NO: 11383 - protein, 484 aa, Synechococcus sp; identical to SEQ ID NO: 7487

SEQ ID NO: 11384 - DNA, 1431 bp, Rhodopirellula baltica; identical to SEQ ID NO: 7488
  CDS (1)..(1431)

SEQ ID NO: 11385 - protein, 476 aa, Rhodopirellula baltica; identical to SEQ ID NO: 7489

SEQ ID NO: 11386 - DNA, 1791 bp, Prochlorococcus marinus subsp; identical to SEQ ID NO: 7490
  CDS (1)..(1791)

SEQ ID NO: 11387 - protein, 596 aa, Prochlorococcus marinus subsp; identical to SEQ ID NO: 7491

SEQ ID NO: 11388 - DNA, 1818 bp, Prochlorococcus marinus; identical to SEQ ID NO: 7492
  CDS (1)..(1818)

SEQ ID NO: 11389 - protein, 605 aa, Prochlorococcus marinus; identical to SEQ ID NO: 7493

SEQ ID NO: 11390 - DNA, 1785 bp, Prochlorococcus marinus; identical to SEQ ID NO: 7494
  CDS (1)..(1785)

SEQ ID NO: 11391 - protein, 594 aa, Prochlorococcus marinus; identical to SEQ ID NO: 7495

SEQ ID NO: 11392 - DNA, 1440 bp, Haemophilus ducreyi; identical to SEQ ID NO: 7496
  CDS (1)..(1440)

SEQ ID NO: 11393 - protein, 479 aa, Haemophilus ducreyi; identical to SEQ ID NO: 7497

SEQ ID NO: 11394 - DNA, 1467 bp, Candidatus Blochmannia floridanus; identical to SEQ ID NO: 7498
  CDS (1)..(1467)

SEQ ID NO: 11395 - protein, 488 aa, Candidatus Blochmannia floridanus; identical to SEQ ID NO: 7499

SEQ ID NO: 11396 - DNA, 1443 bp, Bordetella parapertussis; identical to SEQ ID NO: 7500
  CDS (1)..(1443)

SEQ ID NO: 11397 - protein, 480 aa, Bordetella parapertussis; identical to SEQ ID NO: 7501

SEQ ID NO: 11398 - DNA, 2002 bp, Oryza sativa; identical to SEQ ID NO: 7502
  CDS (113)..(1648)

SEQ ID NO: 11399 - protein, 511 aa, Oryza sativa; identical to SEQ ID NO: 7503

SEQ ID NO: 11400 - DNA, 1071 bp, Bacillus cereus; identical to SEQ ID NO: 7504
  CDS (1)..(1071)

SEQ ID NO: 11401 - protein, 356 aa, Bacillus cereus; identical to SEQ ID NO: 7505

SEQ ID NO: 11402 - DNA, 1059 bp, Bacillus anthracis; identical to SEQ ID NO: 7506
  CDS (1)..(1059)

SEQ ID NO: 11403 - protein, 352 aa, Bacillus anthracis; identical to SEQ ID NO: 7507

SEQ ID NO: 11404 - DNA, 1446 bp, Chlamydophila caviae; identical to SEQ ID NO: 7508
  CDS (1)..(1446)

SEQ ID NO: 11405 - protein, 481 aa, Chlamydophila caviae; identical to SEQ ID NO: 7509

SEQ ID NO: 11406 - DNA, 1437 bp, Streptomyces avermitilis; identical to SEQ ID NO: 7510
  CDS (1)..(1437)

SEQ ID NO: 11407 - protein, 478 aa, Streptomyces avermitilis; identical to SEQ ID NO: 7511

SEQ ID NO: 11408 - DNA, 1431 bp, Streptomyces avermitilis; identical to SEQ ID NO: 7512
  CDS (1)..(1431)

SEQ ID NO: 11409 - protein, 476 aa, Streptomyces avermitilis; identical to SEQ ID NO: 7513

SEQ ID NO: 11410 - DNA, 1491 bp, Nitrosomonas europaea; identical to SEQ ID NO: 7514
  CDS (1)..(1491)

SEQ ID NO: 11411 - protein, 496 aa, Nitrosomonas europaea; identical to SEQ ID NO: 7515

SEQ ID NO: 11412 - DNA, 1758 bp, Enterococcus faecalis; identical to SEQ ID NO: 7516
  CDS (1)..(1758)

SEQ ID NO: 11413 - protein, 585 aa, Enterococcus faecalis; identical to SEQ ID NO: 7517

SEQ ID NO: 11414 - DNA, 1434 bp, Coxiella burnetii; identical to SEQ ID NO: 7518
  CDS (1)..(1434)

SEQ ID NO: 11415 - protein, 477 aa, Coxiella burnetii; identical to SEQ ID NO: 7519

SEQ ID NO: 11416 - DNA, 1422 bp, Tropheryma whipplei; identical to SEQ ID NO: 7520
  CDS (1)..(1422)

SEQ ID NO: 11417 - protein, 473 aa, Tropheryma whipplei; identical to SEQ ID NO: 7521

SEQ ID NO: 11418 - DNA, 1416 bp, Tropheryma whipplei; identical to SEQ ID NO: 7522
  CDS (1)..(1416)

SEQ ID NO: 11419 - protein, 471 aa, Tropheryma whipplei; identical to SEQ ID NO: 7523

SEQ ID NO: 11420 - DNA, 1584 bp, Shigella flexneri; identical to SEQ ID NO: 7524
  CDS (1)..(1584)

SEQ ID NO: 11421 - protein, 527 aa, Shigella flexneri; identical to SEQ ID NO: 7525

SEQ ID NO: 11422 - DNA, 1425 bp, Microbispora rosea subsp; identical to SEQ ID NO: 7526
  CDS (1)..(1425)

SEQ ID NO: 11423 - protein, 474 aa, Microbispora rosea subsp; identical to SEQ ID NO: 7527

SEQ ID NO: 11424 - DNA, 1806 bp, Oryza sativa; identical to SEQ ID NO: 7528
  CDS (75)..(1721)

SEQ ID NO: 11425 - protein, 548 aa, Oryza sativa; identical to SEQ ID NO: 7529

SEQ ID NO: 11426 - DNA, 1506 bp, Kluyveromyces lactis; identical to SEQ ID NO: 7530
  CDS (1)..(1506)

SEQ ID NO: 11427 - protein, 501 aa, Kluyveromyces lactis; identical to SEQ ID NO: 7531

SEQ ID NO: 11428 - DNA, 1506 bp, Saccharomyces kluyveri; identical to SEQ ID NO: 7532
  CDS (1)..(1506)

SEQ ID NO: 11429 - protein, 501 aa, Saccharomyces kluyveri; identical to SEQ ID NO: 7533

SEQ ID NO: 11430 - DNA, 1506 bp, Saccharomyces castellii; identical to SEQ ID NO: 7534
  CDS (1)..(1506)

SEQ ID NO: 11431 - protein, 501 aa, Saccharomyces castellii; identical to SEQ ID NO: 7535

SEQ ID NO: 11432 - DNA, 1521 bp, Saccharomyces bayanus; identical to SEQ ID NO: 7536
  CDS (1)..(1521)

SEQ ID NO: 11433 - protein, 506 aa, Saccharomyces bayanus; identical to SEQ ID NO: 7537

SEQ ID NO: 11434 - DNA, 1467 bp, Xylella fastidiosa; identical to SEQ ID NO: 7538
  CDS (1)..(1467)

SEQ ID NO: 11435 - protein, 488 aa, Xylella fastidiosa; identical to SEQ ID NO: 7539

SEQ ID NO: 11436 - DNA, 1479 bp, Vibrio parahaemolyticus; identical to SEQ ID NO: 7540
  CDS (1)..(1479)

SEQ ID NO: 11437 - protein, 492 aa, Vibrio parahaemolyticus; identical to SEQ ID NO: 7541

SEQ ID NO: 11438 - DNA, 1443 bp, Vibrio parahaemolyticus; identical to SEQ ID NO: 7542
  CDS (1)..(1443)

SEQ ID NO: 11439 - protein, 480 aa, Vibrio parahaemolyticus; identical to SEQ ID NO: 7543

SEQ ID NO: 11440 - DNA, 1413 bp, Vibrio parahaemolyticus; identical to SEQ ID NO: 7544
  CDS (1)..(1413)

SEQ ID NO: 11441 - protein, 470 aa, Vibrio parahaemolyticus; identical to SEQ ID NO: 7545

SEQ ID NO: 11442 - DNA, 1452 bp, Pseudomonas syringae; identical to SEQ ID NO: 7546
  CDS (1)..(1452)

SEQ ID NO: 11443 - protein, 483 aa, Pseudomonas syringae; identical to SEQ ID NO: 7547

SEQ ID NO: 11444 - DNA, 1416 bp, Pseudomonas putida; identical to SEQ ID NO: 7548
  CDS (1)..(1416)

SEQ ID NO: 11445 - protein, 471 aa, Pseudomonas putida; identical to SEQ ID NO: 7549

SEQ ID NO: 11446 - DNA, 1455 bp, Pseudomonas putida; identical to SEQ ID NO: 7550
  CDS (1)..(1455)

SEQ ID NO: 11447 - protein, 484 aa, Pseudomonas putida; identical to SEQ ID NO: 7551

SEQ ID NO: 11448 - DNA, 1761 bp, Lactobacillus plantarum; identical to SEQ ID NO: 7552
  CDS (1)..(1761)

SEQ ID NO: 11449 - protein, 586 aa, Lactobacillus plantarum; identical to SEQ ID NO: 7553

SEQ ID NO: 11450 - DNA, 1755 bp, Clostridium tetani; identical to SEQ ID NO: 7554
  CDS (1)..(1755)

SEQ ID NO: 11451 - protein, 584 aa, Clostridium tetani; identical to SEQ ID NO: 7555

SEQ ID NO: 11452 - DNA, 1437 bp, Bradyrhizobium japonicum; identical to SEQ ID NO: 7556
  CDS (1)..(1437)

SEQ ID NO: 11453 - protein, 478 aa, Bradyrhizobium japonicum; identical to SEQ ID NO: 7557

SEQ ID NO: 11454 - DNA, 1458 bp, Bacteroides thetaiotaomicron; identical to SEQ ID NO: 7558
  CDS (1)..(1458)

SEQ ID NO: 11455 - protein, 485 aa, Bacteroides thetaiotaomicron; identical to SEQ ID NO: 7559

SEQ ID NO: 11456 - DNA, 2797 bp, Staphylococcus epidermidis; identical to SEQ ID NO: 7560
  CDS (854)..(2611)

SEQ ID NO: 11457 - protein, 585 aa, Staphylococcus epidermidis; identical to SEQ ID NO: 7561

SEQ ID NO: 11458 - DNA, 1440 bp, Wigglesworthia glossinidia brevipalpis; identical to SEQ ID NO: 7562
  CDS (1)..(1440)

SEQ ID NO: 11459 - protein, 479 aa, Wigglesworthia glossinidia brevipalpis; identical to SEQ ID NO: 7563

SEQ ID NO: 11460 - DNA, 1413 bp, Vibrio vulnificus; identical to SEQ ID NO: 7564
  CDS (1)..(1413)

SEQ ID NO: 11461 - protein, 470 aa, Vibrio vulnificus; identical to SEQ ID NO: 7565

SEQ ID NO: 11462 - DNA, 1785 bp, Synechococcus elongatus; identical to SEQ ID NO: 7566
  CDS (1)..(1785)

SEQ ID NO: 11463 - protein, 594 aa, Synechococcus elongatus; identical to SEQ ID NO: 7567

SEQ ID NO: 11464 - DNA, 1503 bp, Streptococcus mutans; identical to SEQ ID NO: 7568
  CDS (1)..(1503)

SEQ ID NO: 11465 - protein, 500 aa, Streptococcus mutans; identical to SEQ ID NO: 7569

SEQ ID NO: 11466 - DNA, 1503 bp, Streptococcus agalactiae; identical to SEQ ID NO: 7570
  CDS (1)..(1503)

SEQ ID NO: 11467 - protein, 500 aa, Streptococcus agalactiae; identical to SEQ ID NO: 7571

SEQ ID NO: 11468 - DNA, 1440 bp, Shewanella oneidensis; identical to SEQ ID NO: 7572
  CDS (1)..(1440)

SEQ ID NO: 11469 - protein, 479 aa, Shewanella oneidensis; identical to SEQ ID NO: 7573

SEQ ID NO: 11470 - DNA, 1761 bp, Oceanobacillus iheyensis; identical to SEQ ID NO: 7574
  CDS (1)..(1761)

SEQ ID NO: 11471 - protein, 586 aa, Oceanobacillus iheyensis; identical to SEQ ID NO: 7575

SEQ ID NO: 11472 - DNA, 1497 bp, Mycoplasma penetrans; identical to SEQ ID NO: 7576
  CDS (1)..(1497): transl_table=4

SEQ ID NO: 11473 - protein, 498 aa, Mycoplasma penetrans; identical to SEQ ID NO: 7577

SEQ ID NO: 11474 - DNA, 1584 bp, Escherichia coli O6; identical to SEQ ID NO: 7578
  CDS (1)..(1584)

SEQ ID NO: 11475 - protein, 527 aa, Escherichia coli O6; identical to SEQ ID NO: 7579

SEQ ID NO: 11476 - DNA, 1437 bp, Brucella suis; identical to SEQ ID NO: 7580
  CDS (1)..(1437)

SEQ ID NO: 11477 - protein, 478 aa, Brucella suis; identical to SEQ ID NO: 7581

SEQ ID NO: 11478 - DNA, 1530 bp, Bifidobacterium longum; identical to SEQ ID NO: 7582
  CDS (1)..(1530)

SEQ ID NO: 11479 - protein, 509 aa, Bifidobacterium longum; identical to SEQ ID NO: 7583

SEQ ID NO: 11480 - DNA, 1890 bp, Lactobacillus delbrueckii; identical to SEQ ID NO: 7584
  CDS (1)..(1770)

SEQ ID NO: 11481 - protein, 589 aa, Lactobacillus delbrueckii; identical to SEQ ID NO: 7585

SEQ ID NO: 11482 - DNA, 2043 bp, Stigmatella aurantiaca; identical to SEQ ID NO: 7586
  CDS (463)..(1896)

SEQ ID NO: 11483 - protein, 477 aa, Stigmatella aurantiaca; identical to SEQ ID NO: 7587

SEQ ID NO: 11484 - DNA, 1584 bp, Arabidopsis thaliana; identical to SEQ ID NO: 7588
  CDS (1)..(1584)

SEQ ID NO: 11485 - protein, 527 aa, Arabidopsis thaliana; identical to SEQ ID NO: 7589

SEQ ID NO: 11486 - DNA, 1437 bp, Bartonella henselae; identical to SEQ ID NO: 7590
  CDS (1)..(1437)

SEQ ID NO: 11487 - protein, 478 aa, Bartonella henselae; identical to SEQ ID NO: 7591

SEQ ID NO: 11488 - DNA, 1533 bp, Glycine max; identical to SEQ ID NO: 7592
  CDS (1)..(1533)

SEQ ID NO: 11489 - protein, 510 aa, Glycine max; identical to SEQ ID NO: 7593

SEQ ID NO: 11490 - DNA, 1536 bp, Glycine max; identical to SEQ ID NO: 7594
  CDS (1)..(1536)

SEQ ID NO: 11491 - protein, 511 aa, Glycine max; identical to SEQ ID NO: 7595

SEQ ID NO: 11492 - DNA, 1527 bp, Xanthomonas campestris; identical to SEQ ID NO: 7596
  CDS (1)..(1527)

SEQ ID NO: 11493 - protein, 508 aa, Xanthomonas campestris; identical to SEQ ID NO: 7597

SEQ ID NO: 11494 - DNA, 1506 bp, Xanthomonas axonopodis; identical to SEQ ID NO: 7598
  CDS (1)..(1506)

SEQ ID NO: 11495 - protein, 501 aa, Xanthomonas axonopodis; identical to SEQ ID NO: 7599

SEQ ID NO: 11496 - DNA, 1434 bp, Methanosarcina mazei; identical to SEQ ID NO: 7600
  CDS (1)..(1434)

SEQ ID NO: 11497 - protein, 477 aa, Methanosarcina mazei; identical to SEQ ID NO: 7601

SEQ ID NO: 11498 - DNA, 1752 bp, Thermoanaerobacter tengcongensis; identical to SEQ ID NO: 7602
  CDS (1)..(1752)

SEQ ID NO: 11499 - protein, 583 aa, Thermoanaerobacter tengcongensis; identical to SEQ ID NO: 7603

SEQ ID NO: 11500 - DNA, 1428 bp, Fusobacterium nucleatum; identical to SEQ ID NO: 7604
  CDS (1)..(1428)

SEQ ID NO: 11501 - protein, 475 aa, Fusobacterium nucleatum; identical to SEQ ID NO: 7605

SEQ ID NO: 11502 - DNA, 1713 bp, Oryza sativa; identical to SEQ ID NO: 7606
  CDS (1)..(1713)

SEQ ID NO: 11503 - protein, 570 aa, Oryza sativa; identical to SEQ ID NO: 7607

SEQ ID NO: 11504 - DNA, 1872 bp, Oryza sativa; identical to SEQ ID NO: 7608
  CDS (1)..(1872)

SEQ ID NO: 11505 - protein, 623 aa, Oryza sativa; identical to SEQ ID NO: 7609

SEQ ID NO: 11506 - DNA, 1560 bp, Encephalitozoon cuniculi; identical to SEQ ID NO: 7610
  CDS (1)..(1560)

SEQ ID NO: 11507 - protein, 519 aa, Encephalitozoon cuniculi; identical to SEQ ID NO: 7611

SEQ ID NO: 11508 - DNA, 1470 bp, Methanosarcina acetivorans; identical to SEQ ID NO: 7612
  CDS (1)..(1470)

SEQ ID NO: 11509 - protein, 489 aa, Methanosarcina acetivorans; identical to SEQ ID NO: 7613

SEQ ID NO: 11510 - DNA, 1434 bp, Pyrococcus furiosus; identical to SEQ ID NO: 7614
  CDS (1)..(1434)

SEQ ID NO: 11511 - protein, 477 aa, Pyrococcus furiosus; identical to SEQ ID NO: 7615

SEQ ID NO: 11512 - DNA, 1404 bp, Clostridium perfringens; identical to SEQ ID NO: 7616
  CDS (1)..(1404)

SEQ ID NO: 11513 - protein, 467 aa, Clostridium perfringens; identical to SEQ ID NO: 7617

SEQ ID NO: 11514 - DNA, 1419 bp, Ralstonia solanacearum; identical to SEQ ID NO: 7618
  CDS (1)..(1419)

SEQ ID NO: 11515 - protein, 472 aa, Ralstonia solanacearum; identical to SEQ ID NO: 7619

SEQ ID NO: 11516 - DNA, 1440 bp, Ralstonia solanacearum; identical to SEQ ID NO: 7620
  CDS (1)..(1440)

SEQ ID NO: 11517 - protein, 479 aa, Ralstonia solanacearum; identical to SEQ ID NO: 7621

SEQ ID NO: 11518 - DNA, 1443 bp, Salmonella typhimurium; identical to SEQ ID NO: 7622
  CDS (1)..(1443)

SEQ ID NO: 11519 - protein, 480 aa, Salmonella typhimurium; identical to SEQ ID NO: 7623

SEQ ID NO: 11520 - DNA, 1386 bp, Pyrobaculum aerophilum; identical to SEQ ID NO: 7624
  CDS (1)..(1386)

SEQ ID NO: 11521 - protein, 461 aa, Pyrobaculum aerophilum; identical to SEQ ID NO: 7625

SEQ ID NO: 11522 - DNA, 1440 bp, Rhizobium meliloti; identical to SEQ ID NO: 7626
  CDS (1)..(1440)

SEQ ID NO: 11523 - protein, 479 aa, Rhizobium meliloti; identical to SEQ ID NO: 7627

SEQ ID NO: 11524 - DNA, 1745 bp, Mastigamoeba balamuthi; identical to SEQ ID NO: 7628
  CDS (36)..(1541)

SEQ ID NO: 11525 - protein, 501 aa, Mastigamoeba balamuthi; identical to SEQ ID NO: 7629

SEQ ID NO: 11526 - DNA, 2207 bp, Toxoplasma gondii; identical to SEQ ID NO: 7630
  CDS (225)..(1820)

SEQ ID NO: 11527 - protein, 531 aa, Toxoplasma gondii; identical to SEQ ID NO: 7631

SEQ ID NO: 11528 - DNA, 1317 bp, Sulfolobus tokodaii; identical to SEQ ID NO: 7632
  CDS (1)..(1317)

SEQ ID NO: 11529 - protein, 438 aa, Sulfolobus tokodaii; identical to SEQ ID NO: 7633

SEQ ID NO: 11530 - DNA, 1626 bp, Thermoplasma volcanium; identical to SEQ ID NO: 7634
  CDS (1)..(1626)

SEQ ID NO: 11531 - protein, 541 aa, Thermoplasma volcanium; identical to SEQ ID NO: 7635

SEQ ID NO: 11532 - DNA, 1437 bp, Rhizobium loti; identical to SEQ ID NO: 7636
  CDS (1)..(1437)

SEQ ID NO: 11533 - protein, 478 aa, Rhizobium loti; identical to SEQ ID NO: 7637

SEQ ID NO: 11534 - DNA, 1440 bp, Pasteurella multocida; identical to SEQ ID NO: 7638
  CDS (1)..(1440)

SEQ ID NO: 11535 - protein, 479 aa, Pasteurella multocida; identical to SEQ ID NO: 7639

SEQ ID NO: 11536 - DNA, 1880 bp, Arabidopsis thaliana; identical to SEQ ID NO: 7640
  CDS (126)..(1658)

SEQ ID NO: 11537 - protein, 510 aa, Arabidopsis thaliana; identical to SEQ ID NO: 7641

SEQ ID NO: 11538 - DNA, 1517 bp, Arabidopsis thaliana; identical to SEQ ID NO: 7642
  CDS (1)..(1497)

SEQ ID NO: 11539 - protein, 498 aa, Arabidopsis thaliana; identical to SEQ ID NO: 7643

SEQ ID NO: 11540 - DNA, 1564 bp, Arabidopsis thaliana; identical to SEQ ID NO: 7644
  CDS (1)..(1533)

SEQ ID NO: 11541 - protein, 510 aa, Arabidopsis thaliana; identical to SEQ ID NO: 7645

SEQ ID NO: 11542 - DNA, 1581 bp, Aspergillus oryzae; identical to SEQ ID NO: 7646
  CDS (1)..(1581)

SEQ ID NO: 11543 - protein, 526 aa, Aspergillus oryzae; identical to SEQ ID NO: 7647

SEQ ID NO: 11544 - DNA, 1431 bp, Streptomyces coelicolor; identical to SEQ ID NO: 7648
  CDS (1)..(1431)

SEQ ID NO: 11545 - protein, 476 aa, Streptomyces coelicolor; identical to SEQ ID NO: 7649

SEQ ID NO: 11546 - DNA, 1503 bp, Streptococcus thermophilus; identical to SEQ ID NO: 7650
  CDS (1)..(1503)

SEQ ID NO: 11547 - protein, 500 aa, Streptococcus thermophilus; identical to SEQ ID NO: 7651

SEQ ID NO: 11548 - DNA, 2150 bp, Pseudomonas hydrogenothermophila; identical to SEQ ID NO: 7652
  CDS (16)..(1437)

SEQ ID NO: 11549 - protein, 473 aa, Pseudomonas hydrogenothermophila; identical to SEQ ID NO: 7653

SEQ ID NO: 11550 - DNA, 1413 bp, Selenomonas ruminantium; identical to SEQ ID NO: 7654
  CDS (1)..(1413)

SEQ ID NO: 11551 - protein, 470 aa, Selenomonas ruminantium; identical to SEQ ID NO: 7655

SEQ ID NO: 11552 - DNA, 1822 bp, Arabidopsis thaliana; identical to SEQ ID NO: 7656
  CDS (1)..(1791)

SEQ ID NO: 11553 - protein, 596 aa, Arabidopsis thaliana; identical to SEQ ID NO: 7657

SEQ ID NO: 11554 - DNA, 1494 bp, Arabidopsis thaliana; identical to SEQ ID NO: 7658
  CDS (1)..(1494)

SEQ ID NO: 11555 - protein, 497 aa, Arabidopsis thaliana; identical to SEQ ID NO: 7659

SEQ ID NO: 11556 - DNA, 1920 bp, Lilium longiflorum; identical to SEQ ID NO: 7660
  CDS (145)..(1677)

SEQ ID NO: 11557 - protein, 510 aa, Lilium longiflorum; identical to SEQ ID NO: 7661

SEQ ID NO: 11558 - DNA, 1413 bp, Vibrio marinus; identical to SEQ ID NO: 7662
  CDS (1)..(1413)

SEQ ID NO: 11559 - protein, 470 aa, Vibrio marinus; identical to SEQ ID NO: 7663

SEQ ID NO: 11560 - DNA, 1979 bp, Oryza sativa; identical to SEQ ID NO: 7664
  CDS (224)..(1747)

SEQ ID NO: 11561 - protein, 507 aa, Oryza sativa; identical to SEQ ID NO: 7665

SEQ ID NO: 11562 - DNA, 1533 bp, Arabidopsis thaliana; identical to SEQ ID NO: 7666
  CDS (1)..(1533)

SEQ ID NO: 11563 - protein, 510 aa, Arabidopsis thaliana; identical to SEQ ID NO: 7667

SEQ ID NO: 11564 - DNA, 2235 bp, Drosophila melanogaster; identical to SEQ ID NO: 7668
  CDS (1)..(2235)

SEQ ID NO: 11565 - protein, 744 aa, Drosophila melanogaster; identical to SEQ ID NO: 7669

SEQ ID NO: 11566 - DNA, 3033 bp, Drosophila melanogaster; identical to SEQ ID NO: 7670
  CDS (1)..(3033)

SEQ ID NO: 11567 - protein, 1010 aa, Drosophila melanogaster; identical to SEQ ID NO: 7671

SEQ ID NO: 11568 - DNA, 1814 bp, Drosophila melanogaster; identical to SEQ ID NO: 7672
  CDS (83)..(1747)

SEQ ID NO: 11569 - protein, 554 aa, Drosophila melanogaster; identical to SEQ ID NO: 7673

SEQ ID NO: 11570 - DNA, 1425 bp, Agrobacterium vitis; identical to SEQ ID NO: 7674
  CDS (1)..(1425)

SEQ ID NO: 11571 - protein, 474 aa, Agrobacterium vitis; identical to SEQ ID NO: 7675

SEQ ID NO: 11572 - DNA, 1449 bp, Agrobacterium vitis; identical to SEQ ID NO: 7676
  CDS (1)..(1449)

SEQ ID NO: 11573 - protein, 482 aa, Agrobacterium vitis; identical to SEQ ID NO: 7677

SEQ ID NO: 11574 - DNA, 2234 bp, Nicotiana tabacum; identical to SEQ ID NO: 7678
  CDS (59)..(1840)

SEQ ID NO: 11575 - protein, 593 aa, Nicotiana tabacum; identical to SEQ ID NO: 7679

SEQ ID NO: 11576 - DNA, 1599 bp, Agaricus bisporus; identical to SEQ ID NO: 7680
  CDS (1)..(1599)

SEQ ID NO: 11577 - protein, 532 aa, Agaricus bisporus; identical to SEQ ID NO: 7681

SEQ ID NO: 11578 - DNA, 1446 bp, Buchnera aphidicola; identical to SEQ ID NO: 7682
  CDS (1)..(1446)

SEQ ID NO: 11579 - protein, 481 aa, Buchnera aphidicola; identical to SEQ ID NO: 7683

SEQ ID NO: 11580 - DNA, 1440 bp, Buchnera aphidicola; identical to SEQ ID NO: 7684
  CDS (1)..(1440)

SEQ ID NO: 11581 - protein, 479 aa, Buchnera aphidicola; identical to SEQ ID NO: 7685

SEQ ID NO: 11582 - DNA, 2354 bp, Gallus gallus; identical to SEQ ID NO: 7686
  CDS (81)..(1673)

SEQ ID NO: 11583 - protein, 530 aa, Gallus gallus; identical to SEQ ID NO: 7687

SEQ ID NO: 11584 - DNA, 1425 bp, Clostridium perfringens; identical to SEQ ID NO: 7688
  CDS (1)..(1425)

SEQ ID NO: 11585 - protein, 474 aa, Clostridium perfringens; identical to SEQ ID NO: 7689

SEQ ID NO: 11586 - DNA, 1425 bp, Corynebacterium efficiens; identical to SEQ ID NO: 7690
  CDS (1)..(1425)

SEQ ID NO: 11587 - protein, 474 aa, Corynebacterium efficiens; identical to SEQ ID NO: 7691

SEQ ID NO: 11588 - DNA, 2084 bp, Drosophila melanogaster; identical to SEQ ID NO: 7692
  CDS (229)..(1830)

SEQ ID NO: 11589 - protein, 533 aa, Drosophila melanogaster; identical to SEQ ID NO: 7693

SEQ ID NO: 11590 - DNA, 1901 bp, Eimeria tenella; identical to SEQ ID NO: 7694
  CDS (57)..(1652)

SEQ ID NO: 11591 - protein, 531 aa, Eimeria tenella; identical to SEQ ID NO: 7695

SEQ ID NO: 11592 - DNA, 3479 bp, Lactobacillus delbrueckii; identical to SEQ ID NO: 7696
  CDS (1277)..(3046)

SEQ ID NO: 11593 - protein, 589 aa, Lactobacillus delbrueckii; identical to SEQ ID NO: 7697

SEQ ID NO: 11594 - DNA, 1941 bp, Leishmania mexicana; identical to SEQ ID NO: 7698
  CDS (112)..(1611)

SEQ ID NO: 11595 - protein, 499 aa, Leishmania mexicana; identical to SEQ ID NO: 7699

SEQ ID NO: 11596 - DNA, 1452 bp, Methylobacterium extorquens; identical to SEQ ID NO: 7700
  CDS (1)..(1452)

SEQ ID NO: 11597 - protein, 483 aa, Methylobacterium extorquens; identical to SEQ ID NO: 7701

SEQ ID NO: 11598 - DNA, 1439 bp, Mycobacterium intracellulare; identical to SEQ ID NO: 7702
  CDS (1)..(1419)

SEQ ID NO: 11599 - protein, 472 aa, Mycobacterium intracellulare; identical to SEQ ID NO: 7703

SEQ ID NO: 11600 - DNA, 1635 bp, Thermoplasma acidophilum; identical to SEQ ID NO: 7704
  CDS (1)..(1635)

SEQ ID NO: 11601 - protein, 544 aa, Thermoplasma acidophilum; identical to SEQ ID NO: 7705

SEQ ID NO: 11602 - DNA, 1497 bp, Trypanoplasma borreli; identical to SEQ ID NO: 7706
  CDS (1)..(1497)

SEQ ID NO: 11603 - protein, 498 aa, Trypanoplasma borreli; identical to SEQ ID NO: 7707

SEQ ID NO: 11604 - DNA, 1629 bp, Yarrowia lipolytica; identical to SEQ ID NO: 7708
  CDS (1)..(1629)

SEQ ID NO: 11605 - protein, 542 aa, Yarrowia lipolytica; identical to SEQ ID NO: 7709

SEQ ID NO: 11606 - DNA, 1596 bp, Oryctolagus cuniculus; identical to SEQ ID NO: 7710
  CDS (1)..(1596)

SEQ ID NO: 11607 - protein, 531 aa, Oryctolagus cuniculus; identical to SEQ ID NO: 7711

SEQ ID NO: 11608 - DNA, 1799 bp, Xenopus laevis; identical to SEQ ID NO: 7712
  CDS (11)..(1606)

SEQ ID NO: 11609 - protein, 531 aa, Xenopus laevis; identical to SEQ ID NO: 7713

SEQ ID NO: 11610 - DNA, 2404 bp, Brachydanio rerio; identical to SEQ ID NO: 7714
  CDS (37)..(1635)

SEQ ID NO: 11611 - protein, 532 aa, Brachydanio rerio; identical to SEQ ID NO: 7715

SEQ ID NO: 11612 - DNA, 26 bp, Primer
atgtctagattagaaagattgacctc

SEQ ID NO: 11613 - DNA, 25 bp, Primer
ttaaacggtagagacttgcaaagtg

SEQ ID NO: 11614 - DNA, 2343 bp, Saccharomyces cerevisiae
  CDS (1)..(2343)
atggtagattttttaccaaaagtaacggaaataaatcctccatccgaaggtaatgatggtgaagataacataaagccactttcaagtggttcagagcagcggccgttgaaagaagaggggcaacaaggtggtagaagacatcaccggcggttgtcctctatgcatgagtattttgacccgttttccaacgcagaggtctattatggaccaataacagatccaagaaaacagtcaaaaattcatagactaaatagaaccagaactatgagtgttttcaataaagtttctgacttcaaaaacggaatgaaggattataccctgaaaaggaggggttctgaagacgacagcttcctcagcagccaaggtaaccgtagattttatattgataatgtggatctcgctttagatgagctgctcgctagtgaggacacagacaagaatcaccaaattaccatagaagacactgggcccaaagttattaaagtcgggacggccaattccaacggtttcaaacatgtaaatgttaggggaacatatatgctttctaacttgttgcaggaactaaccattgcaaaaagtttcggacgacaccaaatatttttggatgaggcgcgtataaatgaaaaccctgttgatagattatcaagattgataacgactcaattttggacgagtttaacgagaagagttgatctttataatattgcagaaattgctagagactcaaaaatagatacgccaggcgctaaaaatccaagaatttatgttccatataactgcccagagcagtacgaattttacattcaggcatctcaaatgaacccgtccttaaaacttgaagtggagtacttaccaaaagatattacagcagagtatgttaaatcattaaatgatacaccgggtttgttagccctggctatggaagaacacgttaatccatctactggtgaaaggtccctagttggttatccttatgcggtacctggcggtagattcaatgaattgtatggctgggattcatatttaatggcactgggactcatagaaagtaataaggttgatgttgcaagaggtatggtggagcattttatattcgaaattgatcactatagtaaaattttgaatgctaataggagttattatctttgcagatctcagccaccattcctaaccgatatggctctgctcgtatttgaaaagataggaggtaagaataatccaaacgctattcagttgttaaaacgcgcgttcagagctgctattaaagaatataaagaggtgtggatgtcgagccctaggttagattctctgacagggctgtcttgttatcattctgatggtattggtatccctccggaaactgaaccagatcattttgatactatattattaccgtatgctgaaaagtacaatgttactctggaaaagcttaggtacctttataacgaaggcatgattaaagaacccaaactggatgcattttttttacatgatcgtgccgtgagagagtcaggacatgacacgacttataggtttgaaggtgtatgtgcatatttagcgacaattgatctaaactccttgctctataaatatgagaaagatattgctttcgtcattaaggagtattttggtaatgaatataaagatgagaatgatggaacggtaaccgattctgaacactgggaggagctagctgaactgaggaaaacaaggattaataagtatatgtgggacgaagattcagggtttttcttctattataacacgaaactgaaatgcagaacgtcttatgagtctgcaacgactttttggagtttgtgggctggtcttgcaactgaagagcaagcaaaaatcacagtagaaaaagctcttcctcagttagaaatgctcggcggactagttgcatgcacagaaaaatcaagaggtcctatttctattgatagaccgatcaggcaatgggattatccttttggttgggcgccgcaccaaatattagcctggaaaggtttatctgcatatggttatcaacaagtagctacaagattggcttataggtggctgtacatgattacaaaatcatttgttgattataacggaatggtggtagaaaaatatgatgtgacaagagggactgatccgcatcgcgttgatgcggaatatggtaatcaaggtgctgattttaagggcgtcgctacagaaggctttggttgggtgaacacaagttatttgctcggattgaaatatatgaataatcatgcaagaagggctctcgctgcttgtagtccaccattgccatttttcaatagtttgaaaccctctgagaaaaaattgtattacctataa

SEQ ID NO: 11615 - protein, 780 aa, Saccharomyces cerevisiae
MVDFLPKVTEINPPSEGNDGEDNIKPLSSGSEQRPLKEEGQQGGRRHHRRLSSMHEYFDPFSNAEVYYGPITDPRKQSKIHRLNRTRTMSVFNKVSDFKNGMKDYTLKRRGSEDDSFLSSQGNRRFYIDNVDLALDELLASEDTDKNHQITIEDTGPKVIKVGTANSNGFKHVNVRGTYMLSNLLQELTIAKSFGRHQIFLDEARINENPVDRLSRLITTQFWTSLTRRVDLYNIAEIARDSKIDTPGAKNPRIYVPYNCPEQYEFYIQASQMNPSLKLEVEYLPKDITAEYVKSLNDTPGLLALAMEEHVNPSTGERSLVGYPYAVPGGRFNELYGWDSYLMALGLIESNKVDVARGMVEHFIFEIDHYSKILNANRSYYLCRSQPPFLTDMALLVFEKIGGKNNPNAIQLLKRAFRAAIKEYKEVWMSSPRLDSLTGLSCYHSDGIGIPPETEPDHFDTILLPYAEKYNVTLEKLRYLYNEGMIKEPKLDAFFLHDRAVRESGHDTTYRFEGVCAYLATIDLNSLLYKYEKDIAFVIKEYFGNEYKDENDGTVTDSEHWEELAELRKTRINKYMWDEDSGFFFYYNTKLKCRTSYESATTFWSLWAGLATEEQAKITVEKALPQLEMLGGLVACTEKSRGPISIDRPIRQWDYPFGWAPHQILAWKGLSAYGYQQVATRLAYRWLYMITKSFVDYNGMVVEKYDVTRGTDPHRVDAEYGNQGADFKGVATEGFGWVNTSYLLGLKYMNNHARRALAACSPPLPFFNSLKPSEKKLYYL

SEQ ID NO: 11616 - DNA, 1788 bp, Oryctolagus cuniculus (domestic rabbit)
  CDS (4)..(1740)
gccatgcccgggagcacctgggagctgcacctgctgcttctgctggggctggggctggggtccgagcaggccctccccccaccctgtgagagccagatttactgccatggggagctcctgcaccaggtccagatggcccggctctacccggacgataagcagtttgtggacatgccgctgtccacggctccagaccaggttctgcagagcttcgccgagctggccgcgacctacaacaacaccgtccccagggagcagctcgagaagtttgtccaggagcacttccaggcggtggggcaggagctggaatcatggacccccggggactggaaagagagcccccagttcctgcagaagatctcggaccccaagctgcgagcctgggcagagcagctgcacctgctctggaagaagctgggaaagaagataaagccagaggtgctgagccagcctgagcggttctctctgatctactctcaacatcccttcattgtgcctggcgggcgctttgtggagttctactactgggactcctactgggtcatggagggcctgctcctgtctgagatggccgagacggtgaagggcatgctgcaaaacttcctggacctggtgacggcctatgggcacatccccaatggtgggcgagtgtactacttgcagcgcagccagcccccgctcctgacgctcatgatggaccgatacgtggcgcacaccggtgaccttgccttcctacgggagaacattgagaccttggccttggaactggacttctgggctgagaacaggaccatctctgtgagctcggggggaaacagccacaccctgaaccgctatcacgtcccttacggggggcccaggcccgagtcctacagcaaagacacagagctggcacacaccttgccggaagggagctgggaaaccttgtgggcggagctcaaggccggcgccgagtccggctgggacttctcttcgcgctggctggttggcagcccaaacccggactcactcggcagcatccgaacgagcaagctggtgcccgtcgacctgaatgccttcctgtgccaggccgaagagctgctcagtggcttctacagcaggctcgggaatgaatcccaggctacgaagtacagaaatctgcgggcacagcgcatagcggccctgacggccctcctgtgggacgaggacaagggcgcttggttcgactacgaccttgagaaccagaagaagaaccacgagttttacccgtccaacctcactccactctgggccggctgcttctctgaccctgccatcgcagacaaggctctgcagtacctgcaggacagccagatcctgaaccaccgccatggaatcccaacctctctccagaacacaggccagcagtgggactttcccaatgcctgggccccccttcaggatctggtcatcagaggcctggccaagtcgccttcagctcggacacaggaagtggctttccagctggctcagaactggatccggaccaactttgatgtctactcccaaagatcagccatgtatgagaagtatgacatcagcaatgcacagccgggtggcggaggggagtatgaagtgcaggaggggtttggctggaccaacggagtcgccctgatgctcctggaccgctatggtgaccggctgagctcggggacccagctggcgctcctggagccccactgcctggccgctgccctcctgctcagcttcctaacacggtgaccacagggcggcctccctgcacctctgttcattaaacctctcaccggc

SEQ ID NO: 11617 - protein, 578 aa, Oryctolagus cuniculus (domestic rabbit)
MPGSTWELHLLLLLGLGLGSEQALPPPCESQIYCHGELLHQVQMARLYPDDKQFVDMPLSTAPDQVLQSFAELAATYNNTVPREQLEKFVQEHFQAVGQELESWTPGDWKESPQFLQKISDPKLRAWAEQLHLLWKKLGKKIKPEVLSQPERFSLIYSQHPFIVPGGRFVEFYYWDSYWVMEGLLLSEMAETVKGMLQNFLDLVTAYGHIPNGGRVYYLQRSQPPLLTLMMDRYVAHTGDLAFLRENIETLALELDFWAENRTISVSSGGNSHTLNRYHVPYGGPRPESYSKDTELAHTLPEGSWETLWAELKAGAESGWDFSSRWLVGSPNPDSLGSIRTSKLVPVDLNAFLCQAEELLSGFYSRLGNESQATKYRNLRAQRIAALTALLWDEDKGAWFDYDLENQKKNHEFYPSNLTPLWAGCFSDPAIADKALQYLQDSQILNHRHGIPTSLQNTGQQWDFPNAWAPLQDLVIRGLAKSPSARTQEVAFQLAQNWIRTNFDVYSQRSAMYEKYDISNAQPGGGGEYEVQEGFGWTNGVALMLLDRYGDRLSSGTQLALLEPHCLAAALLLSFLTR

SEQ ID NO: 11618 - DNA, 1488 bp, Nostoc sp. PCC 7120
  CDS (1)..(1488)
atgaccaaaaacaccgtcagaacctacatcaaacaaacctggaaaaccctcactcgctcccaccaacatttactagaatccgcccaagacaccaaactagaacaccaacccaacaccccttggattatctacatctccccccaagaagactgtaatacagtccagtccgtattagagcgatcactctcggcaaaagagatgcagcaaatagaaattcgcaccttacccagcgaagttgaagccatccaagaacacggattgttatatctccctggtgcttacgtcgttcctggtggtcgttttaatgaaatgtatggttgggatagctattttattttgcttggactgttgcaagatgaagaatgggaactagcccaaagtcaagttgatcagctactttaccaagtccagcattacggtacaatcctcaacgccaaccgtacctatatgctgacgcgatcgcaaccccccgttctgagtatgatggtcttggcgttattccaacacacccaagaccaagcatggctcaaatcaaccctgccattgctagaacagttttactattattgggtcgtaccgccgcatctaaattcagccacaggcttatctagatactacgccttaggcgaaggggctgcaccagaagtattattttccgagctagatgaaactggacgcagccactacgaacgtgtcaaggaatattacaagacatttgagattgatgattatgatgtgagtttgttttatgactcagaaagagacgaactcacagacttattttacaaaggcgatcgctccatgcgcgagtctggttttgatatcaccaaccgctttggcccctttagcgttgatatcgtccattatgcacctgtctgtctgaacagcctgctttatcaaatggagcaagacttggcgcaaattcacaagattttagataatcccgaacttgcagaacaatggagcgatcgcgccactttgcgccgtgagcgtatcaatcaatacctgtgggatgaagaaaaaggaatttatttagactatcacttctacagtggcaaacgccgtcattatgaatttgccactaccttctatcccctgtggacaggattatcctccccagaacaagcccaacgcattgtagaaaatctttccttatttacagccccagggggaatcttcaccagcacccatgtaacagggaaccaatgggacgcgccttttggctgggccccactcaccttaattgcagtccaaggactttatcgttacggatatcgcaaggagggggatgatattgctcataaattcctaactatggcgattcaagaatttacgaaatatggcttttttgtagaaaaatacgatgtagaacgttgttcggctcaagtttccgatgaaatctgctttggctatagttctaacgagataggttttggttggacgaacggagtcattttagaactattagctaaccttgacgattcatga

SEQ ID NO: 11619 - protein, 495 aa, Nostoc sp. PCC 7120
MTKNTVRTYIKQTWKTLTRSHQHLLESAQDTKLEHQPNTPWIIYISPQEDCNTVQSVLERSLSAKEMQQIEIRTLPSEVEAIQEHGLLYLPGAYVVPGGRFNEMYGWDSYFILLGLLQDEEWELAQSQVDQLLYQVQHYGTILNANRTYMLTRSQPPVLSMMVLALFQHTQDQAWLKSTLPLLEQFYYYWVVPPHLNSATGLSRYYALGEGAAPEVLFSELDETGRSHYERVKEYYKTFEIDDYDVSLFYDSERDELTDLFYKGDRSMRESGFDITNRFGPFSVDIVHYAPVCLNSLLYQMEQDLAQIHKILDNPELAEQWSDRATLRRERINQYLWDEEKGIYLDYHFYSGKRRHYEFATTFYPLWTGLSSPEQAQRIVENLSLFTAPGGIFTSTHVTGNQWDAPFGWAPLTLIAVQGLYRYGYRKEGDDIAHKFLTMAIQEFTKYGFFVEKYDVERCSAQVSDEICFGYSSNEIGFGWTNGVILELLANLDDS

SEQ ID NO: 11620 - DNA, 1638 bp, Pseudomonas aeruginosa
  CDS (1)..(1638)
atgcctgatcgaaccgctctaccccgcgccatgctcgcggcctgggtcctgctcctgctggcggcctgcagccagggcccggcgcctaccccgcccgcgtcctggggttggcaggacgccagcggcgaacgcgcgatcgcccccgacgaagcctatcccgagctgttccaggcggtgcaggaaaaccggctgttcagcgaccagaagcacttcgtcgatgcgctcccgctgcgcgagcctgcacggatccgcgccgactacctgcgcgagagggagcggcccggcttcgacctgcgcgccttcgtcggccgcaacttcgaggagtccggcagcgtcgagaccgccccgccggaagcgggtgccgatctcgccagccacatcagcgacctgtggccggcgttgacccgccactacgagcaggtgccggcccacagcagcctgctgccgctgccgaaaccctacgtggtccccggcggacgcttccgcgaggtgtactactgggactcctacttcaccatgctcggccttgcggagagcgggcagcaccagcgggtgcgcgacatgctcgacaacttcgcctacctgatcgatacctacgggcacattcccaacggtaaccgcagctactacctgagccgttcgcagccgccgttcttcgcctacatggtggatctccaggcaagacgcgaaggcgacgccgcctaccggcgctacctgccgcagctacagaaggaatacgcctactggatggaaggctccgccgggctgcgccccaacgaggcgcgcctgcacgtggtgaaactggccgacggaagcctgctgaaccgctactgggacaaccgtgacacaccgcgccaggagtccttcctggaggaccgggcgaccgccgcgcgcgccccgcagcgccccgcgggcgaggtctatcgcgacctgcgggccggcgcggaaagcggctgggacttctcctcccgctggctggacgacggccgcgaactggccagcatccgcaccaccgccatcgtcccggtggacctcaacgccctgctctaccatctcgaacgaatcatcgccaaggcctgcgccagcagcgcgctgaaggcctgcgagcaaggctacggcgcccgcgcggagaagcgacgacaggccatcgaagaccacctctggcacccggcgggctactacgccgactacgactggcaacgccggcggcccatcgagcggatcaacgccgccagcctcttcccgctattcaccgggctggcctccgccgaacgcgccggtcgtaccgccgacagcgtcgccgcccaactgctgcgcccgggcggactggccaccaccacccgtgccagcggccagcaatgggacgagccgaacggctgggcacccttgcagtgggtcgccgtacagggcctgcgcgcctacggccgggacgccctggcggaagacatcggccggcgattcctcgcccaggtgcagcaggtctacgaccgcgaaggaaaactggtggagaaatacgacatcagcggcaaccagggcggcggcggcggtggcgagtacccgttgcaggacggcttcggctggtccaacggcgtgaccctgcaactgctccgactctacggcccgggcgccggtcgctga

SEQ ID NO: 11621 - protein, 545 aa, Pseudomonas aeruginosa
MPDRTALPRAMLAAWVLLLLAACSQGPAPTPPASWGWQDASGERAIAPDEAYPELFQAVQENRLFSDQKHFVDALPLREPARIRADYLRERERPGFDLRAFVGRNFEESGSVETAPPEAGADLASHISDLWPALTRHYEQVPAHSSLLPLPKPYVVPGGRFREVYYWDSYFTMLGLAESGQHQRVRDMLDNFAYLIDTYGHIPNGNRSYYLSRSQPPFFAYMVDLQARREGDAAYRRYLPQLQKEYAYWMEGSAGLRPNEARLHVVKLADGSLLNRYWDNRDTPRQESFLEDRATAARAPQRPAGEVYRDLRAGAESGWDFSSRWLDDGRELASIRTTAIVPVDLNALLYHLERIIAKACASSALKACEQGYGARAEKRRQAIEDHLWHPAGYYADYDWQRRRPIERINAASLFPLFTGLASAERAGRTADSVAAQLLRPGGLATTTRASGQQWDEPNGWAPLQWVAVQGLRAYGRDALAEDIGRRFLAQVQQVYDREGKLVEKYDISGNQGGGGGGEYPLQDGFGWSNGVTLQLLRLYGPGAGR

SEQ ID NO: 11622 - DNA, 1854 bp, Homo sapiens (man)
  CDS (56)..(1807)
gaattccgggccgaaggtgcctgggcttgctcattcagtcacagtcacagccaccatgccagggaggacctgggagctgtgcctgctactgctgctggggctgggactggggtcccaggaggccctacccccaccctgtgagagtgagatttactgccacggggagctcctaaaccaagttcaaatggccaagctctaccaggatgacaagcagtttgtggacatgccactgtctatagctccagaacaagtcctgcagaccttcactgagctgtccagggaccacaatcacagcatccccagggagcagctgcaggcgtttgtccacgaacacttccaggccaaggggcaggagctgcagccctggacccctgcagactggaaagacagcccccagttcctgcagaagatttcagatgccaaactgcgtgcctgggcagggcagctgcatcagctctggaagaagctggggaagaagatgaagccagaggttctcagccaccctgagcggttctctctcatatactcagaacatcctttcattgtgcctggcggtcgctttgttgagttctactactgggactcctactgggtcatggagggtctgctcctctcagagatggctgagacggtgaagggcatgctgcagaacttcttggacctggtgaaaacctatgggcatgtccccaatggtgggcgcgtgtactacttgcagcggagccagcccccactcttgaccctcatgatggattgctacttgactcacaccaatgacaccgcctttctacaggaaaacattgaaacactagccttggaattggacttttggaccaagaacaggactgtctctgtgagcttggagggaaagaactacctcctgaatcgctattatgtcccttatgggggacccaggcctgagtcctacagcaaagatgtggagttggctgacaccttgccagaaggagaccgggaggctctgtgggctgagctcaaggctggggctgagtctggctgggacttctcttcacgctggctcattggaggcccaaaccccaactcgcttagcggcatccgaacaagcaaactggtgcctgttgacctgaatgccttcctatgccaagcagaggagctgatgagcaacttctattccaggctggggaacgactcccaggccacgaagtacagaatcctgcggtcgcagcgcttggccgccctgaacacagtcctgtgggatgagcagaccggagcctggttcgattacgaccttgagaagaagaagaaaaaccgggagttttacccatccaacctcactccactctgggccgggtgtttctctgaccctggcgtggcggacaaggctctgaaatacctggaggacaaccggatcctgacttaccagtatgggatcccgacctctctccagaagacaggccagcagtgggatttccccaatgcctgggcccccctgcaggacttggtcatcagaggcctggccaaggcacctttacgtcgggcccaggaagtggctttccagctggctcagaattggatccgaaccaattttgatgtctactcgcagaagtcagccatgtatgagaagtatgacgtcagcaacggtggacagcccggtgggggaggagaatatgaagttcaggagggatttggctgggacgaaggtgtggtcctgatgctgctggaccgctatggtgaccggctgacctcaggggccaagctggctttcctggagccccactgcctggcggccacccttctgcccagcctcctgctcagcctcctgccatggtgacagccctcctctcctcacctggccccagctcctgccccccggaattc

SEQ ID NO: 11623 - protein, 583 aa, Homo sapiens (man)
MPGRTWELCLLLLLGLGLGSQEALPPPCESEIYCHGELLNQVQMAKLYQDDKQFVDMPLSIAPEQVLQTFTELSRDHNHSIPREQLQAFVHEHFQAKGQELQPWTPADWKDSPQFLQKISDAKLRAWAGQLHQLWKKLGKKMKPEVLSHPERFSLIYSEHPFIVPGGRFVEFYYWDSYWVMEGLLLSEMAETVKGMLQNFLDLVKTYGHVPNGGRVYYLQRSQPPLLTLMMDCYLTHTNDTAFLQENIETLALELDFWTKNRTVSVSLEGKNYLLNRYYVPYGGPRPESYSKDVELADTLPEGDREALWAELKAGAESGWDFSSRWLIGGPNPNSLSGIRTSKLVPVDLNAFLCQAEELMSNFYSRLGNDSQATKYRILRSQRLAALNTVLWDEQTGAWFDYDLEKKKKNREFYPSNLTPLWAGCFSDPGVADKALKYLEDNRILTYQYGIPTSLQKTGQQWDFPNAWAPLQDLVIRGLAKAPLRRAQEVAFQLAQNWIRTNFDVYSQKSAMYEKYDVSNGGQPGGGGEYEVQEGFGWDEGVVLMLLDRYGDRLTSGAKLAFLEPHCLAATLLPSLLLSLLPW

SEQ ID NO: 11624 - DNA, 1830 bp, Tenebrio molitor (yellow mealworm)
  CDS (50)..(1717)
caaactggccaccacttttttagggttcgccagtaaagactcttactcgatgatccccttcctgcttatggtcgcttttgctgacaccgtccttcaagtgtcagcacagtcgcaaccatcatgtgacagtaaagtctactgtcagggtaagttgctccacgttgttgaaatgtcgcgaattttcaacgactccaagacgttcgtcgagttgaaaatgatcaacgacgaacaaaccaccctcgagaattttgacaactttctcagagacaccaaccacaagcgtacccgtgcagatctgatgaaatttgtcagcgacaacttcaagcaagagaacgagttcgaaagttggaccccgacggactttaccgacaacccgacactgttgtcgagaattgaagacaaaaccatcagacagtttgctcaagatttggtcaagatctggccgaccctcgccaggaaggtgaagaaagaagtactggattatccggagcactatagtttgttaccggtggacaatgggttcatcataccgggaggtcgcttcacggagttttactactgggactcttattggatagtggaggggctcctgttgagtgacatgcacgaaaccgtgcgagggatgttggacaacttcttgtcgatagtcgagaaatacgggttcataccgaacggtgctcgcgtcttctatctgaacaggtcccaaccaccattgctgaccttgatggtgtcgctgtatgtgtcggcaactaatgacatggagtggttggcaaagaacatccgcaccatcgatacagagttgcgtttttggctcaacaacagactagtcgacgtggtgaaagacggtattgtttacaaactcgctcaatacaactccaacagcggaagtcctcgtcctgagtcctactacgaagacgtcacaaccgctagcgtcttcagcgacgaaagagacaaagccgagctgtacatggacctgaagagcgccgccgagagcggttgggacttctcgtcgcggtggatcgtcgacgaatacggaggcaccagaggcaacctgtctgcccttcacacccggaggataattccggtggacctcaacgcgtttctctgtcaagctttccaaaagctgtccgaattctaccagaccctcggcgactaccccaacgccaccttctggtccaaactcgtcaaaatctggcaacacagtatcgagatggtccactacaacagagacgacggcatttggtacgactgggataacgagttgagtcagcacagaagaatgttcttcccttcgaatttcgcaccgctttggtccgaaactttcgactcacgcaacgctgaaatcttgggtgaaatggcggctgagtatttcataactcaaaacatgatggactaccacggaggaattcctacttcgttgagccacaccggagagcaatgggactatccgaacgcttggccgccaatgcagtccatcattgtgatgggtctggacaaaagtgggagttacagagctaaacaactagcgagagagttggctcgaagatgggtcaaagctaatctgattggttttagacagacgggtgagatgtttgagaagtacaatgttgaagttcctggacagaatggaggtgggggagagtacgtcgtccaaagcgggtttggatggacgaacggggtagttttagaatttataaaccaattttttacaacataaaaaacaacagagataatgttggcagcgttgggtatgcttttgtaagtgcgacacttgtagagtacattgtttatcaatattgtccatttaactagtttaaaataaattgtttt

SEQ ID NO: 11625 - protein, 555 aa, Tenebrio molitor (yellow mealworm)
MIPFLLMVAFADTVLQVSAQSQPSCDSKVYCQGKLLHVVEMSRIFNDSKTFVELKMINDEQTTLENFDNFLRDTNHKRTRADLMKFVSDNFKQENEFESWTPTDFTDNPTLLSRIEDKTIRQFAQDLVKIWPTLARKVKKEVLDYPEHYSLLPVDNGFIIPGGRFTEFYYWDSYWIVEGLLLSDMHETVRGMLDNFLSIVEKYGFIPNGARVFYLNRSQPPLLTLMVSLYVSATNDMEWLAKNIRTIDTELRFWLNNRLVDVVKDGIVYKLAQYNSNSGSPRPESYYEDVTTASVFSDERDKAELYMDLKSAAESGWDFSSRWIVDEYGGTRGNLSALHTRRIIPVDLNAFLCQAFQKLSEFYQTLGDYPNATFWSKLVKIWQHSIEMVHYNRDDGIWYDWDNELSQHRRMFFPSNFAPLWSETFDSRNAEILGEMAAEYFITQNMMDYHGGIPTSLSHTGEQWDYPNAWPPMQSIIVMGLDKSGSYRAKQLARELARRWVKANLIGFRQTGEMFEKYNVEVPGQNGGGGEYVVQSGFGWTNGVVLEFINQFFTT

SEQ ID NO: 11626 - DNA, 3143 bp, Bombyx mori (silkworm)
  CDS (187)..(1926)
cgatcgagtcggacgtacgcgattataatcgaataaaaaaaaaatgacaatcgaattataaaattattttgtctttaaaataaacagtttagttacttacttagtactagagtttagtacttagtgtaacggaattgttatcattattatatttgtttttgtaagtgaacgttgatcgtcttcacgatgaggttgtttctactactggtgggattgacgacggtaatcgcggatgacctaccgccgacttgcatcagaccagtttactgcaatagtacgctgctccattacgttcaaatggccagactctaccccgattctaaaactttcgtcgattttcaaatgcgtaaagacgagaacgcaacactgtccgccttccaagagctattggaccgcacgaatcataatccaacgaaagaagacctgcaggaatttgtcgttgacttttttgatgaaaccagcgaacttgaagaatggaaaccggatgaccataaagaaaacccgcctttcctcgccaaaattcgtgatcaaggtttccgggaattcgctaaagctttaaatgatatttggccaactttagccaggcgcgttaagccctcggtccttgaaaaacccgaacaatctagtctcgtgcctatgacacatggcttcatcgttcctggaggtcgatttaaagaaatctactattgggacgcatattggattatcgaaggtcttctaatcactgacatgaccgaaactgcaaaaggaatgatcgaaaacctaatcgagcttctgtataaatttggccacattcccaatggaagcagatggtattaccaagaacgtagccagcctcctttattggcggccatgataaagctttattacgaaaagactaaggacatcgaattcatcagaaagtatattagtgctttagaaaaggaattagaatattggctggacactcatcttatcgctttcaacaaggacgacagagtttacactctcctgaggtattatattccaagcgctggtcctcgaccggagtcttattatgaagattacgaattggctcagaaattagacaagaatactgatcctaatgatatttacgctgatttaaaaagcgccgctgagagcgggtgggacttttctacgcgctggtttatttcagaaagcggcgacaacagtggtaatctaaccaatttaaacacaaagaacgttatccccgtagacttgaatgctattttcgccggagcgttacagattacggcgaacttccaagctatactaaagaatcctcggagagcggctcactggggctacatggccgaacaatggagaagttctatagagcaagcattatgggatgaagaagacggagtctggcacgactacgacatattgaataataagccacgtagatatttttacactagcaacctagctcccctgtggatgaacgcagtcgaaaaaccatttctagctaagcatggcgctagagtcctggagtaccttcacgaatcgcaagcgctcgagtaccccggaggtgtcccggtgtctctagtcaacagtggagaacaatgggacttccctaacgcttggcctccagaagtcagcattgtcgttacggctatccaaaacattggttccgaggagagtagtaaattggcaaaagaactcgcccaggtctgggtgagagcttgtaaatcaggatttaccgaaaagaaacagatgtttgagaagtacgatgcgttgaacgctggtaaatacggcggcggcggtgaatacacggttcaagatggattcggatggtcgaacggcgttgtcctggagttcttagataggtacggagctgtactgacttcggtggactctgtagatgctagtgcaaataacggtcagtcaaacgaagaatctgagacggattctaaggaaaaataaatcgaggccgatgtgaatgacatttaatgatatttaagaacaagagttttaaagctaataattcattaaattctaagcaaaacaagatttcacaacttgtttactaatgtttattttcgtccgtatttttcctcaatctcaatccggtgctaaaatattagaaggttttataattgactgactcaatggtgtagtagttagcggccctgactatcgcgctgagggtcgtgggttcgattcccacatcaagccaacattgtgtggtgaacaggtttgtttgctctttgtctggcagcttattatctatatatgtatatatttaatcatatataagtatgtttatcagtatctggtacccgttaagctgctttcagactacgctatactttagtaccatatagtatagcagcctatagttaggcaataatttaaagtacagtacagtgtgagtctgtccataagaatgcattgtgtgggatattgttgtgctatgagagatatactatatatgctattatattatagcatagtctgaaagcggcttaacacagggaatcctaaataggagccggacgaccgtgccggatttgttcccagttacctatgtatatgaatattttatttaatatatatagttgagttcacaaaagcatttacgtgaaaaaaatggtgataatcccctttattaatttactgctggaatcattctgaaataatattaattcaaattcaggtggacgcgattaattgtgtactcccaaaaatgcattgtattattcctataatataaatgaagccacggctttttaacgcaactaaaagagtctaccgattagcgtctacgtcaaacgaaaagaaccatttagacttagttttggtaacaacagagagacttttcaatttattcatctgtgaacagataattaatttacaatttagcatttaaggatattttgttactgtattttaaatacggttcttcttgattaaattaagaaaatacctcacatagtgggggggctgattatcttaattaacctaagtacaattttagcttaagtgtctgttattgaaggttccaaaattaaataagaatgttgttaaaattacctaactgccatattatttcggtttgattcaaataaactatgtaacttgactgttttaaaaaaaaaaaaaaaaaaaaaaaaaaaaaaaaaaaaaaaaaaaaaaaaaaa

SEQ ID NO: 11627 - protein, 579 aa, Bombyx mori (silkworm)
MRLFLLLVGLTTVIADDLPPTCIRPVYCNSTLLHYVQMARLYPDSKTFVDFQMRKDENATLSAFQELLDRTNHNPTKEDLQEFVVDFFDETSELEEWKPDDHKENPPFLAKIRDQGFREFAKALNDIWPTLARRVKPSVLEKPEQSSLVPMTHGFIVPGGRFKEIYYWDAYWIIEGLLITDMTETAKGMIENLIELLYKFGHIPNGSRWYYQERSQPPLLAAMIKLYYEKTKDIEFIRKYISALEKELEYWLDTHLIAFNKDDRVYTLLRYYIPSAGPRPESYYEDYELAQKLDKNTDPNDIYADLKSAAESGWDFSTRWFISESGDNSGNLTNLNTKNVIPVDLNAIFAGALQITANFQAILKNPRRAAHWGYMAEQWRSSIEQALWDEEDGVWHDYDILNNKPRRYFYTSNLAPLWMNAVEKPFLAKHGARVLEYLHESQALEYPGGVPVSLVNSGEQWDFPNAWPPEVSIVVTAIQNIGSEESSKLAKELAQVWVRACKSGFTEKKQMFEKYDALNAGKYGGGGEYTVQDGFGWSNGVVLEFLDRYGAVLTSVDSVDASANNGQSNEESETDSKEK

SEQ ID NO: 11628 - DNA, 2256 bp, Saccharomyces cerevisiae
  CDS (1)..(2256)
atgagtcaagttaatacaagccaaggaccggtagcccaaggccgtcaaagaagattatcatcactaagtgaattcaatgatccattttcgaacgcagaagtctactatggccccccaacagacccaagaaagcagaagcaggcaaagcccgctaagatcaaccgtacgaggactatgagtgttttcgataatgtatctcctttcaagaaaactggttttggtaaacttcaacagactagacgtggttctgaggatgacacctattcaagtagtcaaggtaatcgtcgtttctttatcgaagatgtcgataaaacacttaatgaactactggctgctgaggataccgataaaaattatcagatcaccatcgaggataccggtccaaaagttttgaaagtcggtaccgcaaactcctatggctataagcatattaatattaggggtacgtatatgttatccaatttgttgcaggaactaactattgcgaaaagttttggtagacaccaaattttcttagatgaagctcgtataaacgaaaatcccgtcaacagattatcaagattgataaacacacagttctggaactctttgaccaggagagttgatctgaacaacgtaggcgaaattgcaaaagataccaagattgatacgccgggggcaaaaaatccaagaatctatgttccttatgattgtccagaacaatacgaattttatgttcaagcttctcaaatgcatccatctttgaaattagaagttgaatatttaccaaaaaaaataacggcagaatacgtcaaatccgtcaatgatacccccggtttactagcattggctatggaagagcacttcaatccttctactggtgaaaaaactctcattggttacccttatgctgttcctggtggtagattcaatgaattatatggttgggactcctatatgatggcactaggtctcctagaagccaacaagactgatgttgcaagaggtatggtggagcattttatttttgagattaatcactatggaaaaatattgaatgctaacagaagctactatctatgtagatcacagcccccattcttgactgaaatggccttggtagtattcaaaaaacttggtggtaggagtaatcccgatgctgtggatttgttgaaaagagctttccaagcaagcataaaagagtacaaaactgtttggaccgcatctccaaggcttgatcccgaaacaggcttatccaggtaccatcctaacggtctcggtattcctccggaaactgaaagtgatcacttcgataccgttttactaccatatgcatcgaaacacggcgttaccttagacgaatttaagcaactttataacgatggtaagataaaggagcctaaattggatgagttttttcttcatgaccgtggcgttagagaatctggacacgacactacatataggtttgagggcgtatgtgcctacctggccactattgacctgaattctcttctttacaaatacgagattgatattgcagacttcataaaggaattctgcgacgacaaatatgaagatcctttagaccattctataacaacttcagctatgtggaaagaaatggccaaaatcagacaagaaaagattaccaaatatatgtgggatgacgagtcggggtttttctttgactacaacacaaaaatcaagcacagaacgtcatacgaatccgcaactacattctgggcattatgggctggacttgccacgaaggagcaagcacagaaaatggtggagaaagcactacccaagttagagatgcttggaggtttagctgcatgtacggagcgttctcgaggcccaatttctatttcgagaccaattagacaatgggactatccatttggttgggcaccccatcaaattcttgcttgggaaggcctccgttcttatggttatttaactgtaacgaataggctagcttatagatggcttttcatgatgacaaaggcttttgtcgattataatggtattgtggttgaaaaatatgatgtcacaagaggaacagatcctcatcgtgttgaagcagaatacggtaatcaaggtgctgactttaaaggggcagctactgaaggttttggatgggtcaatgccagttacattcttggtttgaagtatatgaacagtcacgcaagaagagcgcttggtgcttgcattccaccaatatcattctttagcagtttaaggcctcaagaaagaaacctctatggactatag

SEQ ID NO: 11629 - protein, 751 aa, Saccharomyces cerevisiae
MSQVNTSQGPVAQGRQRRLSSLSEFNDPFSNAEVYYGPPTDPRKQKQAKPAKINRTRTMSVFDNVSPFKKTGFGKLQQTRRGSEDDTYSSSQGNRRFFIEDVDKTLNELLAAEDTDKNYQITIEDTGPKVLKVGTANSYGYKHINIRGTYMLSNLLQELTIAKSFGRHQIFLDEARINENPVNRLSRLINTQFWNSLTRRVDLNNVGEIAKDTKIDTPGAKNPRIYVPYDCPEQYEFYVQASQMHPSLKLEVEYLPKKITAEYVKSVNDTPGLLALAMEEHFNPSTGEKTLIGYPYAVPGGRFNELYGWDSYMMALGLLEANKTDVARGMVEHFIFEINHYGKILNANRSYYLCRSQPPFLTEMALVVFKKLGGRSNPDAVDLLKRAFQASIKEYKTVWTASPRLDPETGLSRYHPNGLGIPPETESDHFDTVLLPYASKHGVTLDEFKQLYNDGKIKEPKLDEFFLHDRGVRESGHDTTYRFEGVCAYLATIDLNSLLYKYEIDIADFIKEFCDDKYEDPLDHSITTSAMWKEMAKIRQEKITKYMWDDESGFFFDYNTKIKHRTSYESATTFWALWAGLATKEQAQKMVEKALPKLEMLGGLAACTERSRGPISISRPIRQWDYPFGWAPHQILAWEGLRSYGYLTVTNRLAYRWLFMMTKAFVDYNGIVVEKYDVTRGTDPHRVEAEYGNQGADFKGAATEGFGWVNASYILGLKYMNSHARRALGACIPPISFFSSLRPQERNLYGL

SEQ ID NO: 11630 - DNA, 2077 bp, Arabidopsis thaliana (mouse-ear cress)
  CDS (60)..(1940)
actctttcctttttggtgcgttattctaagagccctagtcagaattcaaacatttggcaatgaaatcatacaaacttaataaccctaatttactcatctccacgcacacacataataaactcttcttatcctcttctccattcaatctcttattctcttttccttccttcatataccttaaacagcaacgttctctgttcttcttcttctttttcttcctctgtttttctttcacaacttccatgttggactcggacacagacacggactcaggtcctgtggttgcaacaaccaaactcgtcactttcctccagcgtgtgcagcacacggcacttcgatcataccctaaaaaacaaacgcctgatcccaaatcctacattgatctatctctcaaacgtccctacagtctctccaccatcgaatcagccttcgatgatctcacgagcgagtcacatgaccagccagtgccagtggagacgcttgaaaagttcgtcaaggaatattttgacggtgcaggggaggatctgctgcaccacgaaccagtagatttcgtctcagatccctccggcttcctctccaacgtggagaacgaagaagtcagagaatgggcgcgtgaggtacacggtctttggagaaatctgagctgcagagtctctgactcagtaagagagtctgccgaccggcacacgcttctaccgttgccggaaccggttatcattcccggttcgagattcagagaagtctattactgggattcttattgggtcatcaaaggacttatgacgagtcaaatgttcactaccgccaaaggtttagtgacgaatctgatgtcacttgtggagacttatggttacgctttgaacggtgctagagcttattatactaacagaagccaaccacctttgttgagctccatggtctatgaaatttataatgtgacaaaagatgaagaacttgtgaggaaagcaatccctctgcttctcaaagagtacgagttttggaactcaggaaaacataaagtggttattcgagacgctaatggttatgatcacgttttgagccgttattatgctatgtggaacaagccaaggcctgaatcctctgttttcgatgaagaatctgcttcagggttctcgactatgttagagaaacaacggttccatcgagatatagccacggctgctgaatcaggatgcgatttcagcacgcgatggatgagggatcctcctaatttcacaacgatggctacaacatcagtggttcctgttgatctaaatgtttttcttctcaagatggaactcgatatagcgttcatgatgaaggtttctggagatcaaaatggttcagaccgttttgtgaaagcgtcaaaagcgagagagaaagcgtttcaaaccgtgttttggaacgagaaagcagggcaatggctggattactggctttcctccagtggtgaggaatctgagacatggaaggctgagaaccaaaacaccaacgtctttgcgtctaactttgcaccaatctggattaattccatcaattcagatgaaaatcttgtcaagaaagttgtgacagctcttaagaactcagggctcattgctcccgctggaatcctaacttctttgacaaactcaggacaacaatgggattctccgaatggatgggcaccgcaacaagagatgatcgtcacagggctcggaagatcgagtgtaaaagaagctaaagagatggcagaggatattgcaaggagatggatcaaaagcaactatcttgtctacaagaaaagtgggactatacatgagaagctcaaagttacagagcttggtgaatatggtggtggaggagaatatatgccacagaccggattcggatggtcaaatggagttatcttagcattcttggaggaatatggatggccctctcatcttagcattgaagcctagatttactaagtttattgaaagttaaataacggaattagacattttatgttacaaaaactttggtagatttgatcgtagtggattatttcttggggttttctgtcagaacgttttagagttacaaatgttttatgacc

SEQ ID NO: 11631 - protein, 626 aa, Arabidopsis thaliana (mouse-ear cress)
MKSYKLNNPNLLISTHTHNKLFLSSSPFNLLFSFPSFIYLKQQRSLFFFFFFFLCFSFTTSMLDSDTDTDSGPVVATTKLVTFLQRVQHTALRSYPKKQTPDPKSYIDLSLKRPYSLSTIESAFDDLTSESHDQPVPVETLEKFVKEYFDGAGEDLLHHEPVDFVSDPSGFLSNVENEEVREWAREVHGLWRNLSCRVSDSVRESADRHTLLPLPEPVIIPGSRFREVYYWDSYWVIKGLMTSQMFTTAKGLVTNLMSLVETYGYALNGARAYYTNRSQPPLLSSMVYEIYNVTKDEELVRKAIPLLLKEYEFWNSGKHKVVIRDANGYDHVLSRYYAMWNKPRPESSVFDEESASGFSTMLEKQRFHRDIATAAESGCDFSTRWMRDPPNFTTMATTSVVPVDLNVFLLKMELDIAFMMKVSGDQNGSDRFVKASKAREKAFQTVFWNEKAGQWLDYWLSSSGEESETWKAENQNTNVFASNFAPIWINSINSDENLVKKVVTALKNSGLIAPAGILTSLTNSGQQWDSPNGWAPQQEMIVTGLGRSSVKEAKEMAEDIARRWIKSNYLVYKKSGTIHEKLKVTELGEYGGGGEYMPQTGFGWSNGVILAFLEEYGWPSHLSIEA

SEQ ID NO: 11632 - DNA, 1767 bp, Caenorhabditis elegans
  CDS (1)..(1767)
atgttgaatccttggaatttcttcgtttttgtattattcataatatgtgggccactaggatccaatcaagttgaggttcatgtgtgcgacaccacaaattcaaacaactcattcatctattgtaatggaccaatattagatgcagtaaactatcattcactatacaatgattcaaaagaatttgttgatatgccattaaaagatgatcctcaaattgtttacaatgcgtggagggctaaatacggaaatcaatcatctgcaaacttgaataaaagcgatgttcaagcgtttgtaaatcaatatttcagtgctgctggaacagagcttgtcgtttgtacacctgacgattggcaagagaaaccaccaaaattggcaacaatcgctgatccgaaactccctattgaacaacatacatctcgttactctcttctgtatgttccaaatagttttattgtgcctggaggaagattccgcgagttttattattgggatgcatattggattatcaaaggattgattgcatctgatatgtataacacaactagaagtatgattagaaatcttgcatcaatggttgacaaatatggttttgtaccaaatggtggaagagtttattatcttcaaagaagtcagccaccattcctggctgcaatggtttacgaactttatgaagcaaccaacgacaaggcctttgttgctgaacttctgccaactctcttgaaagaattgaatttctggaatgaaaagagaatgactgatgtgcaaatgaatgggaaatcatttaaagtttatcaatataaaacagccagcaacgttcctcgacctgaatcataccgtgttgacacccaaaactctgcaaaattagcaaatggagctgatcagcaacagttttatcaagatcttgcaagcgccgccgagtctggatgggatttctcaactagatggttttctgattataaaactttgacatctatcgaaactaccaaggttttgcctgttgacctgaatggtttgctgtgctggaatatggatatcatggagtatctttacgagcaaattggtgacacaaagaattctcaaatattccgtaacaaaagagctgatttccgagatactgttcaaaatgttttctataatcgaacagatggaacttggtacgattataatttgagaacacaatcccataatccaagattctacacaagtaccgcagttcctttattcacaaattgctataacacattgaataccggaaaatcacaaaaagtattcgactatatggataaaatgggagtattcacttatccagggggaattccaacttcaatgtctcaagaaagtgaccaacaatgggatttcccaaatggatggagtccaaataatcatatgatcattgaaggattaagaaaatcagcaaatcccgaaatgcaagataagggattcctgattgcttccaaatgggttatgggcaacttccgagtgttctatgaaaccggccacatgtgggagaagtacaacgtgatcggcagctacccacaaccaggatctggaggtgaatatgatgttcaggatggatttggatggagcaacggagctatattggatcttctcttgacatataacgatcgattatttgttccagaaaactttgtcaacacaactgtcacaccttcggttgaatctactaccaaatctgctccaaaatatgctaagctaccatgggtactcgttttcgctttcatgattcgtcaactttttaattattaa

SEQ ID NO: 11633 - protein, 588 aa, Caenorhabditis elegans
MLNPWNFFVFVLFIICGPLGSNQVEVHVCDTTNSNNSFIYCNGPILDAVNYHSLYNDSKEFVDMPLKDDPQIVYNAWRAKYGNQSSANLNKSDVQAFVNQYFSAAGTELVVCTPDDWQEKPPKLATIADPKLPIEQHTSRYSLLYVPNSFIVPGGRFREFYYWDAYWIIKGLIASDMYNTTRSMIRNLASMVDKYGFVPNGGRVYYLQRSQPPFLAAMVYELYEATNDKAFVAELLPTLLKELNFWNEKRMTDVQMNGKSFKVYQYKTASNVPRPESYRVDTQNSAKLANGADQQQFYQDLASAAESGWDFSTRWFSDYKTLTSIETTKVLPVDLNGLLCWNMDIMEYLYEQIGDTKNSQIFRNKRADFRDTVQNVFYNRTDGTWYDYNLRTQSHNPRFYTSTAVPLFTNCYNTLNTGKSQKVFDYMDKMGVFTYPGGIPTSMSQESDQQWDFPNGWSPNNHMIIEGLRKSANPEMQDKGFLIASKWVMGNFRVFYETGHMWEKYNVIGSYPQPGSGGEYDVQDGFGWSNGAILDLLLTYNDRLFVPENFVNTTVTPSVESTTKSAPKYAKLPWVLVFAFMIRQLFNY

SEQ ID NO: 11634 - DNA, 2119 bp, Caenorhabditis elegans
  CDS (236)..(1993)
aatttggcacgagaaccagcatagccctgtgttattcttacaacgactccaaaaggtacacaactcaaattgtaaagtatatccacactatcaccgattagaaagatgttgctcaactgttgcaagtggagttcggatccaaagccagacaccacaagaaggagaaaaagaaagaagagaaccttccacttccttctcagctccatttcctacttcaacggctttttccaccaaaatgagcccgtcacccgtttggtgcgatggaactcttcttcacgccgttcaattatccggtcttttcccggattgtaagacctttgtggatatgccattgaagcatgatgcagacgtcacacttgccagatggaatgcccttatggctcttgctcctatcaccaatgacgtgttagcccttttccttcgggaaaactttgatgagccagaaggagaactagaagaatgtgccccgactgattgggcgcctatgactgatcaatttggtggcattatagatgaagattatcgaagattcgcagcagcgctgcatgccaaatggccaacgttatatagaaaaatttccaaaaaagtccgcgttaatccagaaaaatactcaattattccggttcccaatccatttgttgtgcctggcggaagattccgtgaaatgtactactgggattcgttctttacaatcaaaggtctcatcgcatctggaatgcttacaacagtcaagggaatgattgagaatatgatctacttagttgaaacatatggtttcattccaaatggtacacgtgtatattacttgaaccgatcacagccaccactattaacttggtgtgtcaaagcatattatgaagctactggtgacaaacaatttctgtcagatgtactgccaacacttagaaaagagttctcattcttccaaactcacaaaacatataatcatcctgattggaacactcctttgtatagattcgtagttgaaacatcacatccacgtccggaatcttatcgagaagatttggaaagcgccgagcatttggatactcttgagaagaaatgtgtactttggggagatttggccgcagcagctgaaagtggtcgtgacttctcatctcgtttctttgctgttcatggtccatatgctggtcaactggcaagcacacggacatctcaattgattcctgtagacttgaattcaatcatttgtggaaatatgaaaacattgagtgagatgtatacggtgtgtggagatttggaaagtgcaaaatactttgataatgagtatcgaacgctcagagatactattcgacaggttttgtggaatgaagagcataattgttggtttgactttgatgttgaagagggaaatcatgccacaagcttccacgacactaacttcttcccaatgtactgtgacagctatcatgaagatctcgactcacaagtggtagttgactatttgacaacatctggagccatcagcttccccggaggtattcctgtatccctagtgaattctggagaacaatgggattttccgaacagttggccaccaactacttgggttcttcttgaaggattacgaaaagttggtcaagaagaattagcattgagcttggtggagaaatgggtacagaagaacttcaatatgtggagaacaagtggaggaagaatgttcgaaaagtacaacgtagtctcaccatgcttcaaagtgaaaggaggtggtgaatacgtgatgcaagaaggattcggttggacaaacggcgtcattctagactttctcaagaactacggatccaaaatccggtggcaagttgcagaatcctgtgaatgctgtgatgtcacattatcacgtactcttatcaaaccaacatctcctgctccatcatcatcttcaactgctcgcctctttgctagtgaactcacacagacaccttccgtcgtgtcacttcaatcaatgttgtccgatggatcagttcagaattagatcaaatccttcgaaatagaattgaaaaatatatatgtttgtctccctttgtctcttcatgcggttcacactttcttgcgttatttattgaatataaaattacagattaataaatttattttatga

SEQ ID NO: 11635 - protein, 585 aa, Caenorhabditis elegans
MSPSPVWCDGTLLHAVQLSGLFPDCKTFVDMPLKHDADVTLARWNALMALAPITNDVLALFLRENFDEPEGELEECAPTDWAPMTDQFGGIIDEDYRRFAAALHAKWPTLYRKISKKVRVNPEKYSIIPVPNPFVVPGGRFREMYYWDSFFTIKGLIASGMLTTVKGMIENMIYLVETYGFIPNGTRVYYLNRSQPPLLTWCVKAYYEATGDKQFLSDVLPTLRKEFSFFQTHKTYNHPDWNTPLYRFVVETSHPRPESYREDLESAEHLDTLEKKCVLWGDLAAAAESGRDFSSRFFAVHGPYAGQLASTRTSQLIPVDLNSIICGNMKTLSEMYTVCGDLESAKYFDNEYRTLRDTIRQVLWNEEHNCWFDFDVEEGNHATSFHDTNFFPMYCDSYHEDLDSQVVVDYLTTSGAISFPGGIPVSLVNSGEQWDFPNSWPPTTWVLLEGLRKVGQEELALSLVEKWVQKNFNMWRTSGGRMFEKYNVVSPCFKVKGGGEYVMQEGFGWTNGVILDFLKNYGSKIRWQVAESCECCDVTLSRTLIKPTSPAPSSSSTARLFASELTQTPSVVSLQSMLSDGSVQN

SEQ ID NO: 11636 - DNA, 2208 bp, Schizosaccharomyces pombe
  CDS (1)..(2208)
atgccttcgaaattttcctctaaatacgtggatacagaagccatttcaaatgatgatgacaatccctttgcaaccgctaagagttattactccaaggatacagacttgtcgactcgggtaagtgctggccgtcctcgcaccttatccacttcgatggaggcatccgccgcaccaactataccagaattaaagaatttacgtcgacgtggaagtcttgatgaacataaacaaccacgaaaatttcttgttgatgttgataagacattgaatgcacttttggaatctgaagacaccgaccggaacatgcaaatcaccatcgaggataccggacctaaagttgtttcccttggcagcgctagctcgggtggatatcgcttgtatgagcttcgcggcacatatcaattgtcaaatttacttcaggaattgaccttggcaaaggattatggacgtcgatatattttacttgatgagcgaagacttaatgaaaaccctgtgaaccgactttctagactcatcaaaggtaccttttgggatgcccttactcgaagaatcgatgccagtgttttggatgttatttgccgtgataccaaagaccgatcaggatcacacgtgaatcgaatttatgttcctaaagccgaacaagagatgtatgaatactatgttcgcgctgctaaggaaaggccttacttgaatttacaggtcgaatatctgccggaagagattactccagaatgggtgagagatgtaaatgataagccagggttacttgcacttgcaatggaaaaataccaagatgatgaaggcaatacacatcttcgaggtgtgccatttgtcgttcctggtggccggtttaatgaactgtacggctgggactcttactttgaatcactgggtttgcttgttgacgatcgggttgacttggcgaaaggtatggtggagaattttatttttgaaattacctattacggtaagatcttgaatgccaaccgcacttattatcttcttcgctcccagcctccatttttgaccgatatggcccttcgagtttatgaacgtataaaaaacgaagaaggatctttagactttttgcatcgggccttttctgcgactataaaagaatatcacactgtttggactgccactccacgactggatcccaaaactggtctttcccgctatcgccctggaggactcggtattcctccggaaactgaagcttctcattttgagcatttgcttcgtccttacatggagaagtatcatatgactcttgaggagtttactcatgcatacaattaccaacaaattcatgaacccgcgttggatgagtatttcgtgcacgaccgcgcagttcgcgaaagcgggcatgatactacttatcggttggaaaaagtttgtgctgacttggccaccgtggatctgaactcgttgctatacaaatatgaaaccgacatctcacatgtgattttagaatatttcgatgacaagtttgtacttccaaacggaactatagaaacttctgccatttgggatcgtcgtgctcgtgctcgtcgtgctgcaatggaaaagtatctttggtcagaagctgattcgatgtggtatgattacaacacgaagttagaaacgaagagtacttatgaaagtgctactgctttctgggccttgtgggccggtgtggcaactccccgtcaagccgcaaaatttgttgatgttagtcttcccaagtttgaagttgctggaggtatagttgctggtacaaagagaagcttgggtaaagtgggtcttgataatcccagccgtcaatgggattatcctaatggctggagccctcagcagattttagcttggtatggattgattcgatacggatatgaagaggagactcgtagacttgtatatcgttggctatatactattactaaatcgtttgttgattttaatggtattgttgttgaaaaatatgatttgaccagaccagttgatccacatcgtgttgaagctgagtatggtaatcagggtgtcaatatcaaaggcgttgctcgcgaaggttttggatgggttaatgccagttacgaagtcggccttacattctgtaattcgcatatgcgtcgggctcttggtgcttgtacgactcctgatgttttctttgccggcatcaaggaagaatctcttcctgctttcgaaaacctttccattcataaaaattaa

SEQ ID NO: 11637 - protein, 735 aa, Schizosaccharomyces pombe
MPSKFSSKYVDTEAISNDDDNPFATAKSYYSKDTDLSTRVSAGRPRTLSTSMEASAAPTIPELKNLRRRGSLDEHKQPRKFLVDVDKTLNALLESEDTDRNMQITIEDTGPKVVSLGSASSGGYRLYELRGTYQLSNLLQELTLAKDYGRRYILLDERRLNENPVNRLSRLIKGTFWDALTRRIDASVLDVICRDTKDRSGSHVNRIYVPKAEQEMYEYYVRAAKERPYLNLQVEYLPEEITPEWVRDVNDKPGLLALAMEKYQDDEGNTHLRGVPFVVPGGRFNELYGWDSYFESLGLLVDDRVDLAKGMVENFIFEITYYGKILNANRTYYLLRSQPPFLTDMALRVYERIKNEEGSLDFLHRAFSATIKEYHTVWTATPRLDPKTGLSRYRPGGLGIPPETEASHFEHLLRPYMEKYHMTLEEFTHAYNYQQIHEPALDEYFVHDRAVRESGHDTTYRLEKVCADLATVDLNSLLYKYETDISHVILEYFDDKFVLPNGTIETSAIWDRRARARRAAMEKYLWSEADSMWYDYNTKLETKSTYESATAFWALWAGVATPRQAAKFVDVSLPKFEVAGGIVAGTKRSLGKVGLDNPSRQWDYPNGWSPQQILAWYGLIRYGYEEETRRLVYRWLYTITKSFVDFNGIVVEKYDLTRPVDPHRVEAEYGNQGVNIKGVAREGFGWVNASYEVGLTFCNSHMRRALGACTTPDVFFAGIKEESLPAFENLSIHKN

SEQ ID NO: 11638 - DNA, 2207 bp, Solanum tuberosum
  CDS (161)..(1906)
cttttctgagtaataacataggcattgattttttttcaattaataacacctgcaaacattcccattgccggcattctctgttcttacaaaaaaaaacatttttttgttcacataaattagttatggcatcagtattgaaccctttaacttgttatacaatatgggtaaagctataatttttatgatttttactatgtctatgaatatgattaaagctgaaacttgcaaatccattgataagggtcctgtaatcccaacaacccctttagtgatttttcttgaaaaagttcaagaagctgctcttcaaacttatggccataaagggtttgatgctaaactgtttgttgatatgtcactgagagagagtctttcagaaacagttgaagcttttaataagcttccaagagttgtgaatggttcaatatcaaaaagtgatttggatggttttataggtagttacttgagtagtcctgataaggatttggtttatgttgagcctatggattttgtggctgagcctgaaggctttttgccaaaggtgaagaattctgaggtgagggcatgggcattggaggtgcattcactttggaagaatttaagtaggaaagtggctgatcatgtattggaaaaaccagagttgtatactttgcttccattgaaaaatccagttattataccgggatcgcgttttaaggaggtttattattgggattcttattgggtaataaggggtttgttagcaagcaaaatgtatgaaactgcaaaagggattgtgactaatctggtttctctgatagatcaatttggttatgttcttaacggtgcaagagcatactacagtaacagaagtcagcctcctgtcctggccacgatgattgttgacatattcaatcagacaggtgatttaaatttggttagaagatcccttcctgctttgctcaaggagaatcatttttggaattcaggaatacataaggtgactattcaagatgctcagggatcaaaccacagcttgagtcggtactatgctatgtggaataagccccgtccagaatcgtcaactatagacagtgaaacagcttccgtactcccaaatatatgtgaaaaaagagaattataccgtgaactggcatcagctgctgaaagtggatgggatttcagttcaagatggatgagcaacggatctgatctgacaacaactagtacaacatcaattctaccagttgatttgaatgcattccttctgaagatggaacttgacattgcctttctagcaaatcttgttggagaaagtagcacggcttcacattttacagaagctgctcaaaatagacagaaggctataaactgtatcttttggaacgcagagatggggcaatggcttgattactggcttaccaacagcgacacatctgaggatatttataaatgggaagatttgcaccagaacaagaagtcatttgcctctaattttgttccgctgtggactgaaatttcttgttcagataataatatcacaactcagaaagtagttcaaagtctcatgagctcgggcttgcttcagcctgcagggattgcaatgaccttgtctaatactggacagcaatgggattttccgaatggttggcccccccttcaacacataatcattgaaggtctcttaaggtctggactagaagaggcaagaaccttagcaaaagacattgctattcgctggttaagaactaactatgtgacttacaagaaaaccggtgctatgtatgaaaaatatgatgtcacaaaatgtggagcatatggaggtggtggtgaatatatgtcccaaacgggtttcggatggtcaaatggcgttgtactggcacttctagaggaatttggatggcctgaagatttgaagattgattgctaatgagcaagtagaaaagccaaatgaaacatcattgagttttattttcttcttttgttaaaataagctgcaatggtttgctgatagtttatgttttgtattactatttcataaggtttttgtaccatatcaagtgatattaccatgaactatgtcgttcggactcttcaaatcggattttgcaaaaataatgcagttttggagaatccgataacatagaccatgtatggatctaaattgtaaacagcttactatattaagtaaaagaaagatgattcctctgctttaaaaaaaaaaaaaaaaa

SEQ ID NO: 11639 - protein, 581 aa, Solanum tuberosum
MGKAIIFMIFTMSMNMIKAETCKSIDKGPVIPTTPLVIFLEKVQEAALQTYGHKGFDAKLFVDMSLRESLSETVEAFNKLPRVVNGSISKSDLDGFIGSYLSSPDKDLVYVEPMDFVAEPEGFLPKVKNSEVRAWALEVHSLWKNLSRKVADHVLEKPELYTLLPLKNPVIIPGSRFKEVYYWDSYWVIRGLLASKMYETAKGIVTNLVSLIDQFGYVLNGARAYYSNRSQPPVLATMIVDIFNQTGDLNLVRRSLPALLKENHFWNSGIHKVTIQDAQGSNHSLSRYYAMWNKPRPESSTIDSETASVLPNICEKRELYRELASAAESGWDFSSRWMSNGSDLTTTSTTSILPVDLNAFLLKMELDIAFLANLVGESSTASHFTEAAQNRQKAINCIFWNAEMGQWLDYWLTNSDTSEDIYKWEDLHQNKKSFASNFVPLWTEISCSDNNITTQKVVQSLMSSGLLQPAGIAMTLSNTGQQWDFPNGWPPLQHIIIEGLLRSGLEEARTLAKDIAIRWLRTNYVTYKKTGAMYEKYDVTKCGAYGGGGEYMSQTGFGWSNGVVLALLEEFGWPEDLKIDC

SEQ ID NO: 11640 - DNA, 1966 bp, Caenorhabditis elegans
  CDS (1)..(1704)
atgctctacactgtaatcaacctcctagcacaaatctattgcaatggaccaattcttcaaactgtacaagattcacacatgtttccagactcgaagcacttcgtcgatatgtcactaaaatatgatccaattacgacacttcgacatttcgacgagcttggtgatcgaacttcagatatgattattttaagggaatttgtaacttcacattttaatccgcctggaagtgagctggttgaatggtttcctccagattgggtcgattttccatcaaactttttgaatattcatgattatcaccatagacgatgggcattgcatttacataggatttggaaagatttatgtagaaaagttcgagatgacgtcaagcatcgtcaagatcactattcacttctatatgttcctcatccatttattatcccgggtggtcgatttttggagttctactattgggatactttctggatactcaaagggcttctcttctcagaaatgtatgaaacagctcgaggagttatcaaaaatctaggatatatggttgataatcacggtttcgtaccaaatggaggtcgtgtctattatctaacacgttcccaaccacctctattgacaccgatggtctacgaatattacatgagcacaggagatttggattttgtaatggaaattcttccaacccttgacaaagaatacgagttttggattaaaaatcgacaggaatggttcaaagacaaagatggtgtcaagcagtttccatattatcaatataaggctaaactcaaagtaccgagaccagaatcatatcgtgaggattcggaattagcagagcatctgcaaactgaagcggagaaaattcaaatgtggagtgagatagcgtcggctgccgagacgggatgggatttctccactcgatggttttctcaaaatggagatacaatgcatcgaatggattctataagaacgtggagcattatcccagccgatttaaacgctttcatgtgtgcaaatgctcgaattctggcgagtctttatgaaattgctggtgatttcaaaaaagtgaaagtatttgaacaacgatacacttgggcaaaacgggaaatgcgtgaattacattggaatgaaacagatggtatttggtatgattatgatatcgaattgaaaactcattcaaatcaatattatgtatcaaatgctgttcctttgtatgcaaaatgttatgatgatgatgatgatattccacatcgtgttcatgattatttagagcgccaaggactattgaaatacacaaaaggtcttccaacatctcttgcaatgagtagtacgcagcaatgggataaggaaaacgcatggcctccaatgattcatatggttatcgaaggattccgtacaactggtgacataaaactgatgaaagttgctgaaaagatggcaacgtcatggcttactggaacatatcagtcatttatcagaactcatgctatgtttgaaaagtataatgttactccacatactgaagaaacttctggaggaggtggaggagaatatgaagttcaaactggctttggttggacaaatggcgttattttggatttattggacaaatacggagatcaatttgcatccagctctacagcttccaaattcagtttttccctttcgaatatcacatttgtagtttttattttgtatattttctcatagattcctgtagaatttgcacctgattttattattttctgttgtgtatagtccagttccctcatttagatcttttttaactaaagaatcaaaaacattgccatagcgattgccttaatttttttgttttaaatatcaaactcacattttgctttttctcatccggtccaaccccccattttcagattataacgattgttttctttcgggttctttttttccttattttcaaaaaaccttttttagttcataaaatttttactta

SEQ ID NO: 11641 - protein, 567 aa, Caenorhabditis elegans
MLYTVINLLAQIYCNGPILQTVQDSHMFPDSKHFVDMSLKYDPITTLRHFDELGDRTSDMIILREFVTSHFNPPGSELVEWFPPDWVDFPSNFLNIHDYHHRRWALHLHRIWKDLCRKVRDDVKHRQDHYSLLYVPHPFIIPGGRFLEFYYWDTFWILKGLLFSEMYETARGVIKNLGYMVDNHGFVPNGGRVYYLTRSQPPLLTPMVYEYYMSTGDLDFVMEILPTLDKEYEFWIKNRQEWFKDKDGVKQFPYYQYKAKLKVPRPESYREDSELAEHLQTEAEKIQMWSEIASAAETGWDFSTRWFSQNGDTMHRMDSIRTWSIIPADLNAFMCANARILASLYEIAGDFKKVKVFEQRYTWAKREMRELHWNETDGIWYDYDIELKTHSNQYYVSNAVPLYAKCYDDDDDIPHRVHDYLERQGLLKYTKGLPTSLAMSSTQQWDKENAWPPMIHMVIEGFRTTGDIKLMKVAEKMATSWLTGTYQSFIRTHAMFEKYNVTPHTEETSGGGGGEYEVQTGFGWTNGVILDLLDKYGDQFASSSTASKFSFSLSNITFVVFILYIFS

SEQ ID NO: 11642 - DNA, 1908 bp, Caenorhabditis elegans
  CDS (1)..(1908)
atgagatggacgccacaattactaataagtgttttaattggttatgttcaagcaagactagaaatcagtgagctgaggtttaaagatatattaagctctcactacattttcaaacccctggaagtcccttgcaacgaaagtctctgcactggacctctctcagaaatctattgccatggcccaattttaacaaattcctggcagtttggactacagaaaacatgtcctggagacaaactcaaggttactgcaaaagaggttctcgctaattttaacaagttgccgtggcctttgaagaaggaagtatttcagcaattttgcgaggaacatttcgagcaagtaaactatttggaagttgtaaatcttacagattatgaagttcagcctaagtttctgaatgaaattgggaatttgagccacagaaaacttgctgcagaaatgcacgagagatgggaacgacttgcacgccaattcacttccgatgtgcaacaccatccagatttatatcctcttattcccgtgcaaaacccgttcattgtgccaggcggccgatttgacgtatatttctactgggatactttttggatcatcaaaggtctactcgtctcaagaatgttcgaaacgactaaagggatcatcaataatttttcaaatctagtggtcacactgggctatatcccaaattctggaaacttgcagttgtctagaaggtctcaaccaccactcttcccacatatgatatgggagtacactaaagctacgggtaactatgaaaaacaatggatagatagtatggatatggaaatgaagttttgggagaataatcgaacgattgcgataggaactcacaagttattcctttacaagacactcacaaattgtccgcgacctgaaaacttcctaggagatttcaatattggaaaagctgccaaaactccatcagacgtttggcggtctatatcatcagcatgtgagagtggatgggatttcagttctagatggatgcacaataacgatacagatctatcaagtattcacaccgatctaattattcctgtcgatttgaatgttttcatcgcaaacaactatcggtacatggcatactatgcaaatcattttggaagatttgataagtctgcaagctatcggcaaaagtatgagaaactacgctatgcaattcaggaagtattgtgggataataatttaggcgcttggtttgactacgatatttcaatacagaaacgaaatttgaacttctacccatcaaatgtgtatccattaatgctggaagggatggataagtttgccgatcgtgttgaagattatatgaaaaaatcgggagcattggagtttgtgggcggtattccatcttcgttacctgctcagtccacgcaacagtgggattttccaaatgtttgggctccaaatcaacattttgtaattcaaagctttatggcttgcaataacagtttcctgcagcaagaagctaaaaaacaagctatggaatttattgaaactgtgtataacggaatgtacaacccaatagcaggactagatggaggagtatgggaaaagtacgacgcgaggagcacgaatggggctccaggagctggaggagagtacgtggttcaagaaggatttggttggacaaatggagccgttatggacctcatttggacacttagagactctcacaaaaaacagattagatctgaaaatttgaagcttgatcaaggccaacactttgcattggtgttaacagcttttatattttgtattgccatagcttttattgtgattatcaaaggaattatcaaaggaaacactttaaatcaacgggatgatgaagaagccggtgcccgtctactcgcggaagaaaacgacgaggacgaccaagaagagctgtga

SEQ ID NO: 11643 - protein, 635 aa, Caenorhabditis elegans
MRWTPQLLISVLIGYVQARLEISELRFKDILSSHYIFKPLEVPCNESLCTGPLSEIYCHGPILTNSWQFGLQKTCPGDKLKVTAKEVLANFNKLPWPLKKEVFQQFCEEHFEQVNYLEVVNLTDYEVQPKFLNEIGNLSHRKLAAEMHERWERLARQFTSDVQHHPDLYPLIPVQNPFIVPGGRFDVYFYWDTFWIIKGLLVSRMFETTKGIINNFSNLVVTLGYIPNSGNLQLSRRSQPPLFPHMIWEYTKATGNYEKQWIDSMDMEMKFWENNRTIAIGTHKLFLYKTLTNCPRPENFLGDFNIGKAAKTPSDVWRSISSACESGWDFSSRWMHNNDTDLSSIHTDLIIPVDLNVFIANNYRYMAYYANHFGRFDKSASYRQKYEKLRYAIQEVLWDNNLGAWFDYDISIQKRNLNFYPSNVYPLMLEGMDKFADRVEDYMKKSGALEFVGGIPSSLPAQSTQQWDFPNVWAPNQHFVIQSFMACNNSFLQQEAKKQAMEFIETVYNGMYNPIAGLDGGVWEKYDARSTNGAPGAGGEYVVQEGFGWTNGAVMDLIWTLRDSHKKQIRSENLKLDQGQHFALVLTAFIFCIAIAFIVIIKGIIKGNTLNQRDDEEAGARLLAEENDEDDQEEL

SEQ ID NO: 11644 - DNA, 2541 bp, Debaryomyces hansenii CBS767
  CDS (1)..(2541)
atgagcaatccatcccactcgagatcagtttcatcttcgagtgaagatgacaatccttatgatacaccagagaattactatggtcctaagaccaaccctgttggtgcaggcaagaattcgaaattaggaaaggttagaacattttccgtctttgaaccaaaacggtcacaattttttgatgattacaaccctggtttagccaattacgatcctggtttagctaactcggatgttaccgaacagcctgacaaagaaacgagtccattttcagattcgccaacgccagaagtcgaatgcaaatgggatttcaagcagtcatctgggcttgccccactgacgggaaagaaagtggatgatattccctcaacacataaccctaaaagagggaacagaaattctatagtgccaatctatgaagacatttcgctggattcggtggaggatttcaatgcatcgacgaaacctgatcctaaacgtttgcattataggcgagcctcaatggatgatacgttcctcaaaccaagaaagttctatatcaacgacattgaccttacacttaaggagctcttgaagaatgaagatactgaccacaattttcaaattactatcgaagataatgggcccaaagttatcaaattaggtacggccaactcaaatggatatcgacaggcaccaattagaggtacatacatgttgtccaacttgttacaagagctcacaatagctaagaggcttggtagagaccaaatgattttggatgagaccagattgaatgaaaatccagtgtaccgtatgaagcgtcttattacgactcaattctggaggtcattaacaagattgttgactagagacaatataatggaaatgtctaaggatactaagattgaagaagaaataactgacgaaaatggtcaagttcaacataataaggagagtcatagaatatacattccttataacagaaaggatcagtttgattatttcaatagtataaaagaagcaaacccagatattagtcttgatgtccaatatttgccagaaattattgatgctgactatgtaaaatcgattaataaaaagccaggtttgttggcccttagtgctgcccctgacccaaatgattcaaccaacttaattagtcaaccatatattgtcccaggcggtagatttaatgaattatatggatgggattcttatatggaaaccattggtttattggttgatgtcactgttgatgatcaggaacatttaaagttagctaggggtatgacagagaatttcatatatgaaattcatcattacggtaaaatattgaatgctaacagatcctattatttgacaaggtcgcagccacctttcttaactgacatggccttgagagttttcaataaaactatggaagtagctccagaaaggctagaagagtcgatggactttataagaagagccattgaggcggccattaaagagtataataacgtctggtttgcagagccaaggttagacaaagagacaggtttatcttgttatcatccagttggaaaaggtatacctccagagactgaggctagtcatttcaatgcgattttagatccttacatcaagaaatatggcatctctcagactgattttattgaagagtataataatgggaccattaaggaacctgaattagacgagtatttcctacacgacagggctgtaagagaatcgggacatgatacatcttataggttagaaggtaagtgtgcggatctagccacagtggacttaaattccttgttgtataagtacgaagcagatatcgcctttgttatcgagtcactctgtgatggaaaattggaaaataaggacactggcgaaatcgaaacaccagagaaatggagagagaaggctaatttgagaaagaaaagaattactaagtacttgtggaacgaggaggactcgattttctatgactataatattaaaaagaagagacaaacaggttacgaatcggcgactacgttttggcctttatggtcacaagtagcctctgcagaacaagcggatatgctagttaagaattcgacacagaaactagaagaatttggtggacttgcggctggcaccttgaagtctcgaggtggtatcaatttacacagaccatcaagacaatgggactatccctatggatgggctccacagcagattctagcatggatcgggttgtgtaattacggttacgaaggagttgctcgtagattagcctatcgttggttatatctaatgactcaagctttcgttgattataatggtgttgtggtggagaaatataatgtcactaagggtgccattccacacaaagttgatgcagaatacggtaaccaaggcttggatttcaaaggggttgctatggaagggtttggctgggttaacgcaagttatgtgtttggcttgacatttatgaatcttcatgcttgtagatgtttaggaactctcaccccacccgatgttttcttgagatatttacatcctcaacaaagaaaagactatcagtga

SEQ ID NO: 11645 - protein, 846 aa, Debaryomyces hansenii CBS767
MSNPSHSRSVSSSSEDDNPYDTPENYYGPKTNPVGAGKNSKLGKVRTFSVFEPKRSQFFDDYNPGLANYDPGLANSDVTEQPDKETSPFSDSPTPEVECKWDFKQSSGLAPLTGKKVDDIPSTHNPKRGNRNSIVPIYEDISLDSVEDFNASTKPDPKRLHYRRASMDDTFLKPRKFYINDIDLTLKELLKNEDTDHNFQITIEDNGPKVIKLGTANSNGYRQAPIRGTYMLSNLLQELTIAKRLGRDQMILDETRLNENPVYRMKRLITTQFWRSLTRLLTRDNIMEMSKDTKIEEEITDENGQVQHNKESHRIYIPYNRKDQFDYFNSIKEANPDISLDVQYLPEIIDADYVKSINKKPGLLALSAAPDPNDSTNLISQPYIVPGGRFNELYGWDSYMETIGLLVDVTVDDQEHLKLARGMTENFIYEIHHYGKILNANRSYYLTRSQPPFLTDMALRVFNKTMEVAPERLEESMDFIRRAIEAAIKEYNNVWFAEPRLDKETGLSCYHPVGKGIPPETEASHFNAILDPYIKKYGISQTDFIEEYNNGTIKEPELDEYFLHDRAVRESGHDTSYRLEGKCADLATVDLNSLLYKYEADIAFVIESLCDGKLENKDTGEIETPEKWREKANLRKKRITKYLWNEEDSIFYDYNIKKKRQTGYESATTFWPLWSQVASAEQADMLVKNSTQKLEEFGGLAAGTLKSRGGINLHRPSRQWDYPYGWAPQQILAWIGLCNYGYEGVARRLAYRWLYLMTQAFVDYNGVVVEKYNVTKGAIPHKVDAEYGNQGLDFKGVAMEGFGWVNASYVFGLTFMNLHACRCLGTLTPPDVFLRYLHPQQRKDYQ

SEQ ID NO: 11646 - DNA, 1947 bp, Yarrowia lipolytica CLIB99
  CDS (1)..(1947)
atgacacgatcaagaagttatagcctgccaacaccacctcaacccagaacaccaagacggttcagtgccagcagtctcatactgggtggtgagaaaaggttcatagcaagtgatcatacagtcgagcaactgctgcttctctgtgacgacgaaggacatatcacgatcgacaccaccacgacttcttctgacaattttctacaggtggagacagatgctgggtggtgctaccaggtcataggcgcctaccagttagctactgtactcaattatctcctccttaaacgagggggtcctgaaactgggttgaaaaggctgaaacaaaaccagaagacaattgctccgagttcttgcgtgacacatatctcaagcgacaaaattttggaacccccacaccagagacttaaaaaccttgtggacaatcaattttggcaccaattgaccaggtctatggataccaagacgatctattctctattgggggattcaaaagtgcagggtgaaggagttttgtatttaccacatgctagtgagcaacgccaatactatgcaagcctggatgtaaatttacaagatctacccaagagaatctcacctgaatatgtcctcagcatcaattctagtcctggtgtgctagcacttgctatggacaaaagccacaatcctttgccttacatcgttccaggaggtcgtttcaacgaaatgtatggctgggatagctatttcgagctcttgggtcttctcgaaagcggggggcctgggtatattcacatcgccgagtcaatgtgcttgcatttttgctaccagatcaagaattatggcaagatactgaatgccaacagaagttactatctcagcagatcgcagcctccatttcttacagacatgggcctgagagtctactgtcgtactcgcaacaaggagtttctgaaagaaatctataactctgcagtcacagaatacaacacagtatggatgggaaacccgagactggacagacgtactggactatcgaagtattgcccagcagggttaggtattccacctgaagtggagacagggcacttcgacggagtccttggaccgtacgcgcagaagtatgggcttactttggatgaatttgttcaagcatacaactctggtaacatcgttcagccagaactagatgagtactttttgcatgatcgagcaattagagagtctggtcacgatacctcttacagattagaaggcgtctgtgctgacctcgctactgttgacctgaactcattgctatacaagtatgaagttgaccttgagtacattgagcgggagctgaatctcagcccatgcggattctatgaagctgcagagagacgaaaggaagcattcacgcaattcttgtggaactccgaagactcatgtttttacgactacaattgcaagaccaacgctcaaaggaagtacacctcgagcacgggtctgtggccactgtggtcgggaattgccactcgcgaacaagcgagggggatcgtgtctactatagcgtccctcgaagaatatggcggcctggcatccggctctaaggcatcattggatgagttttctggaggatcaggggttcctagacaatgggactaccctaatggatgggccccacaccaggttttggcatggcagggactgcaaaactatggatacgataacgtggcaactagactcgcattcaaatggtgtgctatgatggttcattcattcagagactactccgggttggtggtggagaaatacaacgttaccgatcctaccaaaccccatgttgtcacagctgagtatggaaatcagggatccgtagcctcaggctttggatgggtcaatgcttcctacgtagtgggactagggtacctgagcaatcagcaacgacaacgattagagtggggtgtgtggaagagacacgaaaagctgtaa

SEQ ID NO: 11647 - protein, 648 aa, Yarrowia lipolytica CLIB99
MTRSRSYSLPTPPQPRTPRRFSASSLILGGEKRFIASDHTVEQLLLLCDDEGHITIDTTTTSSDNFLQVETDAGWCYQVIGAYQLATVLNYLLLKRGGPETGLKRLKQNQKTIAPSSCVTHISSDKILEPPHQRLKNLVDNQFWHQLTRSMDTKTIYSLLGDSKVQGEGVLYLPHASEQRQYYASLDVNLQDLPKRISPEYVLSINSSPGVLALAMDKSHNPLPYIVPGGRFNEMYGWDSYFELLGLLESGGPGYIHIAESMCLHFCYQIKNYGKILNANRSYYLSRSQPPFLTDMGLRVYCRTRNKEFLKEIYNSAVTEYNTVWMGNPRLDRRTGLSKYCPAGLGIPPEVETGHFDGVLGPYAQKYGLTLDEFVQAYNSGNIVQPELDEYFLHDRAIRESGHDTSYRLEGVCADLATVDLNSLLYKYEVDLEYIERELNLSPCGFYEAAERRKEAFTQFLWNSEDSCFYDYNCKTNAQRKYTSSTGLWPLWSGIATREQARGIVSTIASLEEYGGLASGSKASLDEFSGGSGVPRQWDYPNGWAPHQVLAWQGLQNYGYDNVATRLAFKWCAMMVHSFRDYSGLVVEKYNVTDPTKPHVVTAEYGNQGSVASGFGWVNASYVVGLGYLSNQQRQRLEWGVWKRHEKL

SEQ ID NO: 11648 - DNA, 2298 bp, Candida glabrata CBS138
  CDS (1)..(2298)
atggatgaagggcctttgggcaagggtgctgtggccacaccagcaatggtcgagaaagtcgctaacgagagtccaaagaagacaagaccaaggagactgtcctcgctgaacgagttctatgaccctttctccacagcagaagtctattacggtcccgctaccgaccccaggaagcagaaaaagagctcgactaagctcaacaggacaagaaccatgagtgtcttcgacaacacttccatcgccaagaccactgccagcttcggccaattccaattgaaaagaaggggttccgaggacgacagtctaactgcaagtcaaggtaacagaaagttcttcatcgaggatgtcgacggcaccctggaagaacttctatccagcgaagacacagaccgtaattatcagatcacaatcgaagacaccggcccaaaagtgttgaaagtcggtaccgctaactctggaggttacaaacatgtcaacattagaggtacctacatgctttcgaaccttttacaagaacttacaattgcaaagagttttggtagacactccatcttcctggatgaagcaagaattaacgaaaacccagtgaacagattgtcaagattgatcaccaatcagttctggaataacttgactagaagaatagatttgaataacatcggagaaattgctagtgatactaaagttgacacaccagaggcaaagaaccctagagtctacgtcccatacaactgccctgaacaatacgaattttacattcaagcatcccagatgaacccttcgatgaaactcgaagtcgaatacttaccaaaagatataaccccggagtacgtaaagtcattgaatgcaacacctggtttgctggctctggcaatggaagaacacgtcaacccagcaactggtgaggtgtccctaattggttacccatatgcagttccaggtggtagattcaatgaactatatggttgggattcttacatgatggcactgggattattggaaagtaataaggtcgacgttgcccgtggtatggtagaacactttatcttcgaaattgaacattacggtaagatattgaatgctaacagaagttattatctgtgtagatcgcaaccaccatttttgactgatatggctttagtggtattcaacagaattggtggtgataataacccaaacgcaatcgatttcttaaagagatctttcaaagccgctatcaaggaatataaaacggtctggatggctcatccaagactagatccagaaaccggtctatcatgctatcatcctgatggtttaggtattccacctgaaacagaacctactcatttcgatagtatattaacgccatacgctgcaaagtactattgcacaattcctgagttcattgcgatgtacaacgatggctcagtaaaggaacctcatcttgacgagtttttcttacatgatcgtggtgttagagaatctggtcacgacaccacttatagattcgaaggtgtttgcgcatatctagctaccattgatctcaactcactgctttacaagtacgaggtcgatatcgctaatttcatagaaaaatatcataacgatgaataccatgatccatttgatggaacagttaccaattctgcttactggcgcgatctagcagctaaaagaaaggaaaatataactaaatatatgtgggacgaagagactggtttcttttatgactacaatatcaaagtgaagtgcaggactaactatgagtcagcaactacgttttggtctttatgggcaggattagcaactccggaacaagcaaaaaagatggttgaattagcattgccgaagcttgaaatgctaggtgggttggttgcttgtacagaagagtccagaggacctatttctattgatagacctcatagacagtgggattatccttttggttgggcaccacatcaaatacttgcttgggagggcttaaatgattacggttacacctctgttgcaacgagattggcatacagatggttatttatgatgaccaaagcatttgttgactataacggtattgtggtagagaagtatgatgttacacgaggcactgatcctcatcgtgttgatgctgaatatggtaatcaaggtgcagacttcaagggggttgctaaagaagggtttggctgggttaatactagttacatattagggttgaagttcatgaacagtcatgctagaagagcgttaggagcatgcattcccccagcaccattcttcaatagtttgaaagatgatgaaaagagcatatatggtctttaa

SEQ ID NO: 11649 - protein, 765 aa, Candida glabrata CBS138
MDEGPLGKGAVATPAMVEKVANESPKKTRPRRLSSLNEFYDPFSTAEVYYGPATDPRKQKKSSTKLNRTRTMSVFDNTSIAKTTASFGQFQLKRRGSEDDSLTASQGNRKFFIEDVDGTLEELLSSEDTDRNYQITIEDTGPKVLKVGTANSGGYKHVNIRGTYMLSNLLQELTIAKSFGRHSIFLDEARINENPVNRLSRLITNQFWNNLTRRIDLNNIGEIASDTKVDTPEAKNPRVYVPYNCPEQYEFYIQASQMNPSMKLEVEYLPKDITPEYVKSLNATPGLLALAMEEHVNPATGEVSLIGYPYAVPGGRFNELYGWDSYMMALGLLESNKVDVARGMVEHFIFEIEHYGKILNANRSYYLCRSQPPFLTDMALVVFNRIGGDNNPNAIDFLKRSFKAAIKEYKTVWMAHPRLDPETGLSCYHPDGLGIPPETEPTHFDSILTPYAAKYYCTIPEFIAMYNDGSVKEPHLDEFFLHDRGVRESGHDTTYRFEGVCAYLATIDLNSLLYKYEVDIANFIEKYHNDEYHDPFDGTVTNSAYWRDLAAKRKENITKYMWDEETGFFYDYNIKVKCRTNYESATTFWSLWAGLATPEQAKKMVELALPKLEMLGGLVACTEESRGPISIDRPHRQWDYPFGWAPHQILAWEGLNDYGYTSVATRLAYRWLFMMTKAFVDYNGIVVEKYDVTRGTDPHRVDAEYGNQGADFKGVAKEGFGWVNTSYILGLKFMNSHARRALGACIPPAPFFNSLKDDEKSIYGL

SEQ ID NO: 11650 - DNA, 2253 bp, Candida glabrata CBS138
  CDS (1)..(2253)
atgcctacgcttacattttatttaggtgcggatgacgctgtggatggcggggtgaagagcaaaagcatggccttcagcgaccccttccataagaacgtcaaggtacagtcacctgagccggagcctgtggacgcaaaggagaagaagaagctcaatagaaccagaactatgagtgtgttctacaacgtggctgacttcaaggatgacgaagagataaggaagcacaaactcaagagaagggcctcagaggatgacacttacatcagcagcaaaggtaccagaagactatttgtgaaggatgtcgactggactttgaaagagttgctgcaaaacgaggacacagaccagaatttccagattacagtagaggacacaggtcctaaagttatcaaactgggtactgccaactctgcgggttataaccacatcgacatacgagggacgtatatgttgtctaatttgctacaggagttgaccatcgcccataacttcggacagaggcaactgtacttgccagaatcaaggctaaacgaaaacccagtacaccgcctgaaaagggtaatagagactcacttctgggatgggctcaccaggcggctcgatttaaacaccattggtgaggccgcccaggagaaaaaaattgatactccagaggctaagaatccaagagtttatgtaccatatgactgtcccgagatgtatgaatacttcattcaggcttcccaaatgaatccctcagtaaagctagaagtagaatatttgccaaaagacattacacccgaatacgtacaatcactgaacgaaaccccaggcttactcgcaatcgctatggataagcatgtgaacccaaccacaggtgaaacttcattagttggattcccatatgtcttcccaggtggcagatttaatgaactttacggttgggattcttacttgataaccttgggacttctcgctagtaagcgcaccgatttagccagaggaatggtagagcatttcatattcgaaatagaacattatggcaagattttgaatgcaaacaggacctactatctgtgccgctctcaaccgcctttccttactgatatggctaatgttacatttaatggaatgggcggcaataagaatccaattgcagtagatttactaaggagggcctttagagccgcaattaaggagtataaaacggtatggatggcaaaaccaagattagacgaaaagacagggctatcgtgttaccaccctgatggtgttggtataccacccgagactgaaccagagcacttcgatacaaaactaaggccatacgcaaaaaaatacaatgtgacaattccagaatttagaagaatgtacaatgccaaagaggttcatgaaccagaattagatgaattcttccttcatgaccgaggtgtgcgtgaatccggtcacgatacgacatatcgactagaaggagtctgcgcctaccttgctacaatagatctaaattctttattatacaaatatgaggttgatattgcaaacttcattaaagaattttgcaatgacaagtatgtcgatccatatgataaaagtgtaactacctctgaagattggatgaatttggctaacaagcgcaaagaaaggataaagttttatatgtgggatgaagaggccggctttttctttgactataacgtgaagactgaaaagcgtacgtcttatgagtccgcaaccacattttgggctatgtgggcaggcgttgcaagccctcaggaggctgaaattatggtcaagaaggccgttccaaaactagaaacgttaggtggtattgttgcttgtacagaaagctcgagagggcctatagcaattgataggccatatagacaatgggattatccatttggttgggctcctcatcaaatattggcctggaaaggattttcgaactatgggtacgacaacattgctagacgcttagtgtacaggtggctttacatgatgactaaagcgtttgttgactataatgggattgtggtagagaaatatgatgttaccaaagtcactgatcctcataaaattacagctgaatatggaaatcaaggagttgatttcaaaggatatgccagagaaggatttggttgggtgaactcatcctttttacttggtctgcaatatctggataaccatgccataagagctctaggtgcctgtatacctccaaaacctttcttgaacggattacgtgcgaaagaaaaagcacgttatggcctataa

SEQ ID NO: 11651 - protein, 750 aa, Candida glabrata CBS138
MPTLTFYLGADDAVDGGVKSKSMAFSDPFHKNVKVQSPEPEPVDAKEKKKLNRTRTMSVFYNVADFKDDEEIRKHKLKRRASEDDTYISSKGTRRLFVKDVDWTLKELLQNEDTDQNFQITVEDTGPKVIKLGTANSAGYNHIDIRGTYMLSNLLQELTIAHNFGQRQLYLPESRLNENPVHRLKRVIETHFWDGLTRRLDLNTIGEAAQEKKIDTPEAKNPRVYVPYDCPEMYEYFIQASQMNPSVKLEVEYLPKDITPEYVQSLNETPGLLAIAMDKHVNPTTGETSLVGFPYVFPGGRFNELYGWDSYLITLGLLASKRTDLARGMVEHFIFEIEHYGKILNANRTYYLCRSQPPFLTDMANVTFNGMGGNKNPIAVDLLRRAFRAAIKEYKTVWMAKPRLDEKTGLSCYHPDGVGIPPETEPEHFDTKLRPYAKKYNVTIPEFRRMYNAKEVHEPELDEFFLHDRGVRESGHDTTYRLEGVCAYLATIDLNSLLYKYEVDIANFIKEFCNDKYVDPYDKSVTTSEDWMNLANKRKERIKFYMWDEEAGFFFDYNVKTEKRTSYESATTFWAMWAGVASPQEAEIMVKKAVPKLETLGGIVACTESSRGPIAIDRPYRQWDYPFGWAPHQILAWKGFSNYGYDNIARRLVYRWLYMMTKAFVDYNGIVVEKYDVTKVTDPHKITAEYGNQGVDFKGYAREGFGWVNSSFLLGLQYLDNHAIRALGACIPPKPFLNGLRAKEKARYGL

SEQ ID NO: 11652 - DNA, 2385 bp, Metarhizium anisopliae var
  CDS (42)..(2255)
ggccacctccacgttcgtcagtctgcgccctcgtcataaccatggcgggaacgacaaaccaccaagcgcatggctcggatgactacaatgtgtttgacgacgcaaagacatactatgcttctgaagagcgacatcagaaccgatttggctcccggacacgtacatactctcagaacagcttgatgaagcagtttgaacgaaacggcctgcgtgaaccacacagaagaggcagccacgacgagagttctctgccccaaggccgccgattcctcatccaagtcgaccctactctcgaaagcttgcaagcacaagaagataccgatggcaatatgcaaattaccatcgaggacgaaggccccaaagtgctctccttacgaaccgcagcttctgctggccacaatcgtttcgaagtccgaggcacatatatgctctccaatctactgcaggaattgaccttggcaaaagaatacgggcggaaacaaatcgttctcgatgagggtcggctaaatgagaacccagtggatcgtctgtcccgcctgatccgtgaccacttctgggatggcctgactagacgtatcgatgcatccagtatcgaaatagccgcgcgagaccccaaggattggacagatgatcctcgaccacgaatctacgtccctgctggagtgccggagcagtatgaatactacaagcaagttgccgaggagcggcctgagattcgtctagatgtccagcagctccctgaaaagatcacacccgagctgatccgggacatgaacgagaagcccggcctactggcggtcgaaaccgaacaggttgtggaccctgaaacgggtcgaaagacgctacggggcctcccgttcgtagtacctggaggaagattcaacgaattatacggctgggacagctacatggagtcacttggcctgttggtcaacgacagggttgacttggcaaagtcaatggtgctgaacttttgcttctgcattgaacactacggaaagatactcaatgctacccgctcgtactatcttggccgatcacagcctccattcttaaccgacatggcattgcgtgtgtacgagaaaatcaagcatgaaccagacgccaaggagttcctcagacggtcgatactagccgccataaaggagtaccacagtgtctggacatgtgagccccggcttgacccggtcactggtttgtcgagatatcggccagagggtcttggtgtgcctccggaaactgaggctggccattttgtgcacattcttgagccgtatgtcaagaagcacaatatggagttcaaggagtttgttcgcgcgtacaattatggcgagatcaaagagcctgaactggatgactattttatgcacgatcgagcagtgcgagagtctgggcatgacactacatatcgattcgaaggcatttgtgccgaccttgccacaattgatctcaactcacttttgttcaaatacgaaacagacattgcgcgcacaatccgcaatgtttttgacgacaagcttgtgatcccgggcgagttctgcgataggacgccatatcagccgggagaagtgctggcttctgcagcttgggatcgacgcgcgaagcgacgcaagctcactgtcgacaagctgatgtgggacgaagaacagggtgtcttttttgattacgacactgcaaagcgggagcgatgcaactacgaaagctcaaccacgttttgggctctgtgggcgggcattgctacgccgaagcaggcagccgacatggttaagaagggcttgccgcgatttgaagcgtacggcggtctgttggctggcactgagaagtctcgaggggatatcggactcgagcgtcccaaccgacaatgggactacccatacggctgggctcctcagcagatgcttgcttggactggtctgctccggtatagcttcacagaagaggccgagcgtctggcctacaagtggctgtttatgattaccaaggcgtttgttgatttcaacggtgtcgttgtggaaaagtatgacgtgacgcgaccagccgatcctcatcgtgtggatgccgagtatggtaaccaagggctggactttaaaggtgttgccaaagaagggtttggctgggttaatgccagttatgtgtatggtctgcagattgtaaatgcccatatgcgtcgcgccttgggtactctgacaccgtacccgacgtttatcaaggcaattgaactgagtttggagaaggaattggctgatttgccgtgaatagcggcatgaagcggctcaaggtggcgggtaaagagagcgtgaaatggcattgctacagcgtgtgtgtctgtgggttccatagtagttaccgattaattgccctctcaatgaaaaaaaaaaaaaaaaa

SEQ ID NO: 11653 - protein, 737 aa, Metarhizium anisopliae var
MAGTTNHQAHGSDDYNVFDDAKTYYASEERHQNRFGSRTRTYSQNSLMKQFERNGLREPHRRGSHDESSLPQGRRFLIQVDPTLESLQAQEDTDGNMQITIEDEGPKVLSLRTAASAGHNRFEVRGTYMLSNLLQELTLAKEYGRKQIVLDEGRLNENPVDRLSRLIRDHFWDGLTRRIDASSIEIAARDPKDWTDDPRPRIYVPAGVPEQYEYYKQVAEERPEIRLDVQQLPEKITPELIRDMNEKPGLLAVETEQVVDPETGRKTLRGLPFVVPGGRFNELYGWDSYMESLGLLVNDRVDLAKSMVLNFCFCIEHYGKILNATRSYYLGRSQPPFLTDMALRVYEKIKHEPDAKEFLRRSILAAIKEYHSVWTCEPRLDPVTGLSRYRPEGLGVPPETEAGHFVHILEPYVKKHNMEFKEFVRAYNYGEIKEPELDDYFMHDRAVRESGHDTTYRFEGICADLATIDLNSLLFKYETDIARTIRNVFDDKLVIPGEFCDRTPYQPGEVLASAAWDRRAKRRKLTVDKLMWDEEQGVFFDYDTAKRERCNYESSTTFWALWAGIATPKQAADMVKKGLPRFEAYGGLLAGTEKSRGDIGLERPNRQWDYPYGWAPQQMLAWTGLLRYSFTEEAERLAYKWLFMITKAFVDFNGVVVEKYDVTRPADPHRVDAEYGNQGLDFKGVAKEGFGWVNASYVYGLQIVNAHMRRALGTLTPYPTFIKAIELSLEKELADLP

SEQ ID NO: 11654 - DNA, 1752 bp, Anopheles gambiae str
  CDS (1)..(1752)
atgtccatgctaattgtcgttcttttttctaccctctcttccctgcacagtgaaatctactgccatggggagctgctcaagacggtgcagatgagcgagatctatcccgactcgaagacgttcgtcgacatgaagatgcgcaagtcgccgaacgagacgcttgactcgttccacgagtttatggtcgcgcaggacaacagcccgtcgaaggcgaagctgaaggagtgggtggaatcgaactttgagaagcccggggctgagtttgaaaactggacgccggacgactggaccgcaagcccgaaattcctcgcgcgcatcaaggacgaagatttgcgcggtttcgcctccgaactgaataagatctggcactcgctcggccgtaagatgacgtcggatgtggcgctcaatccggacctctactcgatcatccacgtggaccatccggtaatcgtgccgggtggacggttccgcgagttctactactgggactcgtactggatcgtcaaggggctgctgctgtccgagatgtacagcaccaccaagggcatgctggagaacttcctgtcgatcatccagcggtacgggttcatcccgaacgggggccgcatctactacagcatgcgctcgcagccgccgctgctgtgcggcatggtcaagtcgtacgtcgacgccaccaacgacaccaagttcgcgatggacagcgtggaaacgctcgagcgcgagttccagttcttcatgaacaactacgtgacggaggtgaacaaccaccagctggcgacgtacggctacaagtcgagcgggccgcgccccgaatcgtaccgcgaggacgtgctgagtgcggccatcttccagcgggaggaggacaagcaggactactactgcgagctgaaggcggccgccgaaagtgggatggacttttccagccgctggttcatcaaggacggcacgaacgcgggcaacctgaccgacctgaagtgccgctcgatcgtggcggtcgagctgaacgcgatcctgtattggaacgcgctgatcattgccgagttctacggctaccggaacgacattggctcgatcgcgaagaaggaagagtacctggccaaggcggacgagctgaagaaagcgatcaatgcggtgctgtgggacgagcaggaaggggcgtggttcgattacgatctgatcaacaagaagctgcgcaagtacttcacgccgaccaacctgtcgccgctctgggtcggctgctacgatcgggaggacaaggagctgccgaagcgcatcctggcgtacatcgaccggctgcagctcgaccgctatccgggcggtgtgccgaacacgctgcaaaacaccaacgagcagtgggacttcccgaacgtgtgggccccgatgcagcacatgctcgtaatggggctcgattcgctggagaatgcggaagcgaaggagctggccttcagctgggcccagcgctgggtccgggggaactacctaacctacaacaatacgcattccatgttcgaaaagtacgatgcgcaagagctcggtggacatggcagtggtggtgagtacgaagtccagaccggcttcggctggaccaacggtgccgcaatggatctgatgaacaagtacgccgacagactgacgacagtggatgctgcggaacaaccggaagacaatggaaacggtgcgctggtagcatactccatcaataccggcattattgccacactgttagcattcttcgttggagtcttcgggtga

SEQ ID NO: 11655 - protein, 583 aa, Anopheles gambiae str
MSMLIVVLFSTLSSLHSEIYCHGELLKTVQMSEIYPDSKTFVDMKMRKSPNETLDSFHEFMVAQDNSPSKAKLKEWVESNFEKPGAEFENWTPDDWTASPKFLARIKDEDLRGFASELNKIWHSLGRKMTSDVALNPDLYSIIHVDHPVIVPGGRFREFYYWDSYWIVKGLLLSEMYSTTKGMLENFLSIIQRYGFIPNGGRIYYSMRSQPPLLCGMVKSYVDATNDTKFAMDSVETLEREFQFFMNNYVTEVNNHQLATYGYKSSGPRPESYREDVLSAAIFQREEDKQDYYCELKAAAESGMDFSSRWFIKDGTNAGNLTDLKCRSIVAVELNAILYWNALIIAEFYGYRNDIGSIAKKEEYLAKADELKKAINAVLWDEQEGAWFDYDLINKKLRKYFTPTNLSPLWVGCYDREDKELPKRILAYIDRLQLDRYPGGVPNTLQNTNEQWDFPNVWAPMQHMLVMGLDSLENAEAKELAFSWAQRWVRGNYLTYNNTHSMFEKYDAQELGGHGSGGEYEVQTGFGWTNGAAMDLMNKYADRLTTVDAAEQPEDNGNGALVAYSINTGIIATLLAFFVGVFG

SEQ ID NO: 11656 - DNA, 1752 bp, Anopheles gambiae str
  CDS (1)..(1752)
atgtccgtgctaattgtcgttcttttttctaccctctcttccctgcacagtgaaatctactgccatggggagctgctcaagacggtgcagatgagcgagatctatcccgactcgaagacgttcgtcgacatgaagatgcgcaagtcgccgaacgagacgctcgactcgttccacgaatttatggtcgcgcaggacaacagcccgtcgaaggcgaagctgaaggagtgggtggaattgaactttgagaagcccggggccgagtttgaaaactggacgccggacgactggaccgccagcccgaaattcctcgcgcgcatcaaggacgaagatttgcgcggtttcgcctccgaactgaataagatctggcactcgctcggccgtaagatgacgtcggatgtggcgctcaatccggacctctactcgatcatccatgtggaccatccggtaattgtgccgggtgggcggttccgcgagttctactactgggactcgtactggatcgtcaaggggctgctgctgtccgagatgtacagcaccaccaagggcatgctggagaacttcctgtcgatcatccagcggtacgggttcatcccgaacgggggccgcatctactatagcatgcgctcgcagccaccgctgctgtgcggcatggtcaagtcgtacgtcgacgccaccaacgacaccaagttcgcgatggacagcgtggaaacgctcgagcgcgagttccagttcttcatgaacaactacgtgacggaggtgaacaaccaccagctggcgacgtacggctacaagtcgagcgggccgcgccccgaatcgtaccgcgaggacgtgctgagtgcggccatcttccagcgggaggaggacaagcaggactactactgcgagctgaaggcggccgctgaaagtgggatggacttttccagccgctggttcatcaaggacggcacgaacgcgggcaacctgaccgacctgaagtgccgctcgatcgtggcggtcgagctgaacgcgatcctgtactggaacgcgctgatcattgccgagttctacggctaccggaacgacattggctcgatcgcgaagaaggaagagtacctggccaaggcggacgagctgaagaaagcgatcaatgcggtgctgtgggatgaggcggaaggggcctggttcgattacgatctgatcaacaagaagctgcgcaagtacttcacgccgaccaacctatcgccgctctgggtcggctgctacgatcgggaggataaggagctgccgaagcgcatcctggcgtacatcgaccggctgcagctcgaccgctatccgggcggcgtgccgaacacgctgcaaaacacgaacgagcagtgggacttcccgaacgtgtgggccccgatgcagcacatgctcgtgatggggctcgactcgctggacaatgcggaagcgaaggagctggccttcagctgggcccagcgctgggtccgggggaactacctgaccttcaacaaaacgcattccatgttcgaaaagtacgatgcgcaagagctcggtggacatggcagtggtggtgagtacgaagtccagaccggcttcggctggaccaacggtgccgcaatggatctgatgaacaagtacgccgacagactgacgacagtggatgctgcggaacaaccggaagacaatggaaacggtgcgctggtagcatactccatcaataccggcattattgccacactgttagcattcttcgttggagtcttcgggtga

SEQ ID NO: 11657 - protein, 583 aa, Anopheles gambiae str
MSVLIVVLFSTLSSLHSEIYCHGELLKTVQMSEIYPDSKTFVDMKMRKSPNETLDSFHEFMVAQDNSPSKAKLKEWVELNFEKPGAEFENWTPDDWTASPKFLARIKDEDLRGFASELNKIWHSLGRKMTSDVALNPDLYSIIHVDHPVIVPGGRFREFYYWDSYWIVKGLLLSEMYSTTKGMLENFLSIIQRYGFIPNGGRIYYSMRSQPPLLCGMVKSYVDATNDTKFAMDSVETLEREFQFFMNNYVTEVNNHQLATYGYKSSGPRPESYREDVLSAAIFQREEDKQDYYCELKAAAESGMDFSSRWFIKDGTNAGNLTDLKCRSIVAVELNAILYWNALIIAEFYGYRNDIGSIAKKEEYLAKADELKKAINAVLWDEAEGAWFDYDLINKKLRKYFTPTNLSPLWVGCYDREDKELPKRILAYIDRLQLDRYPGGVPNTLQNTNEQWDFPNVWAPMQHMLVMGLDSLDNAEAKELAFSWAQRWVRGNYLTFNKTHSMFEKYDAQELGGHGSGGEYEVQTGFGWTNGAAMDLMNKYADRLTTVDAAEQPEDNGNGALVAYSINTGIIATLLAFFVGVFG

SEQ ID NO: 11658 - DNA, 2079 bp, Neurospora crassa
  CDS (1)..(2079)
atggtatcacgattccttggggcaactgtgcccctggctgctgctattctgcctggagcccgcgcgctgtatgtcaatggctcagtaacggctccatgcgactcgccaatctattgctatggcgagcttctacaccaggtcgagctagctcgtccattctccgattcaaagaccttcgtcgatatgcccaccatcaaacccgtggatgaggtgcttgaagctttcagcaagctaaccctcccattgagcaacaactcggagctccacgaattcctcagcacctatttcggacccgctggtggcgagcttgaagcagtaccaaccgaccagctccatgtatcgccgacatttcttgacaatgtcagtgacgatgtgatcaagcaatttgtcgattcggttatcaacatctggccagacctcaccaggaaatacgtgggcgcgggcgaattatgcacgggatgcgctgacagcttcatccccgtcaaccgtaccttcgtcgtggctggtggccgcttccgtgaaccctactactgggactcgttctggattctcgaaggtcttctgcgcacggggggtgccttcaccgagatctcgaagaacattattgagaacttccttgacttggtggagcagatcggatttgttcccaacggagcaagactctactaccttgaccgctcgcagcctccactcctgacgcagatggtcaggatctatgttgaacacaccaacgatacaagcatcctcgagagagcggtgccagttctgaagaaggaatgggagtggtggacgaccaaccgcacggtcgaagtcactgcggatggaaagacatactctctccagagataccacgtcgacaacaaccaaccccgtcccgagtcttaccgtgaagattacattaccgctaacaacaactcttattatgctacctctggtatcatttacccagagacaactcctcttaatgacacccagaaagcgctgctctacgcaaacctcgccagtggcgccgagtcaggatgggactacagttctagatggctgaagaaccctggcgacgctgcccgcgacgtgtacttccctctccgctcgctcaatgtcctcgagattgtccctgttgacctcaactcgatactttaccagaatgaggtcaccatcggcaagtttctcgctcagcagggcagcaaggacgaagctgaggagtgggccaagaaagccgaagagcgcagcgaagccatgtacaagctcatgtggaactcgacgctgtggagctactttgattataacttaacatcgtcctcccaaaatatctatgtgcccgccgaccctcaagtcttccccttcgaacagcccagcggcacccccgagggctaccaggttctcttctctgtcaaccagatgttccccttctggactggtgctgccccagaccagctcaaaggcaacccattggctgtcaagcttgcctttgaacggatcaagaacttgctcgacaacaaggccggtggcattcctgctaccaactttgtcactggccaacagtgggacgagcctaacgtatggccacccctcatgcatgtcctcatggacggcctcctcaacaccccggccaccttcggcgaggatgacccggcgtatcaggagacacagactctggccctccgtcttgctcagcgttacgtcgactcgaccttctgtacctggtacgccaccggcgggtctacatcggagacgccgaagctgcaaggtctcggttccgacctcaagggcatcatgttcgagaagtactctgacaactcgaccaacgtcgctggtagcggaggcgagtacgaggtcgtggaaggcttcggctggaccaatggcgtgctgatttgggccgcggacaagtttggtgataagctcaagaggccagattgtggtgatattacccctgcgcaagtgggcaagagggccgacatcactatggagaagagggcggttgagctggatgtctttgatgccaagttcacaaagaagttcgccaggaaggggaagcttgagaagctgaaggccaagttcaagaggcgcgccgctatctag

SEQ ID NO: 11659 - protein, 692 aa, Neurospora crassa
MVSRFLGATVPLAAAILPGARALYVNGSVTAPCDSPIYCYGELLHQVELARPFSDSKTFVDMPTIKPVDEVLEAFSKLTLPLSNNSELHEFLSTYFGPAGGELEAVPTDQLHVSPTFLDNVSDDVIKQFVDSVINIWPDLTRKYVGAGELCTGCADSFIPVNRTFVVAGGRFREPYYWDSFWILEGLLRTGGAFTEISKNIIENFLDLVEQIGFVPNGARLYYLDRSQPPLLTQMVRIYVEHTNDTSILERAVPVLKKEWEWWTTNRTVEVTADGKTYSLQRYHVDNNQPRPESYREDYITANNNSYYATSGIIYPETTPLNDTQKALLYANLASGAESGWDYSSRWLKNPGDAARDVYFPLRSLNVLEIVPVDLNSILYQNEVTIGKFLAQQGSKDEAEEWAKKAEERSEAMYKLMWNSTLWSYFDYNLTSSSQNIYVPADPQVFPFEQPSGTPEGYQVLFSVNQMFPFWTGAAPDQLKGNPLAVKLAFERIKNLLDNKAGGIPATNFVTGQQWDEPNVWPPLMHVLMDGLLNTPATFGEDDPAYQETQTLALRLAQRYVDSTFCTWYATGGSTSETPKLQGLGSDLKGIMFEKYSDNSTNVAGSGGEYEVVEGFGWTNGVLIWAADKFGDKLKRPDCGDITPAQVGKRADITMEKRAVELDVFDAKFTKKFARKGKLEKLKAKFKRRAAI

SEQ ID NO: 11660 - DNA, 3036 bp, Drosophila melanogaster
  CDS (661)..(2208)
cagtcggttttctttcgtctcgccggttggtcgcacttttttttacatttatatcgaaacaacgtgcatgcgcagaaatccccacgaagatttgatttagtggaccttgatgcgacagttatcctgccagcgtatatctcgccgatataggtgtatattacaatccggtcgctttttgcgctgctgttatccaagtttctgatgtgagcagcagagctgaaaagcgcgaaattcgctgagcgaaaactatttaacaaccgtaagttgcacggtcgtgattagtctcgtggcgctgctcgaaggcaaaagaagcaaccaggcgttacggtggatcgaaattcgaataataatacggcagtgatcaaatcgagtgataaatgcaaacaacgcatattgacgtgataaacaagtggcaagaataaacaaaacattttggtcaaattgaaatcttcgcttcgcgcccgcaaccttgcgagaatctcaacatattttgcgacatcaggaaacaacagtctttgtcgcaatatggcctctccagcgaatccatcgagcaatcacaaaatgaacggaaatggtaaaatctactgcgagggcaatctgctgcacaccatccaaacggcagtgcccaaactatttgcggattcgaaaacgtttgtggacatgaagctgaacaattcgcccgacaagaccctcgaggactttaatgccatgatggaggccaagaatcagacgccaagcagtgaggatctcaagcagtttgtcgataagtacttcagtgcaccgggcaccgagcttgagaaatggacgcccaccgactggaaggagaatcccagtttcctcgacctgatctccgacccagatctgaagcaatggggcgtcgagctgaatagcatttggaaggacttgggacgcaaaatgaaggacgaggtgtcaaagaatcccgaatactactcaatcattcccgtgccaaatccagtgatcgtgcccggcggtcgtttcattgagttctactactgggactcctactggatcatccgtggacttctctacagccagatgtttgacaccgcgcgcggcatgattgagaacttcttttccattgtcaatcggttcggttttattccaaacggcggtcgagtctactaccacggtcgctcccagccgccacttctaaccggtatggtcaagtcgtacgtggacttcaccaacgatgacaagttcgccatcgatgccctggacacgctggagcacgagttcgagttctttgtgaacaaccacaatgtcacggtgaagaatcacagcctgtgtgtgtaccgcgattcgtcgtccggaccgcgaccagaatcctaccgagaggatgtggagaccggcgaggagttccccacggatgaggccaaggaactgcattacagtgaactcaaggcaggcgccgaatcgggcatggactttagctcgcgctggttcatctcaccgactggaaccaatgatggcaaccggagcgctctgagcaccacctccattgtgcccgtcgacctgaatgcctatctctactggaacgccaagttgattgccgagttccattccaaagcgggcaacaccaaaaaggtcaccgaatacgagaccaaggccgagaaactccttctgggtatccaagaagttttgtggaacgaggaggccggtgtctggttggactacgatatgattaaccagaagcctcgcgattactacacgcccaccaatctatctccactgtgggtgaaggccttcaacatttcggagtccgaaaagatatcggcttcggttatggcctacattgagaggaacaagctggacagcttccctggcggagttcccaacacgctgagctacaccggagaacagtgggatgcccccaatgtgtgggcaccgatgcagtacatcctggtcgagggcctaaacaacctgaacactcccgaggccaagaatatgtcactgaagtgggccaccaggtgggtgaagacaaactttgcggcgtttagcaaggacaggcacatgtacgagaagtacaacgccgatgagttcggagttggaggcggcggtggcgagtacgaggtacagactggattcggttggtccaacggtgtgatcatcgagtggctgagcaagcacgggcgcgacatttccattggatccggttgtggctgcctagcaggtgaaaagcggcagtagaaagaatctgtagccaggccagaacgcaatccatcagacatcattgtcagcatcatcacaggctcgaagccaaagcttattcaaaaaattgtatttagatatttgtatattattaaggctccaatcagaagcgctcatcaactgctcatccttaggctaagaaaatgctgtctctctcgctctgcgcaatctttatacctttaaaagccgctgtctataaccaatatctgtaccgcgaaccatcgacatctcgagccaagcaccacgaaccacagcaccacagttacagcaccgccaggaatcaagatctgaagtccgccatccgtcgagcatctgtgtactgtctgttgtccatgtagtaaaccacgtccagtccacgtttgcacactcgtgtgacttgtccaaattcaagaaataagaacgcaaagaacgctatctatcaagttgaggattcacgagtaatcgtatgatgggcatcgtgggcgtggcagctgtcactatagttgctctgatagcaggtcgtgttctatggtgagacaatgtgtgccaaaacaagacgtaattgctactcaagtagtgtgattcccccctccgtgtttgtgcgtgtgttgtgaagtctgtagttgctaacgtttttcgttgagtgcggagattgcagtattagtttatcattatttggtagttgaagtgagagttgtatatactgaatttatatgggcatgcccgaaattgttattacgttttaatatttagcaaatacctataccaatcctagctcctcgcaaccaaatgaagacacaaatacaattgttaacaataatttacaaa

SEQ ID NO: 11661 - protein, 515 aa, Drosophila melanogaster
MKLNNSPDKTLEDFNAMMEAKNQTPSSEDLKQFVDKYFSAPGTELEKWTPTDWKENPSFLDLISDPDLKQWGVELNSIWKDLGRKMKDEVSKNPEYYSIIPVPNPVIVPGGRFIEFYYWDSYWIIRGLLYSQMFDTARGMIENFFSIVNRFGFIPNGGRVYYHGRSQPPLLTGMVKSYVDFTNDDKFAIDALDTLEHEFEFFVNNHNVTVKNHSLCVYRDSSSGPRPESYREDVETGEEFPTDEAKELHYSELKAGAESGMDFSSRWFISPTGTNDGNRSALSTTSIVPVDLNAYLYWNAKLIAEFHSKAGNTKKVTEYETKAEKLLLGIQEVLWNEEAGVWLDYDMINQKPRDYYTPTNLSPLWVKAFNISESEKISASVMAYIERNKLDSFPGGVPNTLSYTGEQWDAPNVWAPMQYILVEGLNNLNTPEAKNMSLKWATRWVKTNFAAFSKDRHMYEKYNADEFGVGGGGGEYEVQTGFGWSNGVIIEWLSKHGRDISIGSGCGCLAGEKRQ

SEQ ID NO: 11662 - DNA, 1632 bp, Coxiella burnetii
  CDS (1)..(1632)
atgccctaccctttaccgtttcctaaaaccagggaatcaaggcctccaggacgacctccggtaaaacgataccctcaaattgaagggccgctgtttatcgtctcgcaatctcagcaagttttctctgattctaaaacctgggttgactgtattccgcgaatttcaccggctgaaattttatgccgttttcaacaagagagaacagcaccacactttaatttaattcattttatttcacagcattttgaagtgcccaacccggtggaacgtttacttgcttttgatccctctcatacaatggaaacttatattcagtcgctttggcctctgttaacctataacgccgacagtgctcagccggattattcttcgctaattccgttaccccacccctacgtcatccccggtgggcgttttcgagaaatttattattgggatagttatttcactgctgaaggacttgcctgttctgatcagctcgacctcgtgatcaatatggcaaaaaatttagcccatttaatagaaactattggtcatatccctaacggcaataggatttattatcgtagccgctcgcagccttctttctttggttgcctcattgagattatcgcgcaacatcaaggagtcgatgctataaaacccttcgtgagagcactggaaaaagaataccggttttggatggcgggagaagatcgactaacaccacaaagtcccgctcatcgacgcgtggtgctgctagacgatcagtgtgttttaaatcgctattgggataatttatcgctgccgcgtccggaatcttatcgagaagacgtgttgctttataagcaagctgcgcctttagagaaacggcatttgtatcgaaatattcgcgccgcatgcgaatcgggatgggatttctcatcgcgatggatgagagataaagagagattaacatcgatttataccaccgagcttgttccggtagatcttaatgccatactttatcacatggaaataaaactggccgattatttcgagcattttagtaatcgacgcaaagccgaattttttcaacgccgagctgaacggcgaaaacaagccattgtgcaatactgttgggacaccgataaacaattttattttgattattgttggacagaaaaagaaaaaacggcttcgttcactttagcagccgctttcccgttattttttaaattagcttcttcatttcaagcagcggcggttactgataaattaataaaagattttttttatcccggcggtttagtcactactttagatgaaagcgcccaacaatgggataaacccaatggctgggcgccgctgcattggattgctattaaagggcttcttaattacggttatgaaaccgaagccaaaataattaccgaacgttggcttgcccttaatcgtcaggtgtttcagcgcacaggaaaaatgatggaaaaatacaatgtgtgtgaccctcaccttaaagccggtggcggcgaatatccactccaagacggtttcgggtggacaaacggaatcgctgtcgccttaaatgcccttttttcccaacgttggggagagcatttgtttacgggctttgaaatacatcaggaaaggcgggagactcatcactattaa

SEQ ID NO: 11663 - protein, 543 aa, Coxiella burnetii
MPYPLPFPKTRESRPPGRPPVKRYPQIEGPLFIVSQSQQVFSDSKTWVDCIPRISPAEILCRFQQERTAPHFNLIHFISQHFEVPNPVERLLAFDPSHTMETYIQSLWPLLTYNADSAQPDYSSLIPLPHPYVIPGGRFREIYYWDSYFTAEGLACSDQLDLVINMAKNLAHLIETIGHIPNGNRIYYRSRSQPSFFGCLIEIIAQHQGVDAIKPFVRALEKEYRFWMAGEDRLTPQSPAHRRVVLLDDQCVLNRYWDNLSLPRPESYREDVLLYKQAAPLEKRHLYRNIRAACESGWDFSSRWMRDKERLTSIYTTELVPVDLNAILYHMEIKLADYFEHFSNRRKAEFFQRRAERRKQAIVQYCWDTDKQFYFDYCWTEKEKTASFTLAAAFPLFFKLASSFQAAAVTDKLIKDFFYPGGLVTTLDESAQQWDKPNGWAPLHWIAIKGLLNYGYETEAKIITERWLALNRQVFQRTGKMMEKYNVCDPHLKAGGGEYPLQDGFGWTNGIAVALNALFSQRWGEHLFTGFEIHQERRETHHY

SEQ ID NO: 11664 - DNA, 2211 bp, Magnaporthe grisea
  CDS (1)..(2211)
atgagcgaagctcctcaggcccgtcgggtagggtctgtagacgaccacagcgtctacgatgatgcaaagacgtactatacatccgaggagcggcacaacaactcgaggagcggtcctaggcagaggacgtactcgcagaacagcttgcttggtcagatggagcgattgggcctgaaggaaccattccggagaggcagtcatgacgagtccaaccacaatagacgtttcctcatccaggtcgaccccacccttgaaagcctgaaatcccaagaggataccgatgggaatatgcaaatcaccatcgaggacaacgggcccaaggttcttacgcttcgcactgcagggtccaacggccacaacagatttgacattcgtggcacttacatgctttcgaacctcctccaagagctgacgctggcacaagaatatggacgcaaacaagtcattcttgatgaggcacgtctgaacgaaaacccggtcaatcgtctgtccagattgattcgggaccacttctgggatgctcttactcgtcgcatcgatgcatctagcattgaggtagcagccaaggatcccaaagactggaccgacgaccctcggccccgcatttacgtgccaaagggggcacctgagcagcttgagtactacaaaaagttggctgcggataagcccgatatacgcctggatgtcgttgagcttcccgagactattactcccgagtatgtcgtcggcatcaacaaagccccgggtcttcttgccgtggacatggaagagactgtggaccccaagaccggggagagggtcatgagcggtcgtccattcgtcgttcctggcggtcgcttcaacgagctgtacggctgggacagctacatggagtctctcggtctccttgttaacgacaaggtctacctggccaagtccatggtcttgaacttctgcttctgtatcaagcactatggaaaaatcttgaacgccactaggtcttactacctttgccgatcccagccgccattcctcactgacatggctctgcgcgtctacgacaagattcgacacgagcctgacgcaaccgagtttcttcggaccgccatccttgctgcaatcaaggagtaccacagtgtttgggtggccgagccccgcttggacccagtcactggcctctcacgatataggcccgagggaaccggcgtgccgccggagaccgaagctgaccacttcttgcacatcttggagccttactacaagaaacacaacatgaccttcaaggagtttgtcgaagcgtacaactttggtcgcatccgagaaccggagctggacaagtacttcctgcacgaccgggccgtgcgagagtctggccacgatacttcataccgtctggagggtgtatgtgcagaccttgcgaccgttgatctcaacaccttgctgttcaagtacgaaacagacattgcgcgtaccattcgcaacgtgtttggagacaagctcgtcatcccagccgagtactgcgtcggttccctccagccaggtcaggttgagacgtcggcaatttgggaccgacgatctaagcggagaaagctcgccattgacaagtatctgtggaacgaggaggcgggtatgtacttcgactatgacactgccaagcgccagcagtgcaactacgagagctgcacgaccttttgggcgctgtgggctggcgttgcaagccccaagcaagcggctattatggtcacgcgggcactccccaagttcgaggcatacggaggtttgctttcaggcacagaggaatcaaggggccagataggactggatcgcccaaaccgtcaatgggactacccctatggctgggcgccacagcagatgcttgcctggacgggcctgtatcgctacagcttcaccgaggaggctgaaaggctggcatacaagtggcttttcatgatcaccaaagcctttagcgacttcaacggcgtcgtggtagagaagtatgacgtaacgcgccctgtggacccgcaccgcgtcgatgcggagtatggaaaccagggtcttgggttcaagggagttgcgaaggaaggattcggctgggtcaacgccagttacatctacggacttcagatcatcaatgcccacatgcgccgcgcgttggggaccctcacgccgtacgacaccttcatcaaggcacttgaggataatcgtaaccgcgctctgtcagagatggtctga

SEQ ID NO: 11665 - protein, 736 aa, Magnaporthe grisea
MSEAPQARRVGSVDDHSVYDDAKTYYTSEERHNNSRSGPRQRTYSQNSLLGQMERLGLKEPFRRGSHDESNHNRRFLIQVDPTLESLKSQEDTDGNMQITIEDNGPKVLTLRTAGSNGHNRFDIRGTYMLSNLLQELTLAQEYGRKQVILDEARLNENPVNRLSRLIRDHFWDALTRRIDASSIEVAAKDPKDWTDDPRPRIYVPKGAPEQLEYYKKLAADKPDIRLDVVELPETITPEYVVGINKAPGLLAVDMEETVDPKTGERVMSGRPFVVPGGRFNELYGWDSYMESLGLLVNDKVYLAKSMVLNFCFCIKHYGKILNATRSYYLCRSQPPFLTDMALRVYDKIRHEPDATEFLRTAILAAIKEYHSVWVAEPRLDPVTGLSRYRPEGTGVPPETEADHFLHILEPYYKKHNMTFKEFVEAYNFGRIREPELDKYFLHDRAVRESGHDTSYRLEGVCADLATVDLNTLLFKYETDIARTIRNVFGDKLVIPAEYCVGSLQPGQVETSAIWDRRSKRRKLAIDKYLWNEEAGMYFDYDTAKRQQCNYESCTTFWALWAGVASPKQAAIMVTRALPKFEAYGGLLSGTEESRGQIGLDRPNRQWDYPYGWAPQQMLAWTGLYRYSFTEEAERLAYKWLFMITKAFSDFNGVVVEKYDVTRPVDPHRVDAEYGNQGLGFKGVAKEGFGWVNASYIYGLQIINAHMRRALGTLTPYDTFIKALEDNRNRALSEMV

SEQ ID NO: 11666 - DNA, 2097 bp, Magnaporthe grisea
  CDS (1)..(2097)
atgtctcctctgtggaagacggcagcagcaattgctgttgctgcctctggatccttggtcaatgctgtgtacatcaacgggtccatcataacgccatgtgactcgctcatttactgccgcggcgagctgctcaaggaggtggaactggctcatccttttgccgactccaagacgtttgtggacatgcccacgatcaagccggtggacgaggttattgaagccttcaacaagctccagaagcctctcagtaacaacacggagcttcaggacttcctacgcgagaatttcgctcaggctggtggtgagcttgaggaggtacccaactcggaactggagacggatcctgtctttttggacaaactcgacgacacggtcatccgcgagttcgtggaaaaggtcatcgatatatggccctccctcaccagacgctacaagggcccctccaactgcgaagcttgcgccgacagcttcatccccgtcaaccgcacgttcgtcgtcgctggcggtcgattccgagagccttactattgggactcgtactggatcctcgagggtctgttgagaaccggtggcgctttcaccaacatctccaagaacaccgtggagaactttttggatcttgtagaaaccattggttttgtgcccaatggtgccaggatctactacaagaaccgttcccagccccccttgctttcccagatggttcgcatctatgtggagcataccaatgacacttccatcctgggccgtgccgtcccgctcctcatcaaagagcatgagttcttcatcaacaaccgctccatcgacgtcgaagcatccaatggcaagacatatagactgcaaagatacgccgtgacaaacacacagccccgacccgaatcttaccgagaggactacattacagccagcaataggtcctactactcaccgtcaggcattatctacccagagtctcaccagcttaacgagtccgagaaggcggttctctactctcatctcgccagtggagccgagtccggttgggactacacctcgagatggttgtcgacacccagtgatgctgttcgcgacaattacttccctctccgatcgcttaacaccaacaacatcgtgcccgttgatctcaactctatcctgtacgccaacgaggtcgcaatcgcagagttcttgaacagaactggcaacagcacaggagcttcggattggatggatcttgccaaacagcggagcgaagccatgtacgcgctgatgtggaacgagacactatggagctactttgactacaacatgacctccaagacccagaacaggttcattcctgtcgacgaggatgccgtatcgatcgagacgaacaacgccccagccggccaacaggtgtttttccacgtagcgcagtactatccgttctggaccggcgcggcgccccgtagccttaagaacaacccgctggcggtcctcagggcatacgaacgtatcgatgcataccttgacatcaagcgcggcgccataccggccaccaacctcaagactggccagcagtgggacgagcctaacgtgtggccgccgctaatgcatatcctgatggagggcctgaccagggtccccgcaacgtttggagaggacgacgtggcctggactgagatccaggacctcgcactaaggctgggtcagaggtaccttgactcaacgttctgcacttggtacgccacgggcgggtcgacgagcgagacaccgcagttgcaagggctcaatgcggaggacaagggtatcatgtttgagaagtacggcgataactcaaccaatgtcgccggttcgggaggcgaatacgaagtggtcgagggtttcgggtggacaaacggagtgctcatgtgggttgccgacaccttcaacaacaagctgacgaggccagactgcggcaacatcacggccgccaatgtgcactcggacggctcccaggcgaggaagaggggtgagatgtggagcgctctcgagatgcatccatacgacgcggcgtggaccaaggagtttggggcgaggaaggtcaggagggataaggctgaggcaagggcgttggggaacgtcatgggaggtgtttag

SEQ ID NO: 11667 - protein, 698 aa, Magnaporthe grisea
MSPLWKTAAAIAVAASGSLVNAVYINGSIITPCDSLIYCRGELLKEVELAHPFADSKTFVDMPTIKPVDEVIEAFNKLQKPLSNNTELQDFLRENFAQAGGELEEVPNSELETDPVFLDKLDDTVIREFVEKVIDIWPSLTRRYKGPSNCEACADSFIPVNRTFVVAGGRFREPYYWDSYWILEGLLRTGGAFTNISKNTVENFLDLVETIGFVPNGARIYYKNRSQPPLLSQMVRIYVEHTNDTSILGRAVPLLIKEHEFFINNRSIDVEASNGKTYRLQRYAVTNTQPRPESYREDYITASNRSYYSPSGIIYPESHQLNESEKAVLYSHLASGAESGWDYTSRWLSTPSDAVRDNYFPLRSLNTNNIVPVDLNSILYANEVAIAEFLNRTGNSTGASDWMDLAKQRSEAMYALMWNETLWSYFDYNMTSKTQNRFIPVDEDAVSIETNNAPAGQQVFFHVAQYYPFWTGAAPRSLKNNPLAVLRAYERIDAYLDIKRGAIPATNLKTGQQWDEPNVWPPLMHILMEGLTRVPATFGEDDVAWTEIQDLALRLGQRYLDSTFCTWYATGGSTSETPQLQGLNAEDKGIMFEKYGDNSTNVAGSGGEYEVVEGFGWTNGVLMWVADTFNNKLTRPDCGNITAANVHSDGSQARKRGEMWSALEMHPYDAAWTKEFGARKVRRDKAEARALGNVMGGV

SEQ ID NO: 11668 - DNA, 1920 bp, Pimpla hypochondriaca
  CDS (1)..(1758)
atggcgaaaacgacacccatggctaagccttcggtgggcctgttgaccctccaagtgttggttttttgcgcgttgaccggaagtctcgcgagcgctggcagcatcggccacgtcacacctcgatcggatctctgtgacagcgaggtctactgccagggcgaactactcaagaccatccagctgggcgaagttttcaaagatggaaaaacgttcgtcgatcattaccaagtgaacgatccatcagtcaccgttgccaacttccgaaaattgatggcggagaccggtggaaagccgaataaagatcagttgacgcagtacgtgaaggagaattttgcccaggagaacgaggtgatcgattggtcgccgccggattggcaagagaatccggaattccttcagcgcgtccaagatccggtattcaggaagtgggcgaaggacctgaacgacgtgtggaaaattatctcgaggaaggtggcgccgtccgtcgccgaacaccccgagaggcacagcataatatccgtcgacaatggattcatcgtgccgggcggcagattccaagaattctactactgggacagttactgggtcatggagggtcttctgctgaccggaatgaaaaacacgtccagaggaatcttggaaaatttcctgtcgatggtgacgcgcttcggtttcataccgaacggcggtcgcgtttactacctcatgaggagtcagccacctctgctcatccccatggtcgatctctatcttacgcacacgggtgacatgcaattcttgagggacaacatagggacgctggaaaaggaacttggttacttcttaagccagaaaacggtggacgtaaccaagaacggcaaaacttataaaatggcgcgttacattgtgagcagcaatgggccacgtcctgaaagttaccgtgaggactatgaactggcaaaaaatatcaacgacgaggccgaaaaacgtcgattctacgaggatttaaaagcggcggccgaaagcggttgggacttctcgtcgcgttggtacatttcggagaacgggacgagaggcagcctatccaatatcgctaccagaaacatcatacccgttgaactgaacgcgttcctgcaaagaaacgcccggatgctcgcgcagttccatactacccttggaaaccccacgaaagcaaagtactacaaggacatagcgacttcctatcagcaggcgatagacgacgtcttgtggagcgagtcggagggcgtctggctcgacttcgacctgcggaattcccagcatcgaaactacttcttccccaccaacgtggctccgctctacacgcagagtttcgactccagcaaggcgcagatctacggacagagggcagccgcttatctgacgaggaatggaatcctggactatatgggcggcacaccagcctcgctattccccaccggtgagcaatgggatctgccgaacgcgtggccacctctgcaatcgatcatcgttcaggccctcagaaattcgaacgaggagtccgccgagaaactggccaaggagctcgcgatccggtggctcagggcgaatcacaagggttacagtcagtctgggcaaatgttcgagaagtacgacgccctaaaccctggcaaattcggcggtggcggtgaatatgtagtgcaggagggcttcgggtggaccaacggtgtggtttatgaatttttgaacagctatcccaatgctacccccgacgataacgtccatatgaataacaactaggcggcttgaattccctgcgggattaaattgtggtgagtgaaatgattttttgtgtcgagttatcgtcgatgcgtttagtctgtaatgtaaataaaccagtattgtaagtccccattattttaagaattaaactttacacagtttaaaaaaaaaaaaaaaaaa

SEQ ID NO: 11669 - protein, 585 aa, Pimpla hypochondriaca
MAKTTPMAKPSVGLLTLQVLVFCALTGSLASAGSIGHVTPRSDLCDSEVYCQGELLKTIQLGEVFKDGKTFVDHYQVNDPSVTVANFRKLMAETGGKPNKDQLTQYVKENFAQENEVIDWSPPDWQENPEFLQRVQDPVFRKWAKDLNDVWKIISRKVAPSVAEHPERHSIISVDNGFIVPGGRFQEFYYWDSYWVMEGLLLTGMKNTSRGILENFLSMVTRFGFIPNGGRVYYLMRSQPPLLIPMVDLYLTHTGDMQFLRDNIGTLEKELGYFLSQKTVDVTKNGKTYKMARYIVSSNGPRPESYREDYELAKNINDEAEKRRFYEDLKAAAESGWDFSSRWYISENGTRGSLSNIATRNIIPVELNAFLQRNARMLAQFHTTLGNPTKAKYYKDIATSYQQAIDDVLWSESEGVWLDFDLRNSQHRNYFFPTNVAPLYTQSFDSSKAQIYGQRAAAYLTRNGILDYMGGTPASLFPTGEQWDLPNAWPPLQSIIVQALRNSNEESAEKLAKELAIRWLRANHKGYSQSGQMFEKYDALNPGKFGGGGEYVVQEGFGWTNGVVYEFLNSYPNATPDDNVHMNNN

SEQ ID NO: 11670 - DNA, 2190 bp, Leptosphaeria maculans
  CDS (1)..(2190)
atgagctcgcaatactcgaagcctcgccgaacctcgactgccctcgacccttacgctgccccccacgtctactacggcgaaagccactcgcgcaagcacattagggcgaggacctactcagcgaacttggaacattctggccgcaatgccccaatcacagatggatttccccagggtcgtcgcatcagtcacgatgaggttcctgcgcagccacgtcgctttctcgtccaagtcgagcctaccctgaagacgcttctcgcccgcgaggattcggactcgaattgccaaatcaccatcgacgacaagggtccaaaggtcatatctctgggcaccctggcctcgaatgcccacaacaaattcgacgttcgcggcacttatatgctgtccaacctgctccaggagctcaccctcgcccaggactacggccgcaagacgattgtgctggacgaagcacgcctaaatgaaaatcctgtaaaccgccttgcccgcctcattgaacattctttctgggatggccttacacgacgcatcgatggctccaatatcgccaaagtcggcgtcgaccccaaggactggacggatgacccacgcccgcgcatatacatcccccagggcgcgccagagcaacatgaatattacagtcgcatcgccagagagcatcctgagatgcgactagatgtggtttggctgcaaaaggattgcgacaatgaagagtacgtacgcgacttgaacaaggcccctggtcttctcgccatcgccatggaagagtggattgatcccgagaccaagaagaaggatttgagggggctaccctttgtcgttcctggcggtcggttcaacgaactttatggctgggacagctacatggaatcgctcggtctgctcgtcaacaaccgggtcgacttggtcaagtccatggtcattcacttttgtttctgcatcaaacactacaacaagatcctcaacgcaaaccgaacctactatctctgccgctcgcaaccgcctttcttgaccgacatggcgcttcgttgctatgaccgcatcaagcacgaaccgggcgctctggacttccttcgcgaagccatcttggcagccattaaggaataccactcggtgtggatgtcggctccccgcttggatcctgtcaccggcttgtccaggtaccgacctggtggtatgggcgtaccacccgagaccgaagcaactcacttcaagcatgttctcgatccctatgctaagaagcatggcatgacattcgaagagtttgtcgacgcatacaactatcaacgagtgcacgagcctgagctcgacaattacttcctccacgatcgggctgtacgcgagtctggtcacgacacctcgtatcgtctggaaaaggtcgctgcagatcttgctgtggtggacgtcaacgcactgctttacaagtatgaagtcgacattggacgatgtattcggaactttttcaatgatgctcttgaaattcctgccgagttctgcacaggcgacatgaagccgggccaagtggagaagtctgccgcctgggagcgccgcgctagaagacgccgtgctcaagttgacaagtacctttgggatgaggaggccggcatgtacttcgactataacaccgtcaagcagcagcgcaccggctacgagagcgccacgaccttttggcccatgtggtctggtctcgcaacaccacgacaggctagcattcttatggagaaggctttgcccaaactggaagtgtttggtggccttgtgtcgggtacagaaaagtcacgtggcaaggttggcttggatcggcctaaccgccagtgggattatccattcggttgggctccgcaacagatccttgcgtgggtcggtatgcagcgctatgggtacgatgtggaggcccagcgattggcttatcggtggctgttcatggtcacaaaagcgtttgtcgacttcaatggtgttgtcgttgaaaagtacgatgtgacgaggaagattgatccgcacaaggtggaagcagagtatggaaaccaaggaagtgatttcaagggtgttcctcgggaaggctttggctgggtcaacgcaagctacatctacggcctcacccttctcaacgcacacgagcgtcgtgcccttggagctctgactgactgggatacctatgctaaggccattgcagacctgggcctggcatga

SEQ ID NO: 11671 - protein, 729 aa, Leptosphaeria maculans
MSSQYSKPRRTSTALDPYAAPHVYYGESHSRKHIRARTYSANLEHSGRNAPITDGFPQGRRISHDEVPAQPRRFLVQVEPTLKTLLAREDSDSNCQITIDDKGPKVISLGTLASNAHNKFDVRGTYMLSNLLQELTLAQDYGRKTIVLDEARLNENPVNRLARLIEHSFWDGLTRRIDGSNIAKVGVDPKDWTDDPRPRIYIPQGAPEQHEYYSRIAREHPEMRLDVVWLQKDCDNEEYVRDLNKAPGLLAIAMEEWIDPETKKKDLRGLPFVVPGGRFNELYGWDSYMESLGLLVNNRVDLVKSMVIHFCFCIKHYNKILNANRTYYLCRSQPPFLTDMALRCYDRIKHEPGALDFLREAILAAIKEYHSVWMSAPRLDPVTGLSRYRPGGMGVPPETEATHFKHVLDPYAKKHGMTFEEFVDAYNYQRVHEPELDNYFLHDRAVRESGHDTSYRLEKVAADLAVVDVNALLYKYEVDIGRCIRNFFNDALEIPAEFCTGDMKPGQVEKSAAWERRARRRRAQVDKYLWDEEAGMYFDYNTVKQQRTGYESATTFWPMWSGLATPRQASILMEKALPKLEVFGGLVSGTEKSRGKVGLDRPNRQWDYPFGWAPQQILAWVGMQRYGYDVEAQRLAYRWLFMVTKAFVDFNGVVVEKYDVTRKIDPHKVEAEYGNQGSDFKGVPREGFGWVNASYIYGLTLLNAHERRALGALTDWDTYAKAIADLGLA

SEQ ID NO: 11672 - DNA, 1980 bp, Encephalitozoon cuniculi GB
  CDS (1)..(1980)
atgaacttcacctggtggatgagatggactcttgtccctcttaccatacatgcagcaaaaaggccatcgaagatgcccaggatggacaccaatccctgtgttagcaggaagttgcttgaggctgcattcgaaaacaaaattaccaaggacagcaaatacttagtggacaaactctttttgaaacctcctgaggaaattgatgaaatgcttagaagcatggaatctgaaggcaagttctttaggagcgaagaggatttctggaatttcgtggggatgcattctatcgagccgggatcggaattcatctttgccaaggataacgaagagcttgaagcgagcatgttcagtggtgttccggaatatgtgagtaggcttgaggaaaggctattagagcccaatccgcagagagaaagtgaagggttcaagcaaagcttagaaaccctcgttagagtttctaaagagcttaatgatgcatggaagaacctctatgtaaagcagagagatttggataagggatattactcaactatgataaaagtcaagaatccgttcgtcatccctggagatagatttaaggagtgttactactgggatacatactggataatagagggcctggtcaaaagcgggatgcacaaaattgccgtgggcatggtcgagaatttcattctcttaatagaaaagtatggattcatccctaatggaacgagaacgtactacctaaacagaacccagcctccatacttctgcatgatgctctttaccgtttatagacacgttccatggacagaggaggtggaggagattataaaaaggggactgaaggcagccgtaatggagtataactttttcatgaactacagaaaggaagagatcgagaaagatggcaagtcatatgtgcttaatgtttacagggtttctgactgcacgccaagggcagagtcctatagtgaagacagaaaggtggcggaaaataacaaaagtaaggacgaggtgtatagaagaagagaagaggacatttactcaaaccttaaggctggagcggaatcaggatgggattactcctccagatggttaggtgttcgtggagagctcgactcgataagaacttctaagagggttcccgcagacttgaatgcaataatgtatgccaacgaacttataataatgaagttatttgaagtagttgaaggcaagaggtcaaagaatgccgaggacttcaagaagaaaagcgaggagaggtacagggcaatcaatgctgttctatggagcgatgaggagggtgtgtggaacgactacgatatcgaaaaaaagaagcacacatcaccaggcttctacttctcaaatctggcgccaatgtgctatggaatcagccctccgccagacaagaacatcactgtttacgatattttgaatgcctttgcagaagagatatttggacaccctggaggaatgccagcaagcggatctaaaaacaaaaacagccccgagcagtgggattatccgaatgtatggccccctcttgtgcatataatgacgtttttcctggaaaggataggcgagcggcaaatggcattgcatctggcaaggtccctcttagaaaacatatctgtttccacatccatttccgatgtgacaaggagagggatctttgaaaaatataactgcgaaagagtcggggattctgggtacaagggcgagtatgcacctcaggttggatttggctggaccaacggatctgccatccattttctggaacacttttctttcgagcttgcttctacaaaatctcatgcagtgtcgtatcaagaaattaaggatttaatggaaaagaaggtggctagtagagaagttcccagaaaacataccccagaaaactgtcttcttctggaagataaactctgggacatagaatcgcactcggaagggcccaatagctccagcggacggcctcatcctgttgtacctactacggtatga

SEQ ID NO: 11673 - protein, 659 aa, Encephalitozoon cuniculi GB
MNFTWWMRWTLVPLTIHAAKRPSKMPRMDTNPCVSRKLLEAAFENKITKDSKYLVDKLFLKPPEEIDEMLRSMESEGKFFRSEEDFWNFVGMHSIEPGSEFIFAKDNEELEASMFSGVPEYVSRLEERLLEPNPQRESEGFKQSLETLVRVSKELNDAWKNLYVKQRDLDKGYYSTMIKVKNPFVIPGDRFKECYYWDTYWIIEGLVKSGMHKIAVGMVENFILLIEKYGFIPNGTRTYYLNRTQPPYFCMMLFTVYRHVPWTEEVEEIIKRGLKAAVMEYNFFMNYRKEEIEKDGKSYVLNVYRVSDCTPRAESYSEDRKVAENNKSKDEVYRRREEDIYSNLKAGAESGWDYSSRWLGVRGELDSIRTSKRVPADLNAIMYANELIIMKLFEVVEGKRSKNAEDFKKKSEERYRAINAVLWSDEEGVWNDYDIEKKKHTSPGFYFSNLAPMCYGISPPPDKNITVYDILNAFAEEIFGHPGGMPASGSKNKNSPEQWDYPNVWPPLVHIMTFFLERIGERQMALHLARSLLENISVSTSISDVTRRGIFEKYNCERVGDSGYKGEYAPQVGFGWTNGSAIHFLEHFSFELASTKSHAVSYQEIKDLMEKKVASREVPRKHTPENCLLLEDKLWDIESHSEGPNSSSGRPHPVVPTTV

SEQ ID NO: 11674 - DNA, 1972 bp, Mus musculus
  CDS (24)..(1649)
ccacgcgtccgaccgtgcccaggatgacctgggagctgcacctgctgcttctgctggggctgggacttaggtcccaggaggccctgccaccaccctgtgagagatctactgccatggagagctcctgcaccaagttcagatggcccagctctaccaagatgacaagcagtttgtggatatgtcactggccacatctccagatgaagtcctgcagaagttcagtgagctggccacagtccacaaccacagcatccccaaggaacagcttcaggaatttgtccagagtcacttccagcccgtggggcaggagctgcagtcctggacccctgaggactggaaggacagccctcagttcctgcagaagatctcggatgctaatctgcgtgtctgggcggaggagctacacaagatctggaaaaagctgggaaagaagggactcgtactgggtgatggaaggcctgcttctttctgagatggcctcaacagtgaagggtatgctgcagaactttctggatctggtgaagacctacggacatatccccaatggtggacgcatatattacctgcaacggagccagcccccactcctgactctcatgatggatcgatatgtagctcataccaaggatgtcgccttccttcaggagaatattgggactctagcctctgaactggacttctggactgtgaacaggactgtctctgtagtctcaggaggacaaagctatgtcttaaatcgctactatgtcccttatgggggacccaggccagagtcctacaggaaagacgcagaattggcaaactctgtgccagaaggggaccgagagactctgtgggctgagctcaaggctggggctgagtctggctgggacttctcttcacgctggcttgttggaggcccagaccctgatttgctcagcagcatccgaaccagcaaaatggtacccgctgatctgaacgcgttcctgtgccaagcagaggaactgatgagtaacttctactccagactagggaacaacacagaggccacaaagtacaggaacctgcgggcccagcgcttggccgccatggaagctgtcctgtgggacgagcagaagggtgcctggttcgactatgacttggaaaaggggaagaagaacctggagttttatccctccaacctcaccccactttgggctggctgcttctcagaccctagtgttgctgacaaggctctgaagtacttggaggacagcaagatcttgacctaccaatatggaatcccaacctctcttcgtaacacaggccagcagtgggacttccccaatgcctgggccccactgcaggacctggtcattagaggtttggccaagtcagcttccccccggactcaggaggtggctttccagctggcccagaattggatcaaaaccaacttcaaagtctactcccaaaagtcagcgatgtttgagaagtatgacatcagcaacggtggacatccaggtggaggaggggagtatgaagttcaggaaggatttggctggacaaacggattggccctgatgcttctggatcgctatggtgaccagttgacttcagggacccagttagcttccctgggaccccactgcctagtggctgcccttcttctcagtcttctgctacagtgacaagaacaagaatggactcactgcctgcgctttctcccctggccccagctcatggttcattaaacccttgctctacctcccttctagccccacccccaccctgccccttcctgctcatagtgtcctgagccaagaagtgaccaagaggtcaagactgtaattttcacggtgttctgagccaagaagtgaccaagaggtcaaggttgtaattttcacgagggcggaaactgaatcctgatacctaaagtatcctatcgggtaccaaatatagttcagacttccacactcaaaaaaaaaaaaaaaaaaaaaaaaaaaaaaaaaaa

SEQ ID NO: 11675 - protein, 541 aa, Mus musculus
MTWELHLLLLLGLGLRSQEALPPPCERSTAMESSCTKFRWPSSTKMTSSLWICHWPHLQMKSCRSSVSWPQSTTTASPRNSFRNLSRVTSSPWGRSCSPGPLRTGRTALSSCRRSRMLICVSGRRSYTRSGKSWERRDSYWVMEGLLLSEMASTVKGMLQNFLDLVKTYGHIPNGGRIYYLQRSQPPLLTLMMDRYVAHTKDVAFLQENIGTLASELDFWTVNRTVSVVSGGQSYVLNRYYVPYGGPRPESYRKDAELANSVPEGDRETLWAELKAGAESGWDFSSRWLVGGPDPDLLSSIRTSKMVPADLNAFLCQAEELMSNFYSRLGNNTEATKYRNLRAQRLAAMEAVLWDEQKGAWFDYDLEKGKKNLEFYPSNLTPLWAGCFSDPSVADKALKYLEDSKILTYQYGIPTSLRNTGQQWDFPNAWAPLQDLVIRGLAKSASPRTQEVAFQLAQNWIKTNFKVYSQKSAMFEKYDISNGGHPGGGGEYEVQEGFGWTNGLALMLLDRYGDQLTSGTQLASLGPHCLVAALLLSLLLQ

SEQ ID NO: 11676 - DNA, 2074 bp, Caenorhabditis elegans
  CDS (23)..(2047)
ggtttaattacccaagtttgagatgagagagactctcttagctatcctattaatagtttacgtttctgcaagaccacaaaaagatccaagagggccgaatatcatagacgataatgccgattttggaacaccagagcatgacaatcgagtacataccgagctaacgcaattgaccgataaggaagtcgctcagttgattggatccgactattttaatggaagtgttctaccatgtgataatgaaacagcgcctggacaatggatgatctactgtagtggtaaacttctacagactgtcatggccgtccaattgtatccggattccaagacttttgtggatcagccaatgaaagaaaatcaaactggaaagtctattatggagcattttgaaaaacgtttccctgtttctattgagaagataaccaagaaagatgttgccgaatttgttgatgaatttttcgataaagaaggcaacgagttagatgtttgcgatcttcctgactggaggcccattacagaacaattggctaatatcaaagatgctagctatcaggcctttgctcaacgacttcatttcatttggattcaactttgccgccagataaagccagaagtgaaaaatgatccatctcgtttctctctcatttatgtgccatatcagttcatccttcctggaggaaggttccgtgaattctactattgggatgcatattggatactcaaagggttaatcgcgtctgaactgtattcaactgcaagaatgatgatattgaacttcgcacatataattgaaacgtatggttttgtgccgaacggaggccgagtttattaccttcgaagatctcagccaccgtttttcgcaccaatggtatacgagtattacttggcaactcaggacattcaactagtagcagatttgataccagttatcgaaaaagagtacacattttggagtgaaagaagaactgttaatgtgacctatgagcatccggacttgaatgaaacacttcacatgttccagtacagaacagaggctgaaactccaagacctgaaagtttcagagaggatgtactgagtgcagaacattttacaacaaaggataggaagaagcagtttttcaaagacttgggaagtgcggcagaaagcggatgggacttttcgagtagatggtttaaaaatcataaagatatttcaactattgagacaactaatatagtaccagtggatttgaatgcctttctttgctacaacatgaacattatgcaattgttctataaacttaccggaaaccccttgaaacatttggagtggtcatctcgttttacaaacttccgtgaagcattcacaaaggtattctacgtaccggctcgaaaaggatggtacgactataatcttcggacactcacccacaatactgacttcttcgcatccaatgctgtacctctattctcgcagtgctacgacccactgaactctcagattgcagtggatgtgtacaatgaaatgcagaattctggggcgttctcaatacccggcggaattccaacaagtatgaacgaggagacgaaccagcaatgggatttcccaaatggttggagtccaatgaatcatatgatcattgaaggacttcgcaagtctaacaatccaattctacaacaaaaggcgtttactcttgctgagaaatggctggagactaatatgcaaacattcaatgtttccgatgaaatgtgggagaaatataatgtaaaggagccactgggaaagttggcgactggtggagaatacgaagttcaggccggattcggttggaccaatggtgcagcactggatttaattttcacatattccgatcgactacagtataacgggccgatattagaatcattggtcggatcacaaacgacgtctatgaaatcgtcaccagattcgtcgacatctctaccaattgatatcaccactaccatcacgacatcatcatcatcctctactttcgggtacagtaacattctcacacttattacggtgtttgtattatatattttatagattcgattgtttttataggaattatta

SEQ ID NO: 11677 - protein, 674 aa, Caenorhabditis elegans
MRETLLAILLIVYVSARPQKDPRGPNIIDDNADFGTPEHDNRVHTELTQLTDKEVAQLIGSDYFNGSVLPCDNETAPGQWMIYCSGKLLQTVMAVQLYPDSKTFVDQPMKENQTGKSIMEHFEKRFPVSIEKITKKDVAEFVDEFFDKEGNELDVCDLPDWRPITEQLANIKDASYQAFAQRLHFIWIQLCRQIKPEVKNDPSRFSLIYVPYQFILPGGRFREFYYWDAYWILKGLIASELYSTARMMILNFAHIIETYGFVPNGGRVYYLRRSQPPFFAPMVYEYYLATQDIQLVADLIPVIEKEYTFWSERRTVNVTYEHPDLNETLHMFQYRTEAETPRPESFREDVLSAEHFTTKDRKKQFFKDLGSAAESGWDFSSRWFKNHKDISTIETTNIVPVDLNAFLCYNMNIMQLFYKLTGNPLKHLEWSSRFTNFREAFTKVFYVPARKGWYDYNLRTLTHNTDFFASNAVPLFSQCYDPLNSQIAVDVYNEMQNSGAFSIPGGIPTSMNEETNQQWDFPNGWSPMNHMIIEGLRKSNNPILQQKAFTLAEKWLETNMQTFNVSDEMWEKYNVKEPLGKLATGGEYEVQAGFGWTNGAALDLIFTYSDRLQYNGPILESLVGSQTTSMKSSPDSSTSLPIDITTTITTSSSSSTFGYSNILTLITVFVLYIL

SEQ ID NO: 11678 - DNA, 2496 bp, Artemia sanfranciscana
  CDS (256)..(2367)
gtgagaacactgtatacaatacttctcttgtatcagattgttcgcccgctcaacatctttgtgatatttctatatagaagtgatattcgattctctttccagagatgaacatcaggatttcaaggaggaaatgaaaagattgcgcagactcagaggaaaaggtccaccaaagaaaggagaaggcaaacgtgcaagtaaaaagtgaacttttgttagtgactcttgaaaagaataaaagatattttatcactaaacatgtgcgcatttttgagttttttcgtcgtttttggatttgctacaacagttagttgtagaggcgatctggttctcagtgaaagagcaaaacaactaccgcctgtttgtgctagcgaaatttactgccatggaacattcctgcatacaatacagatggcagggctgtttcgagactcgaaaacctttgtagataaaaagctaaagataaatccagaagaagttttagctagctttgaagttttgatgaactcaaccgatcaaaatcccagccgggaccaattggctgcttttataaatctacacttcgagccagaagggtcagaatttgaagaatgggatccaatagattggcattctaacccaagttttttggatggtattagagacacgaacttgaaaatatggggaaattctctccacgaagcctggacatggttaggtcgaaaaatccgtgacgacgtgagaataaatccccaattatattcgatgatgtatctccccaaccctttcatcattcctggtggtcgtttccgtgaaacttactactgggattcctattggattatcaaagggcttcttatctcgggaatgcatgagacggtgaagggtatgttgttgaactttttgctgatggtggataccattggccttgtacccaatggtggaaggatatattatgagaaacgatctcagcctccacttcttactccaatggtggaactttacgttaatgctacgggagacattgaatttttaaagcaaaacattcacctgttggaaaaagagatggatttttggcttcaggagcgaacggtcaacgttgatgggcaccggcttatccgttacgatgttaaagttggcggtccccgacctgaatcttacaaggaagatatagaagcaattcatcataaccctgatttagaagcacaattggatttctatatgaacatagcagctggtgctgaaacaggatgggatttctcaagccgatggtattggaacggggatatacaaactaatttgtcacatgttcgaacccgtgacatactacctgtagacctgaattcttttattgcttgggactttgatattatgtcccgctttgaaaagcagttaggtcgagacaacgcatcagttgtctattctgatttatacagtgaatggaaaacgtcgattaatgccattttgtgggatgatgaagctggtagctggtttgattacgattctgcgcatcggagatggaacacgaacttttatgtttctaatttgactcccttattcgtaggatgttacgatccgaaaacagttcatcatgaagacgttgccaccagagtactcgattaccttgaaaaaagtaacgccttgaagtttcctggtggtgtaccaacatcattgatgcagacaagccaacaatgggactttcctaatggctggcctcctctccagcacatgctggttatgggacttgacaagaccggtgatccaagggccaaagaactggcttttgacgttgcgcagagatgggttttcaataattatgaagcgttcacgcaaagcttacctaatgccatgtttgaaaagtatgacgtaacggtcgttggcctccccggtggtgggggagagtacgacgttcaactaggttttggctggacaaatggtgtagtaatggactttttagttaaatacggtgagagattgacttcagtccgtgacgcaaaacaactaatttggagtccatcatcagtttcagttggagttggtgctggtgcaacgttcctcggtgcttggattggtcttgcaagtactcgattctatcgccaacttttcaagtccgaccacaaaatgggaggcatccatggtgtggctgaggcaattcaaggacttattgcctgtgttggttctctgctcgtggctactgcagcactttttagtgaaaaggatacgacgaaacgacctacctctggacagacccctcagtccagcccaataaggagaacaaaatcgttacccggcttcttattgttccaacgaggaagtaaaggcgacgaagagcatctcttaaggaaccgcgcaattagtgaagaatgttcgtattcttctatagaagaatgatgaaggagactttaggtggatacaattttcttcatattgctaggaaatgccagaagttcaaattaatattcattgtaaattttcgagtgtgatattttcttagtaaagcggtttcttcataaaaaaaaa

SEQ ID NO: 11679 - protein, 703 aa, Artemia sanfranciscana
MCAFLSFFVVFGFATTVSCRGDLVLSERAKQLPPVCASEIYCHGTFLHTIQMAGLFRDSKTFVDKKLKINPEEVLASFEVLMNSTDQNPSRDQLAAFINLHFEPEGSEFEEWDPIDWHSNPSFLDGIRDTNLKIWGNSLHEAWTWLGRKIRDDVRINPQLYSMMYLPNPFIIPGGRFRETYYWDSYWIIKGLLISGMHETVKGMLLNFLLMVDTIGLVPNGGRIYYEKRSQPPLLTPMVELYVNATGDIEFLKQNIHLLEKEMDFWLQERTVNVDGHRLIRYDVKVGGPRPESYKEDIEAIHHNPDLEAQLDFYMNIAAGAETGWDFSSRWYWNGDIQTNLSHVRTRDILPVDLNSFIAWDFDIMSRFEKQLGRDNASVVYSDLYSEWKTSINAILWDDEAGSWFDYDSAHRRWNTNFYVSNLTPLFVGCYDPKTVHHEDVATRVLDYLEKSNALKFPGGVPTSLMQTSQQWDFPNGWPPLQHMLVMGLDKTGDPRAKELAFDVAQRWVFNNYEAFTQSLPNAMFEKYDVTVVGLPGGGGEYDVQLGFGWTNGVVMDFLVKYGERLTSVRDAKQLIWSPSSVSVGVGAGATFLGAWIGLASTRFYRQLFKSDHKMGGIHGVAEAIQGLIACVGSLLVATAALFSEKDTTKRPTSGQTPQSSPIRRTKSLPGFLLFQRGSKGDEEHLLRNRAISEECSYSSIEE

SEQ ID NO: 11680 - DNA, 1986 bp, Oryza sativa
  CDS (27)..(1718)
ctgtccccttactccggccgattcacatggcgcccaccgccgcggttgccgggggtggcgtggaggcggaggcgctgctggggctgctgcagcgggtgcagtcggaggcgctgcgggcgttcgggccgaacgacttcgaccccaagctctacgtcgacctgccgctcgccgccgacgccagcgcggcggccgcgctggcgtcgctgccgcgggcggcgccgtcgaggggcgagatggaggcctacatctcgaggtacttcgcgctggccgggtccgacctcgtcgccgccgccgacccgccggacttcgagcgcgacccccccgggttcctgcccagggtggagcgcgccgaggcgcgggcctgggcgctggaggtgcacgcgctgtggaaggacctgacgcggcgggtggcgccggccgtcgcggcgcgccccgaccggcacacgctgctgccgctccccggcagggtggtcgtgccgggctccaggttccgggaggtctactactgggactcctactgggtcgtcagaggtttactggtgagcaaaatgtatgagacggcaaaggatatcgtgcttaatcttgtgtatcttgttgagaaatatggttttgttctgaacggggcaagatcgtactacactaaccgaagccagccaccacttttaagctccatggttttagacatatacatggcaactggtgatatggcttttgtgaggagggtatttccctcactgctgaaagagcatagtttctggatgtcagaggttcacaatgtggcagtaatggacaatcatggacgggtacataatttgagtcgctaccaggctatgtggaacaaacctaggccagaaagtgcaacaattgatgaggaatttgcttcaaaactttctacggctgctaaagaaaaattctaccaccaagttgcttctacagctgaaacaggatgggattttagctctcgatggatgagggattctactgacatgacaactctgacaacatcttgcataatacctgtggacttgaacacattcatattgaagatggaacaggacatagctttctttgctaaactcattggagagagcacaacatcagaaatattttcagaggcttcaaaagcacgccataatgcaattgattctgttctgtggaacgctgacatggagcaatggcttgactactggcttcctactgatggaaactgccagggagtctaccaatggaaatctatctcacagaaccgcgccatctttgcttctaattttgtacctttgtggttaaatgctcaacattcaggcttggagcaatttgtcgatgaggcaaaatcagtgagagtcatgagaagcctccagaaatcaggattactgcaacctgcaggaatcgcaacttccttatcaaacacagggcaacaatgggattttccaaacggatgggccccgttgcagcatctgatagtcgagggattgttgaggtctggttcaggagaggcaagggaacttgctgaggacattgccacgaggtgggtgagaacaaactatgatgcctataaggctaccggcgcgatgcatgagaagtacgatgtggtgacctgtggaaaatctggaggtgggggtgaatacaaaccccagactggttttggttggtccaacggtgtgatattatcattcttggatgaatttggatggcctcaggacaagaagatagactgctagtcatcatgatgaatgttaaaccccatcttcgcagatgcagaatgtggctaggctaggcaggtgtttttgtgtgcaactgtatatacacggctgtgcattacacgcaaagttgaagaggcattctgcaattctgctgtagtttttatctgacaaacatttgcattcagatttcagagcatcacccgcaactgtgtttttttttctttttttgtaacttgccctttgctgtaactcgtatcaaagctcaaagcaagaagaatcttcatgt

SEQ ID NO: 11681 - protein, 563 aa, Oryza sativa
MAPTAAVAGGGVEAEALLGLLQRVQSEALRAFGPNDFDPKLYVDLPLAADASAAAALASLPRAAPSRGEMEAYISRYFALAGSDLVAAADPPDFERDPPGFLPRVERAEARAWALEVHALWKDLTRRVAPAVAARPDRHTLLPLPGRVVVPGSRFREVYYWDSYWVVRGLLVSKMYETAKDIVLNLVYLVEKYGFVLNGARSYYTNRSQPPLLSSMVLDIYMATGDMAFVRRVFPSLLKEHSFWMSEVHNVAVMDNHGRVHNLSRYQAMWNKPRPESATIDEEFASKLSTAAKEKFYHQVASTAETGWDFSSRWMRDSTDMTTLTTSCIIPVDLNTFILKMEQDIAFFAKLIGESTTSEIFSEASKARHNAIDSVLWNADMEQWLDYWLPTDGNCQGVYQWKSISQNRAIFASNFVPLWLNAQHSGLEQFVDEAKSVRVMRSLQKSGLLQPAGIATSLSNTGQQWDFPNGWAPLQHLIVEGLLRSGSGEARELAEDIATRWVRTNYDAYKATGAMHEKYDVVTCGKSGGGGEYKPQTGFGWSNGVILSFLDEFGWPQDKKIDC

SEQ ID NO: 11682 - DNA, 2123 bp, Glycine max
  CDS (134)..(1807): n means a or g or c or t/u, s means g or c
aaagaaatgatatttgtattgaagcaataataaaccaatgacaacagagttggggtagaactagaaagcatccctagcaaaagtcaaggttggccccttgcgtcaatcgccggcttcgaaatcgctgtcaattatggcatcacactgtgtaatggccgtgacgccctcaacccctcttctctccttcctcgaacgcctccaagaaacagccttcgaaaccttcgcccattccaacttcgatcccaaaacctacgtggacatgcctctcaagtccgccctcacgattaccgaggacgcgttccagaagcttccgaggaacgccaacgggtccgtgccggttgaggatttgaagcgtttcatagaagcctactttgaaggtgcaggggatgatctggtgtaccgggacccacaggatttcgttcccgagccggagggtttcttgcccaaggtgaaccaccctcaggttagggcctgggccttgcaggtccattcactttggaaaaacttgagccggaaaatatccggtgcggtgaaggcacagccagacttacatacgctgctccctctccctggttcggttgtcattcccgggtcgcgttttcgcgaggtttattactgggattcctattgggttattaggggcctgctggccagtcaaatgcatgacacagctaaggctattgtcaccaatctcatttccttgatagataaatatggctttgttcttaatggggctagagcttactacactaacaggagccagcctccccttttaagcgccatgatttatgagatatacaatagcacgggtgacgtggaattagttaaaagatctctacctgccttactgaaagaatatgaattttggaattcagatatacataaactgaccattttggatgctcaaggttgcactcataccttaaatcgttattatgcaaagtgggacaaacccaggccggaatcgtccataatggacaaggcatctgcttccaacttctccagtgtttcagaaaaacagcagttttaccgtgaactggcatcagctgctgaatcaggatgggatttcagcaccagatggatgagaaatccacctaatttcacaacattggctacaacatctgtaatacctgttgatttgaacgcatttctactcgggatggaacttaatattgccttatttgcaaaagttactggagataatagcactgctgaacggttcctggaaaattctgatcttagaaagaaggcaatggactctattttctggaatgcaaacaagaaacagtggcttgattactggctcagcagtacatgtgaggaggttcatgtttggaaaaacgagcatcagaatcaaaatgtatttgcttccaattttgttcctttgtggatgaagccattttactcagatacttcgcttgtgagtagtgttgttgaaagtctcaaaacatctggcctgctccgtgatgctggagttgcaacttctttgactgattcagggcaacagtgggactttccaaatgggtgggcgccgcttcaacacatgctagtggaaggactgctaaaatcaggattgaaagaagcaaggttattggctgaggaaattgccatcagatgggtcacaaccaattatattgtttataagaaaacaggtgtaatgcatgaaaagtttgacgtggagcattgtggagaatttggaggtgggggcgaatatgtaccccagactggttttggctggtcaaatggagttgtgttggcattcttggaggagtttggatggcctgaagatcggaacatagaatgttgatgtgcccagagatagaaaggtggaaaaaatttggtacgctgcaagaatttattcatgaaagctatttgcatgaggggttgaagaaaagtagttaataaatgcgtcaaaagccacttgttaaagcctataatgaaagttgagatgatttgagtttattactttatttgccatttgatgttttacttggaagtatgttcagaaaattcaacaaaagtgatggatgtcatcacatatcaatgctttggcacaaattgatgcataattggaccatttgatgtgagttgcttnatatactggcgtctgacgggattaaaga

SEQ ID NO: 11683 - protein, 557 aa, Glycine max
MASHCVMAVTPSTPLLSFLERLQETAFETFAHSNFDPKTYVDMPLKSALTITEDAFQKLPRNANGSVPVEDLKRFIEAYFEGAGDDLVYRDPQDFVPEPEGFLPKVNHPQVRAWALQVHSLWKNLSRKISGAVKAQPDLHTLLPLPGSVVIPGSRFREVYYWDSYWVIRGLLASQMHDTAKAIVTNLISLIDKYGFVLNGARAYYTNRSQPPLLSAMIYEIYNSTGDVELVKRSLPALLKEYEFWNSDIHKLTILDAQGCTHTLNRYYAKWDKPRPESSIMDKASASNFSSVSEKQQFYRELASAAESGWDFSTRWMRNPPNFTTLATTSVIPVDLNAFLLGMELNIALFAKVTGDNSTAERFLENSDLRKKAMDSIFWNANKKQWLDYWLSSTCEEVHVWKNEHQNQNVFASNFVPLWMKPFYSDTSLVSSVVESLKTSGLLRDAGVATSLTDSGQQWDFPNGWAPLQHMLVEGLLKSGLKEARLLAEEIAIRWVTTNYIVYKKTGVMHEKFDVEHCGEFGGGGEYVPQTGFGWSNGVVLAFLEEFGWPEDRNIEC

SEQ ID NO: 11684 - DNA, 2819 bp, Drosophila melanogaster
  CDS (201)..(1991)
agtattcttgcgctgactggcgctggttgtgcttgtgttgttcagtttgagttctgggatcgcgagcatatcctgtgcgccaaaggatatacagcatatatcaggatatatcagcagcctcagcaacgtatttcgtattttcattcacgcagattgaaagttcgttgctttattagccgcgtgaattgtccagtgaaagtatgttcaagctaccgaccatcagcctgctcctcgtgagctggagttgcctggtggccttgtcccaggccaagacctacagcctgcccgatctcaccaccgactataacaatgccattcccgtcgacgaggaggaggcacaggatccgttcgccagctgtaaaatctactgcgagggcaatctgctgcacaccatccaaacggcagtgcccaaactatttgcggattcgaaaacgtttgtggacatgaagctgaacaattcgcccgacaagaccctcgaggactttaatgccatgatggaggccaagaatcagacgccaagcagtgaggatctcaagcagtttgtcgataagtacttcagtgcaccgggcaccgagcttgagaaatggacgcccaccgactggaaggagaatcccagtttcctcgacctgatctccgacccagatctgaagcaatggggcgtcgagctgaatagcatttggaaggacttgggacgcaaaatgaaggacgaggtgtcaaagaatcccgaatactactcaatcattcccgtgccaaatccagtgatcgtgcccggcggtcgtttcattgagttctactactgggactcctactggatcatccgtggacttctctacagccagatgtttgacaccgcgcgcggcatgattgagaacttcttttccattgtcaatcggttcggttttattccaaacggcggtcgagtctactaccacggtcgctcccagccgccacttctaaccggtatggtcaagtcgtacgtggacttcaccaacgatgacaagttcgccatcgatgccctggacacgctggagcacgagttcgagttctttgtgaacaaccacaatgtcacggtgaagaatcacagcctgtgtgtgtaccgcgattcgtcgtccggaccgcgaccagaatcctaccgagaggatgtggagaccggcgaggagttccccacggatgaggccaaggaactgcattacagtgaactcaaggcaggcgccgaatcgggcatggactttagctcgcgctggttcatctcaccgactggaaccaatgatggcaaccggagcgctctgagcaccacctccattgtgcccgtcgacctgaatgcctatctctactggaacgccaagttgattgccgagttccattccaaagcgggcaacaccaaaaaggtcaccgaatacgagaccaaggccgagaaactccttctgggtatccaagaagttttgtggaacgaggaggccggtgtctggttggactacgatatgattaaccagaagcctcgcgattactacacgcccaccaatctatctccactgtgggtgaaggccttcaacatttcggagtccgaaaagatatcggcttcggttatggcctacattgagaggaacaagctggacagcttccctggcggagttcccaacacgctgagctacaccggagaacagtgggatgcccccaatgtgtgggcaccgatgcagtacatcctggtcgagggcctaaacaacctgaacactcccgaggccaagaatatgtcactgaagtgggccaccaggtgggtgaagacaaactttgcggcgtttagcaaggacaggcacatgtacgagaagtacaacgccgatgagttcggagttggaggcggcggtggcgagtacgaggtacagactggattcggttggtccaacggtgtgatcatcgagtggctgagcaagcacgggcgcgacatttccattggatccggttgtggctgcctagcaggtgaaaagcggcagtagaaagaatctgtagccaggccagaacgcaatccatcagacatcattgtcagcatcatcacaggctcgaagccaaagcttattcaaaaaattgtatttagatatttgtatattattaaggctccaatcagaagcgctcatcaactgctcatccttaggctaagaaaatgctgtctctctcgctctgcgcaatctttatacctttaaaagccgctgtctataaccaatatctgtaccgcgaaccatcgacatctcgagccaagcaccacgaaccacagcaccacagttacagcaccgccaggaatcaagatctgaagtccgccatccgtcgagcatctgtgtactgtctgttgtccatgtagtaaaccacgtccagtccacgtttgcacactcgtgtgacttgtccaaattcaagaaataagaacgcaaagaacgctatctatcaagttgaggattcacgagtaatcgtatgatgggcatcgtgggcgtggcagctgtcactatagttgctctgatagcaggtcgtgttctatggtgagacaatgtgtgccaaaacaagacgtaattgctactcaagtagtgtgattcccccctccgtgtttgtgcgtgtgttgtgaagtctgtagttgctaacgtttttcgttgagtgcggagattgcagtattagtttatcattatttggtagttgaagtgagagttgtatatactgaatttatatgggcatgcccgaaattgttattacgttttaatatttagcaaatacctataccaatcctagctcctcgcaaccaaatgaagacacaaatacaattgttaacaataatttacaaa

SEQ ID NO: 11685 - protein, 596 aa, Drosophila melanogaster
MFKLPTISLLLVSWSCLVALSQAKTYSLPDLTTDYNNAIPVDEEEAQDPFASCKIYCEGNLLHTIQTAVPKLFADSKTFVDMKLNNSPDKTLEDFNAMMEAKNQTPSSEDLKQFVDKYFSAPGTELEKWTPTDWKENPSFLDLISDPDLKQWGVELNSIWKDLGRKMKDEVSKNPEYYSIIPVPNPVIVPGGRFIEFYYWDSYWIIRGLLYSQMFDTARGMIENFFSIVNRFGFIPNGGRVYYHGRSQPPLLTGMVKSYVDFTNDDKFAIDALDTLEHEFEFFVNNHNVTVKNHSLCVYRDSSSGPRPESYREDVETGEEFPTDEAKELHYSELKAGAESGMDFSSRWFISPTGTNDGNRSALSTTSIVPVDLNAYLYWNAKLIAEFHSKAGNTKKVTEYETKAEKLLLGIQEVLWNEEAGVWLDYDMINQKPRDYYTPTNLSPLWVKAFNISESEKISASVMAYIERNKLDSFPGGVPNTLSYTGEQWDAPNVWAPMQYILVEGLNNLNTPEAKNMSLKWATRWVKTNFAAFSKDRHMYEKYNADEFGVGGGGGEYEVQTGFGWSNGVIIEWLSKHGRDISIGSGCGCLAGEKRQ

SEQ ID NO: 11686 - DNA, 2265 bp, Kluyveromyces lactis
  CDS (1)..(2265)
atggatggcaaagtaaataataacccaccacgttctagacatagaagaacttcttcattagaagaagtagtggatcctttttccactcctgatgtgtattatgggccaaaaagtgatccttcaaagcttttgagcaaaaataggtttacccgtactagaacatttagtgttgcggaacccggtggtggtaagggacattcttcgtcttatacttccccttatttcgatactacagtgcctctacggcgtagaggctctgaagacgattcgtatagtgcaagtcaaggtcagagaagattttacatcgaggatgtggataagacgctaaaggagttgttagccagtgaggataccgatgggaactaccaaattactatagaggatactggtccaaaagttatcagggttggtactgtaaattcgaacggttacaagcatgtgcatattaggggtacctatatgctttcaaaccttttgcaagagttgactttagccaaacttttcaataggaaacaggttatcttggatgaggcaagattgaatgaaaatccagttaacaggatgacaagactgattagtggtcaattttggaaatcattgacaagaagaattgactctaacaatatcgcaaagattgcgtacgacaccaagatcgatacaccaaaggcgaaaaaccctagaatctatgtcccatacaattgccaagatgaatatcaacaattggtccaatggtctgaaatggacccatcgttacaacttgaagtcaattatttgccaaaggacattactcctgaatttgtgaaatccctaaatgataaaccggggcttttatgtttggcaatggaatcgcatatggatccagtcactggtgaggaaacgtgggttgggtttccttatgcggttcctggtggtcgttttaatgaactttatgggtgggattcctatttcatggcattaggtctcttagagagtaacaaattggatgttgccagaggtatggttgaacacttcatcttcgaaattgatcactatgggaaaatcttgaatgctaacagatcgtactatttatgtagatcacagccacccttcctaacagatatggcactacaggtgtgtaggaagatgggtggagataaaaacccggtagctgttgatctattgagaagggcctttaaagcggctatcaaagaatatttaactgtttggacggctagtccaagactagatgaaaagacaggtctttcgtgttatcatcctgatggtattggtattccaccagagacagagcctggtcactttgactccattttgaggaaatatgctgaaaaatacaatgtctccatacctgaattcagagatctttacaattcacagaaggttcacgaaccagatttggatgttttcttcttacatgatcgtggtgtaagagaaagtggtcatgacaccacgtataggtttgaaaatgtttgtgcttatctagccacgattgatttgaattcgttgttatataagtatgaagtggacattgcctatgttatcaagaaatactttggggataatttcgaaggattgccagaaggtcatagaacttctaacgactgggagaagttggctgaagttagaaaggaaagaattgacaaatatctatgggatgaagaaactggtttctactacgactataatgtaaagactgagaaaagaacgagttatgaatcagttacaacattctgggccctttgggcggggatgtcttcacaggagcaagcacaaagaatggttgagaatgccttgccaaaacttgaggagttcggtggattggtagcatgtactgcgcgctcccgtggtgagctcagtttggatagaccaacaagacagtgggactatccattcggttgggctccacatcagatattggtttgggatggtctagtccgttatggttatgaaaatcacactagacgccttgcttatagatggttgttcttaatgacaaaagcattcgtcgattataacgggattgtcgttgaaaaatacgacgtcacaaggggtacagaccctcacagagttgatgctgaatatggtaatcaaggtgcagactttaaaggtgttgctactgagggcttcggatgggtgaattcaagttacctgttaggaatgaagtatatgaataattttgccagaagggcattaggtacttgcgtcactccaaaagtattctttggaagactaccaccaaaagaaaagaagaaatatggtttagaatga

SEQ ID NO: 11687 - protein, 754 aa, Kluyveromyces lactis
MDGKVNNNPPRSRHRRTSSLEEVVDPFSTPDVYYGPKSDPSKLLSKNRFTRTRTFSVAEPGGGKGHSSSYTSPYFDTTVPLRRRGSEDDSYSASQGQRRFYIEDVDKTLKELLASEDTDGNYQITIEDTGPKVIRVGTVNSNGYKHVHIRGTYMLSNLLQELTLAKLFNRKQVILDEARLNENPVNRMTRLISGQFWKSLTRRIDSNNIAKIAYDTKIDTPKAKNPRIYVPYNCQDEYQQLVQWSEMDPSLQLEVNYLPKDITPEFVKSLNDKPGLLCLAMESHMDPVTGEETWVGFPYAVPGGRFNELYGWDSYFMALGLLESNKLDVARGMVEHFIFEIDHYGKILNANRSYYLCRSQPPFLTDMALQVCRKMGGDKNPVAVDLLRRAFKAAIKEYLTVWTASPRLDEKTGLSCYHPDGIGIPPETEPGHFDSILRKYAEKYNVSIPEFRDLYNSQKVHEPDLDVFFLHDRGVRESGHDTTYRFENVCAYLATIDLNSLLYKYEVDIAYVIKKYFGDNFEGLPEGHRTSNDWEKLAEVRKERIDKYLWDEETGFYYDYNVKTEKRTSYESVTTFWALWAGMSSQEQAQRMVENALPKLEEFGGLVACTARSRGELSLDRPTRQWDYPFGWAPHQILVWDGLVRYGYENHTRRLAYRWLFLMTKAFVDYNGIVVEKYDVTRGTDPHRVDAEYGNQGADFKGVATEGFGWVNSSYLLGMKYMNNFARRALGTCVTPKVFFGRLPPKEKKKYGLE

SEQ ID NO: 11688 - DNA, 2045 bp, Mus musculus
  CDS (24)..(1754)
ccgttctaggcaccgtgcccaggatgacctgggagctgcacctgctgcttctgctggggctgggacttaggtcccaggaggccctgccaccaccctgtgagagccagatctactgccatggagagctcctgcaccaagttcagatggcccagctctaccaagatgacaagcagtttgtggatatgtcactggccacatctccagatgaagtcctgcagaagttcagtgagctggccacagtccacaaccacagcatccccaaggaacagcttcaggaatttgtccagagtcacttccagcccgtggggcaggagctgcagtcctggacccctgaggactggaaggacagccctcagttcctgcagaagatctcggatgctaatctgcgtgtctgggcggaggagctacacaagatctggaaaaagctgggaaagaagatgaaagcagaagtcctcagctaccccgagaggtcctccctaatctactcaaagcaccccttcattgtgcccggggggcgctttgttgaattctactactgggactcgtactgggtgatggaaggcctgcttctttctgagatggcctcaacagtgaagggtatgctgcagaactttctggatctggtgaagacctacggacatatccccaacggtggacgcatatattacctgcaacggagccagcccccactcctgactctcatgatggatcgatatgtagctcataccaaggatgtcgccttccttcaggagaatattgggactctagcctctgaactggacttctggactgtgaacaggactgtctctgtagtctcaggaggacaaagctatgtcttaaatcgctactatgtcccttatgggggacccaggccagagtcctacaggaaagacgcagaattggcaaactctgtgccagaaggggaccgagagactctgtgggctgagctcaaggctggggctgagtctggctgggacttctcttcacgctggcttgttggaggcccagaccctgatttgctcagcagcatccgaaccagcaaaatggtacccgctgatctgaacgcgttcctgtgccaagcagaggaactgatgagtaacttctactccagactagggaacgacacagaggccacaaagtacaggaacctgcgggcccagcgcttggccgccatggaagctgtcctgtgggacgagcagaagggtgcctggtttgactatgacttggaaaaggggaagaagaacctggagttttatccctccaacctctccccactttgggctggctgcttctcagaccctagtgttgctgacaaggctctgaagtacttggaggacagcaagatcttgacctaccaatatggaatcccaacctctcttcgtaacacaggccagcagtgggacttccccaatgcctgggccccactgcaggacctggtcattagaggtttggccaagtcagcttccccccggactcaggaggtggctttccagctggcccagaattggatcaaaaccaacttcaaagtctactcccaaaagtcagcgatgtttgagaagtatgacatcagcaacggtggacatccaggtggaggaggggagtatgaagttcaggaaggatttggctggacaaacggattggccctgatgcttctggatcgctatggtgaccagttgacttcagggacccagttagcttccctgggaccccactgcctagtggctgcccttcttctcagtcttctgctacagtgacaagaacaagaatggactcactgcctgcgctttctcccctggccccagctcatggttcattaaacccttgctctaccttcccttatagccccacccccaccatgccccttcctgctcataatgtgtcctgagccaagaagtgaccaagaggtcaagactgtaattttcacagtgttctgagccaagaagtgaccaagaggtcaaggttgtaattttcacgagggcggaaactgaatcctgatacctaaagtatcctatcgggtaccaaatatagctcagagttccacactc

SEQ ID NO: 11689 - protein, 576 aa, Mus musculus
MTWELHLLLLLGLGLRSQEALPPPCESQIYCHGELLHQVQMAQLYQDDKQFVDMSLATSPDEVLQKFSELATVHNHSIPKEQLQEFVQSHFQPVGQELQSWTPEDWKDSPQFLQKISDANLRVWAEELHKIWKKLGKKMKAEVLSYPERSSLIYSKHPFIVPGGRFVEFYYWDSYWVMEGLLLSEMASTVKGMLQNFLDLVKTYGHIPNGGRIYYLQRSQPPLLTLMMDRYVAHTKDVAFLQENIGTLASELDFWTVNRTVSVVSGGQSYVLNRYYVPYGGPRPESYRKDAELANSVPEGDRETLWAELKAGAESGWDFSSRWLVGGPDPDLLSSIRTSKMVPADLNAFLCQAEELMSNFYSRLGNDTEATKYRNLRAQRLAAMEAVLWDEQKGAWFDYDLEKGKKNLEFYPSNLSPLWAGCFSDPSVADKALKYLEDSKILTYQYGIPTSLRNTGQQWDFPNAWAPLQDLVIRGLAKSASPRTQEVAFQLAQNWIKTNFKVYSQKSAMFEKYDISNGGHPGGGGEYEVQEGFGWTNGLALMLLDRYGDQLTSGTQLASLGPHCLVAALLLSLLLQ

SEQ ID NO: 11690 - DNA, 1656 bp, Ralstonia solanacearum
  CDS (1)..(1656)
atgctcgatccccgtggccttgcacggccatcccggttttgcccgcgcatcatctacgccggcacctcgcacattcgccgcgccaccgccgcggcgctgctggcggccagcctctgtgccctgcctgcctgtgccgatgtcggcgttggcgcggcgttgccgctttcgccggacaagctctatggcgaactgttcgtcgccgtgcagaccgcgcaggtctatcccgaccagaagaccttcgtcgatacggtgcccaaggcggacccggcggtcatcctgcaggcctatcgggcgcagaaggacgtgcccggcttttcgctgaaggcgttcgtcgaccagtacttcaccgtgccgttcgagaccgtcatcacgccgcccgccgggcagtcgctgcgcgcgcacatcaactggctgtggccggcgctcacgcgcaccacggccacggcgccggacaacagctcgctgattccgctgcccaagccctacgtggtgccgggcgggcgcttccgcgaggtctactactgggatacgtatttcacgatgctcgggctgcaggcgtccgggcgcgatgatctcgtcgacagcatgctcgacaacttcgcctaccagatcaaccggttcggccacatccccaacggcaaccggacgtactacctgagccgctcgcagccgccgttcttcgcgctgatggtggagctcgcggccacgaaggaaggggaggccgcctacacccgctacctggccccgctgcgcaaggagtacgcctactggatgcgcggcgccgccggcacggcccccgggcaagccagcggcaacgtggtggtgctgcccgacggcaccgtgctcaaccgctactgggacgatgaggccacgccgcgccccgagtcgtatctgcaggatgtcgccacggcgcagcaggcaccggaccgccccgccgccgaggtctggcgcgacctgcgtgccgccgccgagagcggctgggatttcagctcgcgctggttcggcgacagcgccacgctggccaccatccgcaccacgtccatcctcccggtcgatctcaatgcgctgatgttccaactggagaagaccatcgccaagggctgcgccgtggcgcgcgatttcgcctgcacggtcgagttcggcaaccacgcgcgcaagcgggcggttgcggtcgagcgctacctgtggcatcccgccggctactacgcggattacgactggaagctcggcaaggtgcgcgacaacctgtcggcggccgcgacgtatccgctgttcgtgcagatggcgccatgggggcgggcccggcagacgctgcgccagacgcagacggcgctgctgcaggtcggcggcttgtccaccacgacgctgcacacgcagcagcagtgggatgccccgaacggctgggcgccgctgcagtggattgcgctgcaggccagccagcactatggccaggcgctgctggcccagaccatcggcgagcgcttcctcggcagtgtcgagcgcctgtacgcggccgagcagaagctggtcgagaaatacatcgtcgacggcagcggcacgggcggcggcggtggcgagtatccgctgcaggacggcttcggctggaccaacggcgtgacgctcaggctgctcgacgcatacgggcgcgggcagtga

SEQ ID NO: 11691 - protein, 551 aa, Ralstonia solanacearum
MLDPRGLARPSRFCPRIIYAGTSHIRRATAAALLAASLCALPACADVGVGAALPLSPDKLYGELFVAVQTAQVYPDQKTFVDTVPKADPAVILQAYRAQKDVPGFSLKAFVDQYFTVPFETVITPPAGQSLRAHINWLWPALTRTTATAPDNSSLIPLPKPYVVPGGRFREVYYWDTYFTMLGLQASGRDDLVDSMLDNFAYQINRFGHIPNGNRTYYLSRSQPPFFALMVELAATKEGEAAYTRYLAPLRKEYAYWMRGAAGTAPGQASGNVVVLPDGTVLNRYWDDEATPRPESYLQDVATAQQAPDRPAAEVWRDLRAAAESGWDFSSRWFGDSATLATIRTTSILPVDLNALMFQLEKTIAKGCAVARDFACTVEFGNHARKRAVAVERYLWHPAGYYADYDWKLGKVRDNLSAAATYPLFVQMAPWGRARQTLRQTQTALLQVGGLSTTTLHTQQQWDAPNGWAPLQWIALQASQHYGQALLAQTIGERFLGSVERLYAAEQKLVEKYIVDGSGTGGGGGEYPLQDGFGWTNGVTLRLLDAYGRGQ

SEQ ID NO: 11692 - DNA, 1713 bp, Salmonella typhi
  CDS (514)..(1713)
atgatacccccagagattcgccgttctgttctactacagaaagccataaaactggcgctggcagggacgctgctgacgtttgcatcgttttcggcgactgccgcagacccgtcttccgacactgaaactccgcagccgccggatattttgcttggcccgctctttaatgatgtccagaatgcaaaactcttccccgatcagaaaacctttgctgacgccatacctaatagcgatccgctcatgattcttgcggattatcgtatgcagcggaactagtccggcttcgatttgcgtcattttgttgatgttaacttcaccctgccgaaagcgggtgaaaaatatgtcccgcctgccgggcaatcattgcgtgaacatattgatggcctgtggccggtgctgacccgttcaactaaaaacgtcgaaaagtgggactcgctcttgccgttgcctgaatcctatgtcgtaccgggtgggcgattcagggagatttactactgggacagctactttacgatgctggggctggcggaaagcgggcactgggataaggtggcggatatggtagcgaactttggttacgaaattgacgcctgggggtatattcctaacggcaaccgtacctactacctgagtcgttcacagccgcctttctttgcgtttatggttgaattactggtgcaacatgaaggtgacgatgcgctgaaagaatacctgccgcaactgcaaaaagagtacgcctactggatggagggcgttgagacattgcagccagggcaacaaaaccaacgcgtcgtcaaactggaggacggcagcgttctcaaccgctactgggacgatcgggatacgccccgccctgaatcctgggttgaagatatcgctaccgccaaaagcaaccccagccgcccggcaacggagatctatcgagacctccgatctgctgccgcctccggctgggatttcagctcccgctggatggataatccgcagcagctcagtaccattcgtaccaccacgattgtccctgtcgatcttaacgctctgctgtatcagctggagaaaaccctcgcccgcgccagcgctgcggcgggcgatcgggccaaagcctcgcaatatgacgcgctggccaacgcgcggcaaaaagccattgaaatgcatctgtggaataacaaagagggttggtatgccgactacgatctgcagaacaataaaatccgtgaccaactcaccgctgccgcgctgttcccgctctatgtaaacgccgccgcgaaagatcgcgccgcgaaagtggcagcggcggcccaggcgcatctgctacagcctggcgggctggctaccacctcggttaaaagcggacagcagtgggatgcgccaaatggctgggcgccgttacaatgggtcgctgccgaaggattgcaaaattatgggcaggatgacgtggcaatggaagtcacctggcgctttttaaccaatgtgcagcacacctacgatcgcgagaaaaaactggtcgaaaaatatgacgtcagcagtaccggaaccggcggtggcggcggcgaatatccccttcaggacggctttggctggagcaacggcgtgacgctgaaaatgctcgatctgatttgtccgcaggaaaaaccgtgcgatagcgtaccgtctactcgtccggcatcgttaagcgcaacgccgacaaaaacgccgtctgcagcgacgcagtaa

SEQ ID NO: 11693 - protein, 399 aa, Salmonella typhi
MLGLAESGHWDKVADMVANFGYEIDAWGYIPNGNRTYYLSRSQPPFFAFMVELLVQHEGDDALKEYLPQLQKEYAYWMEGVETLQPGQQNQRVVKLEDGSVLNRYWDDRDTPRPESWVEDIATAKSNPSRPATEIYRDLRSAAASGWDFSSRWMDNPQQLSTIRTTTIVPVDLNALLYQLEKTLARASAAAGDRAKASQYDALANARQKAIEMHLWNNKEGWYADYDLQNNKIRDQLTAAALFPLYVNAAAKDRAAKVAAAAQAHLLQPGGLATTSVKSGQQWDAPNGWAPLQWVAAEGLQNYGQDDVAMEVTWRFLTNVQHTYDREKKLVEKYDVSSTGTGGGGGEYPLQDGFGWSNGVTLKMLDLICPQEKPCDSVPSTRPASLSATPTKTPSAATQ

SEQ ID NO: 11694 - DNA, 1698 bp, Shigella flexneri
  CDS (1)..(1698)
atgaaatcccccgcaccttctcgcccgcaaaaaatggcgttaattccagcctgtatctttttgtgtttcgctgcgctatcggtgcaggcagaagaaacaccggtaacaccacagccgcctgatattttattagggccgctgtttaatgatgtgcaaaacgtcaaactttttccggaccaaaaaacctttgccgatgccgtgcctaacagcgatccgctgatgatccttgctgattatcggatgcagcaaaaccagagcggatttgatctgcgccatttcgttaacgtcaatttcaccctgccgaaagaaggcgagaaatatgttccgccagaggggcagtcactgcgcgaacatattgacggactttggccggtattaacgcgttctaccgaaaacaccgaaaaatgggattctctgttaccgctgccggaaccttatgtcgtgccgggcggacgttttcgcgaggtatattactgggacaattacttcaccatgttaggacttgccgaaagtggtcactgggataaagtcgcggatatggtggccaattttgctcatgaaataaacacttacggtcatattcccaacggcaaccgcagttactatttaagccgctcgcaaccgcccttctttgccctgatggtagagttactggcgcagcatgaaggcgatgccgcgttgaagcaatacctgccgcaaatgcaaaaagaatatgcttactggatggacggtgttgaaaacctgcaagccggacaacaggaaaaacgcgttgtaaaacttcaggatagtacccttctcaaccgctactgggacgatcgcgatacgccacgaccagagtcatgggtggaagatattgccaccgccaaaagcaatccgaatcgacctgccactgaaatttaccgcgacctgcgctctgccgctgcgtctggctgggatttcagctcgcgctggatggacaacccgcagcagttaaataccttacgcaccaccagcatcgtaccggtcgatctgaacagcctgatgtttaaaatggaaaaaatcctcgcccgcgccagcaaagctgcaggagataacgcgatggcaaaccagtacgaaacgctggcgaatgcccgtcaaaaagggatcgaaaaatacctgtggaacgatcaacaaggctggtatgccgattacgacctgaaaagtcataaagtgcgcaatcagttaaccgcggccgccctgttcccgctgtacgtcaatgcggcagcgaaagatcgcgccaacaaaatggcgacggcgacgaaaacacatctgctgcaacccggcggcctgaacaccacgtcggtgaaaagtgggcaacaatgggatgcgccaaatggctgggcaccgttacagtgggtcgcgacagaaggattacaaaactacgggcaaaaagaggtggcgatggacattagctggcacttcctgaccaatgttcagcacacctatgaccgggagaaaaagctggtggaaaaatatgatgtcagcaccaccggaacggggggcggcggtggcgaatatccattacaggatggctttggctggaccaatggcgtgacgctgaaaatgctggatttgatctgcccgaaagagcaaccgtgtgacaatgttccggcgacgcatccgaccgttaagtcagcaacgacgcaaccctcaaccaaagaggcacaacccacaccttaa

SEQ ID NO: 11695 - protein, 565 aa, Shigella flexneri
MKSPAPSRPQKMALIPACIFLCFAALSVQAEETPVTPQPPDILLGPLFNDVQNVKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDNYFTMLGLAESGHWDKVADMVANFAHEINTYGHIPNGNRSYYLSRSQPPFFALMVELLAQHEGDAALKQYLPQMQKEYAYWMDGVENLQAGQQEKRVVKLQDSTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATHPTVKSATTQPSTKEAQPTP

SEQ ID NO: 11696 - DNA, 1707 bp, Xanthomonas axonopodis
  CDS (1)..(1707)
atgccctacgccactgcccgttctggagatgtcatgagttctgccgcgcccccgtgctgcacgtcgctgcttggcctgtcgctgagcatgtttgttgcgccgggcacgctgaccgccgcgccgctggacgctccggtcgtcaatgcgccggcgcccacgccgcccacgcccgacctggcctacccggaactgtttcaggccgtgcagcgcggtgagttgttcgatgaccagaagcactttgtcgacttcctgccgctgcgcgacccggcgctgatcaacgccgactatctggcccagcacgatcaccccggcttcgatctgcgcaagttcgtggacgccaatttcgaagaatcgccgccggtgcagaccgatgcgatccgccaggacaccgcgctgcgcgagcacatcgacctgctgtggcccaagctggtgcgcagccagaaccacgtgccgccgcacagcagcctgctggcgctgccgcatccgtatgtggtgccgggcggacgcttccgcgaggtgtattactgggattcctacttcaccatgctgggcctggtgaagagcggcgaaaccacgctcagccgccagatgctggacaactttgcctacctgatcgacacctacgggcatattcccaacggcaaccgcacctactacctcagccgctcgcagccgccgttcttctcctacatggtggagctgcaggccggcgtggaaggcgaggcggtatatcagcgctacctgccgcagctgcaaaaggaatatgcctactggatgcagggcagcgatgacctgcagcccggccaggccgcgcgccacgtggtgcgtctggccgatggcagcgtgctcaaccgctattgggacgagcgcgacaccccgcgcccggaagcctggctgcacgacacccgcaccgccgcagaagtgaccgaccgcccggccgccgaggtctaccgcgacctgcgtgccggcgccgaaagtggctgggactacaccagccgctggctggccgacggccagaacctgcgcaccatccgtaccactgccatcctcccgatcgacctcaacagcctgctctaccacctggagcgcacgctggcgctggcctgcgcgcaacctggcgcggagtgcacccgcgattacgccgcacttgcacagcagcgcaagcaggccatcgacgcgcatctgtggaataccgccggctactacgccgactacgactggcagacgcgtacgctgagcaaccaggtcaccgccgctgcgctatacccgctgtttgccggcctggcctcggacgatcacgccaagcgcaccgccagcaccgtgcgtaaaacgctactgcgtccgggcggactggccaccaccgcagtgaagaccggtcagcagtgggatgagcccaacggctgggcgccgctgcaatgggtggctgtggatggcctgcggcgctacggcgaagacgcgctggcacgcaccattggcgaacgttttctggctcaagtgcaggcgctgttcgcacgcgagcacaagctggtcgaaaagtacggcctggaaaccgatgcggccggcggcggcggtggcgagtacgcgctgcaggacggcttcggctggaccaacggcgtcaccttgatgctgctgaacctgtatccgggcaaggacaccaaagccgcacccgccaagcgggtgcgcaagcccgaggcggccgcgcgctga

SEQ ID NO: 11697 - protein, 568 aa, Xanthomonas axonopodis
MPYATARSGDVMSSAAPPCCTSLLGLSLSMFVAPGTLTAAPLDAPVVNAPAPTPPTPDLAYPELFQAVQRGELFDDQKHFVDFLPLRDPALINADYLAQHDHPGFDLRKFVDANFEESPPVQTDAIRQDTALREHIDLLWPKLVRSQNHVPPHSSLLALPHPYVVPGGRFREVYYWDSYFTMLGLVKSGETTLSRQMLDNFAYLIDTYGHIPNGNRTYYLSRSQPPFFSYMVELQAGVEGEAVYQRYLPQLQKEYAYWMQGSDDLQPGQAARHVVRLADGSVLNRYWDERDTPRPEAWLHDTRTAAEVTDRPAAEVYRDLRAGAESGWDYTSRWLADGQNLRTIRTTAILPIDLNSLLYHLERTLALACAQPGAECTRDYAALAQQRKQAIDAHLWNTAGYYADYDWQTRTLSNQVTAAALYPLFAGLASDDHAKRTASTVRKTLLRPGGLATTAVKTGQQWDEPNGWAPLQWVAVDGLRRYGEDALARTIGERFLAQVQALFAREHKLVEKYGLETDAAGGGGGEYALQDGFGWTNGVTLMLLNLYPGKDTKAAPAKRVRKPEAAAR

SEQ ID NO: 11698 - DNA, 1707 bp, Xanthomonas campestris
  CDS (1)..(1707)
atgccgcacgcccccgcccgttctggagatgccatgagcgctgctgcgcccccgtgctgcacctcgttgcttggtctgtcgctgagcatgttcgttgcgccctgcgccctggcggccacgccgctggaaggtgcggtggtcagcgcgcccgcgcccacgccgcccacgcccgacctggcgtatccggagctgttccaggccgtgcagcgcggggagctgttcgacgaccagaagcatttcgtcgactttctgccgctgcgcgacccagccctgatcaacgccgactatctggcgcagcacgagcatgccggctttgacctgcgcaagttcgtggatgccaacttcgaggaatcgccgccggtacagaccgatgcgatccgccaggacaccgcgctgcgcgagcacatcgacgcgctgtggcccaagctggtacgcagccagaccaacgtgcccgcacacagcagcctgctggcgttgccgcacccgtacgtggtgccgggcggacgcttccgcgaggtgtattactgggattcgtacttcaccatgctggggctggtgaaaagtggcgaaaccacgctgagccggcagatgctggacaacttcgcctacctgatcgacacctacgggcacatccccaacggcaaccgcacctactacctgagccgctcgcagccgccgttattctcctacatggtggaactgcaggccggcgtggaaggcgaggcggtgtaccagcgctacctgccgcagctgcagaaggaatacgcgtactggatgcagggcggcgacgatctgcaacccggccaggccgcacgccatgtggtgcgcctggccgatggcagcgtgctcaatcgctattgggacgagcgcgataccccgcgcccggaagcctggctgcacgacacccgcaccgctgccgaggcgcatgaccgcccggccgccgatgtctaccgcgacctgcgcgccggcgccgaaagtggctgggactacaccagccgctggctggccgacggcaagacgctgagcaccatccgcaccaccgcgattgtgccgatcgatctcaacagcctgctgtatcacctggaacgcaccctggcgcaggcctgcgcgcacaccggcaccgcctgcagccaggactacgctgcgctcgcacagcagcgcaagcaggccatcgacgcgcacctgtggaatgcagccggctactacgccgactacgactggcagacccgcacgctgagcaaccaggtcaccgcggcggcgctgtacccgctgttcgccggcctggcttcggatgaccacgccaagcgcactgccaccagcgtgcgcgcccgcctgctgcgtcccggcggcctggccaccaccgcgttgaagaccggccagcagtgggacgaacccaacggctgggcgccattgcaatgggtggccgtggacggcctgcgtcgctacggcgaagacggcctggcccgcaccatcggcgagcgcttcctcacccaggtgcaggcgctattcgcgcgcgagcacaagctggtcgaaaaatacggcctggacgccgatgcagccggcggcggcggtggcgaatatgcattgcaggacggctttggctggaccaatggcgtcacgttgatgctgttgaacctgtacccctcacagggcgccacccaggctccggccaagaccaagcgcaagcccgagcccgccgctccctga

SEQ ID NO: 11699 - protein, 568 aa, Xanthomonas campestris
MPHAPARSGDAMSAAAPPCCTSLLGLSLSMFVAPCALAATPLEGAVVSAPAPTPPTPDLAYPELFQAVQRGELFDDQKHFVDFLPLRDPALINADYLAQHEHAGFDLRKFVDANFEESPPVQTDAIRQDTALREHIDALWPKLVRSQTNVPAHSSLLALPHPYVVPGGRFREVYYWDSYFTMLGLVKSGETTLSRQMLDNFAYLIDTYGHIPNGNRTYYLSRSQPPLFSYMVELQAGVEGEAVYQRYLPQLQKEYAYWMQGGDDLQPGQAARHVVRLADGSVLNRYWDERDTPRPEAWLHDTRTAAEAHDRPAADVYRDLRAGAESGWDYTSRWLADGKTLSTIRTTAIVPIDLNSLLYHLERTLAQACAHTGTACSQDYAALAQQRKQAIDAHLWNAAGYYADYDWQTRTLSNQVTAAALYPLFAGLASDDHAKRTATSVRARLLRPGGLATTALKTGQQWDEPNGWAPLQWVAVDGLRRYGEDGLARTIGERFLTQVQALFAREHKLVEKYGLDADAAGGGGGEYALQDGFGWTNGVTLMLLNLYPSQGATQAPAKTKRKPEPAAP

SEQ ID NO: 11700 - DNA, 2217 bp, Ashbya gossypii
  CDS (1)..(2217)
atgttgcaaggaatgcccaagcggagtgggtcaatcagcgagctgcacgacccattctcgagccctgatgtatactacggccccgcgacggacccgcggcggcagaagcagcccaataagtactcgcggacgcggacgatgagcatcatcgaaaacgtttcgaccttcaagagcgcggggaagcagtacaatatcaggcgccgaggctctgaggacgactctatgttggccagctcgggacaccgcaagttctacatcaaggacgttgacaagacgttggaggagctcttggagagcgaggacacagacggcaactaccagataacgattgaggaccgcggtccgaaaacattgcgggtcggcaccgccaactccaacgggttccggcacgtgcagatcagaggcacgtacatgctctccaacttgttgcaggagttgaccatcgcaaaaaattttgggcggaagcaagtgattctcgatgaggcccgcttgaacgaagatccggttaatcgtctcacgcgattgatcacgcatcagttctgggactccttgacccggagaattgactacaacagtattgccgccatcgcggcagatactaaggtcgacacccctggcgcgaaggtgccgcggatttacgtgccccatggctgccccgagcagtacgagtatttcattgagtgctcccagttgaacccctcattgaacctcgaggtaaagtacttgccggatgtgatcacgccggagcacgtgcaatcattgaacgaaagcccggggttgcttgctttggcgatggagagtcacagggacccaattaccggtgagagtacattggttggttttccctacgttgttccgggcggtcgttttaatgaactttacggctgggactcatacctaatggctttgggtcttctagactgtaacaaagtggacatagcacgtgggatggttgagcatttcatctttgagatagagcattacggtaaaatattgaacgccaataggagctactacctctgtcggtcacaacccccgttcctaaccgacatggctttgaaggtcttcgaaaagttcggtggtgaccaaaatcctaccgctgtggatttcttgaaaagagcattcatcgcagccattaaggaatacaagagtgtatggatggcagaaccgcggtacgacaaaaccacgggtctttcatgttatcatccagatggtatcggtttcccaccagaaaccgagcctgaccactttgacgcaatttgccggaaatttgcggaaaagcacaatgtaacgattccggagttcaggtgcatgtacgatgccggcgaagtacacgagcccgaactagatgagttctttttgcatgatcgtgctgtacgtgagagtggacatgacacctcttaccgtctagagaacgtctgtgcttacttagcgacgattgatttgaattcgttactatacaagtacgaaaaagatattgcatatgtggtttccaagtacttcgatgatagtattactgattatgctggtgaaaccaccacttcttctcattgggaggcacttgcagacattcgtaagcaaagaatcacgaaatatttgtgggacgaggaaacaggctttttctatgactacaatgtccatattggaaagagaacatcttacgattctgcaacaacattttgggccatgtgggcaggcttggcaacccaggaacaagccaacgctatggtcgagaaggcattgccaaggcttgaaatgctaggaggcctggttgcctgtactgaggagtctcggggtgagataacaatgaatagaccaagcaggcaatgggattacccttatggttgggcccctcatcaaatgcttgcttggaccgggttagataattacggatttacaggagttgcaagaaggttggcctataggtggttatttttaatgaccaaggcatttgtcgactacaatggtatcgtagtagagaaatacgacgttaccagaggcacagatcctcatagagttgatgccgaatatggtaaccaaggtgcagactttaaaggtgttgctactgaaggatttggctgggtcaattccagttatatcttaggtttgaaatttatgaatacttatgctaagagagctttagctaactgcaccgtccctgatattttctttaagcatatgaagccagaagagaaagctcggtatgccttgatctga

SEQ ID NO: 11701 - protein, 738 aa, Ashbya gossypii
MLQGMPKRSGSISELHDPFSSPDVYYGPATDPRRQKQPNKYSRTRTMSIIENVSTFKSAGKQYNIRRRGSEDDSMLASSGHRKFYIKDVDKTLEELLESEDTDGNYQITIEDRGPKTLRVGTANSNGFRHVQIRGTYMLSNLLQELTIAKNFGRKQVILDEARLNEDPVNRLTRLITHQFWDSLTRRIDYNSIAAIAADTKVDTPGAKVPRIYVPHGCPEQYEYFIECSQLNPSLNLEVKYLPDVITPEHVQSLNESPGLLALAMESHRDPITGESTLVGFPYVVPGGRFNELYGWDSYLMALGLLDCNKVDIARGMVEHFIFEIEHYGKILNANRSYYLCRSQPPFLTDMALKVFEKFGGDQNPTAVDFLKRAFIAAIKEYKSVWMAEPRYDKTTGLSCYHPDGIGFPPETEPDHFDAICRKFAEKHNVTIPEFRCMYDAGEVHEPELDEFFLHDRAVRESGHDTSYRLENVCAYLATIDLNSLLYKYEKDIAYVVSKYFDDSITDYAGETTTSSHWEALADIRKQRITKYLWDEETGFFYDYNVHIGKRTSYDSATTFWAMWAGLATQEQANAMVEKALPRLEMLGGLVACTEESRGEITMNRPSRQWDYPYGWAPHQMLAWTGLDNYGFTGVARRLAYRWLFLMTKAFVDYNGIVVEKYDVTRGTDPHRVDAEYGNQGADFKGVATEGFGWVNSSYILGLKFMNTYAKRALANCTVPDIFFKHMKPEEKARYALI

SEQ ID NO: 11702 - DNA, 2247 bp, Emericella nidulans
  CDS (1)..(2247)
atggacgactcggcactaccttcaaacacctcgaacgggattaacggtcgcaccgcccatcgacggtccagttccggtggtgatccttttcaacacccagatatctactatggaaaccccgagtctgttgaacggatcaagaaccgccgacgtgcgttctcttcgagcttgaaatcgttcaaccggcaagacttccatgaaatgctgggtgaccgtaatacgagacgtggtagcatggacccaacgtctggcaaccccaggaaattccttatcgatgtcgacgctactcttcatagtctgcttgagagagaggattcggacaggaacatgcagatcaccatcgaggatgttggccctaaggtgcggacagctgcatcccatggttacaacaggttcgacgtgcgaggcacatatatgctgtcgaacctcctccaagaattaacaattgctaaagattatgggcgtaaacagattgtccttgatgaggaacgtctttccgagaatcctgtctctcggctttcccgacttatcaagaactctttctggaactctctaactagaagaattgacgggcgtaatatcgaggtggctggaagggatcccaaggattggactgacgatcctcggccgcgtatttatgttccacccggtgctcccgaacagttggagtactacaggagaatcgcggaagagaagcctgaactgcgtcttgatgttcaggaattggctgcggaaatcacaccggaatatgtgcgagacttgaatgagaagcccgggctgctcgcattggccatggaggagaaatacgatgaaaagaccgggaagaccgacttcgctggagttcccttcgtggtcccaggagggcgattcaacgagctttacgggtgggatagctacatggaatcgctggggcttctggctagcaacagggtcgaccttgccaaagccatggtgataaatttctgcttctgcattaagcattatggaaagattctcaacgccaaccggtcgtactatctgacacgatcccaaccacctttcctaactgatatggctttacgtgtgtacgaccgcatccagaatgaaccaggcgccatggatttccttcgccacgcaattctagcagccatcaaggagtactacagtgtttggatggctgagccgcgtctagaccctgtgtcgggcctgtcaagataccgctcaccgggtattggagtacctcctgagacggaggcctctcacttcctccatcttctcaccccgtatgccgagaaacatggtatggaattcaaagagtttgtccaggcctacaactacggcaaagtcaaggagccggaactggacgaatacttcatgcacgacagagctgttagagaatctggacacgacaccagttaccgtttggagagagtctgcggcaatcttgccactgttgacctgaactctctcttatacaagtatgaggtcgatattgcgcgagtaatacgcgtctacttcaaggacaagctcgagattccggtcgagttccgaacaccagccaccaaggatatccaaagcgaatcatcatctgtgtgggaccgccgggcgcgcagaagaaagatgaggatggacacctacctctgggatgaagaaaagggaatgtactttgattacgacacggtcaaacaagaacggaccaactatgagagcgccacgactctctgggcaatgtgggctgggcttgtcacgccacgccaggcttctgcaatgatcaccaaggcacttccccgcttcgaggagtttggtggaattgtctcgggcactgaagagtctcgtggtgctgttggactaaaccgacctactcggcagtgggattacccatacggatgggcgccgcagcagatgctcgcgtggaccgggttcgcccgttacggatatcaggaagaggccgagcgacttgcatacaagtggctctacatgatcactaaggcgttcgttgacttcaacggcgtcgtcgtcgagaaatacgatgtgacccgacccattgaccctcaccgcgttgatgccgagtatggcaaccagggcgtcgacttcaagggcgcccctcgcgaagggttcggttgggtcaatgcaagctacgtttacggcctggaaatgctcaacgcccatcagcgacgtgctcttggtgcggtcactccatgggagacgtacagcaaggctgtttctgcgcagggtagtgacaccgttcttgaaaacagatctgagtga

SEQ ID NO: 11703 - protein, 748 aa, Emericella nidulans
MDDSALPSNTSNGINGRTAHRRSSSGGDPFQHPDIYYGNPESVERIKNRRRAFSSSLKSFNRQDFHEMLGDRNTRRGSMDPTSGNPRKFLIDVDATLHSLLEREDSDRNMQITIEDVGPKVRTAASHGYNRFDVRGTYMLSNLLQELTIAKDYGRKQIVLDEERLSENPVSRLSRLIKNSFWNSLTRRIDGRNIEVAGRDPKDWTDDPRPRIYVPPGAPEQLEYYRRIAEEKPELRLDVQELAAEITPEYVRDLNEKPGLLALAMEEKYDEKTGKTDFAGVPFVVPGGRFNELYGWDSYMESLGLLASNRVDLAKAMVINFCFCIKHYGKILNANRSYYLTRSQPPFLTDMALRVYDRIQNEPGAMDFLRHAILAAIKEYYSVWMAEPRLDPVSGLSRYRSPGIGVPPETEASHFLHLLTPYAEKHGMEFKEFVQAYNYGKVKEPELDEYFMHDRAVRESGHDTSYRLERVCGNLATVDLNSLLYKYEVDIARVIRVYFKDKLEIPVEFRTPATKDIQSESSSVWDRRARRRKMRMDTYLWDEEKGMYFDYDTVKQERTNYESATTLWAMWAGLVTPRQASAMITKALPRFEEFGGIVSGTEESRGAVGLNRPTRQWDYPYGWAPQQMLAWTGFARYGYQEEAERLAYKWLYMITKAFVDFNGVVVEKYDVTRPIDPHRVDAEYGNQGVDFKGAPREGFGWVNASYVYGLEMLNAHQRRALGAVTPWETYSKAVSAQGSDTVLENRSE

SEQ ID NO: 11704 - DNA, 2825 bp, Neurospora crassa
  CDS (173)..(2359)
cggcacgagattccatcgagcacctgtacaacaaacggcgactttgtccgactcacaaagccttatctctttccctctcgctccaaacaaagacatcttcaacatcgaacccgctcgtcttgactgttctccgcatctcgaaacaaacaaacattttcgggagacaaacaagatgacttcccagccttcttcaggcaaaggccggggtcgcaacctgtcgatcgacgagtacaatgtctatgacgacgcgaagacatactataccaccgaggaccgccatcacaaccaccgcgctggagccagaacccgcacctactctcagaacagcttgttcaagcagtttgaacgtctaggccttcagaaggagccctaccgcagaggcagccatgacgagtcaacgatcccgcaatcccgccgattccttatccaggtcgagcccacgctgcagagtctgcaatcgcaggaggacacggatggcaacatgcagatcaccatcgaggacaacgggccaaaggtcctgtccctcagaaccgctgcatccaatggctacaaccgattcgacatccgtggcacttacatgctctccaaccttcttcaggagctttacctcgccaaggaatacggtcgcaagcagattatcctcgatgaggctagactcaacgagaaccccgtgaaccgactttcgcgactgatcaaagaccacttctgggagggtctaacacgccgcattgatgcttccagcattgaaatcgctgcgcgggatcccaaggactggactgacgatccccgaccccgcatttacatccccagaggagcaccggaacaacacgagtattataccaaggtggccttggacaggcctgagcttcgcctggatgttcaatatcttcccgagaagatcacccccgagattgttcgggacatgaatgccaagcctggcctgctggcggtagatatggaagaagtggttgatcccaagaccggtgaaaagactctacgcggccgccctttcgtggtgcccggaggtcgcttcaacgagctgtacggatgggacagctacatggagtctctcggtttgctggtcaacgatcgggttgatctggccaagtccatggtgcaaaacttttgtttctgcatcaagcactacggcaagatcctcaacgctactcgttcctactacctttgccgatcgcagccccccttcctaacggatatgactctgcgcgtctatgacaagatcaagcacgaaccgggtgcgcttgaattccttcgccaatctctgttggccgccatcaaggaatactatagcgtctggacagctgagcctcgccttgaccctgtgactggtctctccaggtaccgccctgaaggccttggcgtccctcccgagaccgaggctggccacttcatccatattcttgagccctatgccaagaagcacaacatgagctttgacgagtttgtgtacgcttacaaccacggtgagatcaaggagcccacgctcgacgactacttcatgcacgacagagctgttcgtgagtccggccacgataccacataccgcttcgaaggtatctgcgctgatctggccaccatcgatctcaattcgctcctgttcaagtatgagaccgacattgcgcgtacaattcgcaacgtcttccacgacaagtttgaggtgccggatgactggctcgctaccaacaaccccgctgctagcaagctcgagacatcggcaatgtgggatcgccgtgccaagcgcagaaagctggccattgacaagtacctgtggaacgaagaggcgggcatgtacttcgactacaacacggccacgcgcaagcagtgcaactatgaaagtgccaccactttctgggccctgtgggcgggtgtcagcaaccccaagcaggcagctgccatggtgaccaaggccttgcccaagttggaggcttttggtggtctgctttctggaacaaaggagtctcgtggtgagattggtctagagcgccctaaccgtcaatgggattacccttacggctgggcgccgcagcaaattcttgcttggacaggtctctaccggtacggctttaacgaggaagcggagcgcctggcctacaagtggctgtttatgattaccaaggcgtttgtggacttcaacggcgtcgtggtggagaagtatgatgtgacgaggcccattgacccacacagagtcgatgccgagtacggcaaccaagggttggatttcaagggagttgccaaagaaggtttcggatgggtcaacgccagttatgtctacggcctgcagatcgttaacgcgcatatgcgccgtgcgctcggcactctgactccctacgaaactttatgaaggccgtcgaggagaatcggaacaaggcgctctctgagctcgtttgatctggtttcggctaccctattttcaacgacacggttatctttccatcgaagcgtctgttagcctgcagccttttggctttcgcaatttccattattcggcgtttaggtttcgtattgactgctggcgcggctttttccatcagattacatagtcagatcggttcttgacaaggggggcgacgaacaggagctagattagagaagtcacatcaggaaagagaaggtactatgatggtatatgcataccactgcgtgttgctgagagagaagactgaaaagcacgcgagttgtgttgctcatgttttgctttaagggctgcaaacattccaagagacggacctcgacctgaacggtcagttagtagtagtagtatagataggcaaatcactacctgatgaaagaaaaaaaaaaaaaaaaaa

SEQ ID NO: 11705 - protein, 728 aa, Neurospora crassa
MTSQPSSGKGRGRNLSIDEYNVYDDAKTYYTTEDRHHNHRAGARTRTYSQNSLFKQFERLGLQKEPYRRGSHDESTIPQSRRFLIQVEPTLQSLQSQEDTDGNMQITIEDNGPKVLSLRTAASNGYNRFDIRGTYMLSNLLQELYLAKEYGRKQIILDEARLNENPVNRLSRLIKDHFWEGLTRRIDASSIEIAARDPKDWTDDPRPRIYIPRGAPEQHEYYTKVALDRPELRLDVQYLPEKITPEIVRDMNAKPGLLAVDMEEVVDPKTGEKTLRGRPFVVPGGRFNELYGWDSYMESLGLLVNDRVDLAKSMVQNFCFCIKHYGKILNATRSYYLCRSQPPFLTDMTLRVYDKIKHEPGALEFLRQSLLAAIKEYYSVWTAEPRLDPVTGLSRYRPEGLGVPPETEAGHFIHILEPYAKKHNMSFDEFVYAYNHGEIKEPTLDDYFMHDRAVRESGHDTTYRFEGICADLATIDLNSLLFKYETDIARTIRNVFHDKFEVPDDWLATNNPAASKLETSAMWDRRAKRRKLAIDKYLWNEEAGMYFDYNTATRKQCNYESATTFWALWAGVSNPKQAAAMVTKALPKLEAFGGLLSGTKESRGEIGLERPNRQWDYPYGWAPQQILAWTGLYRYGFNEEAERLAYKWLFMITKAFVDFNGVVVEKYDVTRPIDPHRVDAEYGNQGLDFKGVAKEGFGWVNASYVYGLQIVNAHMRRALGTLTPYETL

SEQ ID NO: 11706 - DNA, 1650 bp, Salmonella typhimurium
  CDS (1)..(1650)
atgctcaaccagaaattaaaccccacgccttctgaagatctgactattgatgtcgatctgctttatgaaacagacccgtgcgagttaaagctggatgaaatgatcgaggcggaaccggagccggagatgatcgaggggcttcccgcctctgacgccctgacccctgccgatcggtatctcgaactgttcgagcatgtacagtcaacaaaactgtttccagacagtaaaacgttcccggactgcgcgccgaagatggacccgcttgatatcctgatccgctaccgtaaggtcagacgccaccgtgattttgacttacgccgcttcgtcgagaaccatttctggctaccggaaaccttatccagcgagtatgtctctaatcccgaaaactcgctcaaagaacatattgaccagctttggccgatactgacgcgcgaaccgcaggatcatattccgtggtcttcgctgctggcgctgccgcaatcctatatcgtgccgggaggccgttttagcgaaacctattattgggactcttattttaccatgctgggtctggcggaaagcgggcgcgaagacttacttaaatgtatggcggataatttcgcctggatgattgaaaactatggccatattcccaacggcaaccggacctattatctgagccgttcgcagccgccggtttttgccctgatggttgaactgttcgaagaagatggcgtgcgcggcgcgcggcgttatctcgaccatctcaaaatggaatacgccttctggatggacggcgccgaatcgctggcgctcaaccaggcttatcgccacgttgtgcggatgccggacggttccctgctgaaccgctactgggacgatcgcgacacgccgcgcgacgagtcgtggctggaagatgtcgaaactgcaaaacactccggtcgtccgcccaatgaagtctaccgggatttgcgcgccggggcggcgtccggctgggactattcttcacgctggctacgcgatgcgggccggcttgccagcatacgtacgacccagtttatccctatcgatttgaacgcttttctgtataaactggagagcgctatcgccaatatttcagcactgaaaggcgaacgtgacaccgaggcgctatttcgccagaaagccagcgatcgacgcgccgccgtgaaccattatctgtgggatgatgaaaacggctgttatcgggactatgactggcgacgcgaagaaatggcgctcttttccgccgccagtatcgtgccgctgtatgtcggtatggcgaaccacgagcaggccgaccgtctggcaaatgtggtacgcagccgtctgttaacgcccggcgggattatggcgaccgaatacgaaaccggcgaacagtgggataaaccgaacggctgggcaccgctgcaatggatggcgattcagggcttcaaacggtatggcgacgatatgctgggcgatgaaatcgcccataactggttaaaaacagtgaaccatttttatcaggagcaccataaactgatcgagaaataccatatttccggcggtacgccccgcgaaggcggcgggggcgagtatccgctacaggacgggttcggctggaccaatggcgtggtgcgccgcctgattggcctttacggagagccttaa

SEQ ID NO: 11707 - protein, 549 aa, Salmonella typhimurium
MLNQKLNPTPSEDLTIDVDLLYETDPCELKLDEMIEAEPEPEMIEGLPASDALTPADRYLELFEHVQSTKLFPDSKTFPDCAPKMDPLDILIRYRKVRRHRDFDLRRFVENHFWLPETLSSEYVSNPENSLKEHIDQLWPILTREPQDHIPWSSLLALPQSYIVPGGRFSETYYWDSYFTMLGLAESGREDLLKCMADNFAWMIENYGHIPNGNRTYYLSRSQPPVFALMVELFEEDGVRGARRYLDHLKMEYAFWMDGAESLALNQAYRHVVRMPDGSLLNRYWDDRDTPRDESWLEDVETAKHSGRPPNEVYRDLRAGAASGWDYSSRWLRDAGRLASIRTTQFIPIDLNAFLYKLESAIANISALKGERDTEALFRQKASDRRAAVNHYLWDDENGCYRDYDWRREEMALFSAASIVPLYVGMANHEQADRLANVVRSRLLTPGGIMATEYETGEQWDKPNGWAPLQWMAIQGFKRYGDDMLGDEIAHNWLKTVNHFYQEHHKLIEKYHISGGTPREGGGGEYPLQDGFGWTNGVVRRLIGLYGEP

SEQ ID NO: 11708 - DNA, 1650 bp, Shigella flexneri
  CDS (1)..(1650)
atgctcaatcagaaaattcaaaaccctaatccagacgaactgatgatcgaggtcgatctctgctatgaactggacccgtatgaattaaaactggatgagatgatcgaggcagaaccggaacccgagatgattgaagggctgcccgcctctgatgcgctgacgcctgccgatcgctatctcgaactgttcgagcatgttcagtcggcgaaaattttccccgacagtaaaacctttcccgactgcgcacccaaaatggacccgctggatattttaatccgctaccgtaaagtgcgccgtcatcgtgattttgacttgcgcaagtttgttgaaaatcacttctggctgccggaggtctactccagcgagtatgtatcggacccgcaaaattccctgaaagagcatatcgaccagctgtggccggtgctaacccgcgaaccacaggatcacattccgtggtcttctctgctggcgctaccgcagtcatatattgtcccgggcggccgttttagcgaaacctactattgggattcctatttcaccatgctgggactggcggaaagtggtcgggaagatttgctgaaatgcatggccgataacttcgcctggatgatcgaaaactacggtcacatccccaacggcaaccgcacctattatttgagccgctcgcaaccaccggtttttgcgctgatggtggagttgtttgaagaagatggtgtacgcggtgcgcgccgctatctcgaccaccttaaaatggaatatgccttctggatggacggtgcagaatcgttgatccctaatcaggcctatcgccatgttgtgcggatgccggacggatcgctgctcaaccgttactgggacgatcgcgacacgccgcgtgacgaatcctggcttgaggacgttgaaaccgcgaaacattctggtcgcccgcccaacgaggtgtaccgcgatttacgcgcgggagcggcctccggttgggattactcttcccgttggctgcgtgatactggtcgtctggcgagcattcgtaccacccagttcatccccatcgatctgaatgccttcctgtttaaactggagagcgccatcgccaacatctcggcgctgaaaggcgagaaagagacagaagcgctgttccgccagaaggccagtgcccgtcgcgatgcggtaaaccgttacctctgggatgatgaaaacggcatctaccgcgattacgactggcgacgcgaacaactggcgctgttttccgctgccgccattgtgccgctctatgtcggcatggcgaaccatgaacaggccgatcgtctggcaaacgccgtacgcagccggttactgacacctggcgggattttggcaagcgagtacgaaaccggtgaacagtgggataaacccaacggctgggcaccgttacaatggatggcaattcagggatttaaaatgtatggcgatgaccttctgggtgatgaaatcgcgcgcagctggctgaaaacggtgaatcagttctatctggaacagcacaaaatgatcgagaaataccatattgccgatggtgttccccgcgaaggcggcggtggcgagtatccgttgcaggatgggtttggctggactaacggtgtggtacgccgtttaattggtttgtacggcgaaccataa

SEQ ID NO: 11709 - protein, 549 aa, Shigella flexneri
MLNQKIQNPNPDELMIEVDLCYELDPYELKLDEMIEAEPEPEMIEGLPASDALTPADRYLELFEHVQSAKIFPDSKTFPDCAPKMDPLDILIRYRKVRRHRDFDLRKFVENHFWLPEVYSSEYVSDPQNSLKEHIDQLWPVLTREPQDHIPWSSLLALPQSYIVPGGRFSETYYWDSYFTMLGLAESGREDLLKCMADNFAWMIENYGHIPNGNRTYYLSRSQPPVFALMVELFEEDGVRGARRYLDHLKMEYAFWMDGAESLIPNQAYRHVVRMPDGSLLNRYWDDRDTPRDESWLEDVETAKHSGRPPNEVYRDLRAGAASGWDYSSRWLRDTGRLASIRTTQFIPIDLNAFLFKLESAIANISALKGEKETEALFRQKASARRDAVNRYLWDDENGIYRDYDWRREQLALFSAAAIVPLYVGMANHEQADRLANAVRSRLLTPGGILASEYETGEQWDKPNGWAPLQWMAIQGFKMYGDDLLGDEIARSWLKTVNQFYLEQHKMIEKYHIADGVPREGGGGEYPLQDGFGWTNGVVRRLIGLYGEP

SEQ ID NO: 11710 - DNA, 27 bp, Primer
atggtagattttttaccaaaagtaacg

SEQ ID NO: 11711 - DNA, 28 bp, Primer
ttataggtaatacaattttttctcagag

SEQ ID NO: 11712 - DNA, 2772 bp, Saccharomyces cerevisiae; identical to SEQ ID NO: 2477
  CDS (1)..(2772)

SEQ ID NO: 11713 - protein, 923 aa, Saccharomyces cerevisiae; identical to SEQ ID NO: 2478

SEQ ID NO: 11714 - DNA, 2296 bp, Rattus norvegicus (Norway rat); identical to SEQ ID NO: 2479
  CDS (63)..(2039)

SEQ ID NO: 11715 - protein, 658 aa, Rattus norvegicus (Norway rat); identical to SEQ ID NO: 2480

SEQ ID NO: 11716 - DNA, 2255 bp, Homo sapiens (man); identical to SEQ ID NO: 2481
  CDS (102)..(2078)

SEQ ID NO: 11717 - protein, 658 aa, Homo sapiens (man); identical to SEQ ID NO: 2482

SEQ ID NO: 11718 - DNA, 4377 bp, Rattus norvegicus (Norway rat); identical to SEQ ID NO: 2483
  CDS (103)..(2424)

SEQ ID NO: 11719 - protein, 773 aa, Rattus norvegicus (Norway rat); identical to SEQ ID NO: 2484

SEQ ID NO: 11720 - DNA, 2300 bp, Mus musculus (house mouse); identical to SEQ ID NO: 2485
  CDS (69)..(2045)

SEQ ID NO: 11721 - protein, 658 aa, Mus musculus (house mouse); identical to SEQ ID NO: 2486

SEQ ID NO: 11722 - DNA, 2013 bp, Saccharomyces cerevisiae; identical to SEQ ID NO: 2487
  CDS (1)..(2013)

SEQ ID NO: 11723 - protein, 670 aa, Saccharomyces cerevisiae; identical to SEQ ID NO: 2488

SEQ ID NO: 11724 - DNA, 2064 bp, Saccharomyces cerevisiae; identical to SEQ ID NO: 2489
  CDS (1)..(2064)

SEQ ID NO: 11725 - protein, 687 aa, Saccharomyces cerevisiae; identical to SEQ ID NO: 2490

SEQ ID NO: 11726 - DNA, 1941 bp, Caenorhabditis elegans; identical to SEQ ID NO: 2491
  CDS (1)..(1941)

SEQ ID NO: 11727 - protein, 646 aa, Caenorhabditis elegans; identical to SEQ ID NO: 2492

SEQ ID NO: 11728 - DNA, 2415 bp, Emericella nidulans; identical to SEQ ID NO: 2493
  CDS (1)..(2415)

SEQ ID NO: 11729 - protein, 804 aa, Emericella nidulans; identical to SEQ ID NO: 2494

SEQ ID NO: 11730 - DNA, 2601 bp, Debaryomyces hansenii; identical to SEQ ID NO: 2495
  CDS (1)..(2601)

SEQ ID NO: 11731 - protein, 866 aa, Debaryomyces hansenii; identical to SEQ ID NO: 2496

SEQ ID NO: 11732 - DNA, 1899 bp, Debaryomyces hansenii; identical to SEQ ID NO: 2497
  CDS (1)..(1899)

SEQ ID NO: 11733 - protein, 632 aa, Debaryomyces hansenii; identical to SEQ ID NO: 2498

SEQ ID NO: 11734 - DNA, 2259 bp, Debaryomyces hansenii; identical to SEQ ID NO: 2499
  CDS (1)..(2259)

SEQ ID NO: 11735 - protein, 752 aa, Debaryomyces hansenii; identical to SEQ ID NO: 2500

SEQ ID NO: 11736 - DNA, 2244 bp, Yarrowia lipolytica; identical to SEQ ID NO: 2501
  CDS (1)..(2244)

SEQ ID NO: 11737 - protein, 747 aa, Yarrowia lipolytica; identical to SEQ ID NO: 2502

SEQ ID NO: 11738 - DNA, 2598 bp, Kluyveromyces lactis; identical to SEQ ID NO: 2503
  CDS (1)..(2598)

SEQ ID NO: 11739 - protein, 865 aa, Kluyveromyces lactis; identical to SEQ ID NO: 2504

SEQ ID NO: 11740 - DNA, 2079 bp, Kluyveromyces lactis; identical to SEQ ID NO: 2505
  CDS (1)..(2079)

SEQ ID NO: 11741 - protein, 692 aa, Kluyveromyces lactis; identical to SEQ ID NO: 2506

SEQ ID NO: 11742 - DNA, 2034 bp, Kluyveromyces lactis; identical to SEQ ID NO: 2507
  CDS (1)..(2034)

SEQ ID NO: 11743 - protein, 677 aa, Kluyveromyces lactis; identical to SEQ ID NO: 2508

SEQ ID NO: 11744 - DNA, 1989 bp, Candida glabrata; identical to SEQ ID NO: 2509
  CDS (1)..(1989)

SEQ ID NO: 11745 - protein, 662 aa, Candida glabrata; identical to SEQ ID NO: 2510

SEQ ID NO: 11746 - DNA, 2856 bp, Candida glabrata; identical to SEQ ID NO: 2511
  CDS (1)..(2856)

SEQ ID NO: 11747 - protein, 951 aa, Candida glabrata; identical to SEQ ID NO: 2512

SEQ ID NO: 11748 - DNA, 2052 bp, Ashbya gossypii; identical to SEQ ID NO: 2513
  CDS (1)..(2052)

SEQ ID NO: 11749 - protein, 683 aa, Ashbya gossypii; identical to SEQ ID NO: 2514

SEQ ID NO: 11750 - DNA, 2535 bp, Ashbya gossypii; identical to SEQ ID NO: 2515
  CDS (1)..(2535)

SEQ ID NO: 11751 - protein, 844 aa, Ashbya gossypii; identical to SEQ ID NO: 2516

SEQ ID NO: 11752 - DNA, 1830 bp, Neurospora crassa; identical to SEQ ID NO: 2517
  CDS (1)..(1830)

SEQ ID NO: 11753 - protein, 609 aa, Neurospora crassa; identical to SEQ ID NO: 2518

SEQ ID NO: 11754 - DNA, 2388 bp, Candida albicans; identical to SEQ ID NO: 2519
  CDS (1)..(2388)

SEQ ID NO: 11755 - protein, 795 aa, Candida albicans; identical to SEQ ID NO: 2520

SEQ ID NO: 11756 - DNA, 2418 bp, Aspergillus fumigatus; identical to SEQ ID NO: 2521
  CDS (1)..(2418)

SEQ ID NO: 11757 - protein, 805 aa, Aspergillus fumigatus; identical to SEQ ID NO: 2522

SEQ ID NO: 11758 - DNA, 2757 bp, Neurospora crassa; identical to SEQ ID NO: 2523
  CDS (1)..(2757)

SEQ ID NO: 11759 - protein, 918 aa, Neurospora crassa; identical to SEQ ID NO: 2524

SEQ ID NO: 11760 - DNA, 2239 bp, Drosophila melanogaster; identical to SEQ ID NO: 2525
  CDS (76)..(2079)

SEQ ID NO: 11761 - protein, 667 aa, Drosophila melanogaster; identical to SEQ ID NO: 2526

SEQ ID NO: 11762 - DNA, 3100 bp, Saccharomyces cerevisiae; identical to SEQ ID NO: 2527
  CDS (821)..(2887)

SEQ ID NO: 11763 - protein, 688 aa, Saccharomyces cerevisiae; identical to SEQ ID NO: 2528

SEQ ID NO: 11764 - DNA, 2266 bp, Xenopus tropicalis; identical to SEQ ID NO: 2529
  CDS (36)..(2012)

SEQ ID NO: 11765 - protein, 658 aa, Xenopus tropicalis; identical to SEQ ID NO: 2530

SEQ ID NO: 11766 - DNA, 25 bp, Primer
atgtcaagcggcagtactattgttt

SEQ ID NO: 11767 - DNA, 25 bp, Primer
ttattgatctaaggtcgccaccttt

SEQ ID NO: 11768 - DNA, 1479 bp, Saccharomyces cerevisiae
  CDS (1)..(1479)
atgtcaaaggcagtaggtgatttaggcttagttggtttagccgtgatgggtcaaaatttgatcttaaacgcagcggatcacggatttaccgtggttgcttataataggacgcaatcaaaggtagataggtttctagctaatgaggcaaaaggaaaatcaataattggtgcaacttcaattgaggacttggttgcgaaactaaagaaacctagaaagattatgcttttaatcaaagccggtgctccggtcgacactttaataaaggaacttgtaccacatcttgataaaggcgacattattatcgacggtggtaactcacatttcccggacactaacagacgctacgaagagctaacaaagcaaggaattctttttgtgggctctggtgtctcaggcggtgaagatggtgcacgttttggtccatctttaatgcctggtgggtcagcagaagcatggccgcacatcaagaacatctttcaatctattgccgccaaatcaaacggtgagccatgctgcgaatgggtggggcctgccggttctggtcactatgtgaagatggtacacaacggtatcgagtacggtgatatgcagttgatttgcgaggcttacgatatcatgaaacgaattggccggtttacggataaagagatcagtgaagtatttgacaagtggaacactggagttttggattctttcttgattgaaatcacgagggacattttaaaattcgatgacgtcgacggtaagccattggtggaaaaaattatggatactgccggtcaaaagggtactggtaaatggactgcaatcaacgccttggatttaggaatgccagtcactttaattggggaggctgttttcgctcgttgtttgtcagccataaaggacgaacgtaaaagagcttcgaaacttctggcaggaccaacagtaccaaaggatgcaatacatgatagagaacaatttgtgtatgatttggaacaagcattatacgcttcaaagattatttcatatgctcaaggtttcatgctgatccgcgaagctgccagatcatacggctggaaattaaacaacccagctattgctctaatgtggagaggtggctgtataatcagatctgtgttcttagctgagattacgaaggcttatagggacgatccagatttggaaaatttattattcaacgagttcttcgcttctgcagttactaaggcccaatccggttggagaagaactattgcccttgctgctacttacggtattccaactccagctttctctactgctttagcgttttacgacggctatagatctgagaggctaccagcaaacttgttacaagcgcaacgtgattattttggcgctcatacatttagaattttacctgaatgtgcttctgcccatttgccagtagacaaggatattcatatcaattggactgggcacggaggtaatatatcttcctcaacctaccaagcttaa

SEQ ID NO: 11769 - protein, 492 aa, Saccharomyces cerevisiae
MSKAVGDLGLVGLAVMGQNLILNAADHGFTVVAYNRTQSKVDRFLANEAKGKSIIGATSIEDLVAKLKKPRKIMLLIKAGAPVDTLIKELVPHLDKGDIIIDGGNSHFPDTNRRYEELTKQGILFVGSGVSGGEDGARFGPSLMPGGSAEAWPHIKNIFQSIAAKSNGEPCCEWVGPAGSGHYVKMVHNGIEYGDMQLICEAYDIMKRIGRFTDKEISEVFDKWNTGVLDSFLIEITRDILKFDDVDGKPLVEKIMDTAGQKGTGKWTAINALDLGMPVTLIGEAVFARCLSAIKDERKRASKLLAGPTVPKDAIHDREQFVYDLEQALYASKIISYAQGFMLIREAARSYGWKLNNPAIALMWRGGCIIRSVFLAEITKAYRDDPDLENLLFNEFFASAVTKAQSGWRRTIALAATYGIPTPAFSTALAFYDGYRSERLPANLLQAQRDYFGAHTFRILPECASAHLPVDKDIHINWTGHGGNISSSTYQA

SEQ ID NO: 11770 - DNA, 1467 bp, Treponema pallidum subsp. pallidum (syphilis spirochete)
  CDS (1)..(1467)
atgggcgcagacattgggttcattggacttgctgtcatgggagagaatctggttctcaacattgagcgcaacggtttttccgtcgcagttttcaatcgcaccaccacggtggtcgaccgatttcttgcagggcgcgctcatggcaagcgaatcaccggcgcccactccattgcagaacttgtttcacttttggcacgtccacgcaaaatcatgctcatggtcaaagcaggcagcgcagtcgatgcggtcattgaccagatactgccccttctagaaaagggggacctcgttatcgacggtggcaactctcattaccaggataccatccggcgcatgcatgcgctagaggccgcaggtattcatttcattggcacaggagtttcggggggagaagagggggccctccgtggaccgtccctcatgcctggaggctctgctcaggcttggccgttggtttctcccattttctgtgccattgccgccaaagccgacgatggcaccccgtgctgcgactgggtcggcagtgatggcgccgggcactacgtgaaaatgattcacaacggcattgagtacggcgacatgcagataatcgccgagggctactggtttatgaagcatgcgctgggcatgagctatgagcacatgcaccatacgtttacccgctggaacacgggccgcttacactcgtacctgattgagattaccgcggctattctggcacatcaggacacagacggcacaccacttttagagaaaattctagatgccgctggacagaaggggacgggcaggtggacgtgtgttgcagcgctcgaagaaggcagcccgcttacactgatcacagagtcagtgatggcgcgtagtctttctgcgcaaaagcaagcgcgctgcaaggcacatcgcgtttttggttctcccgtgaaagtctccaaagcagaaacgctaagtgcacagcagcgcgaagaactggtgtctgcactggaagacgcgctgtattgcgcgaaaatagtctcgtatgcgcagggttttgagctgttatcgcatacggcaaagcgccgaggatggacactggatttttcccggattgcatcgctgtggcgtggcgggtgtattattcgttcaggattcctgtccaagatcagtgcggcgtttgctcagcagcacgatctagagaatttggtacttgctccctttttcgcagaggaattaaagcgtgcgtgtccaggctggcgcaccatagtggcagaatcggtacggcaggcgttgccagttccggccctctctgctgcgttagcctggtttgatgggttcaccggtgctgctttgccggccaacctccttcaggcacagcgagattattttggtgcgcacacctacgagcgcacagatgcgccgagaggagagttttttcacacaaactggacaggcaccggcggtgataccattgcaggaacctactcaatatag

SEQ ID NO: 11771 - protein, 488 aa, Treponema pallidum subsp. pallidum (syphilis spirochete)
MGADIGFIGLAVMGENLVLNIERNGFSVAVFNRTTTVVDRFLAGRAHGKRITGAHSIAELVSLLARPRKIMLMVKAGSAVDAVIDQILPLLEKGDLVIDGGNSHYQDTIRRMHALEAAGIHFIGTGVSGGEEGALRGPSLMPGGSAQAWPLVSPIFCAIAAKADDGTPCCDWVGSDGAGHYVKMIHNGIEYGDMQIIAEGYWFMKHALGMSYEHMHHTFTRWNTGRLHSYLIEITAAILAHQDTDGTPLLEKILDAAGQKGTGRWTCVAALEEGSPLTLITESVMARSLSAQKQARCKAHRVFGSPVKVSKAETLSAQQREELVSALEDALYCAKIVSYAQGFELLSHTAKRRGWTLDFSRIASLWRGGCIIRSGFLSKISAAFAQQHDLENLVLAPFFAEELKRACPGWRTIVAESVRQALPVPALSAALAWFDGFTGAALPANLLQAQRDYFGAHTYERTDAPRGEFFHTNWTGTGGDTIAGTYSI

SEQ ID NO: 11772 - DNA, 1443 bp, Chlamydia trachomatis
  CDS (1)..(1443)
atggctccaaatacagatattgggttgattggtttggccgtgatgggcaaaaaccttgtattgaacatggtggatcatggtttttctgtttctgtctataaccgaagtccggcgaaaacagaagagttcttgaaagatcatggagagagtggagctctgcaaggatttactacgattcaagagtttgttcaatctttgaagcgtcctcgtaagatcatgatcatgattaaagcgggagctcctgttgatgaaatgattgcctccctgcttcctttcttggaagagggagatattctcatcgatggggggaatagctattatttagattctgagcaacgctatgtcgacctgaaaaaagaaggaattctatttgttgggatgggagtctctggaggggaagagggggctagaaaagggccttccattatgcccggagggaatatagatgcttggcctgcaatcgctcctatctttcaatccatagctgctcaggtggatggacgaccctgttgctcttggattggcacaggaggtgcagggcattttgttaaggctgttcacaatgggatcgaatacggggatatccagttaatttgtgaaacatatgagattcttaagactcgtcttaatctctctttagagcagatagggaatatcttttttgaatggaatcaaaccgatctgaatagctacctcattggagcagcagcggccgttttaatagcaaaagatgagaatggcaatgcgattgcttctacgattcttgatgttgctggacagaaggggactgggcgttgggtcgcagaggacgctattaaggcaggcgttcctatgtccctaattattgaatcggtcttagctcgatacctttcgacttggaaagaagtgcgcacaaaggcagctcaagagtttccagggattcctcttctctgtcaacctccacaagaagcttctgccttcattgaggatgtgcgagaggctttgtatgcagctaagattatcagttacgctcaaggatttatgctgctgaagcaggtctctcaagataaaggatgggatctgaatttaggtgagttagctttgatatggcgtgggggttgcattatacaaagtgcctttttagataaaattcatcaaggttttgaaaatagtccagaagcacactctttgatattacaagattattttaaaaaggttctgtttgattcagaaacaggtttccggcgagctgttttgcatgctatcggatctggtgtagctattccttgcttatcttctgcactatctttttatgatggatatcgtacggtggattcatctttattcttagtgcaaggattaagagattactttggagctcatggttatgagcgtcgagactgtcctcgaggggagttttatcatacggattggctagaaaccaagaaaacttttagagtataa

SEQ ID NO: 11773 - protein, 480 aa, Chlamydia trachomatis
MAPNTDIGLIGLAVMGKNLVLNMVDHGFSVSVYNRSPAKTEEFLKDHGESGALQGFTTIQEFVQSLKRPRKIMIMIKAGAPVDEMIASLLPFLEEGDILIDGGNSYYLDSEQRYVDLKKEGILFVGMGVSGGEEGARKGPSIMPGGNIDAWPAIAPIFQSIAAQVDGRPCCSWIGTGGAGHFVKAVHNGIEYGDIQLICETYEILKTRLNLSLEQIGNIFFEWNQTDLNSYLIGAAAAVLIAKDENGNAIASTILDVAGQKGTGRWVAEDAIKAGVPMSLIIESVLARYLSTWKEVRTKAAQEFPGIPLLCQPPQEASAFIEDVREALYAAKIISYAQGFMLLKQVSQDKGWDLNLGELALIWRGGCIIQSAFLDKIHQGFENSPEAHSLILQDYFKKVLFDSETGFRRAVLHAIGSGVAIPCLSSALSFYDGYRTVDSSLFLVQGLRDYFGAHGYERRDCPRGEFYHTDWLETKKTFRV

SEQ ID NO: 11774 - DNA, 1410 bp, Thermotoga maritima
  CDS (1)..(1410)
atgaaatctcatattggtctcatcggtcttgctgtgatgggtcagaatcttgcactgaacattgcgaggaaaggctacaaagtttcggtttacaacagaacagcacagagaacggaggaatttgtgaaaaatcgtgtaacgaatgaagagatagaacctcattacgatatcgaaagcttcgtgaagtctctcgaaagaccaagaaagataatcttaatggtaaaggcaggaaaacccgtggatgatacgatttctcagcttcttcctcacctcgaaccaggtgatttgataatagacggtggtaattcccattacatggataccgaaagacgcttcaaggaactctctgaaaagggaatacttttcctcggtatgggagtttctggtggtgagtacggggctcttcacgggccttctctcatgcctgggggaagtagagaagcgtacaacctggttgaggagattcttttggaaatagcagcgaaaacagaggatggaccatgctgtacatacgttggtgaaagatcagcgggccactttgtgaagatggttcacaacggcatagaatacgccatcatgcaggcgatagcggaagtttatcacattatgagagatgttttgagcctatcatctgaagaaatgtccagtatctttgaagagtggaacagaggagaactcagctcgttcctggtggagatcacctacaagattttgagaaagaaagatgaagaaacaggaaaaccgatggtcgatgtgattctggacaaggcggaacaaaagggaactggaaagtggacatcccaagcagcccttgacctcggaatacctaccccttccataaacctggcggtggttgaaagggtgatttcccatttcaaagacataagaacaaggctttcgaaactgtataataagagaagaagcgctactcagggtagcgaggaatttttgagagatctccgaaactctctcttctttgccatgttcatggccttttctcagggcatgtggttgatcgcagaagcatcgaaagagttcggctatggggtgagcctctcggaggtgctcagaatatggaagggtggatgtatcataagggcgaagttgatagacacactcagaaggtacatatctaacgagaacgcgtatttgctggagaacgaagaagtgatgaatctattgaaaggcaaaatcgattctctaaagaacatattgaaggcgtccatagagaacgaaatccccgttcctgttttgagttcctcttacaactacttcatgagtcttaccgaagagagactgccggcgaatctcatacaggctcaaagagacttcttcggagcacacacttttgagagagtagacagagaaggtgtgttccacatcaactgggaggaaggagagataggatga

SEQ ID NO: 11775 - protein, 469 aa, Thermotoga maritima
MKSHIGLIGLAVMGQNLALNIARKGYKVSVYNRTAQRTEEFVKNRVTNEEIEPHYDIESFVKSLERPRKIILMVKAGKPVDDTISQLLPHLEPGDLIIDGGNSHYMDTERRFKELSEKGILFLGMGVSGGEYGALHGPSLMPGGSREAYNLVEEILLEIAAKTEDGPCCTYVGERSAGHFVKMVHNGIEYAIMQAIAEVYHIMRDVLSLSSEEMSSIFEEWNRGELSSFLVEITYKILRKKDEETGKPMVDVILDKAEQKGTGKWTSQAALDLGIPTPSINLAVVERVISHFKDIRTRLSKLYNKRRSATQGSEEFLRDLRNSLFFAMFMAFSQGMWLIAEASKEFGYGVSLSEVLRIWKGGCIIRAKLIDTLRRYISNENAYLLENEEVMNLLKGKIDSLKNILKASIENEIPVPVLSSSYNYFMSLTEERLPANLIQAQRDFFGAHTFERVDREGVFHINWEEGEIG

SEQ ID NO: 11776 - DNA, 1107 bp, Deinococcus radiodurans
  CDS (1)..(1107)
atggttatgaaaatcggcatgatcgggctgggcaagatgggcggcaatatggtgattcgcctcaagaacggcgggcaggacgtggtcggttttgaccgcagccaggaagcgattgaccacctcgtgtcgcagggggtcgcggcggacgcgctgacgagtgacatggaccgttttatcgagctgctcggcgaacccggtcagcgagcggtgtgggtgatggtcccggcgggccagattacccagtcggtcatcgacgacctcgcgggccgcctcagcgcgggcgacgtgattatcgacggcggcaactccaactttcacgacacccagcgccggggcgaggctctggcggccaagggcctgcacttcgtggacgtgggcacttccggcggggtgtggggcatcaccgagggctatggcatgatggtgggcggccccgacgagggtgtggagcgcatccgcccggcgctggaagctctggcgcccgcgcccgaccggggctggggccacatggggccgaccggcagcgggcactacgtcaagatggttcacaacggtatcgagtacggcatgatgcaggcctacgccgagggcttcgagctgatgaaggcgcaccagaccttcaacctcgacatggctcagattgccgaagtgtggcgtcacggcacggtgattcgctcgtggctgctcgacctgaccgccgaggccctgaaaaacagcgccgacttcgaccagctctccgactacgtggccgattcgggcgagggccgctggacgattatcgactccatcgaactcggcgtgccgaccccggtgattacgctcgccacccagatgcgcttccgcagccagcaggacgtgagctaccagggccagatgctctcggccatgcgccgcgcgttcggcgggcacgcggttaagacgctggaagcaaccaagcaggaaagcgtggtgccagcggtcaaacccggcgaaagccccaaggccgccgcgcccgagaacatccccaccgccgccgcgcagcccagcatcagcggacgcagcgaagcgcaggaactcggtgaaaccgggcagcagcgcaccaccggcgaccagaaggcgggcgaatga

SEQ ID NO: 11777 - protein, 368 aa, Deinococcus radiodurans
MVMKIGMIGLGKMGGNMVIRLKNGGQDVVGFDRSQEAIDHLVSQGVAADALTSDMDRFIELLGEPGQRAVWVMVPAGQITQSVIDDLAGRLSAGDVIIDGGNSNFHDTQRRGEALAAKGLHFVDVGTSGGVWGITEGYGMMVGGPDEGVERIRPALEALAPAPDRGWGHMGPTGSGHYVKMVHNGIEYGMMQAYAEGFELMKAHQTFNLDMAQIAEVWRHGTVIRSWLLDLTAEALKNSADFDQLSDYVADSGEGRWTIIDSIELGVPTPVITLATQMRFRSQQDVSYQGQMLSAMRRAFGGHAVKTLEATKQESVVPAVKPGESPKAAAPENIPTAAAQPSISGRSEAQELGETGQQRTTGDQKAGE

SEQ ID NO: 11778 - DNA, 1440 bp, Chlamydia muridarum, Chlamydia trachomatis MoPn
  CDS (1)..(1440)
atggctccagcagatattgggttgattggtttggccgtaatgggcaaaaaccttgtgttgaatatgattgatcacggttttgctgtctctgtctataaccgcagtccagagaaaacggaagagttcttgaaggagcatggagagaatatatctcttcaagggtttactgccatcgaagagttcgttcaatctttgaaacgtcctcggaagattatgattatgattaaggcgggagctcctgttgatgaaatgatttcctcgctacttccctttttagaagagggggatattctcattgatggggggaatagctattatctggattctgagcgtcgctacattgatctcaaaaagaaagggattttatttgtcggcatgggggtctctggaggagaagaaggggctcgtaaaggaccttctattatgcccggagggaatattgaagcttggcctgttatcgctcctatttttcaatcaatagctgctcaggttgatggacagccttgttgctcttggattggtacaggaggagcgggtcattttgttaaagccgttcataatggtatagaatatggggatattcagttaatctgtgaaacctatgagattcttaaatctcggcttgatttgtctcttgaacagataggaaacatcttctttgagtggaatcaaacggatttaaatagctatcttatgggagcttcagcagctgttttaacagcaaaagatgagaatggagttgctgtggcttcgactattttggatgtagctgggcagaaaggtactgggcgttgggttgcggaagatgcgattaaggcaggtgttcctatgtcgcttatcatagagtctgttttagctcgttatctctcggcttggaaggaggtgcgtagacaagctgctcgagaattccctgtagcttctcttctttatcaaccttcgcaagaggcctcggtcttgatcgaagatgcaagagaagctctttacgcagcaaagattattagttatgcccaaggcttcatgctattaaagcagatctctgaagaaaggaattgggatcttaatttaggagagcttgctttgatatggcgcggcggatgtattatccaaagtgctttcttggataaaattcaccaagggtttgagagttgcccggatgcacactctttgatgttacaagattatttcaaaaacgttttgttgaactcagaaactggttttcgccgagctattttacatgctgttggagctggtgtagcaattccttgtttagcttctgccttagctttttacgatgggtatcggacggaaaactctccattattcttagttcaaggattaagagattattttggggctcatggttatgagcggcaagatcgtcctcgcggggagttttatcatacggattggttaggaagcaaaaacgcttcccggatgtaa

SEQ ID NO: 11779 - protein, 479 aa, Chlamydia muridarum, Chlamydia trachomatis MoPn
MAPADIGLIGLAVMGKNLVLNMIDHGFAVSVYNRSPEKTEEFLKEHGENISLQGFTAIEEFVQSLKRPRKIMIMIKAGAPVDEMISSLLPFLEEGDILIDGGNSYYLDSERRYIDLKKKGILFVGMGVSGGEEGARKGPSIMPGGNIEAWPVIAPIFQSIAAQVDGQPCCSWIGTGGAGHFVKAVHNGIEYGDIQLICETYEILKSRLDLSLEQIGNIFFEWNQTDLNSYLMGASAAVLTAKDENGVAVASTILDVAGQKGTGRWVAEDAIKAGVPMSLIIESVLARYLSAWKEVRRQAAREFPVASLLYQPSQEASVLIEDAREALYAAKIISYAQGFMLLKQISEERNWDLNLGELALIWRGGCIIQSAFLDKIHQGFESCPDAHSLMLQDYFKNVLLNSETGFRRAILHAVGAGVAIPCLASALAFYDGYRTENSPLFLVQGLRDYFGAHGYERQDRPRGEFYHTDWLGSKNASRM

SEQ ID NO: 11780 - DNA, 909 bp, Lactococcus lactis subsp. lactis
  CDS (1)..(909)
atgatgaaatttggtatgattggtttagggaaaatgggaatgaatcttgtgaaaaatgccgttgaccatgagattgaagttgttgcttacgatctaaatacaaaagcggtagaggaagctaaggattactcagacaaaattaccgctgtcagcacaattgaaaatttactgacagaattgccagcaagcaaaattgtttggttgatgcttccggcaggaactcctacaaattcaacgattgaaatgctttctgaaaagttgtcagctggagatattctgatagacggtggaaattctaattacaaagataatttagaacaaaataaattactgacagaaaaaggaattaaattttttgatgttggaacctctggtggaatggctggagctcgtcaaggcgggaattttatgattggtggagatgatgaaaaatcttggacaatcatagaaccaatcttcaaagcaatctcaatggaagagggctacctctatacagggaaacttggcagtggtcattacttgaaaatgattcataatggaattgaatatgggatgatgcaagcgatcgctgaaggatttgaaattttggaagagtcaccatttgattatgactatgaagccgttgcaaaattatggaatcacggctcagtaatccgaagctggttgatggagcttgctcaagaacaattttcaaaagaccctaaactagaccaaattatcggtcatgttcaatcttcaggagaaggaaaatggaccgttgaagaaagcttggacttaggtgttcctgccccagttattgccttgtcactaatgatgcgtcaacgctcattacaagaagataccatgaccggaaaagtagttgccgctttgcgcaatggctttggcggacatgacgtagaacaaaaataa

SEQ ID NO: 11781 - protein, 302 aa, Lactococcus lactis subsp. lactis
MMKFGMIGLGKMGMNLVKNAVDHEIEVVAYDLNTKAVEEAKDYSDKITAVSTIENLLTELPASKIVWLMLPAGTPTNSTIEMLSEKLSAGDILIDGGNSNYKDNLEQNKLLTEKGIKFFDVGTSGGMAGARQGGNFMIGGDDEKSWTIIEPIFKAISMEEGYLYTGKLGSGHYLKMIHNGIEYGMMQAIAEGFEILEESPFDYDYEAVAKLWNHGSVIRSWLMELAQEQFSKDPKLDQIIGHVQSSGEGKWTVEESLDLGVPAPVIALSLMMRQRSLQEDTMTGKVVAALRNGFGGHDVEQK

SEQ ID NO: 11782 - DNA, 1431 bp, Nostoc sp. PCC 7120
  CDS (1)..(1431)
atgacactacaaagctttggtgtgattggtttagccgttatgggcgagaatatcgctctaaacgtggagcgtaatggcttcccaattgcagtttataaccgttccagagaaaaaaccgatgctttcatggcacagcgtgctggtggacgcaacgttaaagctgcttttaccctggaagagtttgtcgccgcactagaacgtccccgcaagattctggtgatggtgcaagctggtaaaccagtggatgcagtaattcagcagctcaaacctctactagatgaaggcgatatcatcatcgacggtggcaactcttggtttgaagatacccaaagacggactcaagaactagaaccagcaggcttacgcttcctggggatgggtgtcagtggtggtgaagaaggcgcacttaatggcccttcactgatgcccggtggtacacaaagttcttacgagtatctgtccccaattttcaacaaaattgctgctcaagttgatgatggcccttgtgtaacttatgttggccctggtggttccggtcactacgtcaaaatggtacacaacggtattgagtatggcgatatgcagttgattgcagaagcctacgacttgctgaaaaatgctggtgggctgaatgctaaacagctacatgaagtattcacagaatggaatactaccgacgaactcaattctttcttgattgagattacagccaacatcttcccctacatcgacccagagaccaagttacctttggtggatttgattgttgatgcagccggtcaaaagggaactggacgctggactgtacaaactgctttggaattgggtgtttctatccctaccattacagcagccgtgaatgctcggattatctcttccattcgagatgaacggattgctgcatctaagcagttgacaggccccagtggcaaatatgatggcgataccaaagagtttatcaacaaagtccgggatgcactttactgctccaagatttgttcttatgctcaagggatggcgctgttatctacagcctcagccacatttaattggaatttgaatctgagtgaaatggcgcggatttggaaaggtggttgtattattcgcgctggcttcttgaataagattaagaaggcatttaacgaaaatcccgcattacccaacttgctactcgctcctgaatttaaacaaacaattctcgacagacaagcagcttggcgggaagtaatcatcactgcggcaaaactcggaatcccagtacccgcatttagcgcatccttggattattttgacagctatcgccgcgatcgcctaccccaaaacctcacccaggcacaacgcgactacttcggcgcacacacctacttgcgtaccgataaagctggcgctttccacactgaatgggttcctatcgctgaagcgaagaaataa

SEQ ID NO: 11783 - protein, 476 aa, Nostoc sp. PCC 7120
MTLQSFGVIGLAVMGENIALNVERNGFPIAVYNRSREKTDAFMAQRAGGRNVKAAFTLEEFVAALERPRKILVMVQAGKPVDAVIQQLKPLLDEGDIIIDGGNSWFEDTQRRTQELEPAGLRFLGMGVSGGEEGALNGPSLMPGGTQSSYEYLSPIFNKIAAQVDDGPCVTYVGPGGSGHYVKMVHNGIEYGDMQLIAEAYDLLKNAGGLNAKQLHEVFTEWNTTDELNSFLIEITANIFPYIDPETKLPLVDLIVDAAGQKGTGRWTVQTALELGVSIPTITAAVNARIISSIRDERIAASKQLTGPSGKYDGDTKEFINKVRDALYCSKICSYAQGMALLSTASATFNWNLNLSEMARIWKGGCIIRAGFLNKIKKAFNENPALPNLLLAPEFKQTILDRQAAWREVIITAAKLGIPVPAFSASLDYFDSYRRDRLPQNLTQAQRDYFGAHTYLRTDKAGAFHTEWVPIAEAKK

SEQ ID NO: 11784 - DNA, 1410 bp, Brucella melitensis
  CDS (1)..(1410)
atggaaaaagcagatatcggaatggtcggccttggcgtcatgggctccaacctggcgctgaacatagccgagaagggctacaccgtggccgtctatgaccgtgatgagcctgtgctgaaagctttcatcgaaaaggctggccggctgcgcgacaagatcattccctgcccgacctttgaggaactggccgcgaatatccgcaagccccgtccgatcatctttctcatcaaggccggtgcgccagtcgataccgagaccacccgccttaaggcattccttgagaagggcgatatcatgatcgatgcaggcaattccgattatcgcgatacggtgcgccgcctgaaggctcttggccccaatgatccgacctttgtcggcatgggcgtttcgggtggggcggaaggcgcgcgccatggtccgtcgatgatggtcggcggcacggagcaggcctatgagcgcatcgcgccgatcctgcttgctgtcgccgccaaatatcagggcgagccctgctgtgcgctggtcggcccggatggcgcgggtcatttcgtcaaaaccatccataacggtattgaatatgccgatatgcagatgatcgccgaaatttacggcattctgcgcgatggccttggcctttcagctccggccatcggcgatgtgttcgagaagtggaacgaaggtccgctcaattcctatctgattgaaatcaccgccaaggttctcaagtccaccgacccggaaaccggcaaggcgatggtcgatatgatccttgatgaagccggccagaagggtacaggccgctgggctgccattgaggcgcagatactgggcgttcctgccacgggcatcgaagccgcggttgccgcccgttcgctgtcctccatgaagggcgagcgggaagaggccgacaaggcgtataaatccggtgcacgcacacttgatattgccaaccagacccgcttcctttccgatctggaacagggcttgctggcgggcaagatcgccgcttatgcgcaaggctttgcagtgatggaagccgcctcaagggagcatggctggaacattccgcttgccaccacggcgcgcatctggcgcgcgggctgcatcatccgctcgcagcttctggatgatattgcgcaggcttttgaaggcaatgaaagccgcaacctgctcatggccccggccttcgtgccgcgcatggaaacatctgtgaaaagccttcgccagattgtcgcgcaggccgcccttgccagcctgccgctgcccgcgctcggctctgcgctcagctatttcgacagctatacgcaggcgcttggtacggccaatctcattcagggccagcgcgatttcttcggctcgcacggcttcaagcgcattgacaaggagggggatttccacggcccctggggctga

SEQ ID NO: 11785 - protein, 469 aa, Brucella melitensis
MEKADIGMVGLGVMGSNLALNIAEKGYTVAVYDRDEPVLKAFIEKAGRLRDKIIPCPTFEELAANIRKPRPIIFLIKAGAPVDTETTRLKAFLEKGDIMIDAGNSDYRDTVRRLKALGPNDPTFVGMGVSGGAEGARHGPSMMVGGTEQAYERIAPILLAVAAKYQGEPCCALVGPDGAGHFVKTIHNGIEYADMQMIAEIYGILRDGLGLSAPAIGDVFEKWNEGPLNSYLIEITAKVLKSTDPETGKAMVDMILDEAGQKGTGRWAAIEAQILGVPATGIEAAVAARSLSSMKGEREEADKAYKSGARTLDIANQTRFLSDLEQGLLAGKIAAYAQGFAVMEAASREHGWNIPLATTARIWRAGCIIRSQLLDDIAQAFEGNESRNLLMAPAFVPRMETSVKSLRQIVAQAALASLPLPALGSALSYFDSYTQALGTANLIQGQRDFFGSHGFKRIDKEGDFHGPWG

SEQ ID NO: 11786 - DNA, 1407 bp, Salmonella enterica subsp. enterica serovar Typhi
  CDS (1)..(1407)
atgtccaagcaacagatcggcgtcgtcggtatggcagtgatggggcgcaacctcgcgctcaacatcgaaagccgtggttataccgtctccgttttcaaccgctcccgtgaaaagaccgaagaagtgattgccgagaatcccggcaaaaagctggtgccttattacacggtgaaagagtttgttgaatccctcgaaacgcctcgtcgtatcctgttaatggtgaaagcgggtgcaggtactgatgcagctatcgattcgctgaaaccgtatctggaaaaaggcgatatcattattgatggcggtaacaccttcttccaggacacaatccgtcgcaatcgcgagctgtctgcggaaggttttaactttatcggtaccggtgtttccggtggtgaagagggcgcgctgaaagggccatctatcatgcctggcggtcagaaagatgcctatgaactggtggcgccgatcctgacgaagattgctgctgtggcagaagatggcgaaccgtgcgtgacctatatcggcgccgatggcgcgggtcactacgttaagatggtccacaatggtattgaatatggcgatatgcagcttatcgctgaagcttactccttgctgaaaggcggcctgaatctcagcaatgaagagttggcgaacacttttactgagtggaataacggcgagctgagcagttatctgatcgacatcactaaagacatcttcactaaaaaagatgaagacggtaattacttgatagatgttattcttgatgaagccgccaacaaagggaccggtaaatggaccagccagagcgcgctggatctgggcgaaccgctgtcgctgattaccgaatccgtctttgcgcgttacatctcttcgctgaaagcgcaacgtgttgccgcatctaaagtgctctccgggccgaaagcgcagccggcgggcgacaaagcggaatttatcgagaaagtgcgtcgcgcgctgtatcttggcaagatcgtctcctatgcgcagggcttctcgcagctacgcgccgcgtctgatgaatatcactgggagcttaactacggcgagattgctaagattttccgtgcgggctgtatcattcgcgctcagttcctgcagaagatcaccgatgcttacgcagaaaacgccggtatcgctaacttgctgttagcgccttacttcaagaaaattgctgatgagtaccagcaggcgctgcgtgatgttgtggcttacgcggtgcagaatggcattccggtgccgacattctctgcggcagtggcctactatgacagctatcgcgccgcagtactgccagctaacttaattcaggcgcagcgtgactactttggtgcgcacacctataaacgtactgataaagaaggcattttccataccgagtggttggaataa

SEQ ID NO: 11787 - protein, 468 aa, Salmonella enterica subsp. enterica serovar Typhi
MSKQQIGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLIDVILDEAANKGTGKWTSQSALDLGEPLSLITESVFARYISSLKAQRVAASKVLSGPKAQPAGDKAEFIEKVRRALYLGKIVSYAQGFSQLRAASDEYHWELNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRTDKEGIFHTEWLE

SEQ ID NO: 11788 - DNA, 1431 bp, Agrobacterium tumefaciens
  CDS (1)..(1431)
atggaacaggcagaaatcggtttgatcggtctcggcgtcatgggctcgaacctggcgttgaacatcgcagaaaagggcaacaagattgccgtattcaaccgaaccccggaagttacacgaaaattctacgctgatgcgggcgaactgcagggtcagatcattccctgcgaaaccatcgaggaattcgtcgccgccattcgtcctccgcgcccgatcatcatcatgatcaaggcaggcgatccggtcgaccagcagatggaaatcctgaaaccgcatctggccaacggcgacatcatgatcgatgccggcaatgccaacttccgcgatacgatccgccgtttcgataacctcaaggatagcggcctgacctttatcggcatgggcgtttccggcggtgaagaaggtgcgcgccatggaccgtcgatcatggttggcggcaccgaggatagctggaagcgcgtcgaaaaggttctgacctccatttccgccaagtataatgacgatccgtgcgtggcatggctcggcaatgacggtgctggtcatttcgtcaagaccatccataacggcatcgaatatgccgacatgcagatgattgccgaaatctacggcatcctgcgtgatggcctgaaaatgagcgccgtcgagatcgccgacgtgtttgccgaatggaacaagggccgcctgaattcctacctgatcgaaatcaccgagaaggttctgcgcgctgccgatccgatcaccggcaagccgatggtcgatctgatcctcgacaaggccggccagaagggcacaggcaagtggtcggtcatcgaagcccagaacatgggcgtcgctgcaaccgccatcgaggcggccgtggctgcccgtatcctgtcgtcgcagaaggatgagcgtgaagctgccgagaagatcttcggcctgccgaccctcgcagcggcccccgccgacaaaaaggccttcatcgccgatctggaaagcgcgcttctggccgccaaggtcggtgcttacgcccagggcttcgccatcatgtcggctgcttcgaaggagttcaactggaacctgccgatgccgacgattgcccgcatctggcgcgccggctgcatcatccgctcggaattccttgatgagatcacctcggcctttaccaaggatccgcatgtggccaacctcatcgtgacgccggccttctccgccatcgtcaaggataccgacgcgccgctgcgccgtgtggtgtcttacgccgtgctctccggtctgccggtttcggcgcttgcttcggcgctcggttatttcgacgcctatcgccgtggtcgcggcagcgccaacctcattcaggcacagcgcgatttcttcggtgcacatggttttgaacgcaccgatggtgtggacaagccgcacggcccatggggtagcggcgccgatattttttga

SEQ ID NO: 11789 - protein, 476 aa, Agrobacterium tumefaciens
MEQAEIGLIGLGVMGSNLALNIAEKGNKIAVFNRTPEVTRKFYADAGELQGQIIPCETIEEFVAAIRPPRPIIIMIKAGDPVDQQMEILKPHLANGDIMIDAGNANFRDTIRRFDNLKDSGLTFIGMGVSGGEEGARHGPSIMVGGTEDSWKRVEKVLTSISAKYNDDPCVAWLGNDGAGHFVKTIHNGIEYADMQMIAEIYGILRDGLKMSAVEIADVFAEWNKGRLNSYLIEITEKVLRAADPITGKPMVDLILDKAGQKGTGKWSVIEAQNMGVAATAIEAAVAARILSSQKDEREAAEKIFGLPTLAAAPADKKAFIADLESALLAAKVGAYAQGFAIMSAASKEFNWNLPMPTIARIWRAGCIIRSEFLDEITSAFTKDPHVANLIVTPAFSAIVKDTDAPLRRVVSYAVLSGLPVSALASALGYFDAYRRGRGSANLIQAQRDFFGAHGFERTDGVDKPHGPWGSGADIF

SEQ ID NO: 11790 - DNA, 1005 bp, Agrobacterium tumefaciens
  CDS (1)..(1005)
atgcagatcggaatggttgggcttggaagaatgggcgcaaacatggtgcgacggcttttgaaacagggtcatgattgcgtggttttcgacgtcaatcccgacaacgttgcgccattggtgaaggaaggcgctaccggtgccacctcgccggacgatcttgttgcgaagctgtctccgccgcgcgccgtctggctgatgctgccggcggccatcacgccgaaaattgcccgagattttgccgccagacttcaggccggcgatgccatcatcgatggcggaaattcgaactatcgcgacgcgatcgatctcgccgccgaatttgcgcctcgcggcattgatttcatcgataccggcacatccggtggcatctgggggctggagcgcggttattcgttgatgatcggcggcccggtggctgcggtccagcgtctcgacccgatcttcgcctcccttgcgcccggcgcaggtctgggcatcgccgccgacccggtcaccggaacggcaccgatgggatatctgcattgcggtccatcgggagccgggcatttcgtcaagatggtccacaatggcatcgaatatggtgtcatggcagcctatgccgaaggtctcaacatcttgaaagccgccaatgcgggcacgcaacaccgcgaggcggacgccgaaacagcccctctcgcccatccgcaatattaccagttcgacattgatcttcccgccgtcacggaggtctggcggcacggctccgtcatcggctcgtggctgcttgacctcacggcgcaggccctgaaacaggacccgaacctcgatcaatatggtgggcgcgtgtcggattccggtgaaggacgctggaccctgcaggcggccgtcgaaaccggcgtgccggcccccgttttggcatcggcccttttcgagcgtttttcctcacgcggcgaggccgaatttgccggcaaggtgctgtcggccatgcgcaatgcctttggtggccatctggagaaagccaaatga

SEQ ID NO: 11791 - protein, 334 aa, Agrobacterium tumefaciens
MQIGMVGLGRMGANMVRRLLKQGHDCVVFDVNPDNVAPLVKEGATGATSPDDLVAKLSPPRAVWLMLPAAITPKIARDFAARLQAGDAIIDGGNSNYRDAIDLAAEFAPRGIDFIDTGTSGGIWGLERGYSLMIGGPVAAVQRLDPIFASLAPGAGLGIAADPVTGTAPMGYLHCGPSGAGHFVKMVHNGIEYGVMAAYAEGLNILKAANAGTQHREADAETAPLAHPQYYQFDIDLPAVTEVWRHGSVIGSWLLDLTAQALKQDPNLDQYGGRVSDSGEGRWTLQAAVETGVPAPVLASALFERFSSRGEAEFAGKVLSAMRNAFGGHLEKAK

SEQ ID NO: 11792 - DNA, 1419 bp, Listeria monocytogenes
  CDS (1)..(1419)
atggcaaaacaagaaattggcgttataggaatgggcgttatgggtcgtaacttggctctaaacattgaaagccgcggtcatacagtatctatctttaaccgctcgactgaaaaaacgaaagcagttatggaagagaatgcggacaaaaaattagtaccaacttatagtttagaggaatttgtcgaatctcttgaagtgcctcgccgtatccttattatggtaaaagctggcgatgctacagatatgatgattgaagcagttaaacctttcttaaacgaaggcgatattttaattgatggcggtaatgctttcttcaaagatacgattcgtcgtaataaagaactaagtgaagaaggatttaatttcatcggaactggtgtatcaggcggagaagagggcgcgctgaaaggtccttctatcatgccaggtggtcaacgcaaggcatatgaccttgtagcccctattttacgtgaaattgctgcagtagcagacggagagccatgtgtgacttacattggtccagacggtgccggacattacgttaaaatggtgcataatggtatcgaatacggcgatatgcaattaatcgcagaagcttacactattttgaaagaaatcggcggattaagccatgatgaacttgctgacgtatttgaagaatggaataacggggaacttgatagctatttaatcgagatcactaaaaacatcctaaaagtaaaagacgaagaaacaggcaaaccaattgtcgatgttattctggataaagctggtcaaaaaggaactggtaaatggactagccaaagcgcacttgacttaggtgttccgctttccttaattacagaatctgtatttgctcgttacatttctgcactcaaagaagaacgcgtttatgcaagtactgttttaactgggccatcgaattatcgttttgaaggcgacaaaaaagcatttgttgaatctgttcgtcgcgcactttactttagcaaaatcgcatcttatgcacaaggttttgctcaaatgagagctgctagcgaagagtacaattgggatttacaatacggcgaaatcgcgaaaattttccgcgctggctgtattatccgtgctcgtttcctacaaaaaattacagatgcttataaccaagataaaaatcttaaaaacttactacttgatccatatttcaaagatattgcacataactaccaaggcgaccttcgtacagttgttgcagaagcagtaaaagctggaattccagtaccaacattcactgcggcaattagctactacgatagctatcgttcagaagtattatctgcaaatctaatccaagcacaacgcgactactttggcgctcatacgtatgaaagagtcgacaaacctggtgtattccatacagaatggccacaagtagaagattga

SEQ ID NO: 11793 - protein, 472 aa, Listeria monocytogenes
MAKQEIGVIGMGVMGRNLALNIESRGHTVSIFNRSTEKTKAVMEENADKKLVPTYSLEEFVESLEVPRRILIMVKAGDATDMMIEAVKPFLNEGDILIDGGNAFFKDTIRRNKELSEEGFNFIGTGVSGGEEGALKGPSIMPGGQRKAYDLVAPILREIAAVADGEPCVTYIGPDGAGHYVKMVHNGIEYGDMQLIAEAYTILKEIGGLSHDELADVFEEWNNGELDSYLIEITKNILKVKDEETGKPIVDVILDKAGQKGTGKWTSQSALDLGVPLSLITESVFARYISALKEERVYASTVLTGPSNYRFEGDKKAFVESVRRALYFSKIASYAQGFAQMRAASEEYNWDLQYGEIAKIFRAGCIIRARFLQKITDAYNQDKNLKNLLLDPYFKDIAHNYQGDLRTVVAEAVKAGIPVPTFTAAISYYDSYRSEVLSANLIQAQRDYFGAHTYERVDKPGVFHTEWPQVED

SEQ ID NO: 11794 - DNA, 897 bp, Bacillus halodurans
  CDS (1)..(897)
atggagattggattaatcggtttaggacgaatggggtacaatttgggcctcaatatccttgatcacgaacatcagcttgtcgcttatgatgtgaatcgtgaagcggtaaaagaaattggcttagctggtgcaaaagaagctgattcgctagaagagctcgtaagcaaactatcagcaccacgcaagatttgggtcatggttccagccggggatataacagaaaatgtcgtttcacagctaagctctcttttggacgaaggggatgttgtgattgatggcgggaatgcgaattataaggatacgttacgccgtgcaaagcaatatgaggcgaaggggcttcattttgtggatgcaggaacaagcggtggcattgacggggcacgtgaaggtgcttgtttaatggtgggaggaacgaaagaggttgttgaatctttagcccccctattaaaagaaatcgcagtagaagatggatatttatatacaggccctgtcggtagtggacattttttaaagatgattcataacggaatagagtacggtatgatgcaagcgattgcagaagggtttgacctgttagaaaacagtccgtttgactatgattacgaagcggtagcaaaagtgtggaacaacggttcggtcatccgatcatggctaatggaactaaccgaatcagccttttcaaaggatgcgaacttagaaaagattcgcggtgtgatgcattcgtccggtgagggaaaatggacggtggaaaccgcgctagatttacaaatcgaagcgcctgtaatcgctttgtctttaatgatgcgctatcgttccttacgtgatgatacgttttcagggaaagtggttgccgctttaagaaatgaatttggtgggcacgcagttgtaaaaagttga

SEQ ID NO: 11795 - protein, 298 aa, Bacillus halodurans
MEIGLIGLGRMGYNLGLNILDHEHQLVAYDVNREAVKEIGLAGAKEADSLEELVSKLSAPRKIWVMVPAGDITENVVSQLSSLLDEGDVVIDGGNANYKDTLRRAKQYEAKGLHFVDAGTSGGIDGAREGACLMVGGTKEVVESLAPLLKEIAVEDGYLYTGPVGSGHFLKMIHNGIEYGMMQAIAEGFDLLENSPFDYDYEAVAKVWNNGSVIRSWLMELTESAFSKDANLEKIRGVMHSSGEGKWTVETALDLQIEAPVIALSLMMRYRSLRDDTFSGKVVAALRNEFGGHAVVKS

SEQ ID NO: 11796 - DNA, 918 bp, Halobacterium sp. NRC-1
  CDS (1)..(918)
atggaactcggagtcgtcggcctcggccgcatggggcgcatcgtcgtcgaccgctgtctcgacgccggccacgacgtggtcgcgttcgacatcgacgcgaccgcgcgcgaggacgcggccgacgcgggcgcgacgcccgccgacacgctggacgcactcgccgcggagctcggtgccgagaagcgcatctggctgatggtgccggcgggcgaccccgttgacgccgccctcgacgaactcgcgccgcacctcgattccgacgacgtcgtcgtggacggcgggaacagccacttcgaggactcgacgcgccgcgccgaggaacacgacttcgcgtacctcgactgtggtacttcgggcggccccgccggcgcggaactcgggttctccctgatggtcggcggccccgagtgggcgtacgacgacctcgtgcccgtcttcgacgccgtcgctaccggcccagacggccacgaccgcatgggaccggcaggcgccggccactacgtcaaaatggtgcacaacggcgtcgagtacgcgctcatgcagacctacggcgaggggttcgagttgctccacgaggggcgctacgatctcgacctggaggccgtcgcgcgaacctggaacaacggcgccgtgatccggtcgtggctgctggagctctgcgaggaagcgttccgcgaggagggcagcgatctcggcaccgtcgccgaccacgtggccggcggctccacgggcacctggaccgtccaggaagccctcgaacaggaggtcccggtgcccctcgtctcccaggcgctctccgagcggttcggctcccgcagtaccggcggcgacaccggccggttcgcgcgccgcctggccaaccggctgcgctacgggttcggccgccacgaggtcgcccgcaccggcgacgacgcctag

SEQ ID NO: 11797 - protein, 305 aa, Halobacterium sp. NRC-1
MELGVVGLGRMGRIVVDRCLDAGHDVVAFDIDATAREDAADAGATPADTLDALAAELGAEKRIWLMVPAGDPVDAALDELAPHLDSDDVVVDGGNSHFEDSTRRAEEHDFAYLDCGTSGGPAGAELGFSLMVGGPEWAYDDLVPVFDAVATGPDGHDRMGPAGAGHYVKMVHNGVEYALMQTYGEGFELLHEGRYDLDLEAVARTWNNGAVIRSWLLELCEEAFREEGSDLGTVADHVAGGSTGTWTVQEALEQEVPVPLVSQALSERFGSRSTGGDTGRFARRLANRLRYGFGRHEVARTGDDA

SEQ ID NO: 11798 - DNA, 1407 bp, Buchnera sp
  CDS (1)..(1407)
atgtcacggcaacaaataggtgttgtcggaatggcagtcatgggacgaaatttagcattaaatattgaaagcaaaaattacagcgtatctatattcaatagaactagatcagtaacagaagaagtatttaatcagaataagaaaaaaaatattgtcccatatttttctattaaagattttattgattcacttctcaagcctagatgcatcttattaatggttcaatctggaaaagctactgatgaaactatcaagatgattctgccctatttagaaaaagaagatatattaattgatgcaggtaatacattttacaaagacactattcggagaaatgaaaaattatctaaatatgagattaattttattggaatgggggtgtctggaggtgaattaggagcattaaacggtccctctattatgccgggcggacaaaaagaagcatacaaacttgttttacctatgttagaaaaaatatcagcaaagtttaaaggtgagccatgtgtaagctatattggtcctaatggtgcaggtcattatgtaaaaatggtacacaatggtattgaatatggtgatatgcagttaatatcagagtcatattttttattaaaatatttattaaatatgagtaatgaagaattatcatctacattttctaaatggaataaaggtgaattaaatagttatttaattgaaataacaaaaaatatttttattgaaaaagatgaaaagggaaaatatttgatagatcgtattttagatgtagcagaagataaaggtactggtaagtggattagcaaaagtgctttagatcttcgagaaccgctttcattaattactgaatccgtttttgctcgttatttatcttctctaaaaagacaacgcataattgcatcaaaaatattacagggtccaaagataaaaacgtttattaaagataaaaatagttttattgaagaagttcgacgagctttatatttaggtaagataatttcttatgctcaaggtttttctcaattaaaaagagcgtcagaaaaatatcattggaatttaaaatatggtgaaattgctaagatttttagagcagggtgtattatacgagcaaattttttacaaaaaataacagacgaatatactcaaaataaaaatgtagttaatttattattaacaccttatttttccaaaatagctaatgaatatgaaaattcattacgcaatattgttatgtatgcgataaaatatggaatttctactccaactttttctgcggcaatatcatattatgatagttatagagcattatatttaccggctaacttaattcaggctcaaagagattattttggttcacatacttatcaaagaacagatcagactggttactttcatacaaactggtctcaataa

SEQ ID NO: 11799 - protein, 468 aa, Buchnera sp
MSRQQIGVVGMAVMGRNLALNIESKNYSVSIFNRTRSVTEEVFNQNKKKNIVPYFSIKDFIDSLLKPRCILLMVQSGKATDETIKMILPYLEKEDILIDAGNTFYKDTIRRNEKLSKYEINFIGMGVSGGELGALNGPSIMPGGQKEAYKLVLPMLEKISAKFKGEPCVSYIGPNGAGHYVKMVHNGIEYGDMQLISESYFLLKYLLNMSNEELSSTFSKWNKGELNSYLIEITKNIFIEKDEKGKYLIDRILDVAEDKGTGKWISKSALDLREPLSLITESVFARYLSSLKRQRIIASKILQGPKIKTFIKDKNSFIEEVRRALYLGKIISYAQGFSQLKRASEKYHWNLKYGEIAKIFRAGCIIRANFLQKITDEYTQNKNVVNLLLTPYFSKIANEYENSLRNIVMYAIKYGISTPTFSAAISYYDSYRALYLPANLIQAQRDYFGSHTYQRTDQTGYFHTNWSQ

SEQ ID NO: 11800 - DNA, 1455 bp, Haemophilus influenzae
  CDS (1)..(1455)
atgtcagtaaaaggcgacatcggtgttatcggcttagccgtaatggggcaaaacctcattttaaatatgaacgaccacgggtttaaagtcgtggcatataaccgtaccacttcaaaagtggatgagtttttacaaggtgcggcaaaaggcaccaatattatcggcgcatactctttagaagatttagctgctaaattagaaaaaccacgtaaagtgatgttaatggtgcgcgctggtgatgtggtggatcaattcattgaagcattattaccacatttagaagagggcgacatcattattgatggcggtaactcaaactatccagatacgaaccgtcgagtgaaagccttggcggagaaaggtattcgctttatcggttcgggtgtgtctggtggcgaagaaggggcgcgtcacgggccttcaattatgccgggcggtaatcaagaagcgtggcagtatgtgaaacctatcttccaagcaatttcagctaaaacagaacaaggcgaaccttgttgtgactgggtcggcggcgaaggtgctggtcattttgtgaaaatggttcacaatggtattgaatatggcgatatgcagttaatttgcgaagcataccaattcttaaaagaaggtttaggcttaagctatgaagaaatgcaagccatcttcgcagaatggaaaaatactgaacttgatagctatttaatcgatatcaccactgacattcttggttataaagatgcaagtggagaacctttagtcgaaaaaatcttggatactgcgggtcaaaaagggacaggtaaatggacaggtatcaatgcgttagattttggtattccattaactttaatcactgaatccgtttttgcacgctgcgtgtcttcctttaaagatcaacgtgttgcggctaatcaattattcggcaaaactattacaccagttgaaggcgacaaaaaagtatggattgaagcggtacgtaaagcattattagcgtcaaaaattatttcttacgcacaaggctttatgctgattcgtgaagcctctgaacaatttggttgggatattaactatggtgcaacggcgttgttatggcgtgaaggttgtatcattcgtagccgtttcttaggtaatattcgcgatgcttatgaagcaaatccaaatcttgttttcttaggttcagatagctacttcaaaggcattttagaaaacgcattaagtgactggcgtaaagtggtggcaaaatctatcgaagtgggtatcccaatgccttgtatggcgtctgcgattactttcttagatggctatacttcagcacgtttaccagcaaacttattgcaagcacaacgcgactacttcggtgctcatacttatgaacgcacagataaacctcgtggcgagtttttccacactaactggactggtcgtggcggtaatacagcatcaactacttatgatgtgtag

SEQ ID NO: 11801 - protein, 484 aa, Haemophilus influenzae
MSVKGDIGVIGLAVMGQNLILNMNDHGFKVVAYNRTTSKVDEFLQGAAKGTNIIGAYSLEDLAAKLEKPRKVMLMVRAGDVVDQFIEALLPHLEEGDIIIDGGNSNYPDTNRRVKALAEKGIRFIGSGVSGGEEGARHGPSIMPGGNQEAWQYVKPIFQAISAKTEQGEPCCDWVGGEGAGHFVKMVHNGIEYGDMQLICEAYQFLKEGLGLSYEEMQAIFAEWKNTELDSYLIDITTDILGYKDASGEPLVEKILDTAGQKGTGKWTGINALDFGIPLTLITESVFARCVSSFKDQRVAANQLFGKTITPVEGDKKVWIEAVRKALLASKIISYAQGFMLIREASEQFGWDINYGATALLWREGCIIRSRFLGNIRDAYEANPNLVFLGSDSYFKGILENALSDWRKVVAKSIEVGIPMPCMASAITFLDGYTSARLPANLLQAQRDYFGAHTYERTDKPRGEFFHTNWTGRGGNTASTTYDV

SEQ ID NO: 11802 - DNA, 1023 bp, Mycobacterium tuberculosis
  CDS (1)..(1023)
atgcaactaggaatgatcggtctgggccggatgggtgcgaatatcgtccgccgcttggccaaaggtggacacgactgcgtggtctacgaccacgaccccgacgcggtcaaggcgatggccggggaggaccggaccaccggggtggcctcgttgcgtgagttgtctcagcggctctccgccccgcgagttgtctgggtgatggtgcccgcggggaacatcaccaccgcggtgatcgaagagctggccaacacgctcgaggccggcgacattgtgatcgacggtggcaacacctattatcgcgacgatctgcggcacgaaaagctgttgttcaagaagggaattcacctactcgactgtggcaccagcggcggtgtgtggggtcgggaacgtggctactgcctgatgatcggcggggatggcgacgcgttcgcgcgcgcggagccgatcttcgccaccgtcgcgccgggggtggcggccgccccgcgcaccccgggccgagacggtgaggtcgcgccatcggaacaaggctatttgcattgtgggccttgcggttcgggtcacttcgtgaagatggtccacaacggcatcgaatacgggatgatggcctccttggcggagggattgaacatcctgcgcaatgccgacgtcggcacccgcgtgcaacacggtgacgccgaaaccgcgccgctgccgaatcccgagtgctaccagtacgacttcgacatcccggaggtcgccgaggtatggcggcggggcagcgtgatcggctcctggctgctggatttgaccgcgatcgcgctgcgcgaatcacctgacctagcggaattctccggacgggtctccgactctggcgagggccggtggaccgccatcgcggcgatcgacgagggcgtgcccgcgccggtgctgaccaccgcgctgcagtcccgcttcgcctcgcgtgacctcgacgacttcgccaacaaggcgctgtcggcgatgcgcaagcagttcggcggacacgccgagaaaccggctaactaa

SEQ ID NO: 11803 - protein, 340 aa, Mycobacterium tuberculosis
MQLGMIGLGRMGANIVRRLAKGGHDCVVYDHDPDAVKAMAGEDRTTGVASLRELSQRLSAPRVVWVMVPAGNITTAVIEELANTLEAGDIVIDGGNTYYRDDLRHEKLLFKKGIHLLDCGTSGGVWGRERGYCLMIGGDGDAFARAEPIFATVAPGVAAAPRTPGRDGEVAPSEQGYLHCGPCGSGHFVKMVHNGIEYGMMASLAEGLNILRNADVGTRVQHGDAETAPLPNPECYQYDFDIPEVAEVWRRGSVIGSWLLDLTAIALRESPDLAEFSGRVSDSGEGRWTAIAAIDEGVPAPVLTTALQSRFASRDLDDFANKALSAMRKQFGGHAEKPAN

SEQ ID NO: 11804 - DNA, 1449 bp, Vibrio cholerae
  CDS (1)..(1449)
atgaaaggtgatatcggtgtaatcggccttgcagtaatgggccagaacctgatcctcaacatgaacgaccacggcttcaaagtggtggcacacaaccgtaccgcggctaaagtggacgagtttctagaaggcccagcaaaaggcactaacattgttggcgcttacactctgcaagagctggtcgataaactggcgacgccacgcaaagtgatgctgatggttcgtgcaggtcaagtggttgatgacttcatcgagcaactggttccactgctcgacaaaggtgacatcatcattgatggtggtaacaccaacttccctgatactaaccgccgtgtcaaagcgctgcgtgaaaaaggcattcacttcatcggtacgggtgtttctggtggtgaagaaggtgcacgtttcggaccttcgatcatgccgggtggcgcacctgaagcatgggaagcggtaaaaccgattttccaaggcatttctgcaaaaactgacgctggtgagccttgctgtgactgggtgggcaacgatggtgccggtcacttcgtgaaaatggttcacaacggtatcgaatacggcgacatgcagcttatcactgaagcttaccagttcatgaaagatggtctgggaatgtcggccgatgaaatgcaagccgtatttgctgactggaacaaaactgagctagacagctacttggttgagatcaccgctgacatccttggctacaaagatgaagatggtgaagcgttggttgagaagatcctcgatactgctggccaaaaaggcacaggtaaatggacgggtatcaacgcgctggacatgggcatcccactgactctgatcaccgaatccgtgttctctcgctgcctatccgcactgaaagatcaacgtgttgaagctgaaaaactgtttggtaaaaccaaaactcaagtcgaaggtgacaaacaagtttgggttgatgcgctgcgtcaagcgctgctggcttcaaaaatcatctcttacgcacaaggctttatgctgatgcgtgaagcatcgaacgagaatggttggaacctgaactacggtaacgtggctctgatgtggcgtggtggttgtatcatccgctctgcgttcctaggcaacatccgtgatgcgtttgaaaagaacccagaactggcgttcttaggttctgatgcgtacttcaaaggtattctggacaactgtctggctgcatggcgtaaagtggcagcgaagtcgctggaagtcggcattccaatgccatgtacgacttcagcactgaccttccttgatggttacactacggctcgcctgccagcgaacctgctgcaagcacagcgtgattactttggtgcgcacacttatgagcgtatcgatcgtccgcgtggtgagttcttccacactaactggacgggtacaggcggtaatactgcgtctactacttacgacgtgtaa

SEQ ID NO: 11805 - protein, 482 aa, Vibrio cholerae
MKGDIGVIGLAVMGQNLILNMNDHGFKVVAHNRTAAKVDEFLEGPAKGTNIVGAYTLQELVDKLATPRKVMLMVRAGQVVDDFIEQLVPLLDKGDIIIDGGNTNFPDTNRRVKALREKGIHFIGTGVSGGEEGARFGPSIMPGGAPEAWEAVKPIFQGISAKTDAGEPCCDWVGNDGAGHFVKMVHNGIEYGDMQLITEAYQFMKDGLGMSADEMQAVFADWNKTELDSYLVEITADILGYKDEDGEALVEKILDTAGQKGTGKWTGINALDMGIPLTLITESVFSRCLSALKDQRVEAEKLFGKTKTQVEGDKQVWVDALRQALLASKIISYAQGFMLMREASNENGWNLNYGNVALMWRGGCIIRSAFLGNIRDAFEKNPELAFLGSDAYFKGILDNCLAAWRKVAAKSLEVGIPMPCTTSALTFLDGYTTARLPANLLQAQRDYFGAHTYERIDRPRGEFFHTNWTGTGGNTASTTYDV

SEQ ID NO: 11806 - DNA, 1407 bp, Bacillus subtilis
  CDS (1)..(1407)
atgttcaattcgattggtgtcataggcttaggcgtaatgggaagcaacatcgccttaaacatggcaaataaaggcgaaaacgtcgctgtctataattacaccagagatttaacggaccagcttatccaaaagctggatggacaatctctcagcccgtattacgagcttgaggactttgttcaatcgttagaaaaaccaagaaaaatctttttgatggtcacagcgggaaaacccgtagattccgtcatccaatcattaaagcctttgcttgaagaaggcgacgtcatcatggacggaggaaactcccactatgaagacacagaaagaagatatgacgagctgaaggaaaaagggatcggctacctgggagtcggcatttccggcggtgaagtcggtgcgttaacagggccttccatcatgccgggcggagatcgcgacgtctatgagaaagccgctcctatcctgacgaaaatcgcagcccaagtcggagatgacccttgctgtgtctatatcggaccaaaaggggcagggcactttacaaaaatggtgcacaacggcattgaatatgccgacatgcagctgattgcagaagcttatacgtttctaagagaaacgcttcgtctgccgctagatgaaattgcatctatttttgaaacatggaatcaaggtgagctgaaaagctatttaatagagattacagctgagattttacgcaaaaaagacgaaaaaacaggacagcctctgatcgatgtcatccttgataaaaccggccaaaaaggcaccggaaaatggacgagcatgcaggcgattgataacggcatcccgtccacgatcatcacagagtccttgttcgcccgctacttgtcatctttaaaagaagaacggatggcagctcaagatgtattagcaggcccggaagccgaagaaaaacacttggataaagacacttggattgaatacgtcagacaggctctttacatggggaaagtatgcgcctatgcacaaggctttgcccaatataagatgtcatctgagctttacggctggaatctgccgctcaaagacatcgccttgattttccgaggcggctgcatcatccgcgctgatttcctaaacgtgatcagcgaagcattcagtgagcagccaaatctggctaacctgctgatcgcgccttatttcacagataagctccatgcctatcaaacaggcctgcgaaaagtcgtttgcgagggtatcagcaccggaatctctttcccatgcttaactaccgcgctctcttattacgacggctaccgcacagggcgttccaatgcgaacctcttgcaggcacagcgcgattactttggcgctcacacgtacgaacggactgatatggacggcgtcttccatacgaattggtctgaataa

SEQ ID NO: 11807 - protein, 468 aa, Bacillus subtilis
MFNSIGVIGLGVMGSNIALNMANKGENVAVYNYTRDLTDQLIQKLDGQSLSPYYELEDFVQSLEKPRKIFLMVTAGKPVDSVIQSLKPLLEEGDVIMDGGNSHYEDTERRYDELKEKGIGYLGVGISGGEVGALTGPSIMPGGDRDVYEKAAPILTKIAAQVGDDPCCVYIGPKGAGHFTKMVHNGIEYADMQLIAEAYTFLRETLRLPLDEIASIFETWNQGELKSYLIEITAEILRKKDEKTGQPLIDVILDKTGQKGTGKWTSMQAIDNGIPSTIITESLFARYLSSLKEERMAAQDVLAGPEAEEKHLDKDTWIEYVRQALYMGKVCAYAQGFAQYKMSSELYGWNLPLKDIALIFRGGCIIRADFLNVISEAFSEQPNLANLLIAPYFTDKLHAYQTGLRKVVCEGISTGISFPCLTTALSYYDGYRTGRSNANLLQAQRDYFGAHTYERTDMDGVFHTNWSE

SEQ ID NO: 11808 - DNA, 1407 bp, Klebsiella pneumoniae
  CDS (1)..(1407)
atgtccaagcaacagatcggggttgtcggtatggctgtgatggggcgtaaccttgcgctgaacatcgaaagccgtggttataccgtctccgttttcaaccgctcccgtgaaaagaccgaagaagttattgccgaaaacacaggcaagaaactggtcccttactacacagtacaagagtttgttgaatccctcgagacaccacgtcgtatcctgttgatggtgaaggccggggctggcaccgacagcgccattgattccctgaagccttaccttgataaaggcgacatcatcattgatggcggcaacaccttcttccaggacaccatccgtcgtaaccgtgaactctctgccgaaggttttaactttatcggtaccggtgtttccggcggcgaagagggcgctctgaaagggccttccatcatgcctggtggccagaaagaagcctatgaactggtagcaccaattctgaagcagattgcggcggtggctgaagacggcgagccgtgtgtgacctatatcggtgctgacggtgcgggccattatgtgaagatggtgcataacggcattgagtatggtgacatgcagctgattgccgaagcctatgcgctgctgaaaggcggtctggcgctctctaacgaagagctggcgcaaacctttaccgaatggaacgaaggtgaactgagcagctacctgatcgacattaccaaagatatcttcaccaagaaggatgaagagggtaaatacctcgttgatgttattcttgatgaagcggcaaacaaaggtaccggcaagtggaccagccagagctcactggatctcggcgaacctctttctctgatcacggagtccgtatttgctcgttacatctcttcgcttaaagaccagcgtgtcgccgcgtcgaaagtgctgagtggtccgcaggctcaaccggtcggtgataaagcgggatttatcgaaaaagttcgtcgcgcgttgtacctcggtaaaatcgtttcctatgctcagggcttctcccagctgcgtgctgcttctgatgaatacaactgggatctgaactacggcgagatcgctaagattttccgcgcgggctgtatcattcgtgcgcagttcctgcagaagatcaccgatgcttatgcgcaaaacgctggcattgctaacctcctgctggcaccgtacttcaaacagatcgctgatgactatcagcaggcgctgcgtgatgtcgtggcgtatgccgtacagaatggtattccggtaccgacggtctcagcggcaattgcctactacgacagctaccgttccgcagttctgccagctaacctgatccaggctcagcgcgattattttggtgcgcacacctataagcgtactgataaagaaggtgtattccataccgagtggttggaataa

SEQ ID NO: 11809 - protein, 468 aa, Klebsiella pneumoniae
MSKQQIGVVGMAVMGRNLALNIESRGYTVSVFNRSREKTEEVIAENTGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPVGDKAGFIEKVRRALYLGKIVSYAQGFSQLRAASDEYNWDLNYGEIAKIFRAGCIIRAQFLQKITDAYAQNAGIANLLLAPYFKQIADDYQQALRDVVAYAVQNGIPVPTVSAAIAYYDSYRSAVLPANLIQAQRDYFGAHTYKRTDKEGVFHTEWLE

SEQ ID NO: 11810 - DNA, 1458 bp, Mycobacterium tuberculosis
  CDS (1)..(1458)
atgagttcgtcggaatcgccagccggcatcgcgcagatcggcgtcactggcctggccgtgatgggttccaacatcgcccgaaacttcgcccggcacggctacaccgtggcagtgcacaatcggtcggtcgccaagaccgacgcgctgcttaaggagcacagctcagacggcaagttcgtgcgcagtgaaacgatccccgaatttcttgccgcactggaaaaaccgcgtcgggtgctgatcatggtcaaggccggagaggccactgacgctgacgctgtcatcaacgaacttgctgacgccatggaacccggcgacatcatcatcgacggcggcaatgcgttgtacaccgacaccatgcgccgcgagaaagcgatgcgtgagcggggcttgcacttcgtcggggccgggatctccggcggcgaagagggcgcgttgaacgggccgtcgatcatgcccggcggacccgccgagtcataccaatcgctgggtccgctgctcgaggagatctccgcgcatgtcgacggcgtgccgtgctgcacccacattggcccggacggctccgggcacttcgtcaagatggtccacaacggcatcgagtactccgacatgcagctcatcggtgaggcctaccagctgatgcgcgacgggctaggtctgaccgcgccggcgatcgccgatgtgttcaccgagtggaacaatggcgatctggacagctacctggtcgagatcaccgccgaggtgctgcggcagaccgatgccaagaccggcaaaccgctcgtcgacgtcatcgtggaccgggccgagcagaaaggcaccggccgttggaccgtcaagtccgcgctggacctgggtgtgccggtgaccggcatcgccgaagcggtgtttgcccgcgctctctcgggatccgtggggcaacgctcggccgccagcggtctggcttcgggcaagctcggcgagcagcccgccgaccccgccacgttcaccgaagacgtccgccaggcgttgtacgcctccaagatcgtggcctacgctcagggcttcaaccagatccaggccggcagcgccgaattcggctgggacatcacgccgggcgacctggccaccatctggcgtggcggctgcatcatccgggcgaagttcctcaaccacatcaaggaagcctttgacgccagcccgaacctggccagtctgattgtggccccgtatttccgcggcgccgtcgaatcggcgatcgacagttggcggcgtgtggtgtcgacggcggcccaactgggtatcccgaccccgggattctcgtcggccctgtcgtattacgacgcgctgcgcaccgcgcggctgcccgctgcactcacccaggcccagcgcgacttcttcggcgcacacacctacggccggatcgacgaaccaggcaagttccacacactatggagttcagaccgcaccgaagtaccggtgtag

SEQ ID NO: 11811 - protein, 485 aa, Mycobacterium tuberculosis
MSSSESPAGIAQIGVTGLAVMGSNIARNFARHGYTVAVHNRSVAKTDALLKEHSSDGKFVRSETIPEFLAALEKPRRVLIMVKAGEATDADAVINELADAMEPGDIIIDGGNALYTDTMRREKAMRERGLHFVGAGISGGEEGALNGPSIMPGGPAESYQSLGPLLEEISAHVDGVPCCTHIGPDGSGHFVKMVHNGIEYSDMQLIGEAYQLMRDGLGLTAPAIADVFTEWNNGDLDSYLVEITAEVLRQTDAKTGKPLVDVIVDRAEQKGTGRWTVKSALDLGVPVTGIAEAVFARALSGSVGQRSAASGLASGKLGEQPADPATFTEDVRQALYASKIVAYAQGFNQIQAGSAEFGWDITPGDLATIWRGGCIIRAKFLNHIKEAFDASPNLASLIVAPYFRGAVESAIDSWRRVVSTAAQLGIPTPGFSSALSYYDALRTARLPAALTQAQRDFFGAHTYGRIDEPGKFHTLWSSDRTEVPV

SEQ ID NO: 11812 - DNA, 1452 bp, Mycobacterium leprae
  CDS (1)..(1452)
atgagtgcgccggaatcgaagacggccattgcgcagatcggcgtcaccgggctagccgtgatgggttcgaacatcgcccggaatttcgcccgacacggctataccgtggcgttgcacaatcggtcaatcgccaagaccgacacactgctcaaagagcacggatccgaagggaatttcgtgcgaaccgaaacgatccccgagttccttgccgcactacagactccgcgacgggtgctgatcatggtaaaagccggtgacgccaccgatgccgtcatcaatgaactcgccgatgttatggaacccagcgacatcatcatcgacggcggcaattcgctgttcaccgacaccattcgccgcgaaaaagcaatgcgtgagcgtggcctgcacttcgtcggcgccgggatctccggcggcgaggagggtgcactgaacggaccgtcgatcatgcccggcgggcccgccgaatcgtatacctcgctgggcccgctgcttgaggagatttccgcgcacgtcgacggggtgtcgtgttgcacccacatcgggccaggcgggtcgggccacttcgtcaaaatggtccacaacggcatcgagtactccgacatgcagctcattggcgaggcctaccagctgctgcgcgacggattgggcatgagtgcaccgcaaatcgctgacgtgtttaccgaatggaacaggggcgatctgaacagctacttggtagagatcaccgctgaagtgttgcgccagaccgatatcaagaccggcaggccgctggtcgatgtcatcctcgataaggccgagcaaaagggtaccggccggtggaccgtacagtccgccctggacttgggcgtgccgataactggaatagccgaggcggtgttcgcgcgcgcgctgtcgggttcggtgctgcaacgcaaggccgccatcgggctggcctccggcaagttgggcaacaaacccacagatcgcgagacattcatcgaagacgtacgccaggccctgtatgcctccaagattgtggcctacgcgcaggggttcaatcacatccaaaccggtagtaccgagttcggttggaacatcacaccgggtgacttggcgaccatctggcgcggcggctgcatcatccgggcgaagtttctcaaccgcatcaaggaagctttcgacgccgcccccgacctggccagcctgatcgttgcgccgtatttccgcagtgctgtcgaatcggcgattgacagttggcggcgtgtggtgtccacagctacccagctaggtatcccaaatcccggcttctcgtccgcgttgtcgtactacgatgcgctgcgcaccgagcgacttccggccgcactgacccaggctcaacgtgactttttcggcgcgcacagctacggacgcgtcgacgcgcggggcaaattccacacactatggagtgaagaccgtagcgaagttacggtctag

SEQ ID NO: 11813 - protein, 483 aa, Mycobacterium leprae
MSAPESKTAIAQIGVTGLAVMGSNIARNFARHGYTVALHNRSIAKTDTLLKEHGSEGNFVRTETIPEFLAALQTPRRVLIMVKAGDATDAVINELADVMEPSDIIIDGGNSLFTDTIRREKAMRERGLHFVGAGISGGEEGALNGPSIMPGGPAESYTSLGPLLEEISAHVDGVSCCTHIGPGGSGHFVKMVHNGIEYSDMQLIGEAYQLLRDGLGMSAPQIADVFTEWNRGDLNSYLVEITAEVLRQTDIKTGRPLVDVILDKAEQKGTGRWTVQSALDLGVPITGIAEAVFARALSGSVLQRKAAIGLASGKLGNKPTDRETFIEDVRQALYASKIVAYAQGFNHIQTGSTEFGWNITPGDLATIWRGGCIIRAKFLNRIKEAFDAAPDLASLIVAPYFRSAVESAIDSWRRVVSTATQLGIPNPGFSSALSYYDALRTERLPAALTQAQRDFFGAHSYGRVDARGKFHTLWSEDRSEVTV

SEQ ID NO: 11814 - DNA, 1953 bp, Ovis orientalis aries, Ovis ammon aries (domestic sheep)
  CDS (71)..(1522)
ctcgccgtgcgctccctgtgcttcgggtctgcttgctccagcctgctttgccgccgccgccatcgccgccatggcccaagctgacattgccctgattggactggctgtcatgggccagaacttaattttaaacatgaatgaccatggctttgtggtctgtgcttttaataggacagtctccaaagttgatgacttcttggctaatgaggcgaagggcaccaaggtgcttggcgctcactccttggaggaaatggtgtccaagctgaagaagccacggcggatcatcctgcttgtgaaggccggtcaggccgtcgataatttcattgagaaactggtacctttgctagacattggtgatatcatcattgatggaggaaattctgaatacagggataccatgagacggtgccgagacctcaaggataagggcatcttattcgtggggagcggagttagtggtggagaggatggggcccgctatggcccgtcgcttatgccgggagggaacaaggaggcctggccccacatcaaggccatctttcaaggcatcgccgccaaagtggggacaggagaaccctgctgtgactgggtgggggacgacggtgcaggacactttgtgaagatggtgcacaacggcatagagtacggggacatgcagctcatctgtgaggcctaccacctgatgaaggacgtcctgggcctggggcacaaggagatggccaaggcctttgaggaatggaataaaacagagctggactcattcctgattgaaatcacagccagtattctcaagttccaagatgctgatggcaaacacctgctgccaaagatccgggacagcgcagggcagaagggcaccgggaagtggaccgccatctctgccctggagtacggcgtgcccgtcaccctcatcggagaagctgtcttcgcgagatgcttatcatctctgaaggacgagaggatccaagccagcaaaaagctgaaggggcctcaaaatatcccatttgaaggagataagaaatcattcctggaggacattcgaaaggccctctatgcttccaagatcatctcttacgctcagggcttcatgctgttaagacaggcagcaactgaatttggctggaccctcaactatggcggcatcgccctgatgtggaggggcggctgcatcatcaggagtgtattcctgggaaagataaaagatgcatttgatcgaaacccaggacttcagaatctattgctggatgacttttttaagtcagctgtggaaaactgccaggactcctggcggcgggccatcagtactggtgtccaggcaggcattcccatgccctgctttaccactgctctctctttctacgatgggtacagacacgcgatgctgccggccaacctcatccaggctcagcgcgactactttggggcgcacacctacgaactcttggccaagccgggccagttcatccacaccaactggacgggccacgggggcagcgtgtcctcgtcgtcgtacaacgcctgatgggcttctgttccaagccacaactctacagaccaggacattccatctgccacacagcactgcttgcatggccctctgccctactttctgctcagatcttttaaaataccatgtgtcgtaagagactcctttgaagagttggcccgagtctctgagtgtcaagtagttctgagagaaccagcacgccctctgccctcgcctcttgggacggagcaggagtggagtgtgtgcgaggcagctgcccgaggcagcgttccctgcaggtcccctgtgggtgagggaggcagcggctctcatcaaggtggggaagggttttgtagaatttgatcaaactggaacctttgtatcacacacctgaactccctttccttttacttaataaaagaaaaaaaacataaaaaaaaaaaaaaaaaaaaaaaaaaaaaaaaaaa

SEQ ID NO: 11815 - protein, 483 aa, Ovis orientalis aries, Ovis ammon aries (domestic sheep)
MAQADIALIGLAVMGQNLILNMNDHGFVVCAFNRTVSKVDDFLANEAKGTKVLGAHSLEEMVSKLKKPRRIILLVKAGQAVDNFIEKLVPLLDIGDIIIDGGNSEYRDTMRRCRDLKDKGILFVGSGVSGGEDGARYGPSLMPGGNKEAWPHIKAIFQGIAAKVGTGEPCCDWVGDDGAGHFVKMVHNGIEYGDMQLICEAYHLMKDVLGLGHKEMAKAFEEWNKTELDSFLIEITASILKFQDADGKHLLPKIRDSAGQKGTGKWTAISALEYGVPVTLIGEAVFARCLSSLKDERIQASKKLKGPQNIPFEGDKKSFLEDIRKALYASKIISYAQGFMLLRQAATEFGWTLNYGGIALMWRGGCIIRSVFLGKIKDAFDRNPGLQNLLLDDFFKSAVENCQDSWRRAISTGVQAGIPMPCFTTALSFYDGYRHAMLPANLIQAQRDYFGAHTYELLAKPGQFIHTNWTGHGGSVSSSSYNA

SEQ ID NO: 11816 - DNA, 1449 bp, Neisseria meningitidis
  CDS (1)..(1449)
atgaacggcgatattggtgtaatcggtttggcggttatggggcaaaacctgattttgaatatgaacgattgcggatttaaggtggttgcctacaaccgcacgactgccaaggtggacgaatttttaaacggcgcggcaaaaggaactaatattatcggcgcgtattctttgcaagatttggtcgataagctggaaaaaccgcgaaaaattatgatgatggttcgtgccggttcggtggttgacgaatttatcgaacaactgcttccgctgttggaagaaggcgacatccttatcgacggcggcaatgccaattaccccgacacgacacggcggacacattaccttgctgaaaaagggattttgtttgtcggcgcgggcgtgtccggcggggaagaaggggcgcggcgcgggccgtccattatgccgggcggggataagcgcgcttgggatgcggtcaagccgatttttcaggcgattgccgccaaaacgtcgcagggcgaaccgtgttgcgactgggtcggcaaagacggtgcggggcattttgtcaaaatggtgcataacggcatcgaatatggcgatatgcagttgatttgcgaagcgtaccagttcatgaaagacggcttggggctgtcttacgacgaaatgtaccgcgtgtttgccgagtggaacaaaaccgagctggattcttatctgattgaaatcacagcggcaattttgggctataaggacgaaggcggcgaaccgctggtcgagaaaatcctcgatacggcagggcaaaaaggtacaggcaaatggacgggcatcaatgctttggatttgggtattccgctgacgctgatttccgaagccgtattcgcccgctgcgtttcgtcgttcaaagaacagcgcgtgcagaccggcaaactgttcgcccgaaccgttacgcccgtcgaaggcggcaaacaagaatgggtcgaggcgttgagacaggccctgcttgcatctaaaatcatttcctacgcacaaggctttatgctgatccgcgaagcgggcgaaagctacggctgggatttggactacggcaacactgcgctgctgtggcgcgaggggtgcatcattcgcagcgcattcttaagcaatatccgcgacgcgtatgaaaacaatcccgatttggtgttcttgggtgcggatccgtatttcaaaaatattttggaaaactgcctgccggcgtggcgcaaggtggttgccaaggcggtcgaatgcggcatccctatgccctgcatggcttcggcgattacgttcttggacggctacacgaccgaacgtctgcctgccaacctcttgcaggcacagcgcgactacttcggcgcgcacacttacgagcgcaccgacaaaccgcgcggtgagtttttccataccaactggacgggcaagggcggagataccgcttcgacaacctacgatatttga

SEQ ID NO: 11817 - protein, 482 aa, Neisseria meningitidis
MNGDIGVIGLAVMGQNLILNMNDCGFKVVAYNRTTAKVDEFLNGAAKGTNIIGAYSLQDLVDKLEKPRKIMMMVRAGSVVDEFIEQLLPLLEEGDILIDGGNANYPDTTRRTHYLAEKGILFVGAGVSGGEEGARRGPSIMPGGDKRAWDAVKPIFQAIAAKTSQGEPCCDWVGKDGAGHFVKMVHNGIEYGDMQLICEAYQFMKDGLGLSYDEMYRVFAEWNKTELDSYLIEITAAILGYKDEGGEPLVEKILDTAGQKGTGKWTGINALDLGIPLTLISEAVFARCVSSFKEQRVQTGKLFARTVTPVEGGKQEWVEALRQALLASKIISYAQGFMLIREAGESYGWDLDYGNTALLWREGCIIRSAFLSNIRDAYENNPDLVFLGADPYFKNILENCLPAWRKVVAKAVECGIPMPCMASAITFLDGYTTERLPANLLQAQRDYFGAHTYERTDKPRGEFFHTNWTGKGGDTASTTYDI

SEQ ID NO: 11818 - DNA, 1425 bp, Streptococcus pneumoniae
  CDS (1)..(1425)
atgacaaaagctaactttggtgtcgtaggtatggccgtaatgggtcgtaaccttgcccttaatattgaatctcgtggttacacagttgctatctacaaccgtagtaaagaaaaaacggaagatgtgattgcttgccatcctgaaaagaactttgtaccaagctatgacgttgaaagttttgtaaactcaatcgaaaaacctcgtcgtatcatgctgatggttcaagctggacctggtacagatgctactatccaagcccttcttccacaccttgacaagggtgatatcttgattgacggaggaaatactttctacaaagataccatccgtcgtaatgaagaattggcaaactctggtatcaactttatcggtactggggtttctggtggtgaaaaaggtgcccttgaaggtccttctatcatgcctggtggacaaaaagaagcctacgaattggttgcggatgttcttgaagaaatctcagctaaagcaccagaagatggcaaaccatgtgtgacttacatcggtcctgatggagctggtcactatgtgaaaatggttcacaatggtattgagtacggtgatatgcaattgatcgcagaaagctatgacttgatgcaacacttgctaggcctttctgcagaagatatggctgaaatctttactgagtggaacaagggtgaattagacagctacttgattgaaatcacagctgatatcttgagccgtaaagacgatgaaggccaagatggaccaatcgtagactacatccttgatgctgcaggtaacaagggaactggtaaatggactagccaatcatctcttgaccttggtgtaccattgtcactgattactgagtcagtgtttgcacgctacatttcaacttacaaagaagaacgtgtacatgctagcaaggtgcttccaaaaccagctgccttcaactttgaaggagacaaggctgaattgattgaaaagatccgtcaagccctttacttctcaaaaatcatttcatacgcacaaggatttgctcaattgcgtgtagcctctaaagaaaacaactggaacttgccatttgcagatatcgcatctatctggcgtgatggctgtatcatccgttctcgtttcttgcaaaagattacagatgcttacaaccgcgatgcagatcttgccaaccttcttttggacgagtacttcttggatgttactgctaagtaccaacaagcagtacgtgatatcgtagctcttgcggttcaagcaggtgtgccagtgccaactttctcagcagctattacttactttgatagctaccgttcagctgaccttccagctaacttgatccaagcacaacgtgactactttggtgctcacacttaccaacgtaaagacaaagaaggaaccttccactactcttggtatgacgaaaaataa

SEQ ID NO: 11819 - protein, 474 aa, Streptococcus pneumoniae
MTKANFGVVGMAVMGRNLALNIESRGYTVAIYNRSKEKTEDVIACHPEKNFVPSYDVESFVNSIEKPRRIMLMVQAGPGTDATIQALLPHLDKGDILIDGGNTFYKDTIRRNEELANSGINFIGTGVSGGEKGALEGPSIMPGGQKEAYELVADVLEEISAKAPEDGKPCVTYIGPDGAGHYVKMVHNGIEYGDMQLIAESYDLMQHLLGLSAEDMAEIFTEWNKGELDSYLIEITADILSRKDDEGQDGPIVDYILDAAGNKGTGKWTSQSSLDLGVPLSLITESVFARYISTYKEERVHASKVLPKPAAFNFEGDKAELIEKIRQALYFSKIISYAQGFAQLRVASKENNWNLPFADIASIWRDGCIIRSRFLQKITDAYNRDADLANLLLDEYFLDVTAKYQQAVRDIVALAVQAGVPVPTFSAAITYFDSYRSADLPANLIQAQRDYFGAHTYQRKDKEGTFHYSWYDEK

SEQ ID NO: 11820 - DNA, 1440 bp, Chlamydophila pneumoniae, Chlamydia pneumoniae
  CDS (1)..(1440)
atgcaaacgaatattggtcttattggcttagctgtcatggggaaaaatcttgtcttaaacatgatagatcatggtttttctgtctctgtctataatcggaccccagagaaaacgcgggacttcttgaaagaataccctaaccaccgagagcttgtagggtttgaatctttagaagattttgtgaattcattggagagaccacgaaagatcatgttgatgattcaagcagggaaacctgtggatcagagcattcatgcgttactgccttttctagaacccggcgatgtgattatcgatggggggaatagctattttaaagattccgaacgacgatgtaaagagttgcaagaaaaggggattctcttcttaggcgtggggatttctggaggagaagaaggtgcacgtcacggcccatcaattatgcctggaggaaatcctgaggcgtggccattagtggctcctatttttcaatcaatagcagcaaaagtacagggccgtccctgctgttcttgggtaggaactggcggtgcaggccactatgtaaaggctgttcacaatggtatagaatacggcgatatccagttgatatgcgaagcttacggtatcttaagagatttcctaaagctctccgcaactgccgttgctacaattttgaaagagtggaatactctagagttggaaagctatctaattcgtattgcttctgaagtcctagcattgaaagatccggaaggaatccctgttattgatacgattttagatgtcgtgggccaaaaaggtacaggaaagtggaccgcaatcgatgctttaaattctggagttcccctttccttaatcataggagctgttcttgctcgtttcctttcttcttggaaagagatacgcgagcaagctgcccgtaattatccaggaacccccttaatatttgaaatgccccatgatccctcggtattcatacaagatgtctttcatgctttatacgcttccaagatcatcagctatgctcagggattcatgcttttaggagaagcttcaaaagaatataattggggattagacctaggagaaattgctttgatgtggcgcgggggatgcattattcaaagtgcatttttagatgttatacataaaggatttgctgccaacccagagaatacctcgctcatcttccaagaatatttccgtggagcattacgccatgcggagatgggatggcgtagaacagtagtgactgcaattggtgcagggctacctattccctgtttagcagcagcaatcacgttttatgatggctatcgtacagcaagctcttcaatgtcgttagctcaaggactgcgagattattttggagctcatacctacgagcgtaacgatcgccctcgaggagagttctatcataccgattgggtgcacacgaaaactacagaaagagtgaagtaa

SEQ ID NO: 11821 - protein, 479 aa, Chlamydophila pneumoniae, Chlamydia pneumoniae
MQTNIGLIGLAVMGKNLVLNMIDHGFSVSVYNRTPEKTRDFLKEYPNHRELVGFESLEDFVNSLERPRKIMLMIQAGKPVDQSIHALLPFLEPGDVIIDGGNSYFKDSERRCKELQEKGILFLGVGISGGEEGARHGPSIMPGGNPEAWPLVAPIFQSIAAKVQGRPCCSWVGTGGAGHYVKAVHNGIEYGDIQLICEAYGILRDFLKLSATAVATILKEWNTLELESYLIRIASEVLALKDPEGIPVIDTILDVVGQKGTGKWTAIDALNSGVPLSLIIGAVLARFLSSWKEIREQAARNYPGTPLIFEMPHDPSVFIQDVFHALYASKIISYAQGFMLLGEASKEYNWGLDLGEIALMWRGGCIIQSAFLDVIHKGFAANPENTSLIFQEYFRGALRHAEMGWRRTVVTAIGAGLPIPCLAAAITFYDGYRTASSSMSLAQGLRDYFGAHTYERNDRPRGEFYHTDWVHTKTTERVK

SEQ ID NO: 11822 - DNA, 1419 bp, Lactococcus lactis subsp. lactis
  CDS (1)..(1419)
atggcacaagcaaactttggtgttgtcggaatggctgtaatggggaaaaaccttgcactcaacgtagagtcacgtggttataccgttgcaatttacaaccgtacgacttcaaaaactgaagaagtttataaagaacatcaagataagaatcttgttctcactaaaacacttgaagaatttgttggaagtcttgaaaaaccacgtcgtatcatgctcatggttcaagcaggagcagcgacagatgcgacaattaaatcacttttaccactcttggataaaggcgatatcttgattgatggtggaaatactcatttcccagacacaatgcgtcgtaatgctgaacttgcagactcaggtattaacttcatcggtacaggagtttctggtggtgaaaaaggtgcgcttttaggcccatcaatgatgcctggtggtcaaaaagaagcctacgatttggttgcaccaatttttgaacaaatcgcagctaaagctcctcaagatggtaaaccatgtgtggcttacatgggagcaaacggtgctggacattacgttaaaatggttcacaacggaattgagtacggcgatatgcaattgattgctgaatcttatgatttgttgaaacgtgttcttggtcttagcaatgcagaaattcaagccatttttgaagaatggaatgaaggcgaacttgatagctacctcattgaaatcactaaagaagtattgaaacgtaaagatgatgaaggcgaaggctacatcgttgataaaattcttgataaagcaggaaacaaaggaactggtaaatggacttcagagtctgcccttgaccttggtgtaccacttccattgattacagaatcagtatttgctcgttacatttcaacttataaagatgaacgtgttaaagcaagcaaagttttatctggaccagcggttaatttctcaggcgataaaaaagaagtcattgaaaaaatccgcaaagcgctatatttctcaaaaattatgagttatgctcaaggatttgctcaacttcgtaaagcttctgaagaatttgattgggacttgccttacggtacaattgcacaaatttggcgtgctggatgtatcattcgtgcagaattcctccaaaatattactgatgctttcgacaaagatagcgaacttgaaaacctcttgcttgatgactactttgtagacatcacaaaacgttatcaagaagctgttcgtgatgtagtttcacttgctgttcaagcaggaattccaattccaacattcacatcagcaattagctactacgatagctatcgttctgaaaatcttccagctaacttgattcaagcccaacgtgattacttcggtgctcacacttatgaacgtacagacaaagctggaatcttccactacgactggtacacagaagattaa

SEQ ID NO: 11823 - protein, 472 aa, Lactococcus lactis subsp. lactis
MAQANFGVVGMAVMGKNLALNVESRGYTVAIYNRTTSKTEEVYKEHQDKNLVLTKTLEEFVGSLEKPRRIMLMVQAGAATDATIKSLLPLLDKGDILIDGGNTHFPDTMRRNAELADSGINFIGTGVSGGEKGALLGPSMMPGGQKEAYDLVAPIFEQIAAKAPQDGKPCVAYMGANGAGHYVKMVHNGIEYGDMQLIAESYDLLKRVLGLSNAEIQAIFEEWNEGELDSYLIEITKEVLKRKDDEGEGYIVDKILDKAGNKGTGKWTSESALDLGVPLPLITESVFARYISTYKDERVKASKVLSGPAVNFSGDKKEVIEKIRKALYFSKIMSYAQGFAQLRKASEEFDWDLPYGTIAQIWRAGCIIRAEFLQNITDAFDKDSELENLLLDDYFVDITKRYQEAVRDVVSLAVQAGIPIPTFTSAISYYDSYRSENLPANLIQAQRDYFGAHTYERTDKAGIFHYDWYTED

SEQ ID NO: 11824 - DNA, 894 bp, Bacillus subtilis
  CDS (1)..(894)
atgaaaatcggattaatcggcttagggaaaatgggcataaacataggaaagcaattcattgaccgcaatcatcaagtggttggatatgatgtaaatcaagcggctgttgatgaactgaaagcatacggggctgaggggacaacaaatcttaaagagttcatttctttattacacccgccgcgcatcctatgggttatggtaccgcatggcattgtcgatgctgttttgcgtgatgtatcacctttattaagtaaaggcgatatgattatcgaagctggaaactctcattataaagaatcaattcgccgctacaatcaaatgaaagaagcgggtatccattatctcgatgccggaacgtcgggcggaatggaaggcgcacggcatggagcctgttttatggtggggggcgatcatgaagcatgggagattgtggaaccgctttttcgtgatactgccgtcgaaaatggttatctatacgctggtgaagcgggaagcggacattttttaaaaatgatccataatggaattgagtatggaatgatggccgcgattggtgaaggattcgaagtgcttgaaaacagccaatttgattttgactacgagaaggttgccagagtgtggaatcatggttctgtcattcgttcttggcttatgggactgactgagcgagctttcgctaaggatgcgaaactggatcagatcaagggcattatgcattcctcaggtgaaggaaaatggacggtggaaaccgcgcttgatctgcagacggcaacgccggtcatcgccatgtcactaatgatgagataccgttctttaacagacgatacgtttacaggaaaggtggttgctgcgcttcgaaatgaatttggaggccatgcgacagaaaaaaagtaa

SEQ ID NO: 11825 - protein, 297 aa, Bacillus subtilis
MKIGLIGLGKMGINIGKQFIDRNHQVVGYDVNQAAVDELKAYGAEGTTNLKEFISLLHPPRILWVMVPHGIVDAVLRDVSPLLSKGDMIIEAGNSHYKESIRRYNQMKEAGIHYLDAGTSGGMEGARHGACFMVGGDHEAWEIVEPLFRDTAVENGYLYAGEAGSGHFLKMIHNGIEYGMMAAIGEGFEVLENSQFDFDYEKVARVWNHGSVIRSWLMGLTERAFAKDAKLDQIKGIMHSSGEGKWTVETALDLQTATPVIAMSLMMRYRSLTDDTFTGKVVAALRNEFGGHATEKK

SEQ ID NO: 11826 - DNA, 1407 bp, Staphylococcus aureus
  CDS (1)..(1407)
atgacacaacaaattggagttattggtttagccgttatgggtaaaaacctagcttggaatattgaatcacgcggatatagtgtatctgtatttaaccgctcaagtgaaaaaactgatttaatggttgaagaatcaaaagggaaaaatattcatccaacgtattcattggaagaatttgttaattctttagaaaaaccacgtaaaattttattaatggttcaagcaggtaaagctacggatgcaacgattgatagtttgttacctttattagatgatggagatattttaattgatggtggtaatacaaactatcaagatactatcagacgtaataaagcattagcacaaagtgcaatcaactttattggtatgggcgtttctggtggtgaaattggagcgttaactggtccgtcattaatgccgggtggacaagaagaagcttataacaaagttgcagatattcttgatgcaattgctgcaaaggcaaaagacggtgcttcatgtgttacttatattggaccaaatggtgctggacactatgtgaaaatggtacacaatggtatcgaatatgctgacatgcaattaattgcagaaagttatgctatgatgaaagaattattaggcatgtctcatgaagacattgctcaaacgttcaaagactggaatgctggtgaattagaaagttatttaattgaaatcactggtgatattttcatgaaattagatgaaaataaagaagcattagttgaaaaaattcttgatactgcaggtcaaaaaggtacaggaaaatggacttcaattaacgcattagaattaggtattccattaacaatcataactgaatctgtatttgcacgttttatctcttcaatcaaagaagagcgcgtaaatgcttctaaagaattaaatggtccaaaagcatcatttgatggtgacaagaaagactttttagaaaaaattcgtaaagcattatatatgagtaaaatttgttcctatgcacaaggtttcgcgcaaatgcgtaaagcaagtgaagataatgaatggaatttaaaacttggtgatttagctatgatttggagagaaggttgcattatccgtgcacaattcttacaaaagatcaaagatgcttacgataataatcctggattacaaaacttattgctagatccttactttaaaaacatcgttactgaatatcaagatgcgttacgtgatgttgtcgcaactggtgttcaaaatggtgtaccaacacctggtttctcatcaagtattaattactatgatagttaccgtgcagctgatttacctgcaaacttaattcaagcacaacgtgactacttcggtgctcacacgtacgaaagaaaagataaagaaggcgtattccatacacaatggattgaagaataa

SEQ ID NO: 11827 - protein, 468 aa, Staphylococcus aureus
MTQQIGVIGLAVMGKNLAWNIESRGYSVSVFNRSSEKTDLMVEESKGKNIHPTYSLEEFVNSLEKPRKILLMVQAGKATDATIDSLLPLLDDGDILIDGGNTNYQDTIRRNKALAQSAINFIGMGVSGGEIGALTGPSLMPGGQEEAYNKVADILDAIAAKAKDGASCVTYIGPNGAGHYVKMVHNGIEYADMQLIAESYAMMKELLGMSHEDIAQTFKDWNAGELESYLIEITGDIFMKLDENKEALVEKILDTAGQKGTGKWTSINALELGIPLTIITESVFARFISSIKEERVNASKELNGPKASFDGDKKDFLEKIRKALYMSKICSYAQGFAQMRKASEDNEWNLKLGDLAMIWREGCIIRAQFLQKIKDAYDNNPGLQNLLLDPYFKNIVTEYQDALRDVVATGVQNGVPTPGFSSSINYYDSYRAADLPANLIQAQRDYFGAHTYERKDKEGVFHTQWIEE

SEQ ID NO: 11828 - DNA, 1395 bp, Borrelia burgdorferi (Lyme disease spirochete)
  CDS (1)..(1395)
atggatgtaggaatttatggacttggtgttatgggtagtaatttagctctaaatattgctgataacggttttaatgtttctgtttacaatagagataatgaaaaaactgaaatttttgttaaacaaaattctcataaaaagataaatggttttaaagatattgaatcttttgttaaaagcttaaaaactccaaaaaaaatcatcttaatggtgacaagctctgctatagaaaaggttattgagcaaattttaccctttatgaataaatcagacataattattgatggtggaaattctcattataagagcacaatgagattggaaaaagaattgtttgctaaagacatttattttgtaggacttggaatttctggaggggagagaggagcaagatttggtcctgcgctaatgtatggaggaagtaaatcagcctatgaaattcttgagcccatgttaaataaaattgcagctaaaactaaaaataatgatatttgttcgacttatattggggagaacggttctgggcactatgttaaaatgatacataatggagtggaatacgctgatatgcagcttatcagcgaggtttattttttcatgaaaaaagctttcaatttagataatttgaaaatttctgaagtttttgaaaaatggaatgaaggcgatctttcagggtatttactagaaataacttctaagattcttaaatataaagaaaataatgaatatttagttgataagattttagatattgcaaatcaaaaaggcactggtgtttggacagctattgatgctcttgaatctggtgtgcctgtaaatttaattgttgaatctgttttttcaagatttatgtcggggttaaaacacgaaaggattattgctagcgatttacttaagatggatacttcttcttttgagtttgagcttagtgattggattttagatctttattatgctcttttagtttcaaaaatagtagcttatgctcaaggttttatgatgcttaagaccgcgtctgtgaattatggttgggatttgaatttaggtaaaatttctttggtttggagagaaggctgtattattcgtagcagttttttagataaaattaaattggcttatgataaaaatcctcatcttattaatttgctttttgatgattattttttagatttactaaaaaataatcacaaatctttaagaagaataatttcaaaggctagtgaaattgggattcctttgccagcattttatgccagcctttcgtttttagattcttattctactaattatctgccttctaatctaattcaagcacaaagagatttttttggtgctcattcttttgaaagattagactcaaaacgaggtgaattttttcatagcgcttggcaataa

SEQ ID NO: 11829 - protein, 464 aa, Borrelia burgdorferi (Lyme disease spirochete)
MDVGIYGLGVMGSNLALNIADNGFNVSVYNRDNEKTEIFVKQNSHKKINGFKDIESFVKSLKTPKKIILMVTSSAIEKVIEQILPFMNKSDIIIDGGNSHYKSTMRLEKELFAKDIYFVGLGISGGERGARFGPALMYGGSKSAYEILEPMLNKIAAKTKNNDICSTYIGENGSGHYVKMIHNGVEYADMQLISEVYFFMKKAFNLDNLKISEVFEKWNEGDLSGYLLEITSKILKYKENNEYLVDKILDIANQKGTGVWTAIDALESGVPVNLIVESVFSRFMSGLKHERIIASDLLKMDTSSFEFELSDWILDLYYALLVSKIVAYAQGFMMLKTASVNYGWDLNLGKISLVWREGCIIRSSFLDKIKLAYDKNPHLINLLFDDYFLDLLKNNHKSLRRIISKASEIGIPLPAFYASLSFLDSYSTNYLPSNLIQAQRDFFGAHSFERLDSKRGEFFHSAWQ

SEQ ID NO: 11830 - DNA, 903 bp, Aquifex aeolicus
  CDS (1)..(903)
atgaaaacacttttcctcataggtctggggcgcatgggctctgccctcgcctacagactcaagaacagaggctgggagatttacggctattctcgcacacaaacaaccagagaaagagccaaaaaggacctagggataaaggttttaaactcttatgaaaatctaaaaaacttcccttctcctaaaactgtgtggctaatggttccacacaccgcagtggacgaggttctccaaaatttaaaaccttttctaaataagggagatacggtaatagacggaggaaattcttactataaagattcccagaggaggtatagggaactaaaggaagtagatgtaaactttctggatgttggagtaagcggagggattctcggaaaggatacgggcttctcctttatgataggcggagatgaagaagtctttaaaaaacacgaaaagctctttaaggatttggcctacgaggaaaaggggtacgcttatcttggaagtagcggtgcggggcactttgcgaaaatggttcacaacggtattgagtacggaattatggaagcgatagcagagggctttgagctcctaaaaaagtctccttttgattacgatttgagagaagttgcgagagtttactcgcagggaagcgtaatacgttcttttttgattgatctccttgttaaagcctttgaagacttcggagaccttgaagacgtggagggttacgttgaggacagcggagagggcaggtggtgcgttaaagaaagcgtagaactcggagcccctattcccgtaatagctcaatccttttacgaaaggttttcatcaagggagaaagatctatttaaaaacaaagttttggcagttttgaggtatgagttcgggagacacagagttaagaaaaaggattga

SEQ ID NO: 11831 - protein, 300 aa, Aquifex aeolicus
MKTLFLIGLGRMGSALAYRLKNRGWEIYGYSRTQTTRERAKKDLGIKVLNSYENLKNFPSPKTVWLMVPHTAVDEVLQNLKPFLNKGDTVIDGGNSYYKDSQRRYRELKEVDVNFLDVGVSGGILGKDTGFSFMIGGDEEVFKKHEKLFKDLAYEEKGYAYLGSSGAGHFAKMVHNGIEYGIMEAIAEGFELLKKSPFDYDLREVARVYSQGSVIRSFLIDLLVKAFEDFGDLEDVEGYVEDSGEGRWCVKESVELGAPIPVIAQSFYERFSSREKDLFKNKVLAVLRYEFGRHRVKKKD

SEQ ID NO: 11832 - DNA, 1687 bp, Escherichia coli
  CDS (137)..(1543)
attttttgaaatgccatttttttacgcataactggattttgtaatatctcagtattaatattggtttaaattttattctgaccatattcaagccgcgtataccttgtgcggcgaccacacctgacaggagtatgtaatgtctaagcaacagatcggcgtcgtcggtatggcagtgatggggcgcaacctggcgctcaacatcgaaagccgaggttataccgtctccatcttcaaccgctcccgcgagaaaactgaagaagttgttgccgagaacccgggtaagaaactggttccttattacacggtgaaagagttcgtcgagtctcttgaaaccccacgtcgtatcctgttaatggtaaaagcaggggcgggaactgatgctgctatcgattccctgaagccgtaccttgataaaggcgacatcattattgatggtggtaacaccttcttccaggacactatccgtcgtaaccgtgagctgtcagcagaaggttttaacttcatcggtaccggcgtgtccggtggtgaagaaggggcgctgaaaggcccatctatcatgcctggtggccagaaagaagcgtatgagctggttgcgcctatcctgaccaagattgccgctgttgccgaagatggtgaaccgtgcgtaacctacatcggcgctgatggcgcaggtcattatgtgaagatggtgcataacggtattgaatacggcgacatgcagctgattgctgaagcctattccttgctgaaaggcggcctgaacctgtctaacgaagagctggctaccaccttcaccgagtggaatgaaggcgagctgagcagctacctgatcgatatcactaaagacatcttcaccaaaaaagatgaagacggtaactacctggttgatgtgatcctggacgaagcggcgaacaaaggcaccggtaaatggaccagccagagctctctggatctgggtgaaccactgtcgctgatcaccgaatccgtattcgcgcgctacatctcttctctgaaagaccagcgcgttgcggcatctaaagtgctgtccggcccacaggctaaactggctggtgataaagcagagtttgttgagaaagttcgtcgcgcgctgtatttgggcaaaatcgtctcttatgcccagggtttctctcaactgcgtgccgcatctgacgaatacaactgggatctgaactacggtgaaatcgcgaagatcttccgcgcgggctgcatcattcgcgcgcagttcctgcagaaaatcaccgacgcctatgccgaaaacaaaggtatcgcgaacctgctgctggctccgtacttcaaaaatatcgctgacgattatcagcaagcgctgcgtgatgtggtggcttatgctgtgcagaacggtattccggtaccgaccttctcagcagcggtagcctactacgacagctaccgcgctgcggtactgcctgctaacctgatccaggcccagcgcgactactttggtgctcatacgtataaacgcaccgataaagaaggtgcgttccacaccgaatggctggattaatctgatttagtctaactgtgaatccaggcccggagtgctcctccgggcttttaattgccaaaaaatgggattcagtcaggtccgatatccggtgttgtacgaatcacgatatactgtcgatcgagagccgatgtgccagttgtt

SEQ ID NO: 11833 - protein, 468 aa, Escherichia coli
MSKQQIGVVGMAVMGRNLALNIESRGYTVSIFNRSREKTEEVVAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELATTFTEWNEGELSSYLIDITKDIFTKKDEDGNYLVDVILDEAANKGTGKWTSQSSLDLGEPLSLITESVFARYISSLKDQRVAASKVLSGPQAKLAGDKAEFVEKVRRALYLGKIVSYAQGFSQLRAASDEYNWDLNYGEIAKIFRAGCIIRAQFLQKITDAYAENKGIANLLLAPYFKNIADDYQQALRDVVAYAVQNGIPVPTFSAAVAYYDSYRAAVLPANLIQAQRDYFGAHTYKRTDKEGAFHTEWLD

SEQ ID NO: 11834 - DNA, 1407 bp, Escherichia coli
  CDS (1)..(1407)
atgtccaagcaacagatcggggttgtcggtatggctgtgatggggcgtaaccttgcgctgaacatcgaaagccgcggttataccgtctccgttttcaaccgctcccgtgaaaagaccgaagaagttattgccgaaaaccctggcaagaagctggttccttactacacagtacaagagtttgtagaatccctcgaaacaccacgtcgtatcctgttgatggtgaaggccgggtctggcaccgacagcgccatcgattccctgaagccttacctcgataaaggcgacatcatcattgatggcggcaacaccttcttccaagacaccatccgtcgtaaccgtgaactgtctgccgaaggttttaactttatcggtaccggtgtttccggtggtgaagagggtgctctgaaagggccttccatcatgcctggtgggcagaaagaagcctatgagctggttgcgccgattctgaagcagattgctgccgttgctgaagacggtgagccatgtgtgacctatatcggtgctgatggtgctggccattatgtgaagatggttcataacggcatcgagtatggtgacatgcagttgattgctgaagcctatgcgctgttgaaaggcggtctgacactttccaacgaagagctggcgcaaaccttcactgaatggaacgaaggcgagctaagcagctacctgtacgacattaccaaagatatcttcaccaagaaggatgaagaaggtaagtacctcgttgatgtcattcttgatgaagcagcaaacaaaggtaccggtaagtggaccagccagagctcactggatctcggcgaacctctgtctctgatcaccgaatccgtatttcctcgttacatctcttcgcttaaagaccagcgtgtagctgcttcgaaagtgctgagtggtccgcaggctcaaccggctggtgataaagctgaatttatcgaaaaagttcgtcgcgcgttgtacctcggtaagatcgtttcctatgctcagggcttctctcagctgcgagctgcttctgatgaatacaactgggagctaaactacgcggagatcgctaagattttccgcgcgggctgcatcattcgtgcccagttcctgcagaagattactgatgcttatgcgcaaaacgctggtattgctaatctcctgctggcaccgtacttcaaacagatcgctgatgactatcagcaggcgctgcgtgatgtcgttgcgtatgccgtgcagaatggtattcgggtaccgacattctctgccgcaattgcttactacgacagctaccgttccgcggttctgcccgctaatctgattcaggctcagcgtgattattttggtgcgcacacctataagcgtactgataaagaaggtgtattccataccgagtggttggaataa

SEQ ID NO: 11835 - protein, 468 aa, Escherichia coli
MSKQQIGVVGMAVMGRNLALNIESRGYTVSVFNRSREKTEEVIAENPGKKLVPYYTVQEFVESLETPRRILLMVKAGSGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLTLSNEELAQTFTEWNEGELSSYLYDITKDIFTKKDEEGKYLVDVILDEAANKGTGKWTSQSSLDLGEPLSLITESVFPRYISSLKDQRVAASKVLSGPQAQPAGDKAEFIEKVRRALYLGKIVSYAQGFSQLRAASDEYNWELNYAEIAKIFRAGCIIRAQFLQKITDAYAQNAGIANLLLAPYFKQIADDYQQALRDVVAYAVQNGIRVPTFSAAIAYYDSYRSAVLPANLIQAQRDYFGAHTYKRTDKEGVFHTEWLE

SEQ ID NO: 11836 - DNA, 1404 bp, Bacillus licheniformis
  CDS (1)..(1404)
atgcgcaatacaatcggtgtcataggtttgggagtcatggggagcaatatcgccctgaacatggcaagcaaaggcgaacaagtcgccgtctataactacacaagggatttaaccgatcaactcgtccaaaaaacgggaggccaaacagtcaagccgtactatgaacttgaagatttcgtacagtctttagaaaaaccgagaaaaatctttcttatggtcacagcaggcaaaccggttgattctgttatcgactcgctcgttcctctgcttgaagaaggggatgtcatcatggacggcggcaactcccactacgaagatacggaacgaagatatgacagtttgaaagcgaaaggtatcggctacttgggaatcggcatttccggcggcgaagtcggcgctttaaaaggcccatccattatgcccggcggagatcgggacgtctacgaaaaagcagctccgattctcacaaaaatcgccgcccaagtagaaggagatccatgctgtgtctacatcggtccaaaaggcgcggggcattttgttaaaatggtgcacaacggcatcgaatacgcagacatgcagcttatcgctgaagcgtatacatttttaagagaaaagcttcttttgccgatagatgaaatcgctgacattttcgacacgtggaatcaaggagagctgaaaagctatttaatcgaaatcacggcagagatcctgaggaaaaaggatgagcgaacgggcgctccgctcatcgacgtcatcctcgacaaaaccggccaaaaaggcacgggcaaatggacgagcctgcaggccatcgacaacggcattccatcatcaattatcacggaatccctgtttgcccgttacctgtcatcattaaaagacgaacggacagctgccgaaaacgtattggccgggcctgaaacagaagaacggcccctggatcagaacgtgtggatcgaccgcgtcagacaggcgttatacatggggaaagtctgcgcctatgcccaaggcttcgctcaatataaaatgacgtctgatctgaacggatggcacctgccgttaaaggacatcgccctcatcttccgcggcggctgcatcatccgcgcacaatttttaaatctcatcagcgaagtttacgacaaacagccggacctgtccaacctgctggtcgcacctgacttcgctgaaaaactaaaagaataccagtccggcttgcgaaaggtcgtctgcgaaggcatcagctcaggcatctcattcccgtgcctgagcaccgccctctcctattacgacggctaccggacgggccgctcaaacgcaaacctactgcaggcgcaggcgaattatttcggcgctcacacgtatgagcggacggatatggaaggcgtgtttcatacggactggtattaa

SEQ ID NO: 11837 - protein, 467 aa, Bacillus licheniformis
MRNTIGVIGLGVMGSNIALNMASKGEQVAVYNYTRDLTDQLVQKTGGQTVKPYYELEDFVQSLEKPRKIFLMVTAGKPVDSVIDSLVPLLEEGDVIMDGGNSHYEDTERRYDSLKAKGIGYLGIGISGGEVGALKGPSIMPGGDRDVYEKAAPILTKIAAQVEGDPCCVYIGPKGAGHFVKMVHNGIEYADMQLIAEAYTFLREKLLLPIDEIADIFDTWNQGELKSYLIEITAEILRKKDERTGAPLIDVILDKTGQKGTGKWTSLQAIDNGIPSSIITESLFARYLSSLKDERTAAENVLAGPETEERPLDQNVWIDRVRQALYMGKVCAYAQGFAQYKMTSDLNGWHLPLKDIALIFRGGCIIRAQFLNLISEVYDKQPDLSNLLVAPDFAEKLKEYQSGLRKVVCEGISSGISFPCLSTALSYYDGYRTGRSNANLLQAQANYFGAHTYERTDMEGVFHTDWY

SEQ ID NO: 11838 - DNA, 1455 bp, Actinobacillus actinomycetemcomitans
  CDS (1)..(1455)
atgtcagtaaaaggcgacatcggtgttatcggcttagccgtgatggggcagaacctcattttaaatatgaatgaccacgggtttaaagtggtggcgtataaccgtactacttcaaaagtggacgagtttttagaaggcgcggcgaaaggcacgaacattatcggcgcgtattctttggaagatttggcgaacaaattggaaaaaccgcgtaaagtgatgttaatggtgcgtgcgggtgaagtggtggatcactttattgatgcattgcttccgcatttagaagccggcgacatcattatcgacggcggtaactccaattatccagacaccaaccgtcgcgtggcggcattacgtgaaaaaggcattcgtttcatcggcaccggcgtttccggcggtgaagaaggtgcgcgtcacggaccttccatcatgccgggcggtaacgaagaagcatggcaatttgtgaaaccggtattgcaagccatttccgccaaaaccgaacaaggcgaaccttgttgcgactgggtgggtaaagacggcgcaggtcatttcgtgaaaatggtgcataacggcatcgaatacggcgatatgcaactgatttgtgaagcgtaccaattcctaaaagaaggcgtgggcttgtccgacgacgaattgcaagccaccttcaacgaatggcgcaataccgaattagacagctacttaattgacatcaccgctgacattttgggctataaagacgcagacggcagccgtttggtggataaagtcttagataccgcagggcaaaaaggaaccggcaaatggacagggatcaacgcattggatttcggcattccgttgaccttaatcaccgaatccgtgttcgcccgttgcgtgtctgcctttaaagatcaacgcgtcgccgcaagcaaattgttccacaaaaccatcggtaaagtggaaggcgataaaaaagtgtggattgaagcggtgcgcaaagcattgttggcgtctaaaatcatttcttacgcacaaggctttatgttgattcgtgaagcgtccgaacacttcaactggaacatcaactacggcaacacggcattgttatggcgtgaaggttgtattatccgtagccgtttcttgggcaacattcgtgatgcgtacgaagccaatccggatctaattttcttaggctccgacagctacttcaaaggcattttagaaaacgccatgagcgactggcgcaaagtggtggcgaaatccatcgaagtgggtatcccaatgccttgtatggcatctgcgattaccttcttagatggctacacgtcagctcgtttgcctgcaaacttattgcaagcacaacgcgactacttcggcgcccacacctatgagcgtaccgacaaaccacgcggtgaattcttccacaccaactggacgggacgtggcggcaacaccgcttccactacttatgatgtgtag

SEQ ID NO: 11839 - protein, 484 aa, Actinobacillus actinomycetemcomitans
MSVKGDIGVIGLAVMGQNLILNMNDHGFKVVAYNRTTSKVDEFLEGAAKGTNIIGAYSLEDLANKLEKPRKVMLMVRAGEVVDHFIDALLPHLEAGDIIIDGGNSNYPDTNRRVAALREKGIRFIGTGVSGGEEGARHGPSIMPGGNEEAWQFVKPVLQAISAKTEQGEPCCDWVGKDGAGHFVKMVHNGIEYGDMQLICEAYQFLKEGVGLSDDELQATFNEWRNTELDSYLIDITADILGYKDADGSRLVDKVLDTAGQKGTGKWTGINALDFGIPLTLITESVFARCVSAFKDQRVAASKLFHKTIGKVEGDKKVWIEAVRKALLASKIISYAQGFMLIREASEHFNWNINYGNTALLWREGCIIRSRFLGNIRDAYEANPDLIFLGSDSYFKGILENAMSDWRKVVAKSIEVGIPMPCMASAITFLDGYTSARLPANLLQAQRDYFGAHTYERTDKPRGEFFHTNWTGRGGNTASTTYDV

SEQ ID NO: 11840 - DNA, 1915 bp, Drosophila melanogaster
  CDS (272)..(1717)
agtagcagtactcattagagtccactcacaaaattagcaccaaccggcagtaattggtcaaggatcggcgatagcttcaaactccgaagttcaaagtcaaactgccgccctgcgaaagcttcgcgagtggagcttttctgcacttatcgatagctaacattgtggcgcgactatcgatcgacgagctgccgcttaacagtgccatatatagattgtaacattaggagctcaaatcattgttggaacacaaaccacaaagaacacacgaaacatgagcggacaagcggatattgccctcatcggcctggccgtcatgggccaaaacctgatactcaacatggacgagaagggattcgtggtgtgcgcctacaaccgcacggtggccaaggtcaaggagttcctcgccaatgaggctaaggacaccaaagtgattggagccgactcgctcgaggacatggtctccaagctgaagagcccccggaaggtcatgctgctggtcaaggctggaagtgcagtcgacgacttcatccagcagctggtgccgctgctttccgccggcgatgtgatcatcgatggtggcaactcggagtatcaggacacatctcgccgctgcgacgagttagccaaacttggcctgctcttcgtcggatccggcgtgagcggtggcgaggagggcgcccgccacggaccctcgctgatgcccggcggacacgaggccgcgtggccccttatccaacccatcttccaggcgatctgcgccaaggccgacggtgaaccctgctgcgagtgggtgggcgatggaggcgccggtcacttcgtcaagatggtgcacaacggcatcgaatacggtgacatgcagctgatctgcgaggcgtaccacatcatgaagagcctgggactgtcggctgaccagatggcagacgagttcggcaagtggaactcggccgaactggactccttcctcattgaaatcacgcgtgatattcttaagtacaaggacggcaaaggttatctgctggagcggattcgcgataccgccggccagaagggcacgggcaagtggacggcaatcgctgctctgcagtatggagtgcctgtgacgctaattggcgaggcggtcttctcgcgatgcctgtctgccctgaaggacgagcgcgtccaggccagcagcgtgctgaagggaccctcgaccaaggcgcaagtggccaacctcaccaagttcctcgacgacatcaagcacgctctctactgcgccaagatcgtgtcctacgcccagggattcatgctcatgcgagaggcggccagggagaacaagtggagacttaattacggcggcattgcgctgatgtggcgtggcggctgcatcatccgcagcgtctttctgggcaacattaaggacgcgtatacgtcgcagccggagctgtctaatctgctgctggatgacttcttcaagaaggccatcgagcgcggccaggactcgtggcgcgaggtggtggccaatgccttccgctggggcattcccgtgccggccctgtctaccgccctaagcttctacgacggctaccgcacggccaagctgccagccaacttgctgcaggcccagagggattacttcggcgcccacacctatgagctgctgggccaggagggtcagttccaccacacgaactggacaggcaccggcggcaatgtgtccgccagcacttaccaggcgtaggttccacctgctccactttcccgttcacacattccatgtcattggcgccggtgtcttagatgtttcttttttttttctggagtactttagtacttatttataccattaatatatatgtatgtatatagaatttcataattgttgttaaacataacattaaattggtgtttttttgctagcaaaaaaaaaaaaaaaaaa

SEQ ID NO: 11841 - protein, 481 aa, Drosophila melanogaster
MSGQADIALIGLAVMGQNLILNMDEKGFVVCAYNRTVAKVKEFLANEAKDTKVIGADSLEDMVSKLKSPRKVMLLVKAGSAVDDFIQQLVPLLSAGDVIIDGGNSEYQDTSRRCDELAKLGLLFVGSGVSGGEEGARHGPSLMPGGHEAAWPLIQPIFQAICAKADGEPCCEWVGDGGAGHFVKMVHNGIEYGDMQLICEAYHIMKSLGLSADQMADEFGKWNSAELDSFLIEITRDILKYKDGKGYLLERIRDTAGQKGTGKWTAIAALQYGVPVTLIGEAVFSRCLSALKDERVQASSVLKGPSTKAQVANLTKFLDDIKHALYCAKIVSYAQGFMLMREAARENKWRLNYGGIALMWRGGCIIRSVFLGNIKDAYTSQPELSNLLLDDFFKKAIERGQDSWREVVANAFRWGIPVPALSTALSFYDGYRTAKLPANLLQAQRDYFGAHTYELLGQEGQFHHTNWTGTGGNVSASTYQA

SEQ ID NO: 11842 - DNA, 1407 bp, Salmonella typhimurium
  CDS (1)..(1407)
atgtccaagcaacagatcggcgtcgtcggtatggcagtgatggggcgcaacctcgcgctcaacatcgaaagccgtggttataccgtctccgttttcaaccgctcccgtgaaaagaccgaagaagtgattgccgagaatcccggcaaaaagctggtgccttattacacggtgaaagagtttgttgaatccctcgaaacgcctcgtcgtatcctgttaatggtgaaagcgggcgcaggtactgatgcagctatcgattcgctgaaaccgtatctggaaaaaggcgatatcattattgatggcggtaacaccttcttccaggacacaatccgtcgcaatcgcgagctgtctgcggaaggttttaactttatcggtaccggtgtttccggtggtgaagagggcgcgctgaaagggccatctatcatgcctggcggtcagaaagatgcctatgaactggtggcgccgatcctgacgaagattgctgctgtggcagaagatggcgaaccgtgcgtgacctatatcggcgccgatggtgctggtcactacgtcaagatggtccacaatggtattgaatatggcgatatgcagcttatcgctgaagcttactccctgctgaaaggcggcctgaatctcagcaatgaagagttggcgaacacttttactgagtggaataacggcgagctgagcagctatctgatcgacatcactaaagacatcttcactaaaaaagatgaagacggaaactacctggtggatgtcattcttgatgaagccgccaacaaagggaccggtaaatggaccagccagagcgcgctggatctgggtgaaccgctgtcgctgattaccgaatccgtctttgcgcgttacatctcttcgttgaaagcgcaacgtgttgccgcatctaaagtgctctccgggccgaaagcgcagccggcaggcgacaaagctgaatttatcgagaaagtgcgtcgcgcgctgtatcttggcaagatcgtctcctatgcgcagggcttctcgcagctacgcgccgcgtctgatgaatatcactgggatctcaactacggcgagattgctaagattttccgggcgggctgtatcattcgcgctcagttcctgcagaagatcaccgatgcttacgcagaaaacgccgatatcgctaacttgctgttagcgccttacttcaagaaaattgctgatgagtaccagcaggcgctgcgcgatgtcgtggcttacgcggtgcagaacggcattccggtgccgacattctctgcggcagtggcctactatgacagctatcgcgccgcagtactgccagctaacttaattcaggcgcagcgtgactactttggtgcgcacacctataaacgtactgataaagaaggcattttccataccgaatggttggaataa

SEQ ID NO: 11843 - protein, 468 aa, Salmonella typhimurium
MSKQQIGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYFGAHTYKRTDKEGIFHTEWLE

SEQ ID NO: 11844 - DNA, 2263 bp, Synechococcus sp
  CDS (202)..(1614)
aagcttgcccccgtcatcagggcctgaccgatgcgatcgccgtcaagaatccacccccaggcattcaatttttctctgatctgtaaataaatccgcgatcgccgccgtgatccccgcaaagaaagtctaaagaggttgccagagaaccccaaattggcaggctaacctgaggtcattcgttgtcctagcaggaattttcctatggcactgcaacagttcggcctcatcgggctggcagtgatgggtgagaatctcgccctgaacattgagcgcaacggtttttccttgacggtctataaccgcacggccgaaaagactgaagcgttcatggccgatcgcgcccaaggcaagaacattgtgccggcttacagtctggaagactttgttgccagcttggaacgtccgcgccgcattttggtgatggttaaagcgggcggcccggtggatgccgtggtcgagcagctcaaacccctgctagatcccggtgacttgatcatcgatgggggcaactcactgtttaccgacaccgagcgccgcgtcaaagatctagaagcgctaggtctgggtttcatgggcatgggcgtcagtggtggcgaagagggggctttgaatggccccagtttgatgccggggggcacccaagcggcctacgaagccgtggagccgatcgtgcgcacgattgctgcccaagtcgacgatggcccctgcgttacctacatcggtcctggtggctctgggcactacgtcaagatggtgcacaacggcattgaatatggcgatatgcagctgatcgccgaagcctatgacctcctcaaatcggtggcaggcctcaatgccagtgaactgcatgatgtcttcgccgcctggaacaaaacgccggaactcgactcgttcttgattgaaatcacggcggatattttcaccaaagtcgatgacttgggtactggtcagcccttggtcgagctgattttagatgccgctggtcaaaaaggaaccggtcgctggacggtggaaacggcactggaaattggcgttgcgattccaaccatcattgctgctgtcaacgcccgcatcctgtcctcgatcaaagccgagcgtcaggcagcttctgaaattctttcaggaccgattaccgagcccttcagtggcgatcgccaagcctttatcgacagtgtgcgcgatgcgctctactgctcgaaaatttgctcctatgcccaaggcatggcgctgctagccaaagcctcccaggtctacaactacggtctgaatttaggtgaactggcgcggatttggaaaggcggctgcatcattcgggcgggtttcctcaacaagattaagcaggcctatgatgctgacccaacgctggcgaatctgttgctggcacccgaattccggcagacgattctcgatcgccagttgcgttggcggcgcgtgattgcgatccggcagaacgaggaattccggttccgctttcagtgcttccctggattacttcgacagctaccggcgcgatcgctgccccaaaacctcacccaggctcagcgcgactacttcggcgctcatacctacgaacgcaccgatcgctctggctctttccatgcccagtggttctagggcgacaaactccggtcgctgcgctggtcagacggaccaactcctttggcagaatcaggactggcaaggcgatcggagagcgtgatggatgtgttggtggtgcgcggcatcctgctgacggctacacggggttctttgatgccgagcaagaactgggccagtggtttgaggtggacttgcgcgtctgggtcgatcttcagcctgctggggacacgatcacgtcggcgaacaccctcgactacagccaagcggtacaggtcgtgcaaacggggattcgccagagtcgctttcgcacgatcgagcgattggcggctgatctctgcgatcgcctgtttcagcagtttccagccctaccggaattggaactgacgttgcggaaactggcccctcccattcctgactttagtggtgatgtcagcttggttctgcggcgatcgcggaagttaacgggtgcggattgatgctagcaaggggtccgaagatgctcgttctccagagctgacgagactgttttatagacttcaatcttgagataaaagttgactcgcgatcgttagatttgggcatataatcctgagttctaatagctctttttagggttccaaactgtaagtttgaggattcactttggaactaagtcaatccgaat

SEQ ID NO: 11845 - protein, 470 aa, Synechococcus sp
MALQQFGLIGLAVMGENLALNIERNGFSLTVYNRTAEKTEAFMADRAQGKNIVPAYSLEDFVASLERPRRILVMVKAGGPVDAVVEQLKPLLDPGDLIIDGGNSLFTDTERRVKDLEALGLGFMGMGVSGGEEGALNGPSLMPGGTQAAYEAVEPIVRTIAAQVDDGPCVTYIGPGGSGHYVKMVHNGIEYGDMQLIAEAYDLLKSVAGLNASELHDVFAAWNKTPELDSFLIEITADIFTKVDDLGTGQPLVELILDAAGQKGTGRWTVETALEIGVAIPTIIAAVNARILSSIKAERQAASEILSGPITEPFSGDRQAFIDSVRDALYCSKICSYAQGMALLAKASQVYNYGLNLGELARIWKGGCIIRAGFLNKIKQAYDADPTLANLLLAPEFRQTILDRQLRWRRVIAIRQNEEFRFRFQCFPGLLRQLPARSLPQNLTQAQRDYFGAHTYERTDRSGSFHAQWF

SEQ ID NO: 11846 - DNA, 2853 bp, Saccharomyces cerevisiae
  CDS (1074)..(2543)
gaattcaaaggatcgaaaactaccgaaaatacaaactctataatcactgctcatttttttgaaaactcgcacagctatgtcactaatgatctcgtcggactgataaaattatggctgttagagctacccgacagcctaataccttcaaaccactacgatgacttaattaaggccgaaaaatcgctaacatccctatgtgaacagtttccgacgagctccttaaggtttctacaagaactagcaaaccattttcaattgatcaatagcaaatactcacttccgccgcaaacaatacaagatttgtttagagacaacagtgacatagacataccattggcccatcacttcgtaagaagaacaggcttacagaaccctatcgacatcaaaatcttgtcaccaacattatctacatttttcatcaacgaaagaactgtagaaactttgcaaacgttgatcgcaaacaggatcacgacggcaactactgcgacactcactgaaccgccgacgataattataaaggatacaacggcacctatacactctacccctaagccaccgccaaacgacaaggatggccatttcatacctcggccattcaagactagttctactccgacaaccccagagagacctaaacgtaagagtggtttattccttcccatcaacgtcaacgatgtcccttctacataactccatgcatgctacatagtaactacgtaaatcacctgctacctctctgttctttcgtcccgcctcgaggttgtgctgcttttgtacctattgtggctgtcggtgttacattacggtgcctcggtgttacgcggtgcttcgtcctggtggtccacgcggccttgcgctttggccttggtgggcttcgaggctgtattatataaatgggcctgatgttcgttaaaagctgcagtattgttcctgagcttgtttctttttcaaaggtttccttttttcttagtggggtcctttcttacataataaagtaaatagcctgatacatataaacctgtattgttgccattacagaaaaaagccactttctatacaaaaactacaataaaatgtctgctgatttcggtttgattggtttggccgtcatgggtcaaaatttgatcttgaacgctgctgaccacggtttcactgtttgtgcttacaacagaactcaatccaaggtcgaccatttcttggccaatgaagctaagggcaaatctatcatcggtgctacttccattgaagatttcatctccaaattgaagagacctagaaaggtcatgcttttggttaaagctggtgctccagttgacgctttgatcaaccaaatcgtcccacttttggaaaagggtgatattatcatcgatggtggtaactctcacttcccagattctaatagacgttacgaagaattgaagaagaagggtattcttttcgttggttctggtgtctccggtggtgaggaaggtgcccgttacggtccatctttgatgccaggtggttctgaagaagcttggccacatattaagaacatcttccaatccatctctgctaaatccgacggtgaaccatgttgcgaatgggttggcccagccggtgctggtcactacgtcaagatggttcacaacggtattgaatacggtgatatgcaattgatttgtgaagcttatgacatcatgaagagattgggtgggtttaccgataaggaaatcagtgacgtttttgccaaatggaacaatggtgtcttggattccttcttggtcgaaattaccagagatattttgaaattcgacgacgtcgacggtaagccattagttgaaaaaatcatggatactgctggtcaaaagggtactggtaagtggactgccatcaacgccttggatttgggtatgccagttactttgattggtgaagctgtctttgcccgttgtctatctgctttgaagaacgagagaattagagcctccaaggtcttaccaggcccagaagttccaaaagacgccgtcaaggacagagaacaatttgtcgatgatttggaacaagctttgtatgcttccaagattatttcttacgctcaaggtttcatgttgatccgtgaagctgctgctacttatggctggaaactaaacaaccctgccatcgctttgatgtggagaggtggttgtatcattagatctgttttcttgggtcaaatcacaaaggcctacagagaagaaccagatttggaaaacttgttgttcaacaagttcttcgctgatgccgtcaccaaggctcaatctggttggagaaagtcaattgcgttggctaccacctacggtatcccaacaccagccttttccaccgctttgtctttctacgatgggtacagatctgaaagattgccagccaacttactacaagctcaacgtgactactttggtgctcacactttcagagtgttgccagaatgtgcttctgacaacttgccagtagacaaggatatccatatcaactggactggccacggtggtaatgtttcttcctctacataccaagcttaaaggaaatctccaacctggacataaaccaaaaaaatttaatgaaatagattagttatagtaaaagtaatcataataataaatagataaataaatccaaatgcaattataaatagtatatgaagttatgtgttttctaaaatattaaaggtttataaacggggtcccgaaactatctccatttctttttttttttttacgtaaggaaaggcaaacaggcgacacaaaatcatgaagtcagaaaataaaataaaagtgaaaaatttcacaatagtgcctattatcatgatagaagtagagtagaaaagctagc

SEQ ID NO: 11847 - protein, 489 aa, Saccharomyces cerevisiae
MSADFGLIGLAVMGQNLILNAADHGFTVCAYNRTQSKVDHFLANEAKGKSIIGATSIEDFISKLKRPRKVMLLVKAGAPVDALINQIVPLLEKGDIIIDGGNSHFPDSNRRYEELKKKGILFVGSGVSGGEEGARYGPSLMPGGSEEAWPHIKNIFQSISAKSDGEPCCEWVGPAGAGHYVKMVHNGIEYGDMQLICEAYDIMKRLGGFTDKEISDVFAKWNNGVLDSFLVEITRDILKFDDVDGKPLVEKIMDTAGQKGTGKWTAINALDLGMPVTLIGEAVFARCLSALKNERIRASKVLPGPEVPKDAVKDREQFVDDLEQALYASKIISYAQGFMLIREAAATYGWKLNNPAIALMWRGGCIIRSVFLGQITKAYREEPDLENLLFNKFFADAVTKAQSGWRKSIALATTYGIPTPAFSTALSFYDGYRSERLPANLLQAQRDYFGAHTFRVLPECASDNLPVDKDIHINWTGHGGNVSSSTYQA

SEQ ID NO: 11848 - DNA, 1618 bp, Medicago sativa (alfalfa)
  CDS (7)..(1467)
tacattatggctccaccacttacaagaataggccttgccggattggctgttatgggccagaatctcgcactcaatattgccgacaaaggattcccaatttctgtttataatagaacaacatcaaaggttgacgaaactgtggaacgagcaaaacaggagggaaatcttccactctatggcttccatgaccctgaagcctttgttaattccattgaaaaaccaagggtgattataatgcttgttaaggctggtgcacctgttgaacagaccaccaaaaccctatctgcgtaccttgaaaaaggtgattgtataattgatggtgataatgaatggtacgagaacactgagagacgagagaaagaggtagccgaattgggtattctctaccttggaatgggagtttcaggtggtgaggagggtgctcgacgtggtccttctatgatgcctggtggttcgtttgaagcttacaaatacatagaagatattcttctcaaggtggctgctcaagttcctgacagtggcccttgtgtgacatatatcggtaacggtggatctggtaattttgtgaagatgatccataatggaattgaatacggtgacatgcagctgattgctgaggcttacgatgtgttgaagtcagttggaaagttgacaaatgaggagctacaaagtgcatttactgaatggaacaagggagaacttttgagtttcctgattgaaatcactgcagatattttcggaattaaggatgataagggtgatggatatcttgttgacaaggttcttgacaaaactggcatgaagggtaccggtaagtggactgttcagcaagcagctgaattatcagttcctgctcccaccattgaagcttcattggatgctaggttccttagtgggttgatggatgaaagagttgaagctgcaaaggtctttaaatcaggtggttttggcgatatcttgaccgaccaacaagtagacaagaagcagttgattgatgatgttaggaaggctctttatgcagccaagatttgtagttacgcacaagggatgaatctgatccgtgcaaagagtgctgaaaagggttgggatttggcattgggtgaacttgcccgtatttggaaaggaggttgcatcattagagctatattcttggacagaatcaagcaagcgtacgacagaaaccctaatctcgcaaaccttcttgtggatccagagttcgcaaaggaaataattgaacgccaaaccgcatggaggagagttgtttccctttctgtcaattcaggtatcagcctcccaggtatgtctgctagtcttgcatattttgacagttatagaagggaaaggttaccggctaatttggtgcaagctcaacgagactacttcggtgctcatacatatgaaagggttgatattgaggggtcgtaccatactgaatggttcaagcttgccaagcagtcaaggatttagattactgtatttgaactcttcaagattcctaataaatgtaatgttttttactcaagactgtatgctgagttgagcttacatagctgcaatgcggtgaagtttatttataccattctgtactacttaattacttggcttttggttttcccca

SEQ ID NO: 11849 - protein, 486 aa, Medicago sativa (alfalfa)
MAPPLTRIGLAGLAVMGQNLALNIADKGFPISVYNRTTSKVDETVERAKQEGNLPLYGFHDPEAFVNSIEKPRVIIMLVKAGAPVEQTTKTLSAYLEKGDCIIDGDNEWYENTERREKEVAELGILYLGMGVSGGEEGARRGPSMMPGGSFEAYKYIEDILLKVAAQVPDSGPCVTYIGNGGSGNFVKMIHNGIEYGDMQLIAEAYDVLKSVGKLTNEELQSAFTEWNKGELLSFLIEITADIFGIKDDKGDGYLVDKVLDKTGMKGTGKWTVQQAAELSVPAPTIEASLDARFLSGLMDERVEAAKVFKSGGFGDILTDQQVDKKQLIDDVRKALYAAKICSYAQGMNLIRAKSAEKGWDLALGELARIWKGGCIIRAIFLDRIKQAYDRNPNLANLLVDPEFAKEIIERQTAWRRVVSLSVNSGISLPGMSASLAYFDSYRRERLPANLVQAQRDYFGAHTYERVDIEGSYHTEWFKLAKQSRI

SEQ ID NO: 11850 - DNA, 894 bp, Mycobacterium smegmatis
  CDS (1)..(894)
atgcaactcgggttgatcggcctgggcaagatgggcttcaacatgcgcgaacgtctgcgcgaagccggccacgaggtgatcggatacgacccgcggcccgaggtcagcgacgtcgcgaacctcgaggagctcgccggtgcactgtcggcgccgcgtgtcgtgtgggtgatggtcccgtcgggcacgatcacccacagcacgatcgtggaactcgcgggcgtgctcagtcccggtgatctggtgatcgacggcggcaactcgcgctacaccgaagacggtccgcacgcagaattgttgggcgagaagggcatcagcttcatcgacgccggtgtgtccggcggcatctggggtctgaccgagggttacggcctgatggtcggcggcagtgacgacgacgtggctcgagccatgccgatcttcgacgcgctgcgtccgccgggcgacgtcgccgacggtttcgtacatgccggcccggtgggtgctggccactacgccaagatggtccacaacggcatcgagtacggcctgatgcacgcctacgccgagggttacgaactgctggcggccgaggaactcatcaaggatccgcaggcggtgatccaggcgtggagcaacggcaccgtggtgcggtcgtggttgcagtcgctattggccaaggcactcaaggaagaccccggtttcgccgagatcagcggttacaccgaggattccggcgagggacgctggaccgtcgaggaggccatcgcccaccgggtcccgatgccggtgatcgcggcgtcgctgttcgcccggttcgcctcgaggcaggaagactcgccgaccatgaaggccgtctcggcgttgcgcaaccagttcggtggtcatgccgtcaagcggatcagcgagtcgggttag

SEQ ID NO: 11851 - protein, 297 aa, Mycobacterium smegmatis
MQLGLIGLGKMGFNMRERLREAGHEVIGYDPRPEVSDVANLEELAGALSAPRVVWVMVPSGTITHSTIVELAGVLSPGDLVIDGGNSRYTEDGPHAELLGEKGISFIDAGVSGGIWGLTEGYGLMVGGSDDDVARAMPIFDALRPPGDVADGFVHAGPVGAGHYAKMVHNGIEYGLMHAYAEGYELLAAEELIKDPQAVIQAWSNGTVVRSWLQSLLAKALKEDPGFAEISGYTEDSGEGRWTVEEAIAHRVPMPVIAASLFARFASRQEDSPTMKAVSALRNQFGGHAVKRISESG

SEQ ID NO: 11852 - DNA, 1449 bp, Synechocystis sp
  CDS (1)..(1449)
atgcaatttaacgtagctattatgactaagcgaacttttggggtaattggactagcggtaatgggggaaaatcttgccctcaacgtggaaagtcgaggctttcccatcgccgtgtttaaccgttcccccaacaaaactgagaaattcatggccgaacgggctgtgggcaaagatatcaaagccgcctacaccgtagaagaatttgtccaactgttggaacgcccccgtaaaatccttgtaatggtcaaagctgggggacccgtggatgcagtgatcaatgagttgaagcccctgttggaagaaggggacatgatcattgatggtggcaactccctttatgaagatacggaacgtcgcaccaaagatttggaagccaccggcctgggctttgtcggcatgggagtcagtggaggggaagaaggcgcattactgggtcctagtttgatgcccggtggtaccccggccgcctacaaagaattggaacccattctgactaaaattgccgcccaggtggaagaccccgataatcccgcctgtgtgacttttattggcccagggggagcaggacattacgtcaaaatggtccacaacggcattgagtatggcgatatgcaactaatcgctgaagcctacgacatcttgaaaaatggcctcggcttgagcaacgaacaactccacgaagtttttggccaatggaatcaaaccgatgagttaaactccttcctgattgaaatcagcaccgacatttttgctaaaaaggatcccgaaaccggaggccatttaattgactacatccttgatgccgccggccaaaagggcacaggacgctggacggtgatgagtggtttggaattaggagtgcccattcccactatttacgccgccgttaacgccagggtaatgtcttccctcaaagaagaacgggtggccgcttccggtcaactgtcgggtcccagtaaaacctttagtggggacgtagaagcctggattcctaaggtgcgggatgccctctattgctcgaaaatgtgttcctatgcccagggcatggccctaattgccaaagcttcccaggaatttggctacgacgttaacctgccggaaattgcccgcatttggaaagggggttgcattatccgagctggctttttagacaagatcaagaaagcttttaaagacaatccccagttgcccaatttacttctagctccggaattcaagcaaagtattttggatcgccaggggccatggcgagaagtgttgatgctggccaatgaaatgggcattgcagtgccggcctttagttcctcgttggattactttgacagttaccggcgggcggtgcttccccaaaacctgactcaagcgcaacgggattactttggggcccacacctatgaacggactgataagccgaggggagaatttttccacacggaatggcttgattga

SEQ ID NO: 11853 - protein, 482 aa, Synechocystis sp
MQFNVAIMTKRTFGVIGLAVMGENLALNVESRGFPIAVFNRSPNKTEKFMAERAVGKDIKAAYTVEEFVQLLERPRKILVMVKAGGPVDAVINELKPLLEEGDMIIDGGNSLYEDTERRTKDLEATGLGFVGMGVSGGEEGALLGPSLMPGGTPAAYKELEPILTKIAAQVEDPDNPACVTFIGPGGAGHYVKMVHNGIEYGDMQLIAEAYDILKNGLGLSNEQLHEVFGQWNQTDELNSFLIEISTDIFAKKDPETGGHLIDYILDAAGQKGTGRWTVMSGLELGVPIPTIYAAVNARVMSSLKEERVAASGQLSGPSKTFSGDVEAWIPKVRDALYCSKMCSYAQGMALIAKASQEFGYDVNLPEIARIWKGGCIIRAGFLDKIKKAFKDNPQLPNLLLAPEFKQSILDRQGPWREVLMLANEMGIAVPAFSSSLDYFDSYRRAVLPQNLTQAQRDYFGAHTYERTDKPRGEFFHTEWLD

SEQ ID NO: 11854 - DNA, 1818 bp, Zea mays (maize)
  CDS (69)..(1523)
ccacgcgtccgcgcgctgcaggggcgacgcaaggtcgagcgctcctcgatccagatccaaggtaggagatggctctcacgagaattggccttgcgggcctcgcggtcatgggacagaaccttgccctcaacatcgcggagaaagggttccctatctcggtctacaacaggacgacctccaaggttgatgagaccgtgcagcgtgccaaggtcgaaggaaacctccccgtgtttggtttccacgaccccgcgtccttcgtgagctccatccagaagccccgtgtcgtcatcatgctcgtcaaggctggggcgccggtggaccagaccattgccacgctcgcggcgcaccttgatcagggggactgtatcgtcgatggtggcaacgagtggtatgagaacacggagaggagggagaaggcgatggaggagcgcgggctcctttatcttggcatgggcgtctccggaggagaggagggtgcccgcaatggcccgtccttgatgcccgggggctccttcgaggcatacaagtacattgaagatattcttctcaaggtggctgctcaggtacctgacagcggcccgtgcgtcacatatattggcaaaggtggatcaggcaactttgtcaagatggttcacaatggaattgaatatggtgacatgcaacttatcgccgaggcttatgatgttctcaagtcggtcggtaagctcacaaacagcgagctgcatcaggtgttctctgagtggaacaagggtgagctcctcagtttcttgattgagatcacggccgacatctttggtatcaaggatgacaagggtgaaggctacctggtcgacaaggtcctggacaagaccgggatgaagggaaccgggaaatggacagtccagcaggctgctgagctttctgtagctgctcctacaatcgaggcgtccttggactccaggttcctcagcggtctgaaggacgagcgcgttgaggcttccaaaattttccaaggtgactactccactggcctaccggtggacaaggcacagctgatcgaggacgtgaggcaagctctatatgcctccaagatctgcagttacgcgcagggcatgaacatcatcaaggccaagagctcagagaaaggatggggcctcaaccttggtgagctagcgaggatctggaagggagggtgcatcatccgtgccatcttcctcgaccgcatcaagaaggcgtacgataggaaccctaaccttgccaacctcctcgttgaccccgagttcgcccaggagatcatagacaggcaagctgcctggcgcagggttgtctgccttgccatcaacaatggcgttagcaccccaggcatgtctgcaagtctggcctacttcgactcgtaccgcagggataggcttcccgccaacctggtgcaggctcagagagactacttcggcgctcacacgtacgagagggttgacatgcctgttctttccacacccaggctcagagagactacttcggcgctcacacgttacgaaaaggtttgacatgcctggttctttccacaccgagtggttcaagattgcgcgcaactccaagatctgaacatggcctcgtgtttgcatatgccagtatgccaccgtgtcgagtaatcaatcatattactgcttgcagggaggaactgtgtttgatttttattttccatgcgcaatgcttaatttaggtcaggaagtccaaagtctctcccattgtttcctgtaagagctaagcagtaccagatggagaaccttatatttgctggaacatgaataaaagcatttgacgtgcttgtgtttagttctc

SEQ ID NO: 11855 - protein, 484 aa, Zea mays (maize)
MALTRIGLAGLAVMGQNLALNIAEKGFPISVYNRTTSKVDETVQRAKVEGNLPVFGFHDPASFVSSIQKPRVVIMLVKAGAPVDQTIATLAAHLDQGDCIVDGGNEWYENTERREKAMEERGLLYLGMGVSGGEEGARNGPSLMPGGSFEAYKYIEDILLKVAAQVPDSGPCVTYIGKGGSGNFVKMVHNGIEYGDMQLIAEAYDVLKSVGKLTNSELHQVFSEWNKGELLSFLIEITADIFGIKDDKGEGYLVDKVLDKTGMKGTGKWTVQQAAELSVAAPTIEASLDSRFLSGLKDERVEASKIFQGDYSTGLPVDKAQLIEDVRQALYASKICSYAQGMNIIKAKSSEKGWGLNLGELARIWKGGCIIRAIFLDRIKKAYDRNPNLANLLVDPEFAQEIIDRQAAWRRVVCLAINNGVSTPGMSASLAYFDSYRRDRLPANLVQAQRDYFGAHTYERVDMPVLSTPRLRETTSALTRYEKV

SEQ ID NO: 11856 - DNA, 1686 bp, Zea mays (maize)
  CDS (99)..(1547)
ccacgcgtccgggtggccggacggtggtggcatcgccaattcaactccgcatctgaatcggcactcggcagcgcgccagctccatagtgtaggaggagatggcgctcacaagaatcggtcttgctggccttgcggtcatggggcagaaccttgccctcaacattgcagagaaagggttccccatctctgtgtacaacaggacaacctccaaggtggacgagaccgtgcagcgtgccaaggcagaaggaaaccttcccgtctacggcttccatgaccccgcgtcctttgtgaagtccattcagaagccacgggtggtgatcatgctcgtcaaggccggcgcgccagttgaccagaccatcgcgacgctcgcagctcacttggagcagggcgactgcatcatcgatggggggaacgagtggtacgagaacacggagaggagggagaaggccatggaggagcgcggcctcctgtatcttggcatggttgtctctggaggagaggagggtgcccgcaacggcccgtccttgatgcccggaggctcgttcgaggcttacaagtacgtcaaagacattgtcctcaaggtggctgctcaggtccctgacagtggcccgtgtgtcacgtacattggcaaaggtggatcgggcaactttgtcaagatggttcacaacggaatcgagtatggcgatatgcagctgatttccgaggcatacgacgttctcaagttcgtcggtaagctcaccaacagtgagctgcaccaggtgttctccgagtggaacaagggcgagctcctgagcttcttgatcgagatcacggccgacatctttggcatcaaggacgagcatggcgatggctacctggtggacaaggtccttgacaagaccgggatgaaagggacagggaagtggacggtgcagcaggccgccgagctgtcggtggccgctcctacgatcgaggcgtccttggactcgaggttcctgagcgggctgaaggacgagcgggtggaggcctccaagatcttccagggtgactactactccaccggctcgccggtggacaaggcgcagctggtggaggacgtgaggcaggccctgtacgcgtccaagatctgcagctacgcgcagggcatgaacatcatcaaggccaagagcgcggagaaaggctgggggctcaacctcggcgagctggccaggatctggaagggcgggtgcatcatccgcgccatcttcctggaccgcatcaagaaggcctacgacaggaacccgggcctcgccagcctgctcgtagaccccgagttcgcgcaggagatcatggacaggcaggcggcgtggcgcagggtggtgtgcctcgccatcaacaacggcgtcagcaccccgggaatgtccgctagcctggcctacttcgactcctaccgcagggacaggctgcctgccaacctggtgcaggcccagagggactacttcggggctcacacctacgagagggtcgacatgcctggctctttccacaccgagtggttcaagattgcgcgcaacatctccaacaactgatgagctgctcaacggatggcatgcccggtgttgactactccagtcggtaatgagatttcctgcaggaacttgtctattgatctttgtaagttaattatttatatgaataaaataagagcagacatgcttgtgtttgggc

SEQ ID NO: 11857 - protein, 482 aa, Zea mays (maize)
MALTRIGLAGLAVMGQNLALNIAEKGFPISVYNRTTSKVDETVQRAKAEGNLPVYGFHDPASFVKSIQKPRVVIMLVKAGAPVDQTIATLAAHLEQGDCIIDGGNEWYENTERREKAMEERGLLYLGMVVSGGEEGARNGPSLMPGGSFEAYKYVKDIVLKVAAQVPDSGPCVTYIGKGGSGNFVKMVHNGIEYGDMQLISEAYDVLKFVGKLTNSELHQVFSEWNKGELLSFLIEITADIFGIKDEHGDGYLVDKVLDKTGMKGTGKWTVQQAAELSVAAPTIEASLDSRFLSGLKDERVEASKIFQGDYYSTGSPVDKAQLVEDVRQALYASKICSYAQGMNIIKAKSAEKGWGLNLGELARIWKGGCIIRAIFLDRIKKAYDRNPGLASLLVDPEFAQEIMDRQAAWRRVVCLAINNGVSTPGMSASLAYFDSYRRDRLPANLVQAQRDYFGAHTYERVDMPGSFHTEWFKIARNISNN

SEQ ID NO: 11858 - DNA, 1667 bp, Glycine max (soybean)
  CDS (55)..(1590)
tgattccagaccttaatttttctctcattcgcttcaaatttcaggaaatcaattatggctcaaccctcaacaggaataggccttgctggactggctgttatgggccaaaatctagcactcaatattgctgagaaaggctttcccatttctgtttataaccgaaccacttccaaggttgatgagactgtagaacgagcaaaacaagaaggaaatcttccagtttatggctaccatgaccccgaagcttttgttcattccattcaaaagcctagggtgataataatgcttgttaaggctggggcacctgttgaccagaccattaagaccctatctgcatacatggaaaaaggtgactgtataattgatggtggtaacgaatggtatgagaacactgaaagaagagagaaagaggtggccgaattgggtctgctctaccttgggttgggagtttctggtggtgaggaaggtgctcgtaatggtccctctttgatgcctggtggttcgtttgaggctttcaaatacatagaagatattcttctcaaggtggcagctcaagtacctgacagtggtccttgtgtgacttatattggtaaaggtggttctggtaattttgtgaagatgatccacaatggcattgagtatggtgacatgcagctgattgcagaggcctatgatgtgctgaaatcagttggaaagttgtcaaatgaggaactacaaagtgtcttttcagaatggaacaagggagaacttctgagtttcctgattgaaatcactgcagatatatttggaattaaggatgataagggagatggatatcttgttgacaaggtcctagacaagactggcatgaagggcactggtaagtggactgttcagcaagctgctgaattatcaattgctgctcccactattgaagcatcattggatgcaaggttcctgagtgggttgaaggaggaaagagttgaagctgcaaaggtctttaaatcaggtggcattggtgatattgtgactgatcaacatgtagacaagcagaagttgattgatgatgttaggaaggctctttatgcagccaaaatctgtagttatgcacagggaatgaatttgatccgtgcaaagagtattgaaaagggttgggatttgaagttgggtgaactggcccggatttggaaagggggttgcattattagagcaatattcttagacagaatcaagcaggcatatgaaagaaaccctaatctggcaaaccttcttgtggatccagagtttgcaaaggaaataattgattaccaatctgcctggaggagagttgtttgccttgctatcaattctggtattagcactccaggtatgtctgctagtcttgcttattttgacacttacagaagggaaaggttgccagctaatttggtgcaagctcaacgagactactttggtgctcatacatatgaaagggttgacatagaggggtcttaccatactgagtggttcaagcttgccaaacagtcaaagaaattagattactgtatttcagccaatcaggattttcctaataaatgtaatattttctgctcagactgtatgctgagttgagtttacatagccacaacgtggtgaagttttatttatattatttccaactgaattgcttgatagtttgttttcaactt

SEQ ID NO: 11859 - protein, 511 aa, Glycine max (soybean)
MAQPSTGIGLAGLAVMGQNLALNIAEKGFPISVYNRTTSKVDETVERAKQEGNLPVYGYHDPEAFVHSIQKPRVIIMLVKAGAPVDQTIKTLSAYMEKGDCIIDGGNEWYENTERREKEVAELGLLYLGLGVSGGEEGARNGPSLMPGGSFEAFKYIEDILLKVAAQVPDSGPCVTYIGKGGSGNFVKMIHNGIEYGDMQLIAEAYDVLKSVGKLSNEELQSVFSEWNKGELLSFLIEITADIFGIKDDKGDGYLVDKVLDKTGMKGTGKWTVQQAAELSIAAPTIEASLDARFLSGLKEERVEAAKVFKSGGIGDIVTDQHVDKQKLIDDVRKALYAAKICSYAQGMNLIRAKSIEKGWDLKLGELARIWKGGCIIRAIFLDRIKQAYERNPNLANLLVDPEFAKEIIDYQSAWRRVVCLAINSGISTPGMSASLAYFDTYRRERLPANLVQAQRDYFGAHTYERVDIEGSYHTEWFKLAKQSKKLDYCISANQDFPNKCNIFCSDCMLS

SEQ ID NO: 11860 - DNA, 1455 bp, Caenorhabditis elegans
  CDS (1)..(1455)
atggccgaagctgatattgccgtcatcggattggccgttatgggtcaaaatcttattctgaacatgaatgatcacggattcactgtttgcgccttcaacagaactgtcaaattggtcgacgattttcttgccaatgaagctaaaggaactaagattattggagctcattcaattgaggaaatgtgcaagaaattgaaaagaccacgtcgtgtcatgatgctcattaaagccggaactcctgtcgatatgatgatcgatgcaattgttccgcatcttgaggaaggtgatattatcattgatggaggaaattctgaatacactgattcaaacagacgctccgagcaactcgccgcaaaggggatcatgttcgtcggctgtggagtttccggaggagaagaaggagctcgttttggaccatctcttatgccaggaggtaatccaaaagcctggccacatctgaaagacatcttccaaaagatcgctgccaagtcaaacggagaaccatgctgtgattgggtaggaaacgctggatccggtcacttcgtgaaaatggttcataatggaattgaatatggagacatgcaactgatagctgaagcatatcatcttctgagcaaggccgtcgagctgaatcacgatcaaatggctgaagttcttgatgattggaataaaggagaattggaatctttccttattgaaatcaccgctaatattttgaaataccgtgacgagcaaggagagccaattgttccaaagattcgtgattctgctggacaaaagggaactggaaaatggacttgtttcgctgctcttgagtatggacttcctgttactcttatcggagaagccgttttcgccagatgtctatctgctctgaaggatgaacgtgttcgtgcttcgaaacaacttcctcgtccacaagtctcaccagataccgtcgttcaggacaaaagagtcttcatcaagcaaatcagcaaggctctttacgcctcaaaaatcgtcagttatgctcaaggatttatgcttcttgccgaagcatctaaacaattcaactggaatttgaactttggagctattgctttgatgtggagaggaggatgcattattcgttcaagattcctcggagacattgaacacgctttccaaaagaacaagcaactttccaatcttcttctcgatgatttcttcaccaaggccatcaccgaagcgcaggattcatggcgtgttgttgtgtgtgcagctgttcgtctcggaattccagttccagcattctcatcggccctcgctttctatgatggatacaccagtgaggtagttccggctaacttgcttcaagcccaaagagactatttcggagcccacacctacgagcttctcgccaagccaggtacatgggtacacaccaactggactggaactggtggacgtgtcacctcaaatgcttacaatgcataa

SEQ ID NO: 11861 - protein, 484 aa, Caenorhabditis elegans
MAEADIAVIGLAVMGQNLILNMNDHGFTVCAFNRTVKLVDDFLANEAKGTKIIGAHSIEEMCKKLKRPRRVMMLIKAGTPVDMMIDAIVPHLEEGDIIIDGGNSEYTDSNRRSEQLAAKGIMFVGCGVSGGEEGARFGPSLMPGGNPKAWPHLKDIFQKIAAKSNGEPCCDWVGNAGSGHFVKMVHNGIEYGDMQLIAEAYHLLSKAVELNHDQMAEVLDDWNKGELESFLIEITANILKYRDEQGEPIVPKIRDSAGQKGTGKWTCFAALEYGLPVTLIGEAVFARCLSALKDERVRASKQLPRPQVSPDTVVQDKRVFIKQISKALYASKIVSYAQGFMLLAEASKQFNWNLNFGAIALMWRGGCIIRSRFLGDIEHAFQKNKQLSNLLLDDFFTKAITEAQDSWRVVVCAAVRLGIPVPAFSSALAFYDGYTSEVVPANLLQAQRDYFGAHTYELLAKPGTWVHTNWTGTGGRVTSNAYNA

SEQ ID NO: 11862 - DNA, 882 bp, Streptomyces coelicolor
  CDS (1)..(882)
atgcagatcggtcttgtgggtctcggcaagatgggcggcaacatgcgcgagcgactgcgcaacgccggccacaccgtcgtcggatacgacaccaatcccgaccgggccgacgtcgacagcctggtcgagctggtggaccggctggagcggccgcgcgcggtctgggtgatggtcccggccggcggcgccacccagcacgtcatcgaccagctggcgacgctgctcaagcccggtgacaccgtcatcgacggcggcaactcccgctggacggacgacgagaagcacgccgaggaactgggcaagcgcggcatcaacttcgtcgacgcgggcgtctcgggcggcgtgtggggactgaagaacggctatgccctgatggtcggcggcgacaaggagaccgtcgacgacctgaagccggtcttcgacgccctcaagcccgacggcccctacggctacgtccacgcgggcaaggtcggcgccgggcacttctccaagatggtccacaacggcatcgagtacgccatgatgcaggcctacgccgagggctgggagctgctggagaaggtcgactccgtggacaacgtccgcgaggtcttccgctcctggcaggagggcaccgtcatccggtcctggctcctggacctggccgtcaacgccctcgacgacgaccaccacctggagaagctgcgcggctacgccgacgactcgggcgagggccgctggaccgtggaggcggcgatcgacaacgccgtgccgctgcccgcgatcacggcctccctcttcgcccggttcgcgtcccgccaggaggactcgccgcagatgaagatggtcgccgcgctgcgcaaccagttcggtggccacgccgtggagtcggccaagaagtag

SEQ ID NO: 11863 - protein, 293 aa, Streptomyces coelicolor
MQIGLVGLGKMGGNMRERLRNAGHTVVGYDTNPDRADVDSLVELVDRLERPRAVWVMVPAGGATQHVIDQLATLLKPGDTVIDGGNSRWTDDEKHAEELGKRGINFVDAGVSGGVWGLKNGYALMVGGDKETVDDLKPVFDALKPDGPYGYVHAGKVGAGHFSKMVHNGIEYAMMQAYAEGWELLEKVDSVDNVREVFRSWQEGTVIRSWLLDLAVNALDDDHHLEKLRGYADDSGEGRWTVEAAIDNAVPLPAITASLFARFASRQEDSPQMKMVAALRNQFGGHAVESAKK

SEQ ID NO: 11864 - DNA, 1479 bp, Schizosaccharomyces pombe
  CDS (1)..(1479)
atgtcacaaaaagaagttgccgattttggtctcatcggtttggccgtcatgggtcaaaacttgattctcaacggtgccgacaagggctttaccgtctgttgctacaaccgtacaacttccagagttgacgagtttttggcaaacgaagccaaaggtaaatctattgttggtgctcactcccttgaggaatttgtttccaagcttaagaagcctcgtgtttgtattttgcttgttaaggctggtaagcctgttgattaccttattgagggattggctcctctcctcgagaagggcgatatcattgttgacggtggtaactcccattaccctgatactacccgccgttgcgaggagttggccaagaagggcattctttttgttggttccggtgtttctggtggtgaagagggtgctcgttacggtccctctttgatgcctggtggtaatcccgctgcctggcctcgtatcaagcccatcttccaaactttggccgccaaagccggaaacaacgagccttgctgtgactgggttggtgaacaaggtgctggtcattatgttaagatggttcacaatggtatcgaatatggtgacatgcaattgatttgcgaaacttatgacattatgaaacgtggccttggtatgtcttgtgatgagattgccgatgtttttgagaagtggaacactggtaaacttgactctttcttaattgaaatcactcgcgatgttttgcgttacaaggctgatgacggcaagcccttggttgagaagattctcgacgctgctggacagaagggtactggtaagtggactgctcaaaacgctttggaaatgggtacccctgtcagtttgatcaccgaagccgtttttgctcgttgtctttcctccttgaagagcgagcgtgttcgtgcctctaagaagcttactggccccaacaccaagttcactggtgacaagaagcaattgattgatgatttggaagatgccttgtacgcttccaagattatctcttatgctcaaggtttcatgcttatgcgtgaggctgctaaggagtacggctggaagcttaacaacgccggtatcgctttgatgtggcgtggtggttgtattatccgttccgtcttccttaaggatatcactgaggctttccgtgaggatcctaacctcgagtctatccttttccatcctttcttcactaatggtgttgaaaaggctcaagctggttggcgtagagttgttgcccaagccgctatgttgggcattccagtccctgccacttctaccggtctttccttctacgacggttatcgtagtgctgttttgcctgctaacttattgcaagctcaacgtgactactttggtgcccatactttccgtgttttgcctgaagctgctgataagagcttacctgctgacaaggatatccacattaactggaccggtcacggtggtaacatcagtgctactacctatgatgcttag

SEQ ID NO: 11865 - protein, 492 aa, Schizosaccharomyces pombe
MSQKEVADFGLIGLAVMGQNLILNGADKGFTVCCYNRTTSRVDEFLANEAKGKSIVGAHSLEEFVSKLKKPRVCILLVKAGKPVDYLIEGLAPLLEKGDIIVDGGNSHYPDTTRRCEELAKKGILFVGSGVSGGEEGARYGPSLMPGGNPAAWPRIKPIFQTLAAKAGNNEPCCDWVGEQGAGHYVKMVHNGIEYGDMQLICETYDIMKRGLGMSCDEIADVFEKWNTGKLDSFLIEITRDVLRYKADDGKPLVEKILDAAGQKGTGKWTAQNALEMGTPVSLITEAVFARCLSSLKSERVRASKKLTGPNTKFTGDKKQLIDDLEDALYASKIISYAQGFMLMREAAKEYGWKLNNAGIALMWRGGCIIRSVFLKDITEAFREDPNLESILFHPFFTNGVEKAQAGWRRVVAQAAMLGIPVPATSTGLSFYDGYRSAVLPANLLQAQRDYFGAHTFRVLPEAADKSLPADKDIHINWTGHGGNISATTYDA

SEQ ID NO: 11866 - DNA, 1455 bp, Corynebacterium glutamicum
  CDS (1)..(1455)
atgactaatggagataatctcgcacagatcggcgttgtaggcctagcagtaatgggctcaaacctcgcccgcaacttcgcccgcaacggcaacactgtcgctgtctacaaccgcagcactgacaaaaccgacaagctcatcgccgatcacggctccgaaggcaacttcatcccttctgcaaccgtcgaagagttcgtagcatccctggaaaagccacgccgcgccatcatcatggttcaggctggtaacgccaccgacgcagtcatcaaccagctggcagatgccatggacgaaggcgacatcatcatcgacggcggcaacgccctctacaccgacaccattcgtcgcgagaaggaaatctccgcacgcggtctccacttcgtcggtgctggtatctccggcggcgaagaaggcgcactcaacggcccatccatcatgcctggtggcccagcaaagtcctacgagtccctcggaccactgcttgagtccatcgctgccaacgttgacggcaccccatgtgtcacccacatcggcccagacggcgccggccacttcgtcaagatggtccacaacggcatcgagtacgccgacatgcaggtcatcggcgaggcataccaccttctccgctacgcagcaggcatgcagccagctgaaatcgctgaggttttcaaggaatggaacgcaggcgacctggattcctacctcatcgaaatcaccgcagaggttctctcccaggtggatgctgaaaccggcaagccactaatcgacgtcatcgttgacgctgcaggtcagaagggcaccggacgttggaccgtcaaggctgctcttgatctgggtattgctaccaccggcatcggcgaagctgttttcgcacgtgcactctccggcgcaaccagccagcgcgctgcagcacagggcaacctacctgcaggtgtcctcaccgatctggaagcacttggcgtggacaaggcacagttcgtcgaagacgttcgccgtgcactgtacgcatccaagcttgttgcttacgcacagggcttcgacgagatcaaggctggctccgacgagaacaactgggacgttgaccctcgcgacctcgctaccatctggcgcggcggctgcatcattcgcgctaagttcctcaaccgcatcgtcgaagcatacgatgcaaacgctgaacttgagtccctgctgctcgatccttacttcaagagcgagctcggcgacctcatcgattcatggcgtcgcgtgattgtcaccgccacccagcttggcctgccaatcccagtgttcgcttcctccctgtcctactacgacagcctgcgtgcagagcgtctgccagcagccctgatccaaggacagcgcgacttcttcggtgcgcacacctacaagcgcatcgacaaggatggctccttccacaccgagtggtccggcgaccgctccgaggttgaagcttaa

SEQ ID NO: 11867 - protein, 484 aa, Corynebacterium glutamicum
MTNGDNLAQIGVVGLAVMGSNLARNFARNGNTVAVYNRSTDKTDKLIADHGSEGNFIPSATVEEFVASLEKPRRAIIMVQAGNATDAVINQLADAMDEGDIIIDGGNALYTDTIRREKEISARGLHFVGAGISGGEEGALNGPSIMPGGPAKSYESLGPLLESIAANVDGTPCVTHIGPDGAGHFVKMVHNGIEYADMQVIGEAYHLLRYAAGMQPAEIAEVFKEWNAGDLDSYLIEITAEVLSQVDAETGKPLIDVIVDAAGQKGTGRWTVKAALDLGIATTGIGEAVFARALSGATSQRAAAQGNLPAGVLTDLEALGVDKAQFVEDVRRALYASKLVAYAQGFDEIKAGSDENNWDVDPRDLATIWRGGCIIRAKFLNRIVEAYDANAELESLLLDPYFKSELGDLIDSWRRVIVTATQLGLPIPVFASSLSYYDSLRAERLPAALIQGQRDFFGAHTYKRIDKDGSFHTEWSGDRSEVEA

SEQ ID NO: 11868 - DNA, 2335 bp, Corynebacterium glutamicum
  CDS (474)..(1853)
ttgttcggccacgatgacaccggagctcacagcagaaatgaagtcggtgttgttgttgatgccgacgaccatttttccaggggcggaaatcatgctggcgactgatccagtggattcggcgatggcggcgtagacaccaccgttgaccaagcccaccacttgcaggtgcttggatgccacgtgaagttcgctgaccacccggccgggctcgatggtggtgtagcgcagccccagattgcggtcgaggccataattggcgttgttgagtgcttcaagttcgtctgtggttaaagctctggtggcggcaagttctgcaagcgaaagcagatcttggggttgatcatcgcgggaagtcataattaattactctagtcggcctaaaatggttggattttcacctcctgtgacctggtaaaatcgccactacccccaaatggtcacaccttttaggccgattttgctgacaccgggctatgccgtcaagtacgatcaataacatgactaatggagataatctcgcacagatcggcgttgtaggcctagcagtaatgggctcaaacctcgcccgcaacttcgcccgcaacggcaacactgtcgctgtctacaaccgcagcactgacaaaaccgacaagctcatcgccgatcacggctccgaaggcaacttcatcccttctgcaaccgtcgaagagttcgtagcatccctggaaaagccacgccgcgccatcatcatggttcaggctggtaacgccaccgacgcagtcatcaaccagctggcagatgccatggacgaaggcgacatcatcatcgacggcggcaacgccctctacaccgacaccattcgtcgcgagaaggaaatctccgcacgcggtctccacttcgtcggtgctggtatctccggcggcgaagaaggcgcactcaacggcccatccatcatgcctggtggcccagcaaagtcctacgagtccctcggaccactgcttgagtccatcgctgccaacgttgacggcaccccatgtgtcacccacatcggcccagacggcgccggccacttcgtcaagatggtccacaacggcatcgagtacgccgacatgcaggtcatcggcgaggcataccaccttctgccctacgcagcaggcatgcagccagctgaaatcgctgaggttttcaaggaatggaacgcaggcgacctggattcctacctcatcgaaatcaccgcagaggttctctcccaggtggatgctgaaaccggcaagccactaatcgacgtcatcgttgacgctgcaggtcagaagggcaccggcaagtggactgtcaaggctgctcttgatctgggtattgctaccaccggcatcggcgaacgtgttttcgcacgtgcactctccggcgcaaccagccagcgcgctgcagcacagggcaacctacctgcaggtgtcctcaccgatctggaagcacttggcgtggacaaggcacagttcgtcgaaggacttcgccgtgcactgtacgcatccaagcttgttgcttacgcacagggcttcgacgagatcaaggctggctccgacgagaacaactgggacgttgaccctcgcgacctcgctaccatctggcgcggcggctgcatcattcgcgctaagttcctcaaccgcatcgtcgaagcatacgatgcaaacgctgaacttgagtccctgctgctcgatccttacttcaagagcgagctcggcgacctcatcgattcatggcgtcgcgtgattgtcaccgccacccagcttggcctgccaatcccagtgttcgcttcctccctgtcctactacgacagcctgcgtgcagagcgtctgccagcagccctgatccactagtgtcgacctgcaggcgcgcgagctccagcttttgttccctttagtgagggttaatttcgagcttggcgtaatcaaggtcatagctgtttcctgtgtgaaattgttatccgctcacaattccacacaatatacgagccggaagtataaagtgtaaagcctggggtgcctaatgagtgagctaactcacagtaattgcggctagcggatctgacggttcactaaaccagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtccc

SEQ ID NO: 11869 - protein, 459 aa, Corynebacterium glutamicum
MPSSTINNMTNGDNLAQIGVVGLAVMGSNLARNFARNGNTVAVYNRSTDKTDKLIADHGSEGNFIPSATVEEFVASLEKPRRAIIMVQAGNATDAVINQLADAMDEGDIIIDGGNALYTDTIRREKEISARGLHFVGAGISGGEEGALNGPSIMPGGPAKSYESLGPLLESIAANVDGTPCVTHIGPDGAGHFVKMVHNGIEYADMQVIGEAYHLLPYAAGMQPAEIAEVFKEWNAGDLDSYLIEITAEVLSQVDAETGKPLIDVIVDAAGQKGTGKWTVKAALDLGIATTGIGERVFARALSGATSQRAAAQGNLPAGVLTDLEALGVDKAQFVEGLRRALYASKLVAYAQGFDEIKAGSDENNWDVDPRDLATIWRGGCIIRAKFLNRIVEAYDANAELESLLLDPYFKSELGDLIDSWRRVIVTATQLGLPIPVFASSLSYYDSLRAERLPAALIH

SEQ ID NO: 11870 - DNA, 1407 bp, Escherichia coli
  CDS (1)..(1407)
atgtccaagcaacagatcggggttgtcggtatggctgtgatggggcgtaaccttgcgctgaatatcgaaagccgtggttataccgtctccgttttcaaccgctcccgtgaaaagaccgaagaagtgattgccgaaaacccaggcaagaaactggttccttactacacagtacaagagtttgttgaatccctcgaaacaccacgtcgtatcctgttgatggtgaaggccggggctggcaccgacagcgccatcgattccctgaagccttacctcgacaaaggcgacatcatcattgatggcggcaatactttcttccaggataccatccgtcgtaaccgtgaactgtctgccgaaggttttaactttatcggtaccggtgtttccggtggagaagagggggctctgaaagggccttccatcatgcccggtggccagaaagaagcctatgagctggttgctccaattctgaagcagattgctgcggttgctgaagacggcgagccatgtgtcacctatatcggtgctgatggtgctggtcattatgtaaagatggttcataacggcatcgagtatggcgatatgcaactcattgcagaagcttatgcgctgttgaaaggcggtctggctctttccaacgaagagctggcgcaaaccttcaccgaatggaacgaaggtgaactgagcagttacctgatcgacattaccaaagatatcttcaccaagaaggatgaagaaggtaaatacctcgttgatgtcattcttgatgaagctgcaaacaaaggtaccggtaagtggaccagccagagctcactggatctcggcgaacctctgtctctgatcaccgagtccgtatttgctcgttacatttcttcgcttaaagaccagcgtgtagctgcttcgaaagtgctgagtggtccgcaggctcaaccagccggcgataaagcagaatttatcgaaaaagtgcgtcgcgcgttgtacctcggtaaaatcgtctcctatgctcagggcttctcccagctacgagctgcttctgatgaatacaactgggagctgaactacggcgagatcgctaagattttccgcgctggctgcataattcgtgcgcagttcctgcagaaaatcaccgatgcttatgcgcaaaaggctggcattgctaacctcctgctggcgccgtacttcaaacagatcgctgatgactatcagcaggcgctgcgtgatgtcgtggcgtatgcgtatcagaatggtattccggtaccgacgttctctgcggcaattgcctactatgacagctaccgttccgcagttctgcccgctaacctgattcaggctcagcgtgattactttggcgcgcacacttataagcgtactgataaagaaggtgtattccataccgagtggttggaataa

SEQ ID NO: 11871 - protein, 468 aa, Escherichia coli
MSKQQIGVVGMAVMGRNLALNIESRGYTVSVFNRSREKTEEVIAENPGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPAGDKAEFIEKVRRALYLGKIVSYAQGFSQLRAASDEYNWELNYGEIAKIFRAGCIIRAQFLQKITDAYAQKAGIANLLLAPYFKQIADDYQQALRDVVAYAYQNGIPVPTFSAAIAYYDSYRSAVLPANLIQAQRDYFGAHTYKRTDKEGVFHTEWLE

SEQ ID NO: 11872 - DNA, 1407 bp, Escherichia coli
  CDS (1)..(1407)
atgtcaaagcaacagatcggcgtagtcggtatggcagtgatggggcgcaaccttgcgctcaacatcgaaagccgtggttataccgtctctattttcaaccgttcccgtgagaagacggaagaggtgattgccgaaaatccaggcaagaaactggttccttactatacggtgaaagagtttgttgaatctctggaaacgcctcgtcgcatcctgttaatggtgaaagcaggtgcaggcacggatgctgctattgattctctcaagccatacctcgataaaggtgacatcatcattgatggtggtaacaccttcttccaggacaccattcgtcgtaaccgtgagctttctgccgaaggttttaacttcatcggtaccggtgtttctggcggtgaagagggggcgctgaaaggtccttccattatgcctggtgggcagaaagaagcctatgaactggttgctccgatcctgaccaaaatcgccgccgttgctgaagatggcgcaccgtgcgttacctatattggtgccgatggcgctggtcactatgtgaagatggttcacaacggtattgaatacggtgatatgcaactgatcgttgaagcctattctctcctgaaaggcggcctgaatctctctaacgaagaactggcgcagacctttaccgagtggaataacggtgaactgagcagctacctgattgacatcaccaaagacatcttcactaaaaaagatgaagacggtaactacctggttgatgtgatcctggatgaagcagcaaacaaaggtaccggtaaatggactagccagagcgcactggatctcggcgaaccggtgtcgctgattaccgagtctgtgtttgcacgttatatctcttctctgaaagatcagcgtgttgccgcgtctaaagttctctctggtcgccaagcgcagccagcaggcgacaaagctgaattcattgaaaaagttcgccgtgcgctgtatctgggcaaaatcgtttcttacgctcagggcttctctcagctacgcgccgcgtctgaagagtacaactgggatctgaactacggcgaaatcgcgaagattttccgtgctggctgcatcatccgtgccaggttcctgcagaaaacaaccgatgcatatgccgaaaatccgcagatcgctaacctactgctggctccgtacttcaagcaaattgccgatgactaccagcaggcgctgcgtgatgtcgttgcttatgcagtgcagaacggtatcccggttccgaccttcgccgctgcggttgcctattacgatagctaccgtgccgctgttctgcctgcgaacctgatccaggcacagcgtgactatttcggtgcacatacttataagcgcattgataaagccggtgtgttccatactgaatggctggattaa

SEQ ID NO: 11873 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGAPCVTYIGADGAGHYVKMVHNGIEYGDMQLIVEAYSLLKGGLNLSNEELAQTFTEWNNGELSSYLIDITKDIFTKKDEDGNYLVDVILDEAANKGTGKWTSQSALDLGEPVSLITESVFARYISSLKDQRVAASKVLSGRQAQPAGDKAEFIEKVRRALYLGKIVSYAQGFSQLRAASEEYNWDLNYGEIAKIFRAGCIIRARFLQKTTDAYAENPQIANLLLAPYFKQIADDYQQALRDVVAYAVQNGIPVPTFAAAVAYYDSYRAAVLPANLIQAQRDYFGAHTYKRIDKAGVFHTEWLD

SEQ ID NO: 11874 - DNA, 1407 bp, Escherichia coli
  CDS (1)..(1407)
atgtcaaagcaacagatcggcgtcgtcggtatggcagtgatggggcgcaaccttgcgctcaacatcgaaagccgtggttataccgtctctattttcaaccgttcccgtgagaaaacggaagaagtaattgccgaaaacccaggcaagaaactggttccttactatacggtgaaagagtttgttgaatctctggaaacgcctcgtcgcatcctgttaatggtgaaagcaggtgcaggcacggatgctgctattgattccctcaaaccatatctcgataaaggtgacatcatcattgatggcggtaacaccttcttccaggacaccattcgtcgtaaccgtgagctttctgccgaaggctttaacttcattggtaccggtgtttccggtggtgaagaaggcgcgctgaaaggtccttccattatgcctggtgggcagaaagaagcctatgaactggttgcaccgatcctgaccaaaatcgccgcagtggctgaagacggtgagccatgcgttacctatattggtgccgatggcgcaggtcactatgtgaagatggttcacaacggtattgaatacggcgatatgcagctgattgctgaagcctattctctgcttaaaggtggcctgaatctcaccaacgaagaattggcgcagacctttaccgagtggaataacggtgaactgagcagctacctgatcgacatcaccaaagacattttcactaaaaaagatgaagacggtaactacctggttgatgtgattctggatgaagcagcaaacaaaggtaccggtaaatggactagccagagcgcgctggatctcggcgaaccgctgtcgctgattacagagtctgtgtttgcacgttatatctcttctctgaaagagcagcgcgttgccgcgtctaacgtactgactggtcgccaagcgcagccagcaggcgacaaggctgagtttatcgaaaaagttcgccgtgcgctgtatctgggcaaaatcgtttcttacgctcagggcttttctcagctgcgtgctgcgtctgaagagtacaactgggacctgaattacggcgaaatcgcgaagattttccgtgctggctgcatcattcgtgccaggttcctgcagaaaattaccgatgcttatgccgaaaatccgcagatcgctaacctgctgctggctccgtacttcaagcaaattgccgatgattaccagcaggcgctgcgtgatgtcgttgcttatgcggtacagaacggtatcccggttccgaccttcgctgctgcggttgcctattacgatagctaccgtgccgctgttctgcctgcgaacctgatccaggcacagcgtgactatttcggtgcgcatacttataagcgcattgataaagaaggtgtgttccatactgaatggctggattaa

SEQ ID NO: 11875 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASNVLTGRQAQPAGDKAEFIEKVRRALYLGKIVSYAQGFSQLRAASEEYNWDLNYGEIAKIFRAGCIIRARFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 11876 - DNA, 1421 bp, Escherichia coli
  CDS (1)..(1407): n means a or g or c or t/u, s means g or c, r means g or a, Y means t/u or c
atgtccaagcaacagatcggcgtcgtcggtatggcagtgatggggcgcaacctggcgctcaacatcgaaagccgtggttataccgtctctgtcttcaaccggtcccgcgaaaaaactgaagaagttgttgccgagaacccgggtaagaaactggttccttattacacggtgaaagagtttgtcgagtctctggaaacccctcgtcgcatcctgttaatggtgaaagcaggtgcaggcacggatgctgctattgattccctcaaaccatatctcgataaaggtgacatcatcattgatggtggtaacaccttcttccaggacactattcgtcgtaatcgtgagctttcagcagagggctttaacttcatcggtaccggtgtttccggcggtgaagagggggcgttgaaaggaccttccatcatgcctggtgggcagaaagaagcctatgaactggtagcaccgatcctgaccaaaatcgccgcagtagctgaagacggtgagccatgcgttacctatattggtgccgatggcgcaggtcactatgtgaagatggttcacaacggtattgaatacggcgatatgcagctgattgctgaagcctattctctgctaaaaggtggcctgaacctcaccaacgaagaactggcgcagacttttaccgagtggaataacggtgaactgagcagctacctgatcgacatcaccaaagatatcttcaccaaaaaagatgaagacggtaactacctggttgatgtgattctggatgaagcagcaaacaaaggcacgggcaaatggaccagccagagtgcgctggatctcggcgaaccgctgtcgctgataaccgagtctgtgtttgcacgttatatctcttctctgaaagatcagcgcgttgccgcgtctaaagttctctctggcccgcaagcgcagccagcaggcgacaaggctgagttcatcgaaaaagttcgtcgtgcgctgtatctgggcaaaatcgtttcttacgctcagggcttctctcagctacgcgccgcgtctgaagagtacaactgggatctgaactacggcgaaatcgcgaagattttccgtgctggctgcatcatccgtgccaggttcctgcagaaaatcaccgatgcttatgccgaagatccgcagatcgctaacctgctgctggctccgtacttcaagcaaattgctgatgactaccagcaggcgctgcgtgatgtcgttgcttatgcagtacaaaacggtatcccggttccgaccttcgccgctgcggttgcctattacgatagctaccgtgccgctgttctgcctgcgaacctgatccaggcacagcgtgactatttcggtgcacatacttataagcgcattgataaagaaggtgtgttccatactgaatggctggattaanttystrctstart

SEQ ID NO: 11877 - protein, 468 aa, Escherichia coli
MSKQQIGVVGMAVMGRNLALNIESRGYTVSVFNRSREKTEEVVAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRARFLQKITDAYAEDPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 11878 - DNA, 1488 bp, Debaryomyces hansenii CBS767
  CDS (1)..(1488)
atgtctgctccaactggtgatattggtttaattggtttagccgttatgggtcaaaacttgatcttaaacgctgctgacaatggttacactgtcgtagcttacaacagaactgttgcaaaggtcgacgacttcttggacaacgaggctaagggcaaatcagtcattggtgctcactccatcgaagaattatgtgctaacttgaagagaccaagaagaatcattttattagttaaggctggtaaaccagttgacgcttttattgaacaattattacctcacttagaaaagggtgatatcatcattgacggtggtaactcccatttcccagattctaaccgtcgttacgaagaattaaacggtaagggtatcttattcgttggttctggtgtttctggtggtgaagaaggtgctagatacggtccatctttgatgccaggtggtcacaaggacgcttggccacacatcaaggatatcttccaaagtattgctgccaagtctgatggtgaaccatgttgtgactgggttggtgatgccggtgctggtcattacgttaagatggtgcacaatggtattgaatacggtgacatgcaattgatttgtgaagcttatgatttattaaagagagttggtaaattctccaacaaggaaatcggtgacgttttcgctaaatggaacaagggtgttttagactctttcttaattgaaattaccagagatattttgtacttcaatgatccaactgacaataagccattattagaaaagattttggatactgctggtcagaagggtactggtaagtggactgctatcaatgctttagatttaggtatgcctgtcaccttaattggtgaagctgttttctctcgttgtttatccgccttgaaggatgaaagagtcagagcttctaaatcattagccggcccatcagttgaagatgacgaatctccaattcaagataagcaaaagttcgttgacgacttagaacaagctttatatgcttctaagattatctcttacgctcaaggtttcatgttgattagagaagctgctaaggaatacggctggaaattaaataacccagctatcgccttaatgtggagaggtggttgtattatcagatctgttttcttaggtgaaatcacttctgcttaccgtgaaaccccagacttagaaaacttattattccatccattcttcaatgatgccatcaaaaaggctcaaaagggttggagatcaactattggtaaggctgttgaatttggtgttccagttccagcttttagcactgctttatctttctacgatggttacagatctgctaagttaccagctaacttgttgcaagctcaaagagattacttcggtgctcacactttccaagtgttaccaggtgaagaaaatgatttcttaaagaaggaccaatggatccatgttaactggaccggtaagggtggtaatgtttccgcctctacttatgatgcttag

SEQ ID NO: 11879 - protein, 495 aa, Debaryomyces hansenii CBS767
MSAPTGDIGLIGLAVMGQNLILNAADNGYTVVAYNRTVAKVDDFLDNEAKGKSVIGAHSIEELCANLKRPRRIILLVKAGKPVDAFIEQLLPHLEKGDIIIDGGNSHFPDSNRRYEELNGKGILFVGSGVSGGEEGARYGPSLMPGGHKDAWPHIKDIFQSIAAKSDGEPCCDWVGDAGAGHYVKMVHNGIEYGDMQLICEAYDLLKRVGKFSNKEIGDVFAKWNKGVLDSFLIEITRDILYFNDPTDNKPLLEKILDTAGQKGTGKWTAINALDLGMPVTLIGEAVFSRCLSALKDERVRASKSLAGPSVEDDESPIQDKQKFVDDLEQALYASKIISYAQGFMLIREAAKEYGWKLNNPAIALMWRGGCIIRSVFLGEITSAYRETPDLENLLFHPFFNDAIKKAQKGWRSTIGKAVEFGVPVPAFSTALSFYDGYRSAKLPANLLQAQRDYFGAHTFQVLPGEENDFLKKDQWIHVNWTGKGGNVSASTYDA

SEQ ID NO: 11880 - DNA, 1470 bp, Yarrowia lipolytica CLIB99
  CDS (1)..(1470)
atgactgacacttcaaacatcaagcctgtcgctgacattgccctcatcggtctcgccgtcatgggccagaacctgatcctcaacatggccgaccacggctacgaggttgttgcctacaaccgaaccacctccaaggtcgaccacttcctcgagaacgaggccaagggaaagtccattattggtgctcactctatcaaggagctgtgtgctctgctgaagcgaccccgacgaatcattctgctcgttaaggccggtgctgctgtcgattctttcatcgaacagctcctgccctatctcgataagggtgatatcatcattgacggtggtaactcccacttccccgactccaaccgacgatacgaggagcttaacgagaagggaatcctctttgttggttccggtgtttccggcggtgaggagggtgcccgatacggtccctccatcatgcccggtggaaacaaggaggcctggccccacattaagaagattttccaggacatctctgctaaggctgatggtgagccctgctgtgactgggtcggtgacgctggtgccggccactttgtcaagatggttcacaacggtattgagtatggtgacatgcagcttatctgcgaggcttacgacctcatgaagcgaggtgctggtttcaccaatgaggagattggagacgttttcgccaagtggaacaacggtatcctcgactccttcctcattgagatcacccgagacatcttcaagtacgacgacggctctggaactcctctcgttgagaagatctccgacactgctggccagaagggtactggaaagtggaccgctatcaacgctcttgaccttggtatgcccgtcaccctgatcggtgaggccgtcttcgctcgatgcctttctgccctcaagcaggagcgtgtccgagcttccaaggttcttgatggccccgagcccgtcaagttcactggtgacaagaaggagtttgtcgaccagctcgagcaggccctttacgcctccaagatcatctcttacgcccagggtttcatgcttatccgagaggccgccaagacctacggctgggagctcaacaacgccggtattgccctcatgtggcgaggtggttgcatcatccgatccgtcttccttgctgacatcaccaaggcttaccgacaggaccccaacctcgagaacctgctgttcaacgacttcttcaagaacgccatctccaaggccaacccctcttggcgagctaccgtggccaaggctgtcacctggggtgttcccactcccgcctttgcctcggctctggctttctacgacggttaccgatctgccaagctccccgctaacctgctccaggcccagcgagactacttcggcgcccacacctaccagctcctcgatggtgatggaaagtggatccacaccaactggaccggccgaggtggtgaggtttcttcttccacttacgatgcttaa

SEQ ID NO: 11881 - protein, 489 aa, Yarrowia lipolytica CLIB99
MTDTSNIKPVADIALIGLAVMGQNLILNMADHGYEVVAYNRTTSKVDHFLENEAKGKSIIGAHSIKELCALLKRPRRIILLVKAGAAVDSFIEQLLPYLDKGDIIIDGGNSHFPDSNRRYEELNEKGILFVGSGVSGGEEGARYGPSIMPGGNKEAWPHIKKIFQDISAKADGEPCCDWVGDAGAGHFVKMVHNGIEYGDMQLICEAYDLMKRGAGFTNEEIGDVFAKWNNGILDSFLIEITRDIFKYDDGSGTPLVEKISDTAGQKGTGKWTAINALDLGMPVTLIGEAVFARCLSALKQERVRASKVLDGPEPVKFTGDKKEFVDQLEQALYASKIISYAQGFMLIREAAKTYGWELNNAGIALMWRGGCIIRSVFLADITKAYRQDPNLENLLFNDFFKNAISKANPSWRATVAKAVTWGVPTPAFASALAFYDGYRSAKLPANLLQAQRDYFGAHTYQLLDGDGKWIHTNWTGRGGEVSSSTYDA

SEQ ID NO: 11882 - DNA, 1407 bp, Erwinia carotovora subsp
  CDS (1)..(1407)
atgtccaaacagcaaattggcgttgttggtatggcggtgatggggcgcaatctggcgctgaacattgagagccgtggctatagcgtttccatctttaaccgctcttccgataaaaccgatgaagttatcgcggaaaatccgggtaaaaaactggtgccttcttacaccgttgaagagtttgtcgaatccctggaaaaaccccgccgtattctgctgatggtgaaggccggtgaagcaaccgataaaacgattgaatcgctgaaaccttacctggagaagggcgatattctgatcgatggcggtaacaccttctataaagataccattcgccgtaaccgcgaactgtccgctgaagggtttaacttcatcggtacaggcgtatccggcggagaagagggtgcactgaaagggccttctattatgcctggtggccagaaagaagcttatgatttggtggcaccgattctggaacagatcgccgcgcgtgctgatggcgaagcctgtgtgacctatattggctctgatggcgctgggcactatgtcaagatggtgcataacggtattgaatacggcgatatgcagcttattgctgaagcctatgcattgctcaagcaggcactgaatctggacaacgacgagcttgctaccacgttctctgagtggaacaaaggcgagttaagcagctacctgattgaaatcacggccgatatcttcaagaaaaaagatgaagaaggtaaatatctggttgacgtgattctggatgaagcggctaacaaaggtaccggtaaatggaccagccaaagctctctggatctgggcgaacctttgtctctgatcacggaatccgtttttgcccgctacctttcttcactgaaagatcagcgtgtcgctgcatctaaagtactgactggcccaacggctcagccatttggcggtgataaagccgagttcgttgagaaagtacgtcgtgcgctgtacttaggcaaaatcgtttcttatgctcagggcttctcacagctgaaagcggcatcagacgagaacagctgggatctgaactacggtgaaatcgccaagattttccgcgcgggttgcatcattcgtgcgcagttcctacaaaaaatcaccgatgcgtatgagcagaaagcggatattgctaacctgctgctggcaccttacttcaaaaaagtggcggatgaataccagcaagcactgcgcgacgtcgtctcttacgccgttcagcagggtatcccgacgccaacattctcagcggcaattgcctattacgacagctaccgctcagccgtgctgccagctaacctgattcaggctcagcgtgactatttcggcgcgcatacctataagcgtacagataaagaaggtgtattccataccgaatggttggaataa

SEQ ID NO: 11883 - protein, 468 aa, Erwinia carotovora subsp
MSKQQIGVVGMAVMGRNLALNIESRGYSVSIFNRSSDKTDEVIAENPGKKLVPSYTVEEFVESLEKPRRILLMVKAGEATDKTIESLKPYLEKGDILIDGGNTFYKDTIRRNRELSAEGFNFIGTGVSGGEEGALKGPSIMPGGQKEAYDLVAPILEQIAARADGEACVTYIGSDGAGHYVKMVHNGIEYGDMQLIAEAYALLKQALNLDNDELATTFSEWNKGELSSYLIEITADIFKKKDEEGKYLVDVILDEAANKGTGKWTSQSSLDLGEPLSLITESVFARYLSSLKDQRVAASKVLTGPTAQPFGGDKAEFVEKVRRALYLGKIVSYAQGFSQLKAASDENSWDLNYGEIAKIFRAGCIIRAQFLQKITDAYEQKADIANLLLAPYFKKVADEYQQALRDVVSYAVQQGIPTPTFSAAIAYYDSYRSAVLPANLIQAQRDYFGAHTYKRTDKEGVFHTEWLE

SEQ ID NO: 11884 - DNA, 1470 bp, Candida glabrata CBS138
  CDS (1)..(1470)
atgtctgctgatttcggtttgattggtttggccgttatgggtcaaaacttgatcctaaacattgctgaccacggttacactgttgttgcttacaacagatccgttgacaaggtccaccaattcttggacaacgaagccaagggtaagtccatcatcggtgctgagtccatcgaggacttggtcgccaagttgaagagacctagaaagatcatgatgttggtcaaggccggtgccccagtcgacggtttgatcgctcaattggttccacacttggaaaagggtgacatcatcattgacggtggtaactcccacttcccagactctaacagacgttacgaggagttgaaggccaagggtatcttgttcgtcggctctggtgtctctggtggtgaagacggtgcccgttacggtccatctttgatgccaggtggtgccgaagaagcttggccacacatcaaggagatcttccaatccatctccgccaagtccgacggtgagccatgttgtgactgggttggcccagctggttctggtcactacgtcaagatggtccacaacggtatcgaatacggtgacatgcagttgatctgtgaagcctacgacatcatgaagagaatcggtggtttcaccgacaaggaaatctccgaagtcttcggcaagtgggacactggtgttctagactctttcttggtcgaaattaccaccaacatcctaaagaaggacgacgttgacggtaagccattggttgaaaagatcatggactctgctggtcaaaagggtaccggtaagtggaccgccatcaacgccttggacctaggtatgccagtctctttgattggtgaagccgtcttcgctagatgtttgtctgctctaaagtgtgaaagagttaaggcctccaagactttgccaggcccagaaattccaaaggacttgatcaaggacagacaacaattcattgacgacttggaacaagccctatacgcttctaagatcatctcctacgctcaaggtttcatgttgatcagagaagccgctaagacttacggctggaagctaaacaacccagctattgctctaatgtggagaggtggttgtatcatcagatccgtcttcttgggtgaaatcaccaaggcttacagagaaaacccagacttggaaaacttgctattccacaagttcttcaaggacgccgtcaccaaggctcaaggtggctggagaagatctttggctttggctgccacttacggtatcccatccccagccttcgccaccgctttgtccttctacgatggttacagatctgaaagattgccagctaacttgttgcaagctcaacgtgactacttcggtgctcacactttcagagtcttgccagaatgtgcttccgactccctaccaaaggacaaggacatccacatcaactggaccggtcacggtggtaacgtctcttctaccacttacgatgcttaa

SEQ ID NO: 11885 - protein, 489 aa, Candida glabrata CBS138
MSADFGLIGLAVMGQNLILNIADHGYTVVAYNRSVDKVHQFLDNEAKGKSIIGAESIEDLVAKLKRPRKIMMLVKAGAPVDGLIAQLVPHLEKGDIIIDGGNSHFPDSNRRYEELKAKGILFVGSGVSGGEDGARYGPSLMPGGAEEAWPHIKEIFQSISAKSDGEPCCDWVGPAGSGHYVKMVHNGIEYGDMQLICEAYDIMKRIGGFTDKEISEVFGKWDTGVLDSFLVEITTNILKKDDVDGKPLVEKIMDSAGQKGTGKWTAINALDLGMPVSLIGEAVFARCLSALKCERVKASKTLPGPEIPKDLIKDRQQFIDDLEQALYASKIISYAQGFMLIREAAKTYGWKLNNPAIALMWRGGCIIRSVFLGEITKAYRENPDLENLLFHKFFKDAVTKAQGGWRRSLALAATYGIPSPAFATALSFYDGYRSERLPANLLQAQRDYFGAHTFRVLPECASDSLPKDKDIHINWTGHGGNVSSTTYDA

SEQ ID NO: 11886 - DNA, 894 bp, Bacillus thuringiensis
  CDS (1)..(894)
atgcaagtaggattaattggcttaggtaaaatgggattaaacttagggaaaaatttaatcgatcataaacatgaagtagcagcatttgatttgaatgcaagtgcagtggaagaaatgaaagagtacggggcaacaggtgcatctagtttaaatgaacttgttcagtcattacaatcaccaagagttctttgggttatggtaccacacgctgttgtagattctgttatcgatgaggttacaccacttttatcaaaaggagatattttaattgaagcgggtaattcacattataaagagtctattcgccgatatgagcaactaaagaaagatggcattcactttatggatgcaggaacttctggcggaatggaaggcgctcgtaatggtgcttgttatatgatcgggggagatcaagaagcttgggacatcgttgaacctatcttccgcgatactgctgtagaaaatggatacttatatgctggaaaagctggtagtggtcacttcttaaaaatggttcacaacggaattgaatacggtatgatggctgctattggtgaaggatttgagattctagagaaaagtgaatttgactacgattatgaaaaagtatcaagagtatggaacaacggttcagtaatccgttcatggttaatggaattaacagaaaatgcattttctaaagatgcaaaactggatgaaattaagggtgttatgcattcttctggtgaaggaaaatggacagtagaaacggcattagatcttcaaacagcaactcctgttatcgcaatgtctctattaatgcgctaccgctcattagacaatgatacatttacaggaaaagtagtagctgctctgcgcaatgaatttggcggacatgcagtagaaaagaaataa

SEQ ID NO: 11887 - protein, 297 aa, Bacillus thuringiensis
MQVGLIGLGKMGLNLGKNLIDHKHEVAAFDLNASAVEEMKEYGATGASSLNELVQSLQSPRVLWVMVPHAVVDSVIDEVTPLLSKGDILIEAGNSHYKESIRRYEQLKKDGIHFMDAGTSGGMEGARNGACYMIGGDQEAWDIVEPIFRDTAVENGYLYAGKAGSGHFLKMVHNGIEYGMMAAIGEGFEILEKSEFDYDYEKVSRVWNNGSVIRSWLMELTENAFSKDAKLDEIKGVMHSSGEGKWTVETALDLQTATPVIAMSLLMRYRSLDNDTFTGKVVAALRNEFGGHAVEKK

SEQ ID NO: 11888 - DNA, 1410 bp, Bacillus thuringiensis
  CDS (1)..(1410)
atggaaaagttacaaattggagttgttggtgtgggtgttatgggaaaaagtctcgcacttaactttgagagtaaagggtattctgttgccctatatgatatttcaaaggaaaaagttgatgaaaccattgaggaaaaccgtggtaaaaacttagttggtactcatatagttgaagagtttgttaactcactcgaatcacctagaaagattttattaatggttaatgcgggggaaattacagataaagcgattgattctctagtccctcacctcgataaaggtgatattttaattgacggtggtaatacatactttgtcgatacaattcgccgaaacaaacgtcttgccgaagaaggaatcaatttcatcggggcaggtgtgtcaggcggcgaagagggtgcattgaagggaccatctattatgcccggcggacagaaggatgcatacgaaaaagtaaaggatatgcttgaaaacatctctgcaaaagtgaataacgagccttgctgttcttatatcggacctaatggggcaggacactatgtaaagatggttcacaatggtattgagtatggagatatgcaattaatttgtgaagcatatttcttcttgaaacaaacactagatttgactgcagaagagttccatgaaatatttgctgaatggaataaaggtgaactgaatagctatctaattgagattacagccgatattttcaagaagaaagatgaagaaactggtaagccattagtggatgttattcttgatactgcaggacaaaagggtacagggaaatggacaagtcaaagcgcacttgatttaggtatctctctgcctattatcacggaatctgtatttgcacgttgcatttctgctttaaaagaagagcgtgtgaacgcaagcaaagttttatctggccctaaagataaaacggcaattggagttgaaaaagccgaattaattgaagcggtgcgccaagctttatatatgagcaaaatttgttcttatgcacaaggattcacgcaattgaaggcagcttctgaggaatatgattggaaccttgattttggcagcatttctatgctttggagaggtggatgcattatccgtgctgcctttttacagaacattaaagaggcttatgagactaacactgacctaccgaatcttttacttgatccatactttaaagaaattgtagagtcatatcaaggtggattacgccaaattatctcaatggcggtacaacagggcattccgatacctgcattttcagcagcaatttcttattatgacagctatcgtactgccaaactacctgcaaacttattgcaagcgcagcgcgattattttggagcgcatacgtataaacgagtagataaagaaggtacattccatacaaaatggatataa

SEQ ID NO: 11889 - protein, 469 aa, Bacillus thuringiensis
MEKLQIGVVGVGVMGKSLALNFESKGYSVALYDISKEKVDETIEENRGKNLVGTHIVEEFVNSLESPRKILLMVNAGEITDKAIDSLVPHLDKGDILIDGGNTYFVDTIRRNKRLAEEGINFIGAGVSGGEEGALKGPSIMPGGQKDAYEKVKDMLENISAKVNNEPCCSYIGPNGAGHYVKMVHNGIEYGDMQLICEAYFFLKQTLDLTAEEFHEIFAEWNKGELNSYLIEITADIFKKKDEETGKPLVDVILDTAGQKGTGKWTSQSALDLGISLPIITESVFARCISALKEERVNASKVLSGPKDKTAIGVEKAELIEAVRQALYMSKICSYAQGFTQLKAASEEYDWNLDFGSISMLWRGGCIIRAAFLQNIKEAYETNTDLPNLLLDPYFKEIVESYQGGLRQIISMAVQQGIPIPAFSAAISYYDSYRTAKLPANLLQAQRDYFGAHTYKRVDKEGTFHTKWI

SEQ ID NO: 11890 - DNA, 1500 bp, Photobacterium profundum
  CDS (1)..(1500)
atggtttttagattcagacgcagccaaagcgctagtgtaaaggagagtatgatgaaaggtgatattggtgtaatcggtttggctgtaatgggtcagaatctgattttgaacatgaacgatcacggttttaaagtcgtagcgtttaatcgaaccgtcgctaaagtggatgaatttttagcgggccctgcgaaagacacgaacattattggcgcaacgtctttagaagaccttgtagcaaacttagaagcaccccgtaaagtgatgctgatggtacgtgctggtgatgtggttgatcatttcattgatagccttgtgccattgttagataaaggtgacatcattattgatggtggtaattctaattacccagacactaaccgtcgcgttgcggatttagaagcaaaaggcatttacttcgtcggtacgggtgtatcggggggtgaagaaggtgcacgatttgggccttctattatgccgggcggctctcctgaagcttggccacatgttaagcctatttttcaagtaatctctgcaaaaaccgatcaaggtgaagcgtgttgtgattgggtaggtaaagatggttcgggtcattttgttaaaatggttcacaacggcatcgaatacggtgatatgcagctgatcagtgaagcataccatttcatgaaagaaggcttagggctatcttatgatgagatgcaagcaatctttaaagaatggaatgacactgaactcaatagttacttagttgaaattacagcagatatattaggctaccgcgatgaagatggcgagccgctgctagagaaaattcttgatacggcaggtcaaaagggtactggtaaatggacggggattaatgcacttgaccttggtattccgctaacgctgattactgaatctgtgttcgcgcgttgtttgtctgcaattaaagatcagcgtgttgaagctgaagcgttatttggcaaaaccattcaaccgattgatggcgataagaaagagtgggttgatgcactgcgtcaggcgctgcttgcttcaaaaatcatttcttacgcacaaggctttatgttgattcgtgaagcgtcagaagaaaataattggtcactgaactacggtaacgtagcactcatgtggcgtggcggttgtattattcgaagtgctttcttgggcaacattcgtgatgcatacgaagccacacctgatattaagttcttgggtactgacccatactttaaagatatcttggtcgatagcttaccggcatggcgtaaagtggcagcgaaagcaatggaagtgggtttgcctatgccaacaatgacatcagcattaacgttccttgatggttacacaacaggccgtctacctgccaacatgattcaagcacaacgagactacttcggtgcgcacacgtatgagcgcttagatcaaccccgtggccagttcttccatacgaactggacaggtacaggcggtgatactgcatctaccacgtacgatgtgtaa

SEQ ID NO: 11891 - protein, 499 aa, Photobacterium profundum
MVFRFRRSQSASVKESMMKGDIGVIGLAVMGQNLILNMNDHGFKVVAFNRTVAKVDEFLAGPAKDTNIIGATSLEDLVANLEAPRKVMLMVRAGDVVDHFIDSLVPLLDKGDIIIDGGNSNYPDTNRRVADLEAKGIYFVGTGVSGGEEGARFGPSIMPGGSPEAWPHVKPIFQVISAKTDQGEACCDWVGKDGSGHFVKMVHNGIEYGDMQLISEAYHFMKEGLGLSYDEMQAIFKEWNDTELNSYLVEITADILGYRDEDGEPLLEKILDTAGQKGTGKWTGINALDLGIPLTLITESVFARCLSAIKDQRVEAEALFGKTIQPIDGDKKEWVDALRQALLASKIISYAQGFMLIREASEENNWSLNYGNVALMWRGGCIIRSAFLGNIRDAYEATPDIKFLGTDPYFKDILVDSLPAWRKVAAKAMEVGLPMPTMTSALTFLDGYTTGRLPANMIQAQRDYFGAHTYERLDQPRGQFFHTNWTGTGGDTASTTYDV

SEQ ID NO: 11892 - DNA, 1455 bp, Parachlamydia sp
  CDS (1)..(1455)
atgcacatgacacaagcagatattggtttaatcggtctagccgtaatgggacaaaatctcgttcttaatatgaacgatcatggatacacggttgctgtttataataggacaacttccaaggtagatgaatttttagatgggccagcaaaaggcacaaaagtcattggggctcattcattaaaagatttgattagtcagttgaaacggccacgccgtgtgatgctaatggttaaagcaggtgaacctgtcgataattttattgagcaatgtcttccttatcttgaaaaaggtgacatacttatcgatggaggaaatagcttatttacagacacaaatcgccgttgtaatagtttgaaagaaaaaggaattatttttattggaacgggaatttctggaggagaggagggagctcgtcatggtccttctattatgcctggaggaaatcctgagggatggccacatattaaagaaatttttcaatccatcagtgctaaagttgaaggggaaccttgttgtgattgggtaggcgatcaaggagctgggcattacgttaaaatggttcataatgggatcgaatatggcgacatgcagctgatttcagaagcttattatttgttgaaagaagctcttcatcttaatcaaaacgaattatatcaggtgtttgcagattggaataaaggagatttggatagctatttaatcgaaatcacttcgaaaatatttaaagtgaatgatgaagacggaaaaccacttgtagataaaattttagacgttgcaggtcaaaaaggcacaggaaaatggacagtgattaatgcattggatttaggaatgcctttaacattaattggagaggcagtttttgcaagatgtttgtctgctttaaaagatgaacgggtagctgcaagcgagttattgaaagggcctgatgccaaatttgaaggaaatagggaagagtttattcaagcaattcgagaagctctttattcctcaaaaatcattagttatactcaaggttttatgttaatgcaacaagcggcagcagaatataaatggcagcttaattatggggcaattgccttaatgtggcgtggtggatgtattatccgcagtcaatttttgggcaaaattaaagaagcatttaaactaaatccaaacctcaagagtttacttcttgatgaatactttcttcaagaaattcaaaagcggcaaaaagggtggagaaaagtcgtttctaaatcagttgagcttggaattgccactccttgttttaatactgccttggtgttttacgatggttatcgcacagcaaaattacctgccaatctcttacaagctcaaagagatttctttggggctcatacctatgaacgaggagatcgggctcgaggacaatattttcatacagattggtcaggcaccggtggaaaggtgagttcaggttcgtacaacgcttaa

SEQ ID NO: 11893 - protein, 484 aa, Parachlamydia sp
MHMTQADIGLIGLAVMGQNLVLNMNDHGYTVAVYNRTTSKVDEFLDGPAKGTKVIGAHSLKDLISQLKRPRRVMLMVKAGEPVDNFIEQCLPYLEKGDILIDGGNSLFTDTNRRCNSLKEKGIIFIGTGISGGEEGARHGPSIMPGGNPEGWPHIKEIFQSISAKVEGEPCCDWVGDQGAGHYVKMVHNGIEYGDMQLISEAYYLLKEALHLNQNELYQVFADWNKGDLDSYLIEITSKIFKVNDEDGKPLVDKILDVAGQKGTGKWTVINALDLGMPLTLIGEAVFARCLSALKDERVAASELLKGPDAKFEGNREEFIQAIREALYSSKIISYTQGFMLMQQAAAEYKWQLNYGAIALMWRGGCIIRSQFLGKIKEAFKLNPNLKSLLLDEYFLQEIQKRQKGWRKVVSKSVELGIATPCFNTALVFYDGYRTAKLPANLLQAQRDFFGAHTYERGDRARGQYFHTDWSGTGGKVSSGSYNA

SEQ ID NO: 11894 - DNA, 1041 bp, Rhodopseudomonas palustris
  CDS (1)..(1041)
atgcagatcggcatgatcggcctcggccggatgggtggcaatatcgtccggcgcctgatgaaggatggccatcatgccgtggtgtacgacagggacccgcaagcgatcgaaacgctgacgcgcgaaggcgcaaccggcgccggcgggctcgaagacctggtgcgcaagctcgacgcgccgcgcgcggtgtgggtgatgctgcccgccggacagatcaccgagaccaccatcgaacagcttgccaagctgctcgccgccggcgacgtcgtcatcgatggcggcaacaccttctggcaggacgatatccgccgcgccaagacgctgaaggaaaccagcatcgactacgtcgatgtcggcacctccggcggcatctggggcttcgagcgcggctactgcatgatgatcggcggcgacaaagccgtcgtcgaccggctcgatccgatcttcgctacactggcgccgggcatcggcgacatcccgcgcacgccgggccgcgacgatcgcgatccccgcgtcgagcagggctatctgcacgccggcccggtcggcgccggccatttcgtcaaaatggttcacaacggcatcgaatacggcctgatgcaggcctatgccgaaggcttcgacattctcaagaacgccagcagcgactccctgcccgaagcgcaccgcttcgatctcgacatcgccgacatcgccgaggtctggcgccgcggcagcgtgatcccgtcctggctgctcgacctcaccgccaccgcgctggcgaaaaacgatcagctcgacaactactcgggcttcgtcgaggactcaggcgaaggccgctggaccatcaacgccgcgatcgaagaagcggtaccggccgaagtgctcaccgccgcgctgttcgcgcgtttccgctcgcgacgggagcatacgtttgcggagaaaattctctcggcgatgcgggcgggcttcggcggccacaaggagccgcagcagcatcctgagccggagcagcaagccgctccgcagcaaaaactgaaaccgaaagcggagcgcgcgtga

SEQ ID NO: 11895 - protein, 346 aa, Rhodopseudomonas palustris
MQIGMIGLGRMGGNIVRRLMKDGHHAVVYDRDPQAIETLTREGATGAGGLEDLVRKLDAPRAVWVMLPAGQITETTIEQLAKLLAAGDVVIDGGNTFWQDDIRRAKTLKETSIDYVDVGTSGGIWGFERGYCMMIGGDKAVVDRLDPIFATLAPGIGDIPRTPGRDDRDPRVEQGYLHAGPVGAGHFVKMVHNGIEYGLMQAYAEGFDILKNASSDSLPEAHRFDLDIADIAEVWRRGSVIPSWLLDLTATALAKNDQLDNYSGFVEDSGEGRWTINAAIEEAVPAEVLTAALFARFRSRREHTFAEKILSAMRAGFGGHKEPQQHPEPEQQAAPQQKLKPKAERA

SEQ ID NO: 11896 - DNA, 1455 bp, Corynebacterium diphtheriae
  CDS (1)..(1455)
atgactgatcaaacacaactagcgcagatcggcattgtcggtctcgctgtcatgggttcgaacctcgcacgcaattttgctcataaaggccacacggttgctgtttttaatcgcagctttgaaaagacccaagcgctcatggatcagcacggagatgaaggcaatttcatcccgtccgccacaatcgaagaatttgttgcttcgctagaaaagcctcgtcgcgccatcatcatggttcaagcaggacctgcaactgacgcagtaatcaaccaacttgccgatgcgatggatgaaggcgacatcattatcgatggcggcaacgcactctacaccgacacgattcgtcgtgaaagcgaaattgctcaacgaggcctcaacttcgtcggcgccggcatttccggaggcgaagaaggagccctcaacggtccttctatcatgcctggtggtcctgataaatcttgggaagcacttggaccgctgctcgaatccatcgccgcacaggttggcggcacaccatgtgttactcacatcggccctgacggcgcaggccactttgtcaagatggttcataatggaatcgaatatgccgacatgcaagtgatcggcgaggcataccaattgcttcgatacgccaccgaaatgcagccatctgagattgcagatgtgtttaagacatggaaccaaggtgacttggactcctacctcattgagattacgtctgaggtacttgctcaggtcgattctgaaactggcacaccacttatcgatctcatcgtggatgaagctggtcaaaaaggaaccggtcgttggacggtgaaagctgctctagaccttggtattgcaactactggaatcggcgaagcagtattcgctcgcgcactttcaggtgcaaccactcagcgcaaggcagcccaaggtaacttgccagccggcactttggaatcattggcctcgttgaacatcgataaggaccagttcgtagaagatgtccgtcgcgcactctatgcttcaaagctcgtcgcttatgcgcagggcttcgacgaaattatcgccggatcagccgagcacaactgggatgtcgatcctcgcgacctcgctaccatctggcgcggtggctgcatcattcgcgcaaagttccttaaccgcatcgttgaagcttacgacgctaatccagaactcccgtccctcctactggatccctactttaagactgagctggaatcgcttatcgattcatggcgccgcgtagtcgttgcagctacacaactgggattgcctgttccagtgttcgcttcatcgttatcctactacgactctttgcgagccgaacgcctaccagctgcacttatccaaggccagcgtgattttttcggtgcacacacttaccgtcgcacggataaagacggaagcttccacaccttgtggtccggtgatcgtagcgaagtagaagcttaa

SEQ ID NO: 11897 - protein, 484 aa, Corynebacterium diphtheriae
MTDQTQLAQIGIVGLAVMGSNLARNFAHKGHTVAVFNRSFEKTQALMDQHGDEGNFIPSATIEEFVASLEKPRRAIIMVQAGPATDAVINQLADAMDEGDIIIDGGNALYTDTIRRESEIAQRGLNFVGAGISGGEEGALNGPSIMPGGPDKSWEALGPLLESIAAQVGGTPCVTHIGPDGAGHFVKMVHNGIEYADMQVIGEAYQLLRYATEMQPSEIADVFKTWNQGDLDSYLIEITSEVLAQVDSETGTPLIDLIVDEAGQKGTGRWTVKAALDLGIATTGIGEAVFARALSGATTQRKAAQGNLPAGTLESLASLNIDKDQFVEDVRRALYASKLVAYAQGFDEIIAGSAEHNWDVDPRDLATIWRGGCIIRAKFLNRIVEAYDANPELPSLLLDPYFKTELESLIDSWRRVVVAATQLGLPVPVFASSLSYYDSLRAERLPAALIQGQRDFFGAHTYRRTDKDGSFHTLWSGDRSEVEA

SEQ ID NO: 11898 - DNA, 1440 bp, Leishmania mexicana
  CDS (1)..(1440)
atgtcgaacgacctcggcattatcggtctcggcgtcatgggcgcgaatctcgccctgaacatcgccgagaatggatttaaagttgccgtcttcaaccgcacctacacgaagacgacgtcgtttctcaaggagcatgagaacgaggcgcttgtcgtcaacctgaaggggtacgagaccatgaaggagttcgccgcgtccctcaagaagccgcgccgcgcgttcattctcgtccaggccggcgctgctacggactccacaatcgaacagctcaaggaagttttcgaggagggcgacatcgtcatagacactggcaatgcgaacttcaaggaccaggacaggcgcgccgcgcagttggagagccagggtctccgcttcctcggcatgggcatctccggtggtgaggagggtgcgcgcaaggggccggccttcttccctgggggcacaccaagcgtgtgggaggaggtacgcccgatcgtggaggcggctgcggccaaggctgaggacggtcgcccgtgcgtgacgttcaacggcaagggcggcgctggatcctgcgtgaagatgtaccacaacgctggtgagtacgccgtgctgcagatctggggtgaggcgtacagcgccttgcttgccttcggattcaacaacgatcagatcgctgacgtgttcgagtcgtggaaggcagacggcttcctcaaatcctacatgctcgacatctccattgtcgcttgccgggcgagggaggcagcaggcaactatttgtcagagaaggtgctggaccgcatcggctccaaaggaaccggcctgtggtcggcccaggaggctctggaagttggggtgccagcgccctcgctcaacatggccgtcatctcacgccagatgaccatgtacaaagcggagcgtgtcgcgaactccaaggcatttcctcacttcccttgcggcccgtgtgagaaagccacggacaagtccccgaactcccccgaagcgaagcagctgttccacgccgtcagcctttccatcattgcaagttacgcgcagatgtttcagtgcttgcgcgagctggacaaggtgtacggatttggcttgaacctgcccgccaccatcgcaaccttccgcgccggctgcattctgcagggctacctgctggggcccatgacgaaggccttcgaggagaacccgaacctgcccaacctgatggacgccttcaccaaggagatagctgcgggccttaatgactgccgccagattctcgccaggctcacagtgaatacggcagtgtcactggcgggcatgatggcctcactgtcctacatcaacgccatgtacacggagattcttccgtacggacagctggtgtcgttgcaacgcgacgtctttggccgccacggctacgagcgcacggacagggatggtcgtgagtcgttcgaatggcccgcactgcagtaa

SEQ ID NO: 11899 - protein, 479 aa, Leishmania mexicana
MSNDLGIIGLGVMGANLALNIAENGFKVAVFNRTYTKTTSFLKEHENEALVVNLKGYETMKEFAASLKKPRRAFILVQAGAATDSTIEQLKEVFEEGDIVIDTGNANFKDQDRRAAQLESQGLRFLGMGISGGEEGARKGPAFFPGGTPSVWEEVRPIVEAAAAKAEDGRPCVTFNGKGGAGSCVKMYHNAGEYAVLQIWGEAYSALLAFGFNNDQIADVFESWKADGFLKSYMLDISIVACRAREAAGNYLSEKVLDRIGSKGTGLWSAQEALEVGVPAPSLNMAVISRQMTMYKAERVANSKAFPHFPCGPCEKATDKSPNSPEAKQLFHAVSLSIIASYAQMFQCLRELDKVYGFGLNLPATIATFRAGCILQGYLLGPMTKAFEENPNLPNLMDAFTKEIAAGLNDCRQILARLTVNTAVSLAGMMASLSYINAMYTEILPYGQLVSLQRDVFGRHGYERTDRDGRESFEWPALQ

SEQ ID NO: 11900 - DNA, 1461 bp, Buchnera aphidicola
  CDS (1)..(1461)
atgttaaataaaaatcttatagatctatttaggagtttttctaatatgtctttacaaaaagttggtgtaataggaatggcagtaatgggaagaaatttagctttaaatatagaaagtaaaggatatactgtttctatttttaatagatcaaaaaataaaacaaaagaagtaatcttaaaaaataaaaataaaaatcttataccattttttacaattaaagattttatattatctttacaaaaacctagaattattttattaatggttcaatcaggaacagcaacagatttaactattaaatctattattccttatttagatccagaagatattttaattgatggtggtaatagtttttataaagatactataaaacgtagttctttattatttaagaaaaaaatatatttttttggtataggtatatctggtggtgaagagggtgcattaaaaggtccagcaattatgccaggaggtaataaattaatttataaaaaaatatcttctttactgaaaaagattgcagctaaaacagaaaataacgaatcatgtgtaagttatattggtacagatggttctggtcattatgtaaaaatggttcataatggaattgaatatggagatatgcaattaatttctgaatcttattttattttaaaacattctttaaatttaaataataaacaactttctaaaattttttctaattggaataaaggtgaattaaaaagttatttaatcgaaattactaaaaacatttttttaaaaaaagattcttctggaaaatatttaatagatgttatattagataaagctaataataaaggtacaggaaaatggactagtcaaagtgcattaaatttaggcgaacctttatctttaattacgcaatctgttttttttagatatttatcttcttttaaaaaccaaagattacaagcttctaaaattctttatggccctaaaccttctcaagatgttttaaatcatgaagattttattgaaaatattcgacgttctttatatttaggaaaaattatttcttatgctcaaggattctctcaattaaaaaaagcatcacaagtatatcattggaatttaaattattctaaaattgcaaagatttttcgtgcaggtagtatcattagagcagattttttaaaagaaattattcatgcatatcaaaaaagtaatggtttagaaaatttattattagcgccatattttataaaaatttctaaagaatatcaaaattctttaagaaaaattgtatcttattctgttatgcatggtataccaattccagcattttctgcagcaatttcttattatgattcttatagatctcctatattaccagcaaatctattacaagctcaaagagattattttggagctcatacttattctagaattgacaaaaaaggtacttttcatactaattggatagatataaaataa

SEQ ID NO: 11901 - protein, 486 aa, Buchnera aphidicola
MLNKNLIDLFRSFSNMSLQKVGVIGMAVMGRNLALNIESKGYTVSIFNRSKNKTKEVILKNKNKNLIPFFTIKDFILSLQKPRIILLMVQSGTATDLTIKSIIPYLDPEDILIDGGNSFYKDTIKRSSLLFKKKIYFFGIGISGGEEGALKGPAIMPGGNKLIYKKISSLLKKIAAKTENNESCVSYIGTDGSGHYVKMVHNGIEYGDMQLISESYFILKHSLNLNNKQLSKIFSNWNKGELKSYLIEITKNIFLKKDSSGKYLIDVILDKANNKGTGKWTSQSALNLGEPLSLITQSVFFRYLSSFKNQRLQASKILYGPKPSQDVLNHEDFIENIRRSLYLGKIISYAQGFSQLKKASQVYHWNLNYSKIAKIFRAGSIIRADFLKEIIHAYQKSNGLENLLLAPYFIKISKEYQNSLRKIVSYSVMHGIPIPAFSAAISYYDSYRSPILPANLLQAQRDYFGAHTYSRIDKKGTFHTNWIDIK

SEQ ID NO: 11902 - DNA, 1434 bp, Trypanosoma cruzi
  CDS (1)..(1434)
atggacgttggcattgttggacttggtgtcatgggtgccaacctggcactaaacattgcagagaaagggtttcacgttgcggtattcaatcgcacatactccaaggcggagagttttattaaagagcatgcctcggctccttttgcggcaaatcttaaggcatatgagacgatgaattcttttattatggccattaaaaagccgcgcaagatatttattcttgttcaggctggcgctgctactgacgcgacgattgagcaattaaagggcgttctggagaaggatgacattattgtggacacgggtaacgctcacttcaaggatcagacccgccgagccgaacaactggaggcagcaggtctgcgttttcttggaatgggcatttccggtggggaagagggcgcccgaaaaggccctgccttttttcccggtggcacgttgagtgtatggaaagaaatccaaccagtggttgaagctgccgcagcaaaggccgatgatggccgtccgtgtgtcactatgaatggccgtggtggggccggttcgtgtgtcaagatgtaccataacgctggggagtatgccgttctgcaggtatggggcgaggcctttgacattcttcgtgcaatggggttaagcaacgatgaggtggctgctgtatttgaggactggaargctaaggggtttttgacttcatatatgctcgatatttccatcgtcgccgcgcgtgccaaggttgcggatggcagccatctttctgaacacgtcaaggactgtattggttctaaaggcacgggtctatggtctgcgcaggaagcgctagaggttggtgtacccgcaccaagtctaaacatggctgtgttgtcacggcagatgacaatgtacaagtcggaacgtgagctaaatgcaaagacacttccttttgttctaaaagtccctggatacgcaataaaggacaagagtcccaacgcaccagagattcgacaactctaccatgctgtttccatcgcgattatagcgtgctatgcgcaaatgtttcaatgcctccgagctctggataaagtgtatgattttggtttggatcttccagccaccattgccactttccgcgccggttgcattttgaagggttatctccttcagcctatgacggaggccttcgcaaagaatgtaaatctaagtaacctgatgtgtgcctttgaaaaggaaataacagaaggactgcagagctaccgcgatatcttgggttttatcacttccaagacagccttgacgctccctgtgctctcagcctctctggtgtacgttaatgggatgtttaccccgacgctaaggtacggtcaacttgtttctttgcaaagggatgtatttggccgccacggatacgagcggctagacaaggagggccgtgaatcccaccaatggccggagctacagtga

SEQ ID NO: 11903 - protein, 477 aa, Trypanosoma cruzi
MDVGIVGLGVMGANLALNIAEKGFHVAVFNRTYSKAESFIKEHASAPFAANLKAYETMNSFIMAIKKPRKIFILVQAGAATDATIEQLKGVLEKDDIIVDTGNAHFKDQTRRAEQLEAAGLRFLGMGISGGEEGARKGPAFFPGGTLSVWKEIQPVVEAAAAKADDGRPCVTMNGRGGAGSCVKMYHNAGEYAVLQVWGEAFDILRAMGLSNDEVAAVFEDWKAKGFLTSYMLDISIVAARAKVADGSHLSEHVKDCIGSKGTGLWSAQEALEVGVPAPSLNMAVLSRQMTMYKSERELNAKTLPFVLKVPGYAIKDKSPNAPEIRQLYHAVSIAIIACYAQMFQCLRALDKVYDFGLDLPATIATFRAGCILKGYLLQPMTEAFAKNVNLSNLMCAFEKEITEGLQSYRDILGFITSKTALTLPVLSASLVYVNGMFTPTLRYGQLVSLQRDVFGRHGYERLDKEGRESHQWPELQ

SEQ ID NO: 11904 - DNA, 1434 bp, Trypanosoma cruzi
  CDS (1)..(1434)
atggacgttggcattgttggacttggtgtcatgggtgccaacctggcactaaacattgcagagaaagggtttcacgttgcggtattcaatcgcacatactccaaggcggagagttttattaaagagcatgcctcggctccttttgcggcaaatctcaaggcatatgagacgatgaagtcttttattatggccattaaaaagccgcgcaagatatttattcttgttcaggctggcgctgctactgacgcgacgattgagcaattaaaaggcgtcctggagaaggatgacattattgtggacacgggtaacgctcacttcaaggatcagacccgccgggccgaacaactggaggcagcaggtctgcgttttcttggaatgggcatttccggtggggaagagggcgcccgaaaaggccctgccttttttcccggtggcacgttgagtgtatggaaagaaatccaaccagtggttgaagctgccgcggcaaaggccgatgatggccgtccgtgtgtcactatgaatggccgtggtggggccggttcgtgtgtcaagatgtaccataacgctggggagtatgccgttctgcaggtatggggcgaggcctttgacgttcttcgtgcaatggggttaagcaacgatgaggtggctgctgtatttgaggactggaaggctaaggggtttttgacttcatatatgctcgatatttccatcgtcgccgcgcgtgccaaggttgcggatggcagccatctttctgaacacgtcaaggactgtattggttctaaaggcacgggtctatggtctgcgcaggaagcgctagaggttggtgtacccgcaccaagtctaaacatggctgtgttgtcacggcagatgacaatgtacaagtcggaacgtgagctaaatgcaaagacacttccttttgttctaaaagtccctggatacgcaataaaggacaagagtcccaacgcaccagagattcgacaactctaccatgctgtwtccatcgcgattatagcgtgctatgcgcaaatgtttcaatgcctccgagctctggataaagtgtatgattttggtttggatcttccagccaccattgccactttccgcgccggttgcattttgaagggttatctccttcagcctatgacggaggccttcgcaaagaatgtaaagctaagtaacctgctctgtgcctttgaaaaggaaataagagaaggactgcagagctaccgcgatatcttgggttttatcacttccaagacagccttgacgctccctgtgctctcagcctctctggtgtacgttaatgggatgtttaccccgacgctaaggtacggtcaacttgtttctttgcaaagggatgtatttggccgccacggatacgagcggctagacaaggagggccgtgaatcccaccaatggccggagctacagtga

SEQ ID NO: 11905 - protein, 477 aa, Trypanosoma cruzi
MDVGIVGLGVMGANLALNIAEKGFHVAVFNRTYSKAESFIKEHASAPFAANLKAYETMKSFIMAIKKPRKIFILVQAGAATDATIEQLKGVLEKDDIIVDTGNAHFKDQTRRAEQLEAAGLRFLGMGISGGEEGARKGPAFFPGGTLSVWKEIQPVVEAAAAKADDGRPCVTMNGRGGAGSCVKMYHNAGEYAVLQVWGEAFDVLRAMGLSNDEVAAVFEDWKAKGFLTSYMLDISIVAARAKVADGSHLSEHVKDCIGSKGTGLWSAQEALEVGVPAPSLNMAVLSRQMTMYKSERELNAKTLPFVLKVPGYAIKDKSPNAPEIRQLYHAVSIAIIACYAQMFQCLRALDKVYDFGLDLPATIATFRAGCILKGYLLQPMTEAFAKNVKLSNLLCAFEKEIREGLQSYRDILGFITSKTALTLPVLSASLVYVNGMFTPTLRYGQLVSLQRDVFGRHGYERLDKEGRESHQWPELQ

SEQ ID NO: 11906 - DNA, 1023 bp, Mycobacterium paratuberculosis
  CDS (1)..(1023)
atgcagctggggatgatcggcctgggccggatgggtgccaacatcgtccgacgggtggtcaagggcggacacgaatgcgttgtctacgaccacaatccggacgcggtcaaggcgatggcgggggaggagaagacgaccggggtctcctcgctgcaagagctcgccgcgaagctgagcgccccgcgggtggtgtgggtgatggtgccggccgggacgatcaccaccggggtgatcgaggagctggccaccacgctggagcccggcgacatcgtcatcgacggcggcaactcctactaccgcgacgacattcgtcactcgaagaccctgtcggagaaggggattcggctgctggactgcggcaccagcggcggcgtctggggccgggaacggggttactgcctgatgatcggcggcgacgaggaggcgttcgcgcacgccgagccgatcttcgccaccgtcgcaccgggggtggacgccgcgccgcggacgccgggccgcgacggcgaggtcacccggtcggagcaggggtatctgcattgcgggccgtccggcgccgggcacttcgtgaagatggtgcacaacggcatcgagtacgggatgatggcctcgctcgccgagggactcaacgtgttgcgcaacgccgacatcggcaagcacgcgcaggaaggcgacgccgaaaccgcgccgctgtccaatcccgagttctaccaatacgatttcgacatccccgaggtcgccgaggtgtggcggcgcggcagcgtcatcggatcctggctgctggatctcacggcgatcgcactgcacgaatcaccggagctcaaggagttctccgggcgggtctccgactcgggggagggccgctggacgtccatcgccgcgatcgacgagggggtccccacgccggtgctgaccaccgcgctgcagtcccgcttcgcttcccggcatctcgatgacttcgccaacaagacgctctcggcgatgcgtaagcaattcggcgggcacgccgagaagccggccaactag

SEQ ID NO: 11907 - protein, 340 aa, Mycobacterium paratuberculosis
MQLGMIGLGRMGANIVRRVVKGGHECVVYDHNPDAVKAMAGEEKTTGVSSLQELAAKLSAPRVVWVMVPAGTITTGVIEELATTLEPGDIVIDGGNSYYRDDIRHSKTLSEKGIRLLDCGTSGGVWGRERGYCLMIGGDEEAFAHAEPIFATVAPGVDAAPRTPGRDGEVTRSEQGYLHCGPSGAGHFVKMVHNGIEYGMMASLAEGLNVLRNADIGKHAQEGDAETAPLSNPEFYQYDFDIPEVAEVWRRGSVIGSWLLDLTAIALHESPELKEFSGRVSDSGEGRWTSIAAIDEGVPTPVLTTALQSRFASRHLDDFANKTLSAMRKQFGGHAEKPAN

SEQ ID NO: 11908 - DNA, 1470 bp, Mycobacterium paratuberculosis
  CDS (1)..(1470)
atgagttcgtcggttaccccgtcgcgtcccaccaccggcaccgcccagatcggcgtcaccgggctggccgtgatgggttcgaacatcgcccgcaatttcgcccggcacggttacaccgtggcgctgcacaaccggtctatcgccaaaaccgacgcgctgctgaaagagcacggcgacgagggcaagttcgtgcgctgcgaaaccatcgccgaattcctcgacgcgctggaaaaaccgcgtcgcgtgctgataatggtcaaggccggcgaccccaccgacgcggtgatcaacgagctcgccgatgccatggagcccggcgacatcatcatcgacggcggcaacgccctctacaccgacaccatccgccgggagcaggcgatgcgcgaacgcggcctgcacttcgtgggcgccggcatctccggcggcgaggagggcgcgctcaacggcccgtcgatcatgcccggcggcccggccgagtcctaccggtcgctgggcccgctgctcgaggagatctccgcgcacgtcgacggggtgccgtgctgcacgcacatcggccccgacggggccgggcacttcgtcaagatggtgcacaacggcatcgagtactccgacatgcagctgatcggcgaggcctaccagctgctgcgcgacgcgctgggcaagaccgccgagcagatcgccgacgtgttcgacgaatggaactccggcgacctggacagcttcctggtcgagatcaccgcgcaggtgctgcgccagaccgacgccaagaccggaaagccgctcgtcgacctcatcctcgacgaggccgaacagaagggcaccggccgctggacggtcaaatcggcgctggacctcggcgtgccggtgaccggcatcgccgaggcggtgttcgcccgcgcgttgtcgggctcggtggcccagcgcagggccaccaccgggctggcgtcgggccggttcggcgaaaagccaagcgacgcagcacagttcaccgaggacatccgccaggccctgtacgcgtccaagatcatcgcctacgcgcagggcttcaaccagatccaggccggcagcgccgaatacggctgggacatcacccccggcgacctggccaccatctggcgcggcggctgcatcatccgggccaagttcctcaaccggatcaaggacgccttcgacgagaaccccgacctgccgaccctgatcgtcgcgccgtatttccgcagcgcgatcgaggccgccatcgacggctggcgccgggtcgtggtcacggccacccggttgggcatcccgatccccggcttctcctcggcgctgtcctactacgacgcgctgcgcaccgagcggctgcccgccgcgctcacccagggtctgcgggacttcttcggcgcgcacacctacgggcgcatcgacgaggaccccgacaagcgcttccacacgctgtggagcgccgaccgccgcgaagtgccggcgtaa

SEQ ID NO: 11909 - protein, 489 aa, Mycobacterium paratuberculosis
MSSSVTPSRPTTGTAQIGVTGLAVMGSNIARNFARHGYTVALHNRSIAKTDALLKEHGDEGKFVRCETIAEFLDALEKPRRVLIMVKAGDPTDAVINELADAMEPGDIIIDGGNALYTDTIRREQAMRERGLHFVGAGISGGEEGALNGPSIMPGGPAESYRSLGPLLEEISAHVDGVPCCTHIGPDGAGHFVKMVHNGIEYSDMQLIGEAYQLLRDALGKTAEQIADVFDEWNSGDLDSFLVEITAQVLRQTDAKTGKPLVDLILDEAEQKGTGRWTVKSALDLGVPVTGIAEAVFARALSGSVAQRRATTGLASGRFGEKPSDAAQFTEDIRQALYASKIIAYAQGFNQIQAGSAEYGWDITPGDLATIWRGGCIIRAKFLNRIKDAFDENPDLPTLIVAPYFRSAIEAAIDGWRRVVVTATRLGIPIPGFSSALSYYDALRTERLPAALTQGLRDFFGAHTYGRIDEDPDKRFHTLWSADRREVPA

SEQ ID NO: 11910 - DNA, 1389 bp, Lactobacillus johnsonii
  CDS (1)..(1389)
atgcaacaatttggggttattggcttgtccgttatggggaaaaaccttgccttaaacgttaaaaatcatggctactctgtctctggattttcaattgataagccagaggttgatgctttagcaaaatatgaagataagaatttaaagccaacttatacttgggaagaatttgttaattcactagaaaagccacgaaaaatcttgattcaaatcatggctggtaaaccagttgatgaaactttacaaaaactattgcctcttttagataagggcgatattttaattgacggtggtaattctaatttccatgatactaatcgtcgctataaggaaatggaaaagcatggtattcacttcattggtatgggtgtttctggcggtgaagaaggagctttgaacggtcctgccttaatgccaggtggtgatgaaaaagcttatgaagaagtagcgccaatccttgaagctatggctgccaagactccaactggtcaaccatgtgtcggatacattggaccagcaggtagtggtcactatgtgaagatggttcacaatggtattgaatatggtattatgcagattatttctgaagtatacgatgttctccgcaccgttggtcattattcaaacaatgaaatgagtgaaatctttaagaattgggataagggtggtttacaagcttatttaattgaaatcacttctaaggtcttaaaacaaaaggataacttaactgatgatcatattattgatcatatcttaaatgaagcttcttataagggaactggtaactggatgcttgaagatgcaattcgtttaggtgctccaattactgtaattgcagaagccgttcttgctcgttttatgtcaaaagcaactttgagaaatgatcctgaaccaaagattgacccagagaaagctccaaaggacttagttgatcaacttgcaaaagccttatacttagctatggctgtttcatatggtcaaggatttgagcaattaacgatggctgcaaaagcttataactggcgcttgcactattcaactattgcccaaaactgggaagctggatgtatcatccgctcacaaatgcttcatgatattaagtttgcgtataatgctgataaagacttgcctaacttattcaaggctccattttttgataaggtaaagaaagaaaatattggcgctcttagagatgtggttaaaattgcggctgatgctggcgtaccaactccaactcttagtgcagctttgaattacttggaatctatttttaatccacgcttacctcaaaacattattcaaggtcaacgtgattactttggtgctcacacttaccaaagaaatgatcgtccaggtactttccatactgaatggtacgaagaaaaataa

SEQ ID NO: 11911 - protein, 462 aa, Lactobacillus johnsonii
MQQFGVIGLSVMGKNLALNVKNHGYSVSGFSIDKPEVDALAKYEDKNLKPTYTWEEFVNSLEKPRKILIQIMAGKPVDETLQKLLPLLDKGDILIDGGNSNFHDTNRRYKEMEKHGIHFIGMGVSGGEEGALNGPALMPGGDEKAYEEVAPILEAMAAKTPTGQPCVGYIGPAGSGHYVKMVHNGIEYGIMQIISEVYDVLRTVGHYSNNEMSEIFKNWDKGGLQAYLIEITSKVLKQKDNLTDDHIIDHILNEASYKGTGNWMLEDAIRLGAPITVIAEAVLARFMSKATLRNDPEPKIDPEKAPKDLVDQLAKALYLAMAVSYGQGFEQLTMAAKAYNWRLHYSTIAQNWEAGCIIRSQMLHDIKFAYNADKDLPNLFKAPFFDKVKKENIGALRDVVKIAADAGVPTPTLSAALNYLESIFNPRLPQNIIQGQRDYFGAHTYQRNDRPGTFHTEWYEEK

SEQ ID NO: 11912 - DNA, 1461 bp, Yersinia pestis
  CDS (1)..(1461)
atggccttaaggctggtaacaggtgtcatccttcagacaggagtttttttaatgtccaaacaacagatcggcgttgtcggtatggcggtgatgggccgtaacctggcgctcgacatcgaaagccgtggctattccgtttctatttttaaccgttcatcagacaaaaccgacgaagtggttgccgagaatccaggtaagaatctggtgccgagttataccgttgaagagtttgttgattcactggaaaaaccgcgccgtatcctgctgatggtgaaagcgggtgaagcaacagataaaacgatcgcttcactgacgccgcatcttgataaaggcgatattctgattgatggtggcaatacttattacaaagacaccattcgtcgtaaccgtgaactttctgcacaaggctttaactttatcggtaccggcgtgtctggtggtgaagagggtgcattgaaaggcccttctatcatgccgggtggccagaaagaagcctacgaattggttgccccgatccttgagaaaattgcggcccgtgctgatgatggtgacgcctgcgttgcctatatcggcgctgacggtgctggccattacgttaaaatggttcacaacggtatcgaatacggtgatatgcaattgatcgccgaagcctattcactgctgaaacagtctctgggtctgagcaatgaagagctggccagtacttttgctgagtggaacaaaggcgaactgaacagctacctgattgatatcaccaaagacatcttcaccaagaaagacgaagacggtaactatctggttgatgtgatcctggacgaagctgccaacaaaggcaccggtaaatggaccagccaaagttctctggacttgggtgagccgttaacactgatcactgaatctgtgtttgcccgttacttgtcttctctgaaagatcaacgtgttgctgcctctaaagtgttgactggccctaaagttcagcctttcactggtgataaagccgagtttatcgaaaaaattcgtcgcgcgctgtatctgggtaaaatcgtttcttacgcacaaggtttctctcaactgaaagcggcatctaacgagaataactgggatctgaattacggtgaaatcgcgaagattttccgtgctggctgtattattcgtgctcagttcctacaaaaaattactgatgcttatgcagaaaacgcagatatcgctaacttgctgctggcaccgtacttcaagcaaattgctgatgaataccagcaagcgctgcgtgatgtggtgtcttatgcggtacaaaacggtatcccaacgccaacattctctgctgcgattaactattacgacagctaccgttcagccgtgctgcctgctaacttgatccaggcacagcgcgactatttcggtgcgcatacgtataagcggacagataaagaaggtgtattccacactgagtggatggcgtaa

SEQ ID NO: 11913 - protein, 486 aa, Yersinia pestis
MALRLVTGVILQTGVFLMSKQQIGVVGMAVMGRNLALDIESRGYSVSIFNRSSDKTDEVVAENPGKNLVPSYTVEEFVDSLEKPRRILLMVKAGEATDKTIASLTPHLDKGDILIDGGNTYYKDTIRRNRELSAQGFNFIGTGVSGGEEGALKGPSIMPGGQKEAYELVAPILEKIAARADDGDACVAYIGADGAGHYVKMVHNGIEYGDMQLIAEAYSLLKQSLGLSNEELASTFAEWNKGELNSYLIDITKDIFTKKDEDGNYLVDVILDEAANKGTGKWTSQSSLDLGEPLTLITESVFARYLSSLKDQRVAASKVLTGPKVQPFTGDKAEFIEKIRRALYLGKIVSYAQGFSQLKAASNENNWDLNYGEIAKIFRAGCIIRAQFLQKITDAYAENADIANLLLAPYFKQIADEYQQALRDVVSYAVQNGIPTPTFSAAINYYDSYRSAVLPANLIQAQRDYFGAHTYKRTDKEGVFHTEWMA

SEQ ID NO: 11914 - DNA, 1497 bp, Ashbya gossypii
  CDS (1)..(1497)
atgcgccgagaccatatactaacagctagcagaggagatattggcctgatcggcctggctgtcatgggccagaacttgatcctaaacgccgccgaccacggatacacggtcgtggcgtacaacaggacggtttcgaaggtggaccggttcctggaggatgaggcgaagggcaagtccatcatcggcgcgcatacagtggaggaactctgcgcgaacctaaagagaccaagaagggtgattttactggtcatggccggatctgctgatgatgcgttcatcgaacagctgcttccatacatggagcagggtgacatcatcattgtcggcggtaactctcacttccctgtcagcaacagacgctttgaagagctaaagcagaagggtatccacttcgtcggctctggtgtgtccgacggtgaggaaggtgctcgttatggtccttccttgatgcctggtggtgcccctgaggcatggccacacatcaaggagatcttccagtctattgctgccaagtcagagggcgaggcatgctgcgactgggtcggacctgccggcgctggccactacgtcaagatggtgcacaacggtattgagtatggtgacatgcaattgatctgtgaggcgtatgacatcatgaagagattgggtggcttcacggacaaggagattggccaggtgttctcggagtggaacaaaggcatcctagactctttcttgattgagatcacgagagacatcttgctttacgaggatctagatgggacccctctagtggagaagatcctggactctgctggtcaaaagggtactggtaagtggaccgctatcaacgcgttggacatgggcatgcctgtgactttgatcggtgaggccgtcttcgctcgttgcctatcctccctaaaggatgagagaatgcgcgcttccgcgctattgagcggtcccgaaatccctaaggatgctgtgaaggacagaaagcagtttgtcgacgacttggagcaggctttgtatgcgtccaagatcatgtcctacgcccagggcttcatgttaatgagagaggcaggtaagacttttggctgggagctaaacttccctgccattgctttgatgtggagaggtggctgcatcatcagatctgttttccttgcccagatcaccaaggcgtacagagagaacccttacttggagaacttgttgttcaacaagttctttgctgacgctgtcaccaaggctcagcagggctggagaagaaccatcgggttggcaactacctacggtattcctactcccgccttctctaccgcgcttgccttctacgacgggtacagatctaagagattgcctgccaacttgctgcaagctcagcgtgactactttggcgcccacaccttccgtgtgctgccagaggctgccagcgctcacttgccagtagacaaggacatccatatcaactggaccggtaagggtggtaacatctccgcctctacctaccaggcctga

SEQ ID NO: 11915 - protein, 498 aa, Ashbya gossypii
MRRDHILTASRGDIGLIGLAVMGQNLILNAADHGYTVVAYNRTVSKVDRFLEDEAKGKSIIGAHTVEELCANLKRPRRVILLVMAGSADDAFIEQLLPYMEQGDIIIVGGNSHFPVSNRRFEELKQKGIHFVGSGVSDGEEGARYGPSLMPGGAPEAWPHIKEIFQSIAAKSEGEACCDWVGPAGAGHYVKMVHNGIEYGDMQLICEAYDIMKRLGGFTDKEIGQVFSEWNKGILDSFLIEITRDILLYEDLDGTPLVEKILDSAGQKGTGKWTAINALDMGMPVTLIGEAVFARCLSSLKDERMRASALLSGPEIPKDAVKDRKQFVDDLEQALYASKIMSYAQGFMLMREAGKTFGWELNFPAIALMWRGGCIIRSVFLAQITKAYRENPYLENLLFNKFFADAVTKAQQGWRRTIGLATTYGIPTPAFSTALAFYDGYRSKRLPANLLQAQRDYFGAHTFRVLPEAASAHLPVDKDIHINWTGKGGNISASTYQA

SEQ ID NO: 11916 - DNA, 1771 bp, Oryza sativa
  CDS (53)..(1495)
cgcctttccgcgatttcgtcagttacccagatctcatcttacgcaggcagagatggctgtcactagaattggtcttgctggccttgcggtcatggggcagaaccttgccctcaacattgcagagaaagggttccctatctctgtctacaacaggacgacttctaaggttgatgagaccgttcagcgcgccaaggtagaaggaaaccttcctgtgtacgggttccatgaccctgcatcctttgtgaactccattcagaagccacgtgttgtcatcatgcttgtcaaggctggtgcaccagtggaccagaccattgcaactcttgcagcacacttggagcagggtgactgtattattgatggaggaaatgagtggtacgagaacactgagaggagggagaaggcaatggaggagcgtggcctcctctatcttgggatgggtgtttccggaggagaggagggtgcccgcaatggcccgtccttgatgcctggtggctcattcgaggcgtacaagtacattgaagatattcttctcaaggtggctgcccaggttcctgatagtggcccgtgcgtcacatacattggcaaaggtggatctggaaactttgtcaagatggttcacaacggaattgagtatggtgacatgcaactgatttctgaggcatatgatgttctcaagtcagttggtaagctcacaaacagtgagctgcagcaggtgttttctgagtggaacaagggtgagctcctcagtttcctgattgagatcacagccgacatatttagcatcaaggatgaccagggttcaggccacctggtcgacaaggtcctggacaagactgggatgaagggaactgggaagtggactgtgcagcaggccgcagagctttctgtggctgctcctacaattgaggcatccttggattccaggttcctcagtgggttgaaggatgagcgtgttgaggctgccaaggtcttccaaggtgacttctccagcaacttgccagtggacaaggcacagctgattgaagacgtgaggcaggctctttacgcctcgaagatctgcagctacgctcagggcatgaacatcatcaaggccaagagcatggagaaagggtggagcctcaacctcggtgagctagcgaggatctggaagggagggtgcatcatccgtgccatcttcctggaccgcatcaagaaggcctacgacaggaactccgacctcgccaacctgctcgtggaccctgagttcgctcaggagatcatggacaggcaagcggcatggcgcagggtggtctgccttgccatcaacaatggcgtcagcaccccaggcatgtcggcgagtctcgcgtacttcgactcctaccggagggacaggctgcctgccaacctggtgcaggcacagagggactatttcggggctcacacctacgagagggtcgacatgcccggctccttccacaccgagtggttcaagatcgcgcgtgctgctaagatgtgaaatgcttcaaattttcggtaatatttggttgctgcttgctgctgagtcgcttgtagggtgggaggaactgttgttaaattttatggtcaatgtgctacgcttaatttggataaggaggtccatagctatctccattcttttaatgtaaggagcagcccagggtggagagaacatggatatttatcattggaacctttgttgtgatctttgtaagtctatatatgaataaaagcattttggcaatgcttgcttttttaaaaaaaaaaaaaaaaaaaa

SEQ ID NO: 11917 - protein, 480 aa, Oryza sativa
MAVTRIGLAGLAVMGQNLALNIAEKGFPISVYNRTTSKVDETVQRAKVEGNLPVYGFHDPASFVNSIQKPRVVIMLVKAGAPVDQTIATLAAHLEQGDCIIDGGNEWYENTERREKAMEERGLLYLGMGVSGGEEGARNGPSLMPGGSFEAYKYIEDILLKVAAQVPDSGPCVTYIGKGGSGNFVKMVHNGIEYGDMQLISEAYDVLKSVGKLTNSELQQVFSEWNKGELLSFLIEITADIFSIKDDQGSGHLVDKVLDKTGMKGTGKWTVQQAAELSVAAPTIEASLDSRFLSGLKDERVEAAKVFQGDFSSNLPVDKAQLIEDVRQALYASKICSYAQGMNIIKAKSMEKGWSLNLGELARIWKGGCIIRAIFLDRIKKAYDRNSDLANLLVDPEFAQEIMDRQAAWRRVVCLAINNGVSTPGMSASLAYFDSYRRDRLPANLVQAQRDYFGAHTYERVDMPGSFHTEWFKIARAAKM

SEQ ID NO: 11918 - DNA, 1449 bp, Vibrio vulnificus
  CDS (1)..(1449)
atgaaaggtgatatcggtgtaattggcctagcagtaatgggtcaaaaccttatcctgaacatgaacgaccacggctttaaagtggtggctcacaaccgtactgcggcgaaagtagatgagtttctagaaggcccagcgaaaggcactaacatcattggcgcatactcacttgaggaactggttgagaaactggaaacaccacgcaaagtgatgttgatggttcgtgctggcgcggtagtggaccagtttattgatgcacttgtaccgcttcttgataaaggcgacatcatcattgacggtggtaacacgaactacccagacaccaaccgtcgtgtagcggcgctgcgtgaaaaaggcatccacttcatcggtactggtgtctctggtggtgaagaaggcgcacgtttcggcccttctattatgcctggcggtgctcctgaagcatgggaagcggttaagcctatcttccaaggtatctctgcaaaaactgacgctggcgagccttgctgtgactgggttggtaacgatggtgcaggtcacttcgttaaaatggtacacaacggcatcgaatacggcgacatgcagctgatcaccgaagcgtaccagttcatgaaagatggccttggtatgtctgcagacgagatgcaagccgttttcgctgattggaacaagactgagctagacagctacctagtcgaaatcaccgctgacatccttggctacaaagacgaagatggcgagccactagtagaaaagatcctcgatacggctggccaaaaaggcacaggtaaatggacaggtatcaacgcactagacctaggcattccactaacgcttatctctgagtctgtcttctctcgttgcctatcggcactaaaagatcaacgtgttgaagctgagaaattgtttggtaagaccatcacgccagtagaaggtgacaagcaagagtgggttgacgcacttcgccaagcgcttctagcatctaagattatctcttacgctcaaggctttatgctgatgcgtgaagcgtctaatgaaaatggttgggatctcaactacggcaacgtggcactgatgtggcgcggtggttgtatcattcgttctgcattcctaggtaacatccgtgatgcctacgaagcgaacccagatcttgcgttcctaggctctgatgactacttcaaaggcatcctacaaaacagcctagtggcatggcgtaaagtggcggcgaagtcgctagaagcgggcattccaatgccatgtacaacgtctgcactgacgttcctagacggttacacaaccgcgcgtctacctgcaaacctactgcaagcacaacgtgactacttcggtgctcacacttatgagcgtatcgaccgtgagcgtggtgagttcttccacaccaactggacaggtaccggcggcaacacagcgtcgacgacttacgacgtttaa

SEQ ID NO: 11919 - protein, 482 aa, Vibrio vulnificus
MKGDIGVIGLAVMGQNLILNMNDHGFKVVAHNRTAAKVDEFLEGPAKGTNIIGAYSLEELVEKLETPRKVMLMVRAGAVVDQFIDALVPLLDKGDIIIDGGNTNYPDTNRRVAALREKGIHFIGTGVSGGEEGARFGPSIMPGGAPEAWEAVKPIFQGISAKTDAGEPCCDWVGNDGAGHFVKMVHNGIEYGDMQLITEAYQFMKDGLGMSADEMQAVFADWNKTELDSYLVEITADILGYKDEDGEPLVEKILDTAGQKGTGKWTGINALDLGIPLTLISESVFSRCLSALKDQRVEAEKLFGKTITPVEGDKQEWVDALRQALLASKIISYAQGFMLMREASNENGWDLNYGNVALMWRGGCIIRSAFLGNIRDAYEANPDLAFLGSDDYFKGILQNSLVAWRKVAAKSLEAGIPMPCTTSALTFLDGYTTARLPANLLQAQRDYFGAHTYERIDRERGEFFHTNWTGTGGNTASTTYDV

SEQ ID NO: 11920 - DNA, 1407 bp, Photorhabdus luminescens
  CDS (1)..(1407)
atgtccaagcagcagattggtgttgtcggtatggcggtgatggggcgtaacctggcattaaatattgagagccgtggttattccgtatctatatttaaccgttcaagtgataaaactgacgaagtgatcgccgaaaatccggggaagaaattagttccaagttacactgtcgaagaatttgtcgattcactggaaaaaccgcgccgtattctgctcatggttaaggctggcgaagcaaccgataaaactattgcttcactgactccacatctggataaaggtgatattttgattgatgggggtaatacctattttcaggatactatccgtcgtaatcgcgagctttctgctcagggttttaattttatcggtactggggtttccggtggtgaagagggggcattgaaaggtccatctattatgcctggcggccagaaagaggcgtataaattggtggcaccaattctgcaagagattgcggctaaagctgaaggtgaaccttgtgtggcctatattggcccggatggtgccggtcattatgtgaaaatggttcacaatggtattgaatacggtgatatgcagctcattgctgaagcttattctttactgaaaaatgccctaaatctgagcaatgaagaactatctgagattttcactgactggaataacggcgaattgagcagttatttgattgaaatcacggctgatattttccataagaaagatgaagcaggccaatatttggttgatgtgattttggatgaagcagcaaataaaggtacgggtaagtggaccagccagagctctctggatttagggattccagtgacgttgatcacagaatcggtatttgcacgttatatctcttctctgaaagatcagcgagttgctgcggctcaagttttgagcgggccggatgtacaaccatttaaaggtgataaggccgaatttattgagaaagtccgccgtgcgctttatttgggtaaaatcgtctcttatgcccaaggttttcagcaattgaaagcggcatctgatgagtaccagtgggatctcaattacggtgagattgctggaattttccgggcgggttgtattattcgtgctcaattcctgcaaaaaattactgacgcgtataacgaaaatgtggatattgctaacctgttgttggcaccttactttaagaaaattgctgatgaatatcagcaggcgttgcgtgatgtcgtctcgtatggggtgcagaatggtatcccaaccccgactttctctgctgctatttcttactacgatagttatcgttcagcggtactgcctgctaatttaattcaggctcagcgtgattattttggtgctcatacctataagcgtactgataaagaaggtgttttccatactgaatggatggagtaa

SEQ ID NO: 11921 - protein, 468 aa, Photorhabdus luminescens
MSKQQIGVVGMAVMGRNLALNIESRGYSVSIFNRSSDKTDEVIAENPGKKLVPSYTVEEFVDSLEKPRRILLMVKAGEATDKTIASLTPHLDKGDILIDGGNTYFQDTIRRNRELSAQGFNFIGTGVSGGEEGALKGPSIMPGGQKEAYKLVAPILQEIAAKAEGEPCVAYIGPDGAGHYVKMVHNGIEYGDMQLIAEAYSLLKNALNLSNEELSEIFTDWNNGELSSYLIEITADIFHKKDEAGQYLVDVILDEAANKGTGKWTSQSSLDLGIPVTLITESVFARYISSLKDQRVAAAQVLSGPDVQPFKGDKAEFIEKVRRALYLGKIVSYAQGFQQLKAASDEYQWDLNYGEIAGIFRAGCIIRAQFLQKITDAYNENVDIANLLLAPYFKKIADEYQQALRDVVSYGVQNGIPTPTFSAAISYYDSYRSAVLPANLIQAQRDYFGAHTYKRTDKEGVFHTEWME

SEQ ID NO: 11922 - DNA, 1452 bp, Gloeobacter violaceus
  CDS (1)..(1452)
atggaaacatcggctctgcaatccggcgcgcaggcgacccacgaaaaacccagcattgggctgatcgggcttgcggtgatgggcgagaatctggcgctcaacattgccaaccacggttttccaatctcggtctacaaccgcaccgccgctaaaacccaagaactggccgaaggccgcgcccggggcaaggcgctctacccgactttcaccatggaagaattcgtcgcctccatggagcgcccccgcaaaatcatcatcctggtcaaggccggcgctccggtcgatgcggtgatcgaccagctcaagccgctgctcgaaaaagacgacgtgatcatcgacggcggcaactcgctgtttaccgataccgagaagcgctccggcgagatcgaagcgctcggattgcgcttcgtgggcatgggggtctcgggcggcgaagagggtgccctcaagggtcccagcctgatgcccggcggaccgaagaccgcctacgacgatctggccccgattctcacccagattgccgcccaggtcgacgacggcccctgcgtcacctatatcggcccgcgcggcgccggccactacgtgaagatggtccacaacggcatcgagtacggcgacatgcaactcatcgccgaagcctacgacctgctgcgccagaccctgggtctgggggccgccgaactgcacgacatctttgccgagtggaacgcaggggaactcaagtcgtttttgatcgagatcaccgccgacatttttaccaagatcgaccccgagaccggcaagccgctggtggacttgatcctcgacaaagcgggccaaaaaggcaccggcaagtggaccagccagaacgcctacgatctgggtattccgattccgaccatcaacgccgcagtcgaatcgcgcatcctctcggcctacaaaagcgaacgggtggccgcttccaaaatcctgagcggtccggagcggcctccgtttacgggcgagaagaaacaatttatcgatgcggtgcgcgacgcgctctactgcgccaagatctgctcctacgcccaggggatggccctgctcaaagccgcttcccacgagtacgactaccacctcaacctttctgaactggcgcgcatctggaagggcggctgcatcatccgggccatcttcctggataagatcaaaaacgctttcctgcgcgacccggccctcaccaacttgctcatcgacagcgaattcagcggcgatattcaggcgcgccaggccaactggcgctacgcggtacagacggccgcccaactgggcatcccagcctacgccacgggtgcgtcccttgcctactacgacgcctaccgcacagcccaactgcccctcaacctcacccaggcccagcgcgactacttcggcgcccacacctacgagcgcatcgacaaagaaggagtcttccacaccgagtggttcagctga

SEQ ID NO: 11923 - protein, 483 aa, Gloeobacter violaceus
METSALQSGAQATHEKPSIGLIGLAVMGENLALNIANHGFPISVYNRTAAKTQELAEGRARGKALYPTFTMEEFVASMERPRKIIILVKAGAPVDAVIDQLKPLLEKDDVIIDGGNSLFTDTEKRSGEIEALGLRFVGMGVSGGEEGALKGPSLMPGGPKTAYDDLAPILTQIAAQVDDGPCVTYIGPRGAGHYVKMVHNGIEYGDMQLIAEAYDLLRQTLGLGAAELHDIFAEWNAGELKSFLIEITADIFTKIDPETGKPLVDLILDKAGQKGTGKWTSQNAYDLGIPIPTINAAVESRILSAYKSERVAASKILSGPERPPFTGEKKQFIDAVRDALYCAKICSYAQGMALLKAASHEYDYHLNLSELARIWKGGCIIRAIFLDKIKNAFLRDPALTNLLIDSEFSGDIQARQANWRYAVQTAAQLGIPAYATGASLAYYDAYRTAQLPLNLTQAQRDYFGAHTYERIDKEGVFHTEWFS

SEQ ID NO: 11924 - DNA, 1416 bp, Giardia lamblia ATCC 50803
  CDS (1)..(1416)
atggacattggcatcgtggggctgggtgcaatgggcaaaaaccttgcgctcaatttccaccgcaataagttcaaggttgctatctacaacagaacgcactcgaaggcgaaagctgttgccgatgagctcaagtcagagagcttaaaagcgtacgagtccgtcagtgactttgtagcctctttggtaaagcctcgtgttatcgtcctcctcgttcaggcagatgctgtcgattctgttggggagatgatggctaaatgcatgcaggaggatgatatcattatagattcaggtaactcttactacaagctcacagaggagcgtaaggttcgctttcacaagaacttcaaagtgcatttttacgggataggcatttcgggcggtgaagaaggcgccctctgggggcctgcgataatggttggcggggacgaagagagcgcaagaaagcgcctccttccacttcttgagaaggtctgtgcagacccccaggtcgaggggactgatggaaagaaatgcatatcttattgtgggcccggaggtgctggccacatggtgaagatggtgcacaatggctgcgaatacggcatcatgcaacttatttccgaggcaatcgccatctttcgctcggtcctcaagttttccgtggaacaggtggccgatgtctttgcgttgtatgcaaggaccgaaggctgctatctgttcgaaaatgtcgcccagatactatacaagaaggaggatgacaagcctcttattgactttgtcaaagacgtggccatgcagaaagggactggccgttggacgtctatcgaggcgctgaatctaggggtatgcgcgacgatcattgatgcaggcgtggctgcacgcacgttctcgagctcaaaggaccgctttctgatgcatgtcgaggactccaccgcgttgctgaagtctgtcttcacacagggtctttgtaaggacgctatcatgcgttctctgctggccgctatgctccttgcattccaacagtctatctgcgttattcacgccctctccgaatctatgcaatacaacacaagcatctttgaggctctttgctcctggcgcggaggctgcataattcgcatgaatcttcttacaccgctggcggacttctacaagcagaacgccaacaagcgtgtaccgctgatgcatgcaagctttgtgaaggaaaagtacatcaatcgtgacgttgtctcccagctcaggttgctggtctcctctgccgtgaaggctgggctgcctataccggctttttcgtctgctatgacatatctcgacatgatccagactgaggttctgccgaccaagtatattcagggcatgagggataactttggagctcacacctatgaaaggattgacaaggaaggtgtattccactctgtctggactgagaaataa

SEQ ID NO: 11925 - protein, 471 aa, Giardia lamblia ATCC 50803
MDIGIVGLGAMGKNLALNFHRNKFKVAIYNRTHSKAKAVADELKSESLKAYESVSDFVASLVKPRVIVLLVQADAVDSVGEMMAKCMQEDDIIIDSGNSYYKLTEERKVRFHKNFKVHFYGIGISGGEEGALWGPAIMVGGDEESARKRLLPLLEKVCADPQVEGTDGKKCISYCGPGGAGHMVKMVHNGCEYGIMQLISEAIAIFRSVLKFSVEQVADVFALYARTEGCYLFENVAQILYKKEDDKPLIDFVKDVAMQKGTGRWTSIEALNLGVCATIIDAGVAARTFSSSKDRFLMHVEDSTALLKSVFTQGLCKDAIMRSLLAAMLLAFQQSICVIHALSESMQYNTSIFEALCSWRGGCIIRMNLLTPLADFYKQNANKRVPLMHASFVKEKYINRDVVSQLRLLVSSAVKAGLPIPAFSSAMTYLDMIQTEVLPTKYIQGMRDNFGAHTYERIDKEGVFHSVWTEK

SEQ ID NO: 11926 - DNA, 1419 bp, Plasmodium yoelii yoelii
  CDS (1)..(1419)
atgacagatggttgcgacattggtctcattggacttgctgttatgggtcaaaacctcagcatgaacatcgctagtaacggatttaaaataggagtatacaatagaacttatgaaagaacaactgaaaccttaaagagagccaaggaagaaaatttagtgatttatggatataaaacattagaagagttaataaataatttaaaaaaacctcgaaaaattatattattaataaaagcgggtcccgcagttgatgaaaatataaataatatattaaaatattatgaaaaaggtgatataataatagatggaggtaatgaatggtatttaaattcagaaaaaagaataaaaatatgtgctgaaaaaaatgtagaatatttagctatgggagttagtggtggtgaagcaggggcacgatatggttgctcttttatgcctggaggatcaaaatatgcatatgaccaggtagaagaaatattaaaaaaatgttctgctaaagttaatacatcaccatgtgttacatatataggcccgggatcatctggaaattatgttaagatggtacacaatggtatagaatatggtgatatgcaattaatatcagaaagttattttattatgaaacatatattaaaatatgataataaaaagttagcagaagtatttaaaaaatggaatgaaggtatattaaattcttatttaattgaaataacatcaaaaatattagataaaaaagataacttaacagataattatttagtagatgttatattggatatagcgggtgctaaaggaacaggaaaatggactatgctcgaatctattgaaagaggcatcccttgcccaactatttgtgctgccttagatgcccgtaatttaagtgcttacaaagaattaagaataaacgcaaataataatttttctaatgaaataaaaattaataatactaatgaagatctaacaaattttgaaaatgatctattaaatgctttgtattgttgtaaaattatttcatatacacaaggattatttttattaaaacaagtctcaaaagaaatgaattggaatttaaatttaggagaaatatcaagaatatggagaggtggatgtattataagagctatttttctagatcgtataactaatgcatataaaaataataatgctttagaattattgtttatggacaaagaattttccgaagaaatgaaaaacaaattaccatccttaagaagagttgtagacatatctgtacaatgttctattcctattcctgcattttcagcaagtttagcctattttcaaatgatatcatcacaaaatttaccccttaatttggtccaagcacaaagagatttttttggatcacacacatataagagaactgacagagatggtgattatcatactcaatgggaataa

SEQ ID NO: 11927 - protein, 472 aa, Plasmodium yoelii yoelii
MTDGCDIGLIGLAVMGQNLSMNIASNGFKIGVYNRTYERTTETLKRAKEENLVIYGYKTLEELINNLKKPRKIILLIKAGPAVDENINNILKYYEKGDIIIDGGNEWYLNSEKRIKICAEKNVEYLAMGVSGGEAGARYGCSFMPGGSKYAYDQVEEILKKCSAKVNTSPCVTYIGPGSSGNYVKMVHNGIEYGDMQLISESYFIMKHILKYDNKKLAEVFKKWNEGILNSYLIEITSKILDKKDNLTDNYLVDVILDIAGAKGTGKWTMLESIERGIPCPTICAALDARNLSAYKELRINANNNFSNEIKINNTNEDLTNFENDLLNALYCCKIISYTQGLFLLKQVSKEMNWNLNLGEISRIWRGGCIIRAIFLDRITNAYKNNNALELLFMDKEFSEEMKNKLPSLRRVVDISVQCSIPIPAFSASLAYFQMISSQNLPLNLVQAQRDFFGSHTYKRTDRDGDYHTQWE

SEQ ID NO: 11928 - DNA, 1467 bp, Neurospora crassa
  CDS (1)..(1467)
atgtctcttctgttcgccgagtacggcatccacacgcactactacgacccttccaaaaagaacatcgaagccctccaatcgcacgccaaagaaagcaagcacgaagacaagatcacctaccacgacgatcacaagtctttgtgcgaggctctagaggacggtgataaacccaaggttttcatgttcagcatcccccatggcggccccgccgacgacagcatcgatgccctcgaaccctacctcaagccaggcgacatcatcatggacgcctccaacgagcactggaaggcgaccgagagacgacaggcccgccttgagccaaagggaatccattacattggaatgggcgtctctgggggctaccagtctgctcgccatggtccttccatctccccgggtggcagcaaggaggccctcgacaaagttttccccttcctccagaaaatcgcggccaaagacaacaggggacggccatgcgtggccaagcttggaccgggcggatgcgggcactacgtcaagatgatccacaacggcattgagcacggaatgatgactgccctctgtgaagcctgggccatcatgaacatcggcttgggcatggactacgaagagatcggcaccatctttgagaagtggaacggtgacaagcaaaggccattgagggacaacttcttgattgacattggtgccgatatctgtcggaccaaggatgagaagggcaactatgtgctggccaacgtgcgtgacaaggtcgttcaggatgtagacaactccgagggtacgggaacgtggtcggtccaggagggtaccagactccatgtgccagatcctaccattgccgtctcgcatcttttcagggtagcttcggcagatgcagcgaggagagagacagtcaacaaggcgctggacggaaagggggtgaagcccgctcaaatcgagggtgtcgataaggccaagttcctggaagacttgtacaacgctgtctacgcctccttcctcatgtgcttcatccagggcctgcacgtcctatccaaggcaaacgaggaaaacgactggaagctcgactttgctgatgtactgcagctctggcgcaatggatgcatcattcaaagcgacggagttgccgatttgctcgagactgtgtatcgctcgagggagcatgacaacgatgatctcctaggacaccaaacgattgctggcgagctggcaaagacgtacccgtcgctcaagagggttgtactgaaggctatcgagtttgatctacatgctggagcgctgggtaccagtctcgaatactacaagtactcaggttcgactgagctacccacccaattccaagaggccgagttggactacttcggggctcacatgtttgacctaaaaactgctgagccgggtaagccggtgacgggtaaacaccactttgagtggaagcccgcgagaggtattctggagacgaacgactag

SEQ ID NO: 11929 - protein, 488 aa, Neurospora crassa
MSLLFAEYGIHTHYYDPSKKNIEALQSHAKESKHEDKITYHDDHKSLCEALEDGDKPKVFMFSIPHGGPADDSIDALEPYLKPGDIIMDASNEHWKATERRQARLEPKGIHYIGMGVSGGYQSARHGPSISPGGSKEALDKVFPFLQKIAAKDNRGRPCVAKLGPGGCGHYVKMIHNGIEHGMMTALCEAWAIMNIGLGMDYEEIGTIFEKWNGDKQRPLRDNFLIDIGADICRTKDEKGNYVLANVRDKVVQDVDNSEGTGTWSVQEGTRLHVPDPTIAVSHLFRVASADAARRETVNKALDGKGVKPAQIEGVDKAKFLEDLYNAVYASFLMCFIQGLHVLSKANEENDWKLDFADVLQLWRNGCIIQSDGVADLLETVYRSREHDNDDLLGHQTIAGELAKTYPSLKRVVLKAIEFDLHAGALGTSLEYYKYSGSTELPTQFQEAELDYFGAHMFDLKTAEPGKPVTGKHHFEWKPARGILETND

SEQ ID NO: 11930 - DNA, 1572 bp, Neurospora crassa
  CDS (1)..(1572)
atgtctggacctgtcgctcgcctagcgaacatcattgttggcggagctgtgaaaccgggctcccagtcccaatctcaaagtcagacaagtgctaacgatgccccaagcgctgatatcggcctcatcggcctggccgtcatgggtcagaatttgatcctcaacatggccgaccatggcttcaccgtctgcgccttcaaccgtaccgtttccaaggtcgaccacttccttgccaacgaggccaagggcaagtcgatcgttggtgccaagtccaccgaggagttcgtctccaagctcaagtccccccgccgcatcatgctcctcgtccaggccggcaagcccgtcgatgactggatcgagactcttctccccctcctcgagaagggcgacatcatcattgatggcggtaactctcacttccccgacagcaaccgcaggacaaagtaccttgcctccaagggcctccacttcgttggttccggtgtctctggtggtgaggagggtgcccgctacggcccttcgctgatgcccggtggtgacgaggctgcctggccccacatcaaggacatcttccagtccattgctgccaagagcgatggcgaggcctgctgcgagtgggtcggtgacgagggcgctggccactacgtcaagatggtccacaacggcattgagtacggtgacatgcagctcatctgcgaggcctacgacattatgaagcgcggtctcggcctctcccacaaggagatgggcgatgtgtttgccaagtggaacaagggcgttctcgactcgttcctgattgagatcaccagggatatcatgtacttcaccgacgatgatggcactcctctcgtcgagaagattctcgacaaggctggccagaagggtaccggcaagtggactgctgtcaacgcccttgacctgggcatgcctgtcaccctcatcgccgaggctgtccttgctcgttgcctgtctggcatcaaggaggagcgtgtcaaggcctccaccaagctcgagtttgttggccgtgccaacaagttcgagggtgataaggagcagttcttggaggacctcgagcaggctctctatgcttccaagatcatctcttatgcccagggcttcatgctcatgcaggaggctgctaaggagtacaactggaagctcaacaagccttccattgccctcatgtggcgcggtggttgcattatccgctccgtcttcctgaaggacatcaccgctgcttaccgcaagaaccccgacctcgagaaccttttgttcgacgacttcttcaacaaggccatccacaaggcccagcccggctggcgtgacgtcgttgccaaggctgctctccttggtcttcccactcccgctttctccactgctctgtcgtggttcgatggctatcgcaccaaggacctccccgcgaacctgctccaggctcagcgcgactacttcggcgcccacaccttcttggtcaagcccgagtacgccaacgagaagtaccccgagggcaagtacatccacgtcaactggactggccgcggcggcaacgtttccgcttccacctaccaggcgtaa

SEQ ID NO: 11931 - protein, 523 aa, Neurospora crassa
MSGPVARLANIIVGGAVKPGSQSQSQSQTSANDAPSADIGLIGLAVMGQNLILNMADHGFTVCAFNRTVSKVDHFLANEAKGKSIVGAKSTEEFVSKLKSPRRIMLLVQAGKPVDDWIETLLPLLEKGDIIIDGGNSHFPDSNRRTKYLASKGLHFVGSGVSGGEEGARYGPSLMPGGDEAAWPHIKDIFQSIAAKSDGEACCEWVGDEGAGHYVKMVHNGIEYGDMQLICEAYDIMKRGLGLSHKEMGDVFAKWNKGVLDSFLIEITRDIMYFTDDDGTPLVEKILDKAGQKGTGKWTAVNALDLGMPVTLIAEAVLARCLSGIKEERVKASTKLEFVGRANKFEGDKEQFLEDLEQALYASKIISYAQGFMLMQEAAKEYNWKLNKPSIALMWRGGCIIRSVFLKDITAAYRKNPDLENLLFDDFFNKAIHKAQPGWRDVVAKAALLGLPTPAFSTALSWFDGYRTKDLPANLLQAQRDYFGAHTFLVKPEYANEKYPEGKYIHVNWTGRGGNVSASTYQA

SEQ ID NO: 11932 - DNA, 2058 bp, Mycobacterium bovis
  CDS (1)..(2058)
atgggttccaacatcgcccgaaacttcgcccggcacggctacaccgtggcagtgcacaatcggtcggtcgccaagaccgacgcgctgcttaaggagcacagctcagacggcaagttcgtgcgcagtgaaacgatccccgaatttcttgccgcactggaaaaaccgcgtcgggtgctgatcatggtcaaggccggagaggccactgacgctgtcatcaacgaacttgctgacgccatggaacccggcgacatcatcatcgacggcggcaatgcgttgtacaccgacaccatgcgccgcgagaaagcgatgcgtgagcggggcttgcacttcgtcggggccgggatctccggcggcgaagagggcgcgttgaacgggccgtcgatcatgcccggcggacccgccgagtcataccaatcgctgggtccgctgctcgaggagatctccgcgcatgtcgacggcgtgccgtgctgcacccacattggcccggacggctccgggcacttcgtcaagatggtccacaacggcatcgagtactccgacatgcagctcatcggtgaggcctaccagctgatgcgcgacgggctaggtctgaccgcgccggcgatcgccgatgtgttcaccgagtggaacaatggcgatctggacagctacctggtcgagatcaccgccgaggtgctgcggcagaccgatgccaagaccggcaaaccgctcgtcgacgtcatcgtggaccgggccgagcagaaaggcaccggccgttggaccgtcaagtccgcgctggacctgggtgtgccggtgaccggcatcgccgaagcggtgtttgcccgcgctctctcgggatccgtggggcaacgctcggccgccagcggtctggcttcgggcaagctcggcgagcagcccgccgaccccgccacgttcaccgaagacgtccgccaggcgttgtacgcctccaagatcgtggcctacgctcagggcttcaaccagatccaggccggcagcgccgaattcggctgggacatcacgccgggcgacctggccaccatctggcgtggcggctgcatcatccgggcgaagttcctcaaccacatcaaggaagcctttgacgccagcccgaacctggccagtctgattgtggccccgtatttccgcgcgccgtcgaatcggcgatcgacagttggcggcgtgtggtgtcgacggcggcccaactgggtatcccgaccccgggattctcgtcggccctgtcgtattacgacgcgctgcgcaccgcgcggctgcccgctgcactcacccaggcccagcgcgacttcttcggcgcacacacctacggccggatcgacgaaccaggcaagttccacacactatggagttcagaccgcaccgaagtaccggtgtagcgggctagaactaaaggggggtaaaggggtaagtgatgagatttctagacgggcacccacccgggtacgacctgacatacaacgacgtgttcatcgttccgaaccgatccgaggtcgcgtcgcgcttcgacgtcgatttgtccaccgccgacggctcgggcaccaccattccggtagtggtcgccaatatgaccgcggtagccgggcggcggatggccgagacggtcgcccgccgcggtggcatcgtaatcctgccgcaggatctgccgatcccggcggtaaagcagacggtggcgttcgtcaaaagccgggacctggtgctcgacaccccagtgacgctggcacccgacgattcggtgtccgacgccatggcgctcatccacaagcgcgcacatggcgtcgcggtggtcatcctcgagggtcgcccgatcggattggtgcgcgaatcgtcctgcctgggcgtggatcgcttcacccgggtgcgcgatatcgccgtgacggactatgtgaccgctccagcgggaaccgagccacgcaagatcttcgacctgctggagcacgccccggtcgacgttgcggtgctgaccgacgccgacggcacgttggcgggagtgctaagccgcaccggggctatccgcgccggtatctacaccccggccaccgatag

SEQ ID NO: 11933 - protein, 685 aa, Mycobacterium bovis
MGSNIARNFARHGYTVAVHNRSVAKTDALLKEHSSDGKFVRSETIPEFLAALEKPRRVLIMVKAGEATDAVINELADAMEPGDIIIDGGNALYTDTMRREKAMRERGLHFVGAGISGGEEGALNGPSIMPGGPAESYQSLGPLLEEISAHVDGVPCCTHIGPDGSGHFVKMVHNGIEYSDMQLIGEAYQLMRDGLGLTAPAIADVFTEWNNGDLDSYLVEITAEVLRQTDAKTGKPLVDVIVDRAEQKGTGRWTVKSALDLGVPVTGIAEAVFARALSGSVGQRSAASGLASGKLGEQPADPATFTEDVRQALYASKIVAYAQGFNQIQAGSAEFGWDITPGDLATIWRGGCIIRAKFLNHIKEAFDASPNLASLIVAPYFRAPSNRRSTVGGVWCRRRPNWVSRPRDSRRPCRITTRCAPRGCPLHSPRPSATSSAHTPTAGSTNQASSTHYGVQTAPKYRCSGLELKGGKGVSDEISRRAPTRVRPDIQRRVHRSEPIRGRVALRRRFVHRRRLGHHHSGSGRQYDRGSRAADGRDGRPPRWHRNPAAGSADPGGKADGGVRQKPGPGARHPSDAGTRRFGVRRHGAHPQARTWRRGGHPRGSPDRIGARIVLPGRGSLHPGARYRRDGLCDRSSGNRATQDLRPAGARPGRRCGADRRRRHVGGSAKPHRGYPRRYLHPGHR

SEQ ID NO: 11934 - DNA, 1419 bp, Synechococcus sp
  CDS (1)..(1419)
atgtcccagtcgcacttcggtttaatcggtctcggcgtgatgggggagaacctcgtcctcaatgccgagcgcaatgggttctcgagcgttgtctacaaccgcacctacgccaagactgaggagttcctcaacggtcgcggtcaagggcggaacattcagggggcgacggatctgcaggatttcgttggcaagctggaacgtcctcgccggatcctgatgatggtcaaggcaggtccagctgtggatgctgtcgttgaccagatctccccatatctcgaggaaggcgatctgctaatcgatggtggcaactcggattatcacgacaccgagcgccgggtgaaggagctcgagagcaagagcttcggcttcatcggcatgggtgtgtccggtggtgctaagggggctctggagggccccagcatgatgcccggcggcaccaaagcctcctacgacgccattgagagcctggtgaacaagatggcggctcaggtggatgacggcccctgcgtcacttacatcggtcccggtggatctggccaccttgtgaagaccgtccacaacggcattgagtacggcatcgagcagatcctggcggagggctatgacctgatgaagcgggtcaagggcatgaacggggagcagatggccgatgtgcttgcccagtggaatgccactgaggagctctcctcctatctggtggagattacagaggtttgcctgcgcacgaaggatcctgaagacggcgcagatctcgtcgagaaaatcatggatcaggctggccagaagggcaccggtctgtggaccgtggtcaccgccctgcagatgggtgcatccgttcccaccatctacgcatcactcaatggtcgggtgatgagttccctcaagcctgagcgggtggcagccgaatccatcctcaaaggaccagtcatcaaggatttcgacctcggcacccccgacgacgccatggctcccctgatggatgccacggtgctcagctgcatcgccagctatgcccagggcatggaactgctgcgcatcgcctcccgggatctggactacagcttgcagatgccctccatcgcccagatctggaaaggcggctgcatcatccgtgcccgcctgctccagcggattcaggatgccttcgctgccaatcctgatctgaccaacctgatgttggatccctggtttgccgatcagatcaaccggcgtctgcccggtttggccaaggtggtggccggcgccgctgaatccggcattcccgtgccctgcttcagcagcaccctggactacatcaacagctaccgcaccggtcgccttcctcagaacctggtgcaggccatgcgcgactgcttcgggtcccacacgtaccagagggtggacaaagagggcgccttccacaccgagtggctcggctga

SEQ ID NO: 11935 - protein, 472 aa, Synechococcus sp
MSQSHFGLIGLGVMGENLVLNAERNGFSSVVYNRTYAKTEEFLNGRGQGRNIQGATDLQDFVGKLERPRRILMMVKAGPAVDAVVDQISPYLEEGDLLIDGGNSDYHDTERRVKELESKSFGFIGMGVSGGAKGALEGPSMMPGGTKASYDAIESLVNKMAAQVDDGPCVTYIGPGGSGHLVKTVHNGIEYGIEQILAEGYDLMKRVKGMNGEQMADVLAQWNATEELSSYLVEITEVCLRTKDPEDGADLVEKIMDQAGQKGTGLWTVVTALQMGASVPTIYASLNGRVMSSLKPERVAAESILKGPVIKDFDLGTPDDAMAPLMDATVLSCIASYAQGMELLRIASRDLDYSLQMPSIAQIWKGGCIIRARLLQRIQDAFAANPDLTNLMLDPWFADQINRRLPGLAKVVAGAAESGIPVPCFSSTLDYINSYRTGRLPQNLVQAMRDCFGSHTYQRVDKEGAFHTEWLG

SEQ ID NO: 11936 - DNA, 1479 bp, Rhodopirellula baltica
  CDS (1)..(1479)
atgagtggtgattgtgatttcggcctgattggtttggccgtcatgggcgaaaatctggccttgaacgtcgaaagccgcggctacaaagtcgccgtctacaaccgcaccacgtccaaagtcgacgctttgatggaaggccgtgcgaagggcaaaaacttcgtcggctgccactcgatcgaagaattcgtcaaatcagtcaaacgacctcgcagactgatgatgctggtcaaagccggccccgccgtcgacgcattgatcgagcaattgctgccacactgcgaacccggcgacatcatcattgacggtggtaacgagtactacgttcacactgaacgccgcaccaagcaagtcgaagaagccggaatgctgtacgtcggttgcggcgtcagcggtggcgaagaaggtgccctcaaaggcccatcattgatgcccggcggaagtgccgaagcatggcctcacatcaaagaaatgttccagtcgatcgcagccaaggtcggacccaacaacgacatcccttgctgcgaatggctcggtgccggtggcgcgggcaactacgtcaagatggttcacaacggcatcgaatacggcgacatgcagttgatctgcgaagcctatcaattgctgaaagaactcggcggtttgtccaatgacgaactgtatgacgtcttcgacgaatggaaccgtggtgatctgcaaagctatctgatcgaaatctctcgcgacatcttcagcgtcaaagacgaccaaggcggcgacggatacctcgtcgacaagatcatggacgttgccggtgcaaagggcacaggtaaatggatgagccaactggctctcgaccttggcgtccccagcaccctggtcacgaccgccgtgttcgctcgcggtttgtcggcacaaaaggaagcacggactcgtgccagcaagacgctcaacggtcccgctgaatcgtccaaccctgaaatgcgtgcgatcgctcaatcgttggttggtgatcgtgctgagtttgtcgaagcggttcgccaagcactgtacgcttcgaaaattgtttcttacgcgcaaggctttgttcaactgcaagccgcatcggccgagcacaattggggcttggactacggtgccgccgcattgctatggcgaggtggttgcatcatccgtgctcagttcctggatcgcatcaaagaagccttcgacgccgatccaaacctggaaaacttgctgctggccaagtacttcgaagacgcagtcgaaaacgcacaagaaaaatggcgaaaggtcgtcgccatcgcttcgatcatgggcattccggttcccgcgttcagcaccgcattgtgctactacgacggatatcgcatggaacgcttgccagccaacatgctgcaagcccaacgcgattactttggtgctcacacctaccaacgcgtcgacaaggaaggcaccttccacagcgagtggattcaacttcgcaaagagcccaaagcttag

SEQ ID NO: 11937 - protein, 492 aa, Rhodopirellula baltica
MSGDCDFGLIGLAVMGENLALNVESRGYKVAVYNRTTSKVDALMEGRAKGKNFVGCHSIEEFVKSVKRPRRLMMLVKAGPAVDALIEQLLPHCEPGDIIIDGGNEYYVHTERRTKQVEEAGMLYVGCGVSGGEEGALKGPSLMPGGSAEAWPHIKEMFQSIAAKVGPNNDIPCCEWLGAGGAGNYVKMVHNGIEYGDMQLICEAYQLLKELGGLSNDELYDVFDEWNRGDLQSYLIEISRDIFSVKDDQGGDGYLVDKIMDVAGAKGTGKWMSQLALDLGVPSTLVTTAVFARGLSAQKEARTRASKTLNGPAESSNPEMRAIAQSLVGDRAEFVEAVRQALYASKIVSYAQGFVQLQAASAEHNWGLDYGAAALLWRGGCIIRAQFLDRIKEAFDADPNLENLLLAKYFEDAVENAQEKWRKVVAIASIMGIPVPAFSTALCYYDGYRMERLPANMLQAQRDYFGAHTYQRVDKEGTFHSEWIQLRKEPKA

SEQ ID NO: 11938 - DNA, 1419 bp, Prochlorococcus marinus subsp
  CDS (1)..(1419)
atgcccaaggcacattttggtttaatcggtcttggagttatgggggagaatttagttcttaatgcagaaaggaacggattttctagtgtagtttttaatagaacctattcaaaaactcaagaattcttagaaggtagaggtttaggaaagaatgtagaaggagctaaaacacttcaagaatttgtgaataagcttgaaagaccaagaagaattttaatgatggttaaagccggggcagctacagatgctgttattgataatatttctgaatatcttgaagaaggcgatttattaattgatggaggtaattctcagtttaaagatactgaaagacgagttgcgactcttgaaagtaaaagctttggatatataggaatgggtgtctctggaggggctaaaggagccttggaggggccaagcatgatgcctggcggaactaaagcctcttatgacgctatagaaagtttattgactaaaatggctgcgaaagtagaagacggtccttgtgtagcttatgttggacccggtggttcaggccacttcgttaaaactgttcataatggtattgaatatggcattgagcaaattcttgcagaagcttatgaccttatgaaaagagtcaaaaatatgaatggatcacaaatggctgaggtttttggtctttggaataatactgatgaattggcatcttatcttgtagaaataacgcaaatatgtttaaacaccaaagatgaactaacaggcgaagatgttgtggaaaaaatattggataaagctggccaaaaaggtactggattgtggactgttgttagtgccttagaacttggtatatcagttcccactatttatgcttcattaaatgcaagggttatgagttcccttaaggttcaacgtagtgaaatcgagaaaacaattccgatggaagctattgaagattttgatttaggagaaatttctaatggtatgaaacctttgtttgatgcagtcgttcttgctactattgctagttacgctcaagggatggatatattaagtgaagcttcatcagtttataattatgagctaaatatgccatctattgctcaaatatggaaaggtggttgcattattagatcaaaattattaaaaaagattcaagatgcatatcaaaaagatccaaatttgaagaatctaatttttgatgattggttcaacaacgaaatttctacaagaattgataatttagcaagtgtcgtttcttcttcaactaaggctggtattccagtgccttgtttatcaagtactttagattatttaaatagttacagaacaaacagacttcctcagaatttagttcaagccatgagagattgttttggttcacatacttacgaaagagttgacaaggaaggaagttttcatactgaatggatgaaatga

SEQ ID NO: 11939 - protein, 472 aa, Prochlorococcus marinus subsp
MPKAHFGLIGLGVMGENLVLNAERNGFSSVVFNRTYSKTQEFLEGRGLGKNVEGAKTLQEFVNKLERPRRILMMVKAGAATDAVIDNISEYLEEGDLLIDGGNSQFKDTERRVATLESKSFGYIGMGVSGGAKGALEGPSMMPGGTKASYDAIESLLTKMAAKVEDGPCVAYVGPGGSGHFVKTVHNGIEYGIEQILAEAYDLMKRVKNMNGSQMAEVFGLWNNTDELASYLVEITQICLNTKDELTGEDVVEKILDKAGQKGTGLWTVVSALELGISVPTIYASLNARVMSSLKVQRSEIEKTIPMEAIEDFDLGEISNGMKPLFDAVVLATIASYAQGMDILSEASSVYNYELNMPSIAQIWKGGCIIRSKLLKKIQDAYQKDPNLKNLIFDDWFNNEISTRIDNLASVVSSSTKAGIPVPCLSSTLDYLNSYRTNRLPQNLVQAMRDCFGSHTYERVDKEGSFHTEWMK

SEQ ID NO: 11940 - DNA, 1419 bp, Prochlorococcus marinus
  CDS (1)..(1419)
atgtccaaggcacatttcggtttgatcggtcttggcgtgatgggcgaaaaccttgtgctcaatgcagagcgcaatggtttttctagtgtcgtttacaaccgcacctacgccaaaacagaggagttccttaaagggcttgggtctgataaagccattcagggtgccaaggaccttcaagatttcgtcgacaagctcgaacgaccccgtcgaattctgatgatgatcaaggcaggttcggctattgatgctgttattgaacagatctccccttatctgcaggaaggtgatctactcatcgatggtggaaattccgaatttcgtgataccgagcgacgtgtcgccgagttagagagcaaaagctttggatatatcgggatgggtgtctccggtggggctaagggtgcacttgaagggccgagcatgatgccaggcggaacaaaaacctcctatgaggcgattgagagccttgtttgcaagatggctgcccaagttgaggatggtccctgtgtgacctacatcggtcctggaggttctgggcatttcgttaaaaccgtccacaacgggatcgagtacggcattgagcagattcttgctgaggcctatgacctgatgaagcgtgttggtggcatgaccggtacccagatggctgatgtcttggcgcaatggaatgccacagaagagctctcttcttatctggttgagatcaccgaagtatgtttgcgcaccaaggatcctgacgatggaagtgaccttgttgagaaaattatggatcaggcaggccagaagggaactggtctatggaccgttgtcagtgccttggagttaggagcttcagtgccaaccatttacgcctctctaaatggccgtgtgatgagctcaatgaagcctcaaagaattaccgctgagcagattttgcatgggtcagcgatcaaaccatttgatcttggtagttccgcagatggcatggcaccgctcatggacgccgtcgtgttgtcttgcatggctagttacgcgcagggcatggagctactgcgtatagcttctgctgaatacaactacaacttgcatttgccctccatcgcgcagatttggaagggtggctgcatcatcaggtcccgtctgctgaagcgcatccaggatgcctttaatgctgaccctcagctttccaacttgttgatcgatccttggttcgctgagcaagtgaaccgtcgcctgccgggcctagcaaaggtggtagccggcgcagctgaagccggtatcccagtgccttgcttcagcagcacgctcgattacatcaatagctatcgcacggcacgattaccacagaatttggtgcaggccatgcgcgattgcttcggctcacatacctaccagcgggttgacaaagaaggaaccttccatactgagtggctggactga

SEQ ID NO: 11941 - protein, 472 aa, Prochlorococcus marinus
MSKAHFGLIGLGVMGENLVLNAERNGFSSVVYNRTYAKTEEFLKGLGSDKAIQGAKDLQDFVDKLERPRRILMMIKAGSAIDAVIEQISPYLQEGDLLIDGGNSEFRDTERRVAELESKSFGYIGMGVSGGAKGALEGPSMMPGGTKTSYEAIESLVCKMAAQVEDGPCVTYIGPGGSGHFVKTVHNGIEYGIEQILAEAYDLMKRVGGMTGTQMADVLAQWNATEELSSYLVEITEVCLRTKDPDDGSDLVEKIMDQAGQKGTGLWTVVSALELGASVPTIYASLNGRVMSSMKPQRITAEQILHGSAIKPFDLGSSADGMAPLMDAVVLSCMASYAQGMELLRIASAEYNYNLHLPSIAQIWKGGCIIRSRLLKRIQDAFNADPQLSNLLIDPWFAEQVNRRLPGLAKVVAGAAEAGIPVPCFSSTLDYINSYRTARLPQNLVQAMRDCFGSHTYQRVDKEGTFHTEWLD

SEQ ID NO: 11942 - DNA, 1419 bp, Prochlorococcus marinus
  CDS (1)..(1419)
atgtccaaggcacattttggtttggttggtcttggagtaatgggagaaaatctcgtccttaatgctgaaaggaatgggttctctagcgttgtttataatcgaacttattcaaaaaccgaggcttttttaaatggtaaaggcttagggaaaaaaatatctggcgccagtgatcttcaggattttgttaacaaattagagaggcctagaaggattttgatgatggtaaaagcaggagcggcgaccgatgctgttatcgaacaaatatcaccttatttgcaagaagatgacctattgattgatggagggaatgcattgttttcagatactgaaagaagagtcttagaacttgagagtaaaagttttggttatataggaatgggtgtttcaggaggggcaaagggagccttggaaggaccaagcatgatgcctggtggaacaaaagcttcttataaagcaatagaaaatcttttgaacaaaatggcagctcaagtagatgatggaccttgtgttacttatataggtccacgaggttcgggccattttgttaaaacagtacacaatggaattgaatatggaatagaacagatactttctgaaggctatgacttgatgaaacgagtctgcaaaatgaattgtgatgagatttctgacgtttttggtatttggaataaaacagaagaattatcttcctatcttgttgaaattacagaaatttgtttacgaactaaggatccaaccgacggagctgatcttgttgagaaaataatggacaaagcaggtcaaaaaggaactggattatggacagttgtaagtgccttacaactgggggcctcggtccctaccatttacgcttctctgaatgggcgtgtaatgagttctatgaaatctgagagagtcaaggcggaaaaagtatttggcaagctatctatcgaaagaactgaccttggctcaccatcaaatggaatgtctccaataatggatgcggttgttttgtctacgattgcgagttatgcacaaggtatggaaattcttcgtttagcttctgaagaatataaatatgatcttcatatgccttctattgctcaaatttggaaaggaggctgcatcatacgttccacactcttgcaaagaatacaagatgcttttaataacgaaccacaattaacaaatctactaatggatccatggtttgccgaacaaattaaaaatagattgccagggcttacaaaaacagtggctgttgccgcgcagactggagttccagttccatgttttagtagcactttggattatataaatagttatagaactgctaggttgccacaaaatctagttcaggctatgcgtgattgctttggatcacatacttatgaacgtatagataaagaaggttcgtttcatactgaatggattaattaa

SEQ ID NO: 11943 - protein, 472 aa, Prochlorococcus marinus
MSKAHFGLVGLGVMGENLVLNAERNGFSSVVYNRTYSKTEAFLNGKGLGKKISGASDLQDFVNKLERPRRILMMVKAGAATDAVIEQISPYLQEDDLLIDGGNALFSDTERRVLELESKSFGYIGMGVSGGAKGALEGPSMMPGGTKASYKAIENLLNKMAAQVDDGPCVTYIGPRGSGHFVKTVHNGIEYGIEQILSEGYDLMKRVCKMNCDEISDVFGIWNKTEELSSYLVEITEICLRTKDPTDGADLVEKIMDKAGQKGTGLWTVVSALQLGASVPTIYASLNGRVMSSMKSERVKAEKVFGKLSIERTDLGSPSNGMSPIMDAVVLSTIASYAQGMEILRLASEEYKYDLHMPSIAQIWKGGCIIRSTLLQRIQDAFNNEPQLTNLLMDPWFAEQIKNRLPGLTKTVAVAAQTGVPVPCFSSTLDYINSYRTARLPQNLVQAMRDCFGSHTYERIDKEGSFHTEWIN

SEQ ID NO: 11944 - DNA, 1455 bp, Haemophilus ducreyi
  CDS (1)..(1455)
atgtcaatcaaaggtgatatcggcgttattggcttagccgtaatgggacaaaacttaattttaaatatgaatgacaacggcttcaaagttgtcgcatataatcgtactgcatcaaaagtagatgaatttttagcgggcgaagcaaaagataccaacataattggcgcttattctttagaagatttagccgctaaattagaaaaaccacgcaaaataatgttaatggtacgtgcaggcgaagtcgttgatcaatttattgatgctttactaccacatttagaagcaggcgatattattattgatggtggtaactctaactaccctgataccaaccgccgtactataacactagccgaaaaaggcattcgttttataggaacaggcgtgtcaggcggtgaagaaggtgcccgccacggtccgtctattatgccgggcggtaatgaagaagcttggccattcgtcaaacctattttacaagcaatctccgcaaaaacagataaagatgagccttgttgtgattgggttggtaaagaaggtgctggccattttgttaagatggtgcacaacggtatagaatatggcgatatgcaattaatttgtgaagcttatcaattcttaaaagatggcttaggtttaaactatgaagaaatgcacgcgatctttgcagattggaaaaataccgagctagatagctacttaatcgatattaccgcagatattcttgcatataaagatgcagatggtgagccactcgttgagaaaattttagatactgccggtcaaaaaggaacaggtaaatggacgggcatcaatgcgttagactttggtattccattgacgttaattactgaagcggtctttgcgcgttgtgtttctgcctttaaggatcaacgtgttgccgtatcacaattattcaataaaaccattacccctatatcagacgataaaaaagaatggattgaagcggtcagaaaagcattgttagcttcgaaaattatttcttatgcacaaggttttatgctgattcgtgaagcatcagaaaactttgaatggaatattaactatggcgccactgcattattatggcgtgaaggttgtattattcgttctgcctttttaggtaatatccgtgatgcctatgaagcgaacccaggtttagtgttcttaggttcagatccttatttccaaaatattttacaatccgcaatggcagattggcgtaaagtagtggctaaatccattgaaataggtattccaatgccatgtatggccgctgcaatcacgttcttagatggttacagctcagagcatctgcctgctaatttattacaagcacaacgtgactactttggcgcgcatacttatgagcgaacagataaaccacgttgttcattcttccatacaaattggacaggccgtggcggtaatacagcttcaacgacttatgatgtttag

SEQ ID NO: 11945 - protein, 484 aa, Haemophilus ducreyi
MSIKGDIGVIGLAVMGQNLILNMNDNGFKVVAYNRTASKVDEFLAGEAKDTNIIGAYSLEDLAAKLEKPRKIMLMVRAGEVVDQFIDALLPHLEAGDIIIDGGNSNYPDTNRRTITLAEKGIRFIGTGVSGGEEGARHGPSIMPGGNEEAWPFVKPILQAISAKTDKDEPCCDWVGKEGAGHFVKMVHNGIEYGDMQLICEAYQFLKDGLGLNYEEMHAIFADWKNTELDSYLIDITADILAYKDADGEPLVEKILDTAGQKGTGKWTGINALDFGIPLTLITEAVFARCVSAFKDQRVAVSQLFNKTITPISDDKKEWIEAVRKALLASKIISYAQGFMLIREASENFEWNINYGATALLWREGCIIRSAFLGNIRDAYEANPGLVFLGSDPYFQNILQSAMADWRKVVAKSIEIGIPMPCMAAAITFLDGYSSEHLPANLLQAQRDYFGAHTYERTDKPRCSFFHTNWTGRGGNTASTTYDV

SEQ ID NO: 11946 - DNA, 1425 bp, Candidatus Blochmannia floridanus
  CDS (1)..(1425)
atgtttaaacaacaagaagttggtgtaattggtatgggtataatgggtcaaaatttagcgttaaatattgaaaataagggatatagagtttctatttataatagatctccagataaaactaatataatcattaaaaataatcctacaaaaaatttaattccatatttttcaattgaacaatttattttttctttaaaaaaacctcgtgttatatttttaatgattactgcaggggttcatgttgatcatattattcaagttttgtctaattatttagaaataggagatattttaattgatggaggtaattctttttatcaagatacagtacgacgtgacttatatttatcagaaaaaaaaataaattttattggacttggtatatcaggaggggaagaaggagcgttaaaaggcccatcattaatgcctggtggttctcaagatgcttttaagatagttgagtcattattaaaaaaaattgctgctagatttaatgataatgagatttgtatggaatatattggtcctaatggatctggacattatgtgaagatgatgcacaatggtatggaatatggagatatgcaaataatctctgaaatatattttttcttaaaaatggtattacatttaactgctaaacagttaggaaaaatttttagtgattggaatatgggagaattgagcagttatttaattgaaataacaagtcatattttaatgaaaagtgataataatcagtattgtgttttagattatatattagatgttgctgataataaaggtactggattatggtctagtaaggatgctttagatttgggagtaccttcaactatgattactgagtcagtatttgcacgttatttatcaacattaaaaaatcaacgtattcaagcatcaaaagtattttctaatgtttttgaaggtaaagtaaattttgatttagaaaatattgatattttcgtagaaaaagcgcgtaaggctttgtatttaagcaaaattattttgtatgctcagggtttttatcaacttaaaatcagttcaatgacatatcattggaatttgaattatcaaaaaattgctaagatttttcgtgctggttgtattattcggtctaattttttacaagaaattattaatatctattcaaaaactcctaaaatagaaaatttgttattggattcatattgtgtgaatattataaataattatcaacaggatttaagagatatagtaacaattggtattgatcatggtattcctatgcctgcattatctgctgctatatcatattatgatggatttcgcagtttaatgttacctgctaatctgattcaagcgcaaagagattgttttggatctcatacttacaagcgtattgataaatcaggagtatttcatacaagatggttatctaaataa

SEQ ID NO: 11947 - protein, 474 aa, Candidatus Blochmannia floridanus
MFKQQEVGVIGMGIMGQNLALNIENKGYRVSIYNRSPDKTNIIIKNNPTKNLIPYFSIEQFIFSLKKPRVIFLMITAGVHVDHIIQVLSNYLEIGDILIDGGNSFYQDTVRRDLYLSEKKINFIGLGISGGEEGALKGPSLMPGGSQDAFKIVESLLKKIAARFNDNEICMEYIGPNGSGHYVKMMHNGMEYGDMQIISEIYFFLKMVLHLTAKQLGKIFSDWNMGELSSYLIEITSHILMKSDNNQYCVLDYILDVADNKGTGLWSSKDALDLGVPSTMITESVFARYLSTLKNQRIQASKVFSNVFEGKVNFDLENIDIFVEKARKALYLSKIILYAQGFYQLKISSMTYHWNLNYQKIAKIFRAGCIIRSNFLQEIINIYSKTPKIENLLLDSYCVNIINNYQQDLRDIVTIGIDHGIPMPALSAAISYYDGFRSLMLPANLIQAQRDCFGSHTYKRIDKSGVFHTRWLSK

SEQ ID NO: 11948 - DNA, 1480 bp, Oryza sativa
  CDS (9)..(1442)
tcgccaccatgggccagaaactcgccctcaacatcgccgagaagggcttcccgatctccgtctacaaccgcaccgccgccaaggtcgacgccaccgtgtcccgcgccgaggccgagggcgcgctcccggtgctcggccaccgcgacccgcggggcttcgtcctctccctctccaggccccgcaccgtcgtgctgctcgtccaggccgggcgcgccgtcgacgccaccatcgacgcgctcgtcccctacctcgacgccggggacgccatcgtcgacggcgggaacgagtggtaccagaacacggagcggcggatcgaggaggccgccgcgagggggatactctacctcgggatgggggtctccggcggcgaggagggcgcgcggaacgggccctcgctgatgccggggggccacatcgacgcctacaacaacatcagggacatcctcgagaaggccgccgcgcagacggaggatggggcgtgcgtcaccttcgtcggccccggcggcgcgggcaacttcgttaagatggtgcacaacgggatcgagtacggcgacatgcagctcatcgccgaggcctacgacgtgctccgccgcgtcggcggcctgtccaactcggagatcgctgacgtcttcgcggagtggaaccggggggaattggagagtttcttggttgagattactgccgatatattcacggtggccgacccgcttgatggcagcggcggcggtgggctggtggacaagattcttgacaagacggggatgaagggaaccgggaagtggacggtgcagcaggcagcagagcttgcgattgctgcgcccacgattgcagcatcactggatgggaggtacttgtctgggttgaaggacgagcgtgtggcggccgcaggggttctaaaggcggaggggatgccatcagggctactcgagacgattaatgttgataagaagatgctagttgacagggtgaggcaagctctgtatgcgtcaaaaatttgcagctacgcgcaggggatgaaccttctgcgagcaaagagtgtggagaaggggtggaatcttaacctcgcagagcttgcaaggatttggaagggcgggtgcattatccgggcgaagtttcttgataggatcaagaaggcgtatgacaggaaccctgagctggccaatctgatcgtggacagggagtttgcaagggagatggttcagcggcagaatgcatggcggtgggttgtggctcgtgctgtggaggctgggattagcactccagggatgtctgctagcctttcatactttgacacctacaggtgtagtcggctgcctgcaaatctgatccaagcacagagagacttgtttggggcacacacctatgagcgcattgaccgtccaggttcgttccacacagagtggactaagctggcgagaaagagtaatggtgcggccatttgaggacttgaatggtatcagtaactctgtgtggtgtctct

SEQ ID NO: 11949 - protein, 477 aa, Oryza sativa
MGQKLALNIAEKGFPISVYNRTAAKVDATVSRAEAEGALPVLGHRDPRGFVLSLSRPRTVVLLVQAGRAVDATIDALVPYLDAGDAIVDGGNEWYQNTERRIEEAAARGILYLGMGVSGGEEGARNGPSLMPGGHIDAYNNIRDILEKAAAQTEDGACVTFVGPGGAGNFVKMVHNGIEYGDMQLIAEAYDVLRRVGGLSNSEIADVFAEWNRGELESFLVEITADIFTVADPLDGSGGGGLVDKILDKTGMKGTGKWTVQQAAELAIAAPTIAASLDGRYLSGLKDERVAAAGVLKAEGMPSGLLETINVDKKMLVDRVRQALYASKICSYAQGMNLLRAKSVEKGWNLNLAELARIWKGGCIIRAKFLDRIKKAYDRNPELANLIVDREFAREMVQRQNAWRWVVARAVEAGISTPGMSASLSYFDTYRCSRLPANLIQAQRDLFGAHTYERIDRPGSFHTEWTKLARKSNGAAI

SEQ ID NO: 11950 - DNA, 894 bp, Bacillus cereus
  CDS (1)..(894)
atgcaagtaggattaattgggttaggtaaaatgggattaaatttagggaaaaatttaatggatcataaacatgaagtagtagcatttgatttaaatacgagcgcagtagaagaaatgaaagagtacggggcaacgggtacatctagtttaagtgaacttgttcagtcattacaatcaccaagaattctttgggtaatggtaccacacgctgttgttgattctgttattgatgaggttacaccacttttatcaaaaggagatattctaattgaagctggtaattcacattataaagagtctatccgccgatatgagcaattaaaggaagatggcattcactttatggatgcaggaacttctggtggaatggaaggcgctcgtaatggtgcttgttacatgatcggaggagatcaagaagcttgggacatcgttgaacctatcttccgcgatactgctgtagaaaatggattcttatatgctggaaaagctggtagtggtcacttcttaaaaatggttcataacggaattgaatacggtatgatggctgctattggtgaaggatttgagattctagagaaaagtgaatttgactacgattatgaaaaagtatcaagagtatggaacaacggttcagtcattcgttcttggttaatggaattaacagaaaatgcattttctaaagatgcaaaactggatgaaattaagggtgttatgcattcttctggtgaaggaaaatggacagtagaaacagcattagaccttcaaacagcaactcctgttatcgcaatgtctctattaatgcgctaccgctcattagacaatgatacatttacaggaaaagttgtagcagctctgcgcaatgaatttggcggacatgcagtagaaaagaaataa

SEQ ID NO: 11951 - protein, 297 aa, Bacillus cereus
MQVGLIGLGKMGLNLGKNLMDHKHEVVAFDLNTSAVEEMKEYGATGTSSLSELVQSLQSPRILWVMVPHAVVDSVIDEVTPLLSKGDILIEAGNSHYKESIRRYEQLKEDGIHFMDAGTSGGMEGARNGACYMIGGDQEAWDIVEPIFRDTAVENGFLYAGKAGSGHFLKMVHNGIEYGMMAAIGEGFEILEKSEFDYDYEKVSRVWNNGSVIRSWLMELTENAFSKDAKLDEIKGVMHSSGEGKWTVETALDLQTATPVIAMSLLMRYRSLDNDTFTGKVVAALRNEFGGHAVEKK

SEQ ID NO: 11952 - DNA, 897 bp, Bacillus cereus
  CDS (1)..(897)
atgaaactaggtttaattggattaggaaaaatgggatttccattagctgaacacttatatgaagacaagcatgaagtagttgtatacgatgtaaataaagagcttgttgaaaaggcaggaaaactaggaattactgcacgtcatacattaaaagaaatgattgctgaactagaagctcctcgtacaatttgggtaatggtgcctgcaggagaagttgtagagtcagtactaaaagatgtatatccattattagatgaaggtgatatcgttattgaaggcggaaattcattctataaagatacgttacgccgtgctgaagaagcaaaaagcttcggattacattatgtagatatcggtacatcaggcggtgtagaaggagctagatacggtgcttgcttaatggttggtggagaaaaagaaatttacgaccaattagaacctttatttaaagatttagcagtagaaaatggctattcttatgctggccgtgttggtagtggtcatttcttgaaaatggttcataacggtattgagtacggcatgatgcaagcaatcgctgaaggatttgaagtactagataagagtgactttgatttcaattatgaagatgttgcaaaagtatgggctaacggatcagttatccgtggttggttaatggacttaactgaaaaagcatttgcagaagatccgaaactagatggcattaaaggtgtaatgaactcttcaggagaaggaaaatggactgttgaaactgcacttgaacttcaagctgcagcaccagttatcgctatgtcattatttatgcgctatcgttctcaggaagatgatacattccatggaaaagtagtttcagcattacgtaatcagttcggtggacatgaagttgtgaaaaaataa

SEQ ID NO: 11953 - protein, 298 aa, Bacillus cereus
MKLGLIGLGKMGFPLAEHLYEDKHEVVVYDVNKELVEKAGKLGITARHTLKEMIAELEAPRTIWVMVPAGEVVESVLKDVYPLLDEGDIVIEGGNSFYKDTLRRAEEAKSFGLHYVDIGTSGGVEGARYGACLMVGGEKEIYDQLEPLFKDLAVENGYSYAGRVGSGHFLKMVHNGIEYGMMQAIAEGFEVLDKSDFDFNYEDVAKVWANGSVIRGWLMDLTEKAFAEDPKLDGIKGVMNSSGEGKWTVETALELQAAAPVIAMSLFMRYRSQEDDTFHGKVVSALRNQFGGHEVVKK

SEQ ID NO: 11954 - DNA, 1446 bp, Chlamydophila caviae
  CDS (1)..(1446)
atgacagagcaagcagatattgggctaattggtttagctgtaatggggaaaaaccttgtattaaacatgatagatcacggtttttctatttctgtttataaccgtagtccagagaaaacccgagagtttctacaagaacattctcaaaataccctccttcagggacacgaaaatttagaagactttgtgcgttctttaaaacgtcctagaaaagtgatgctgatgatcaaagcaggagctcctgtagatcaaagtatcgaatcattgctaccttatcttgaacctggagatattattatcgacgggggaaacagctattataaagattcagaaaggcgatgccgagacctcaaagaaaagggcatactttttgtagggatggggatttctggaggcgaggaaggtgctcgcaagggaccttctattatgcccggaggtaatagtgaggcgtggccagctatagcccctatctttcaaggtatttctgctaaggttcatggtaacccctgctgttgttgggttggctctggaggggcagggcattatgtaaagactgtacataatggtattgaatacggagatatacaattaatctgcgaagcttacggattattaaggacacgtttaggcatctctccagagggtatatcggaaatttttgccgaatggaatagccgagagttagaaagctaccttatgagaatttctgtagaggtgctttctttaaaaggtcctgacggatctcctgttattgatacaattttagatgtcgcaggacaaaaggggacaggccgctggacagccatagatgctatcgactctggagtccctctttctttaattattgaatctgtattagcgcgctttctctcttcatggaaaacggtacgagaacaggctgctagcgaacttcctggtattcctatagtctttgaaaaacccagagacccgcatctttttatcgaagatgtattccaggcattatatgcttcgaaaattattagctatgctcaaggattcatgctgttaaaacaagcatcagaagagcatcaatggaatctaaatttcggagagctcgctctattgtggagaggaggctgtatcatccaaagcgcatttttagatgctatccataaaggctttgaaaatgaacccgaggctccttcgctaattttacaaacctatttcaaatccacattacaaaactcagaatctggctggcgtagaactgttgcttacgcagttggttcaggatatcctgtgccttgtttagcagctgctttgaccttctatgatggttaccgaacaaaagactcttcaatagctttagctcaaggactacgagattattttggagcgcattcttacgaacgtaaggatagacctcgaggagaattctaccatacagactggatagggactaaaactacaacagcagtaaaataa

SEQ ID NO: 11955 - protein, 481 aa, Chlamydophila caviae
MTEQADIGLIGLAVMGKNLVLNMIDHGFSISVYNRSPEKTREFLQEHSQNTLLQGHENLEDFVRSLKRPRKVMLMIKAGAPVDQSIESLLPYLEPGDIIIDGGNSYYKDSERRCRDLKEKGILFVGMGISGGEEGARKGPSIMPGGNSEAWPAIAPIFQGISAKVHGNPCCCWVGSGGAGHYVKTVHNGIEYGDIQLICEAYGLLRTRLGISPEGISEIFAEWNSRELESYLMRISVEVLSLKGPDGSPVIDTILDVAGQKGTGRWTAIDAIDSGVPLSLIIESVLARFLSSWKTVREQAASELPGIPIVFEKPRDPHLFIEDVFQALYASKIISYAQGFMLLKQASEEHQWNLNFGELALLWRGGCIIQSAFLDAIHKGFENEPEAPSLILQTYFKSTLQNSESGWRRTVAYAVGSGYPVPCLAAALTFYDGYRTKDSSIALAQGLRDYFGAHSYERKDRPRGEFYHTDWIGTKTTTAVK

SEQ ID NO: 11956 - DNA, 1440 bp, Streptomyces avermitilis
  CDS (1)..(1440)
atgagcacaacagcccagatcggcgtcactggtctcgcggtcatgggccgcaacctcgcccgcaacttcgcgcgcaacggctatacggtcgcggtgcacaaccggaccgcgtcgcggacgcgtgacctcgtggaggagttcggccacgagggcgacttcgtgccggccgagaccgcgaaggacttcgtggcggcgctggagcggcccaggcgcctggtgatcatggtgaaggcgggcgcgcccaccgacgcggtgatcgaggagttcgccccgctcctggagcccggcgacatgatcatcgacggtggcaacgcacacttcgcggacacccggcgccgggagcgcgagctgcgcgagcaggacatccacttcgtcggcaccggcatctccggcggcgaggagggcgcgctgcacgggccgagcatcatgccgggcggctcgcccgagtcgtacgactccctcgggcccatgctggagaagatctccgcgaaggcggccgacggggcgccgtgcgtgacgcacgtcggtccggacggtgccgggcacttcgtgaagatggtgcacaacggcatcgagtacgcggacatgcagctgatcggcgaggcgtaccagctgctgcgcgacgtcgccggctacacgcccgcgcagatcgcggacatcttccggacctggaacacgggccgcctcgactcctacctgatcgagatcacggcggaggtcctgtcccacgtggacgcggcgaccggcaagccgttcgtggacgtggtccaggaccaggcggaacagaagggcacgggccgctggacggtccagatcgcgctcgacctgggcgtgccggtgtcgggcatcgcggaggccgtgttcgcccgctccctgtccggccaccaggagctgcgggaggcctcgcgcgggctggccgggccgaaggcggctccgctcggcgagtcggaggcggcggccttcgccgaccgcgtcgagcaggcgctgtacgcctcgaagatcgtctcgtacacgcagggcttccacgagatcgcggcgggcagcgacgagtacgactggaacatcgacctggggaagatcgcgtcgatctggcggggcgggtgcatcatccgcgccgccttcctggaccgcatccgggaggcgtacgacgcgcgtgcggacctgccgagcctgctgtccgacgacacgttcgcgcaggagatcgcggcggcgcaggacgactggcgcgaggtgctgatcgcggcgacccgccagggcgtaccgaccccggggttcgccgcggccctcgcctactacgacgccctgcgcgccgagcgcctgcccgccgccctcacccaggggcagcgggacttcttcggggcgcacacctatcgccgcacggaccgggagggctcgttccacacgctgtggggcggggaccggtcggaggtcaccgcgtag

SEQ ID NO: 11957 - protein, 479 aa, Streptomyces avermitilis
MSTTAQIGVTGLAVMGRNLARNFARNGYTVAVHNRTASRTRDLVEEFGHEGDFVPAETAKDFVAALERPRRLVIMVKAGAPTDAVIEEFAPLLEPGDMIIDGGNAHFADTRRRERELREQDIHFVGTGISGGEEGALHGPSIMPGGSPESYDSLGPMLEKISAKAADGAPCVTHVGPDGAGHFVKMVHNGIEYADMQLIGEAYQLLRDVAGYTPAQIADIFRTWNTGRLDSYLIEITAEVLSHVDAATGKPFVDVVQDQAEQKGTGRWTVQIALDLGVPVSGIAEAVFARSLSGHQELREASRGLAGPKAAPLGESEAAAFADRVEQALYASKIVSYTQGFHEIAAGSDEYDWNIDLGKIASIWRGGCIIRAAFLDRIREAYDARADLPSLLSDDTFAQEIAAAQDDWREVLIAATRQGVPTPGFAAALAYYDALRAERLPAALTQGQRDFFGAHTYRRTDREGSFHTLWGGDRSEVTA

SEQ ID NO: 11958 - DNA, 876 bp, Streptomyces avermitilis
  CDS (1)..(876)
atggagctcggtctcgtcggcctcggcaagatgggcggcaacatgcgcgagcggatccgccgcgcaggtcacaccgtcatcggatacgaccgcaacccggacgtcgccgatgtccacagcctcgaagagcttgtgggcaagctcaagggcccgcgcgtggtgtgggtgatggtccccgccggtgccgcgacgcagtccaccgtcgacgagctgggcgagctcctggagcccggcgacatcgtcgtggacggcgggaactcgcgctggacggacgatgagaagcacgcggaggagctggccgccaagggcatcgggttcgtcgactgcggcgtctccggcggcgtctggggcctgcagaacggctatgcgctgatgtacggcggcgacgccgagaacatcgccaaggtgcagccgatcttcgacgcgctcaagcccgagggcgacttcggcgccgtacacgcgggcaaggtcggcgcgggccacttctcgaagatggtccacaacggcatcgagtacgccatgatgcaggcctacgccgaaggctgggagctgctcgagaaggtcgactcggtcacggacgtccgcgaggtcttcaggtcctggcaggagggcacggtcatccgttcctggctgctcgacctggcggtcaacgccctcgacggggacgagcacctggagaagctgcgcggctacgccgaggactccggcgagggccgctggacggtggaggccgccatcgacaacgcggtcccgctgccggcgatcacggcgtcgctgttcgcgcggttcgcctcgcggcaggacgattcgccgcagatgaagatgatcgccgcgctgcggaaccagttcggcggccacgcggtcgagaagaagtaa

SEQ ID NO: 11959 - protein, 291 aa, Streptomyces avermitilis
MELGLVGLGKMGGNMRERIRRAGHTVIGYDRNPDVADVHSLEELVGKLKGPRVVWVMVPAGAATQSTVDELGELLEPGDIVVDGGNSRWTDDEKHAEELAAKGIGFVDCGVSGGVWGLQNGYALMYGGDAENIAKVQPIFDALKPEGDFGAVHAGKVGAGHFSKMVHNGIEYAMMQAYAEGWELLEKVDSVTDVREVFRSWQEGTVIRSWLLDLAVNALDGDEHLEKLRGYAEDSGEGRWTVEAAIDNAVPLPAITASLFARFASRQDDSPQMKMIAALRNQFGGHAVEKK

SEQ ID NO: 11960 - DNA, 879 bp, Streptomyces avermitilis
  CDS (1)..(879)
atgcagctcggactgatcggtctcggcaaaatgggcggcaacatgcgcgagcggatccgccgcgcgggccacacggtcgtcggctacgaccgcaaccccgaggtctcggacgtcagtagcctcaccgaactcgtgagcgccctcgaaggcccgcgcgtggtctgggtgatggtccccgcgggcgccccgacccagtccgtcgtcgacgagctcggcgacctgctctcccccggcgacaccgtcgtcgacggcggcaactcccgctggacggacgacgagaagcacgccgaggagctggccgccaagggcatcggcttcgtcgacgcgggcgtctcgggtggtgtgtggggtctccagaacggctatgcgctgatggtgggcggcgacgcggagcacatcgctcgcgtccagccgatcttcgacgcgctcaagccggagggcgacttcgggttcgtccacgcgggcaaggtcggcgcgggccacttctcgaagatggtccacaacggcatcgagtacgccatgatgcaggcgtacgccgagggctgggagctcctcgagaaggtcgactccgtgaccgatgtgcgcgcggtcttccgctcctggcaggagggcaccgtcatccgctcctggctgctcgacctcgcggtcaacgccctggacgaggacgagcacctggagaagctgcgcggctacgccgaggactccggcgagggccggtggaccgtcgaggcggccatccacaacgccgtgccgctgcccgcgatcaccgcctccctcttcgcgcggttcgcctcccgccaggacgactcgccgcagatgaagatggtcgcggcgctgcgcaaccagttcggcggccacgccgtcgagtcagcggagtag

SEQ ID NO: 11961 - protein, 292 aa, Streptomyces avermitilis
MQLGLIGLGKMGGNMRERIRRAGHTVVGYDRNPEVSDVSSLTELVSALEGPRVVWVMVPAGAPTQSVVDELGDLLSPGDTVVDGGNSRWTDDEKHAEELAAKGIGFVDAGVSGGVWGLQNGYALMVGGDAEHIARVQPIFDALKPEGDFGFVHAGKVGAGHFSKMVHNGIEYAMMQAYAEGWELLEKVDSVTDVRAVFRSWQEGTVIRSWLLDLAVNALDEDEHLEKLRGYAEDSGEGRWTVEAAIHNAVPLPAITASLFARFASRQDDSPQMKMVAALRNQFGGHAVESAE

SEQ ID NO: 11962 - DNA, 915 bp, Nitrosomonas europaea
  CDS (1)..(915)
atggaattcggtatggtgggtttagggcgcatggggggcaatatggcacgccgtcttgcccgacagagcagaaaaattgcagtgatgaaccgtagttttgatgtagccgaggcattggtgaaggaaacggggcacatcgcgtgcagggattacaccgagctggttgctgtacttgagaaaccacggattatatggctgatgctgccagcgggtgacgtgactgaaacggcgctttccacactattaccattattgtccccaggtgatctgatcgtggatggtgcaaatgcccattatcaggatgatgcgccacgtgcggcacgctgtgcagaacggggtatcgaatttgtcgatgccggggtttccggagggatatggggattggaaaatggttactgcatcatgtttggtggatcagatacagcagctgcgcgactgaagccttatctggaagtattggcaccgaccccaacgactggctggttgcatactgggccggttggctcagggcattatgtgaaaatgatccataacgggatcgagtacggcatgatgcaggcctttgccgagggatttgcgctgatgaaagacaaatccgggttcaatctcgatcttgccgagattgccgagttatggcggcatggtagtgtggtgcgctcgtggttactcgatttgtctgccgattttctggctgaagatcagatgtttgatgatattgctccttttgtggcggattcgggtgaaggtcgctggacggcacttgcttctattgagcagggtattcctgccccggtaatcatgctttcactgatgatgcgttttaccacacagggcagaaatgattatgcggctaaaatgcttgccaagatgcgccacggttttggtggccatgccatcaaaaaaggtgagcaatga

SEQ ID NO: 11963 - protein, 304 aa, Nitrosomonas europaea
MEFGMVGLGRMGGNMARRLARQSRKIAVMNRSFDVAEALVKETGHIACRDYTELVAVLEKPRIIWLMLPAGDVTETALSTLLPLLSPGDLIVDGANAHYQDDAPRAARCAERGIEFVDAGVSGGIWGLENGYCIMFGGSDTAAARLKPYLEVLAPTPTTGWLHTGPVGSGHYVKMIHNGIEYGMMQAFAEGFALMKDKSGFNLDLAEIAELWRHGSVVRSWLLDLSADFLAEDQMFDDIAPFVADSGEGRWTALASIEQGIPAPVIMLSLMMRFTTQGRNDYAAKMLAKMRHGFGGHAIKKGEQ

SEQ ID NO: 11964 - DNA, 900 bp, Enterococcus faecalis
  CDS (1)..(900)
atggacattggctttattggacttgggaaaatgggtttgaacatggcattaaatgttcacgaacaaggctggcccattattggctttgatgtaacaaaggaagcaagagcgactgctagagaacaaggtctttccgttgtagattcgttgtcagaattattgaaagcgcttaacaaaaggaaggtgatttttttaagtacccccgctggtcagattaccaatcaattagtggcagaattggtagagcaattagcaccagaggatatcattgtggatagtggcaattcaaattttcatgatagtgttgcgaatgctcagcttgctaaggaaaaaggaatttattttattgattgtggtacttctggtggcatcaaaggagcgcgggaaggagcgtgtttaatggttggcggtgcgcctgaagctgtcaaagtgttaaccccattttttgaagatttagcttgtgaacaagggtatctttatgctgggaaatcaggagctggtcactatttgaaaatggtgcataacgggattgagtacgtcatgatgcaagccatgggcgaaggattcaatttattagaagctgccgaatatgattttgcgttggagaaagtagccgatgtgtggaatcacggctcgattattgaagctcgcttgatgggcttagcgaaagaggtttttgcggaaaatcctacgttagccaatctagaagggaaagtggcagcaaatggcgaagccaaatggatgattgaagaagcattgcgtttggagatgcccgtcccaactacggcgttgtccttatttactcgaaatgaaagtatgctagcaaatcatttttcaaacaaagtggtcgcttctttgcgacaaggatttggcgggcatgaagtcgtaaaaagtcagtaa

SEQ ID NO: 11965 - protein, 299 aa, Enterococcus faecalis
MDIGFIGLGKMGLNMALNVHEQGWPIIGFDVTKEARATAREQGLSVVDSLSELLKALNKRKVIFLSTPAGQITNQLVAELVEQLAPEDIIVDSGNSNFHDSVANAQLAKEKGIYFIDCGTSGGIKGAREGACLMVGGAPEAVKVLTPFFEDLACEQGYLYAGKSGAGHYLKMVHNGIEYVMMQAMGEGFNLLEAAEYDFALEKVADVWNHGSIIEARLMGLAKEVFAENPTLANLEGKVAANGEAKWMIEEALRLEMPVPTTALSLFTRNESMLANHFSNKVVASLRQGFGGHEVVKSQ

SEQ ID NO: 11966 - DNA, 1422 bp, Enterococcus faecalis
  CDS (1)..(1422)
atgacaaaacaacaatttggcgtagtcggcatggctgtcatgggaaaaaatcttgctttaaacattgaaagcagaggctatacagttgcgctgtataaccgtacaggatcaaaaacaacagaagtggttgaagaacatcctgacaaaaactttcaagcaacatactcaattgaggaatttgtgaatgcaattgaaaaacctcgtcgaattatgttgatggttaaagctggacctgcaacagatgcgacaatccaagaattgttaccacaccttgataaaggcgacatcttaattgatggcggtaatacgttcttcaaagacacaatgcgacgtaatgaagaactagcaaactcaggaattaactttattggtactggcgtttctggcggagaagaaggagccttgaaaggaccatctatcatgcctggcggacaaaaagaagcgtatgagttagttgcgccaattcttgaaaaaatttcagctaaagcagaagacggtgaaccatgtgtgacttacattggcccaaatggtgctggacattatgtaaaaatggttcataatgggattgaatatggggacatgcaattaattgctgaatcctacgatttaatgaaacaaatcttaggcttatctgttgatgaaatggcagagattttcaaagaatggaacgaaggcgaattagacagttaccttatcgagatcacggctgacattttgacacgtaaagatgatgaaggaaccgaccaaccaatcgttgatgttattcttgatgcagcaggcaacaaaggaacaggtaaatggacaagccaaagtgcgttagatcttggcgtaccattaccattaattacagaatcagtatttgcacgttttatttcggcttacaaagaagaacgcgtaaaagcaagtggcattttatcaaaacctgcagcctttaactttgcaggcgataaaaaagaattgattgaaaaaattcgcgaagcattatactttagtaaattaatgagttatgcgcaaggttttgcacaactccgtgcagcttctgaagaatacggatgggatttaccatttggtgaaattgcaaaaatctggcgagcaggttgtattatccgtgcacaattcttacaaaaaattaccgatgcatatgaaaaaaatccagcacttgaaaacttgttgttagatgaatacttcgtagaaattacgaaaaaatatcaacaagccgttcgtgaagttgttgcgattgctgttcaagcaggtgttcctgtaccaacattctcatctgcaattgcttattacgattcttatcgttcagatcgcttaccagcgaatttaattcaagcacaacgtgattacttcggtgctcatacgtacgaacgcacagacaaagaaggaatctaccattacagctggtacaacgaagaataa

SEQ ID NO: 11967 - protein, 473 aa, Enterococcus faecalis
MTKQQFGVVGMAVMGKNLALNIESRGYTVALYNRTGSKTTEVVEEHPDKNFQATYSIEEFVNAIEKPRRIMLMVKAGPATDATIQELLPHLDKGDILIDGGNTFFKDTMRRNEELANSGINFIGTGVSGGEEGALKGPSIMPGGQKEAYELVAPILEKISAKAEDGEPCVTYIGPNGAGHYVKMVHNGIEYGDMQLIAESYDLMKQILGLSVDEMAEIFKEWNEGELDSYLIEITADILTRKDDEGTDQPIVDVILDAAGNKGTGKWTSQSALDLGVPLPLITESVFARFISAYKEERVKASGILSKPAAFNFAGDKKELIEKIREALYFSKLMSYAQGFAQLRAASEEYGWDLPFGEIAKIWRAGCIIRAQFLQKITDAYEKNPALENLLLDEYFVEITKKYQQAVREVVAIAVQAGVPVPTFSSAIAYYDSYRSDRLPANLIQAQRDYFGAHTYERTDKEGIYHYSWYNEE

SEQ ID NO: 11968 - DNA, 1431 bp, Tropheryma whipplei
  CDS (1)..(1431)
atgcgggctgatatcggtgtatatggtcttgcggttatgggcagtaatcttgcgagaaattttgccggcaaaggtatccgggttgctattcataaccggtcatccgacagatctaattccctcgcacagcagcacagtgagtgtaattttattgttgcgaaggatgataaagattttatagattcactcagttcgcccagaactgtccttctgatggttaaggctggatctattgtggatgaagttatagctcgactctccacctttatgcaaccaggagatgtgataatcgacggtggtaattctctgtacaccgatacaatcaggcgtgaggaagaactcaaggcaagggggttgcactttatagggcttggtgtttcgggcggagaggtgggcgccctcgaaggccccagtcttatgcccggaggatctgattacgcttattcgatcgttggtcctatgctcgagaagatagccgctagggcgaatggtgagccctgtgttgcgcacataggtcataatggcgcgggacactttgtgaagatggtccacaatggcattgaatacgctgatatgcaaataattgccgagtcttatgatcttttaagacggggtttggggctctctccgacgcgtatatccgatatttttcgtgagtggaacagcggtgagcttgagtcgtatttagttggagtaacagctgacatactttctcatagagacaagagaaccggaaagccgtttgttgatattgttctcgaccaggctggtgcaaagggaaccggtgcttggacagcgcagaacgcacttgaccttggtgttcccgccggttccgtgtctgaagcagtttttgcgcgcagtctttcatcggatgaacagcgttgccaggtgcaacagaaactttctagatcacaagcatcaagtcatgaagcacccttgaaggaggcggagtttatcgatgctgtacgcaatgccctttacttggcaaagatacttgcgtactctcagggttttagaattattagtgttgcagccgccaagcatgactggggcatagacctttctgcctgtgcacgaatctggcgtgcgggctgtataatccgggcagtttttctggataaagttgcccatgagtacagtaagaatccggacctcacaagtcttatgtgttctccgggtttttctgatgaattggtaggcaggttacggtttttgagggaagttgttgcttctgcagcccgcctggctattccagcacctgttttttcatctctcttgtcatatatcgacgcgcttgcttcagatcgcttgcctgcatgtctgattcaggcgcagagagatgattttggtgcccacacttacaggcgtgtcgacgttccggggatttttcataccctttggtcatcagacctgagcgaagtgcccgcctga

SEQ ID NO: 11969 - protein, 476 aa, Tropheryma whipplei
MRADIGVYGLAVMGSNLARNFAGKGIRVAIHNRSSDRSNSLAQQHSECNFIVAKDDKDFIDSLSSPRTVLLMVKAGSIVDEVIARLSTFMQPGDVIIDGGNSLYTDTIRREEELKARGLHFIGLGVSGGEVGALEGPSLMPGGSDYAYSIVGPMLEKIAARANGEPCVAHIGHNGAGHFVKMVHNGIEYADMQIIAESYDLLRRGLGLSPTRISDIFREWNSGELESYLVGVTADILSHRDKRTGKPFVDIVLDQAGAKGTGAWTAQNALDLGVPAGSVSEAVFARSLSSDEQRCQVQQKLSRSQASSHEAPLKEAEFIDAVRNALYLAKILAYSQGFRIISVAAAKHDWGIDLSACARIWRAGCIIRAVFLDKVAHEYSKNPDLTSLMCSPGFSDELVGRLRFLREVVASAARLAIPAPVFSSLLSYIDALASDRLPACLIQAQRDDFGAHTYRRVDVPGIFHTLWSSDLSEVPA

SEQ ID NO: 11970 - DNA, 1449 bp, Neisseria gonorrhoeae
  CDS (1)..(1449)
atgaaaggcgatattggcgtaatcggtttggcggttatggggcaaaacctgattttgaatatgaacgattgcggatttaaggttgtcgcctacaaccggacaatcggtaaagtggacgaatttttaaacggtgcggcaaaagagacgggcattatcggcgcgtattccctgcaagacttggtcgataagctggcaaaaccgagaaaaatcatgatgatggttcgcgcaggttcggtggttgacgactttgtcgaacaactgcttccgctgttggaagaaggcgacatcattatcgacggcggcaatgccaattaccccgacacgacacggcggacacattaccttgccggaaaagggattttgtttgtcggcgcgggcgtatccggcggcgaagaaggcgcgcggcgcgggccgtccatcatgccgggcggggataagcgcgcttgggaagcggtcaagccgattttccaggcgattgccgccaaaacgccgcagggcgaaccgtgttgcgactgggtcggcaaggatggcgcgggacattttgtcaaaatggtgcacaacggcatcgaatacggcgatatgcagctgatttgcgaagcgtaccagtttatgaaagacggtttggggctgtcctacgacgaaatgcaccgcgtgtttgccgagtggaacaaaaccgagctggattcttatctgattgaaatcacagcggcaattttgggctataaggacgaaggcggcgaaccgctggccgagaaaatcctcgatacggcagggcaaaaaggcacgggcaaatggacgggcatcaatgccttggatttgggcattccgctgacgctgatttccgaagccgtattcgcccgctgtgtttcgtcgttcaaagaacagcgcgtgcagaccggcaggctgttcgcccgaaccgccacgcccgtcgaaggcggcaaacaagaatgggtcgaggcgttgagacaggctttgcttgcctccaaaatcatttcctacgcacaaggctttatgttgatccgcgaagcgggcgaaagttacggctggggtttggactacggcaacactgcgctgctgtggcgcgaaggctgcatcatccgcagcgcgtttttgggcaatatccgcgacgcgtatgaggccaatcccgatttggtgtttttgggtgcggatccgtatttcaaaaatattttggaaaactgcctgccggcatggcgcaaggtggttgccaaggcggtcgaatgcggcatccctatgccctgcatggcttcggcgattacgttcttggacggctatacgaccgaacgcctgcctgccaacctcttgcaggcacagcgcgactacttcggcgcgcacacttacgagcgcaccgacaaaccgcgcggcgaatttttccataccaactggacgggcaagggcggagataccgcttcgacaacctacgatatttga

SEQ ID NO: 11971 - protein, 482 aa, Neisseria gonorrhoeae
MKGDIGVIGLAVMGQNLILNMNDCGFKVVAYNRTIGKVDEFLNGAAKETGIIGAYSLQDLVDKLAKPRKIMMMVRAGSVVDDFVEQLLPLLEEGDIIIDGGNANYPDTTRRTHYLAGKGILFVGAGVSGGEEGARRGPSIMPGGDKRAWEAVKPIFQAIAAKTPQGEPCCDWVGKDGAGHFVKMVHNGIEYGDMQLICEAYQFMKDGLGLSYDEMHRVFAEWNKTELDSYLIEITAAILGYKDEGGEPLAEKILDTAGQKGTGKWTGINALDLGIPLTLISEAVFARCVSSFKEQRVQTGRLFARTATPVEGGKQEWVEALRQALLASKIISYAQGFMLIREAGESYGWGLDYGNTALLWREGCIIRSAFLGNIRDAYEANPDLVFLGADPYFKNILENCLPAWRKVVAKAVECGIPMPCMASAITFLDGYTTERLPANLLQAQRDYFGAHTYERTDKPRGEFFHTNWTGKGGDTASTTYDI

SEQ ID NO: 11972 - DNA, 1479 bp, Kluyveromyces lactis
  CDS (1)..(1479)
atgtctgaacctgccggtgatattggtttgattggtttggccgttatgggtcaaaacttgatcttgaacgctgctgaccacggtttcactgttgttgcttataacagaacagtttctaaggttgatcatttcttagcaaacgaggcaaagggtaaatctatcattggtgctcattctgtggaagaattgtgccgtaacttgaagagaccaagaagaatcattcttttggtcaaggctggtgatgctgtggatgctttcattcaacaattgttgccatttttggaaaagggagacattatcatcgatggtggtaactctcatttcccagattctaacagacgttacgatgaattgaaggaaaagggaatctactttgttggttctggtgtttctggtggtgaagaaggtgctcgttacggtccttctttgatgccaggtggtgccgaagaagcttggcctcacattaaggacatcttccaatctatttctgccaagtctgacggcgaaccatgttgtgactgggttggtccagctgggtctggtcattacgtgaagatggtccacaacggtatcgaatacggtgacatgcaattgatcactgaagcttacgatatcatgaagagaattggtggattcaccgataaggaaatcggtgaagttttctcccaatggaacaagggtgtcttggattccttcttggttgaaattacaagagacattttgctgtacgacgatgtcgatggtactcctctagtggaaaagatcttggattcagctggtcaaaagggtactggtaaatggactgccattaacgctttggatctaggtatgccagttactttgattggtgaagccgtgttcgctcgttgtttgtcctctttgaaggacgaaagagttagagcctccaagttgcttccaggccctcaaattccaaaggatgccgttaaggaaagacaacaattcgttgacgacttggaacaagctctttacgcttccaagatcatctcttacgctcaaggtttcatgttgatccgtgaagctggtaagacttacggctggaagttgaacaaccctgccatcgctttgatgtggagaggtggttgtatcatcagatccgttttcttgggtgaaattacaaaggcttatagagaaaacccagaattggaaaacttattattcaacaaattcttcgctgatgccgtcgaaaaggctcaaagcggttggagaaagactattggtttggctgtttcttacggtatcccaaccccagctttctccactgctctatcgttctacgatggttacagatctgaaagattgccagctaacttgctacaagctcaacgtgattacttcggtgctcacactttcagagtcttgccagaagctgcttccgaaaacttgccagctgaccaaaacatccacattaactggaccggtaaaggtggtaacgtttcagcttccagttaccaagcttaa

SEQ ID NO: 11973 - protein, 492 aa, Kluyveromyces lactis
MSEPAGDIGLIGLAVMGQNLILNAADHGFTVVAYNRTVSKVDHFLANEAKGKSIIGAHSVEELCRNLKRPRRIILLVKAGDAVDAFIQQLLPFLEKGDIIIDGGNSHFPDSNRRYDELKEKGIYFVGSGVSGGEEGARYGPSLMPGGAEEAWPHIKDIFQSISAKSDGEPCCDWVGPAGSGHYVKMVHNGIEYGDMQLITEAYDIMKRIGGFTDKEIGEVFSQWNKGVLDSFLVEITRDILLYDDVDGTPLVEKILDSAGQKGTGKWTAINALDLGMPVTLIGEAVFARCLSSLKDERVRASKLLPGPQIPKDAVKERQQFVDDLEQALYASKIISYAQGFMLIREAGKTYGWKLNNPAIALMWRGGCIIRSVFLGEITKAYRENPELENLLFNKFFADAVEKAQSGWRKTIGLAVSYGIPTPAFSTALSFYDGYRSERLPANLLQAQRDYFGAHTFRVLPEAASENLPADQNIHINWTGKGGNVSASSYQA

SEQ ID NO: 11974 - DNA, 1470 bp, Saccharomyces castellii
  CDS (1)..(1470)
atgtccgctgattttggtttaatcggtttggccgtcatgggtcaaaacttgatcttaaatgccgcagaccacggtttcaccgtctgtgcttacaacagaactgtctccaaagtggaacatttcctagctaacgaagccaagggtaagtccattgttggtgctacttctatcgacgactttttgtctaaattgaagagaccaagaaaggttatgcttcttgttaaggctggtgctccagttgatgctctaattaacgaattggtcccacgtctagaaaagggtgatattatcatcgatggtggtaactctcatttcccagacaccaacagacgttacgaagaattgaagcaaaagggtatcttgtttgttggttccggtgtctctggtggtgaagatggtgcccgttacggtccatctttgatgccaggtggtgcagaagaagcttggccacacattaaggatattttccaatccatctccgctaaatctgatggtgaaccatgttgtgactgggtcggtccagccggtgcaggtcattacgtcaaaatggtccataacggtattgaatacggtgacatgcaattgatttgtgaagcttatgacattatgaagcgtgtcggtcatttcactgataaggaaattggtgatgtttttgaaacctggaacaagggtgtcttggattctttcctaattgaaattaccagagatatcttgaaattcaatgacgttgatggtaagccattggttgaaaagattatggataccgctggtcaaaagggtactggtaagtggaccgctattaatgctctagatttgggtattccagtcactttgattggtgaagctgtcttctctcgttgtctatctgctttgaagtctgaaagaattagagcttccaagactctattgggtccagaagttccaaaggatttgattaaggataagaagcaatttgttgacgatttggaacaagccttatacgcttccaaaattatgtcctacgctcaaggtttcatgttaatccgtgaagctggtaagacttatggttggaaactaaacaacccagctattgccttgatgtggagaggtggttgtattattagatccgtcttcttgggtgaaattaccaaggcttacagagaagatccagaactagaaaatctattattcaacaagttcttctccgatgctgtcactaaggctcaaaccggttggagaaagtccattgctttggctaccacttacggtatcccaaccccagcattctccactgctttggccttctacgatggttacagatctgaaagattaccagctaacttgctacaagctcaaagagattacttcggtgctcacactttcagagtcttgccagaatgtgcctctgacaacttgccattagacaaggatatccacattaactggaccggtcacggtggtaacgtttcttcttctacttaccaagcttaa

SEQ ID NO: 11975 - protein, 489 aa, Saccharomyces castellii
MSADFGLIGLAVMGQNLILNAADHGFTVCAYNRTVSKVEHFLANEAKGKSIVGATSIDDFLSKLKRPRKVMLLVKAGAPVDALINELVPRLEKGDIIIDGGNSHFPDTNRRYEELKQKGILFVGSGVSGGEDGARYGPSLMPGGAEEAWPHIKDIFQSISAKSDGEPCCDWVGPAGAGHYVKMVHNGIEYGDMQLICEAYDIMKRVGHFTDKEIGDVFETWNKGVLDSFLIEITRDILKFNDVDGKPLVEKIMDTAGQKGTGKWTAINALDLGIPVTLIGEAVFSRCLSALKSERIRASKTLLGPEVPKDLIKDKKQFVDDLEQALYASKIMSYAQGFMLIREAGKTYGWKLNNPAIALMWRGGCIIRSVFLGEITKAYREDPELENLLFNKFFSDAVTKAQTGWRKSIALATTYGIPTPAFSTALAFYDGYRSERLPANLLQAQRDYFGAHTFRVLPECASDNLPLDKDIHINWTGHGGNVSSSTYQA

SEQ ID NO: 11976 - DNA, 1482 bp, Saccharomyces servazzii
  CDS (1)..(1482)
atgtctcaagaagctgtcgctgacttcggtctaattggtcttgccgtcatgggccaaaatttaatcctaaacgttgctgatcacggtttcaccgtctgtgcctacaacagaaccgtctctaaagtcgacgatttcttagccaacgaagccaagggcaaatccatcgtcggcgccaagtctatcgaagaattcatcgccaaattgaaaagaccaagaaaaatcatgctattagtcaaagccggtaaaccagtagactacatcatcaacgacctattaccacatctagaaaagggtgatatcatcatcgatggtggtaactcccatttcccagacaccaacagaagatacgaagaattgaccaagaagggcattcttttcgtcggctctggtgtctccggtggtgaagacggggcccgttacggtccttccttaatgccaggtggtgccgaagaagcttggcctcacatcaaggacatcttccaatccatctctgctaaagccgacggtgaaccttgttgtgactgggtcggccctgccggggccggtcactacgtcaagatggtccacaacggtatcgaatacggtgacatgcaattgatctgtgaagcctacgatatcatgaaacgtatcggtggcttctccgacaaagaaatctcagacgtcttcgccacctggaacaagggggtcctagattccttcttaatcgaaatcaccagagatatcctagccttcaacgacaaagatggtaaaccattagtcgaaaaaatcttagacagtgctggccaaaagggtaccggtaaatggaccgccatcaacgccctagacttaggtatgcctgtcacccttatcggtgaagccgtctttgctcgttgtctatccgctttaaagagtgaaagaatcttggcctccaaacaattagccggcccaaccatcccagccgatgccatcaaggacaagaaacaattcgtcgacgaattagaacaagccttatacgcctccaagatcatgtcctacgcccaagggttcatgttgatcagagaagccgccaagacctacggttggaaattaaataacccagctatcgctttaatgtggagaggtggttgtatcatcagatctgtcttcttaggtgaaattaccaaagcttatagagaaaacccagatttagaaaacttattattgaacaaattcttctcagatgccgtcaccaaggctcaaaccggttggagaaagaccatcggtttagctaccacctacggtatcccaaccccaaccttctctaccgctttagccttctacgatggttacagatctgaaagattaccagctaacttattacaagctcaaagagattacttcggtgctcacactttcagagtcttaccagaagaagcttgtgaaactttaccagaaggtaaggatatccacatcaactggaccggtcacggtggtaacgtctcttcttccacttatgatgcttag

SEQ ID NO: 11977 - protein, 493 aa, Saccharomyces servazzii
MSQEAVADFGLIGLAVMGQNLILNVADHGFTVCAYNRTVSKVDDFLANEAKGKSIVGAKSIEEFIAKLKRPRKIMLLVKAGKPVDYIINDLLPHLEKGDIIIDGGNSHFPDTNRRYEELTKKGILFVGSGVSGGEDGARYGPSLMPGGAEEAWPHIKDIFQSISAKADGEPCCDWVGPAGAGHYVKMVHNGIEYGDMQLICEAYDIMKRIGGFSDKEISDVFATWNKGVLDSFLIEITRDILAFNDKDGKPLVEKILDSAGQKGTGKWTAINALDLGMPVTLIGEAVFARCLSALKSERILASKQLAGPTIPADAIKDKKQFVDELEQALYASKIMSYAQGFMLIREAAKTYGWKLNNPAIALMWRGGCIIRSVFLGEITKAYRENPDLENLLLNKFFSDAVTKAQTGWRKTIGLATTYGIPTPTFSTALAFYDGYRSERLPANLLQAQRDYFGAHTFRVLPEEACETLPEGKDIHINWTGHGGNVSSSTYDA

SEQ ID NO: 11978 - DNA, 1470 bp, Saccharomyces bayanus
  CDS (1)..(1470)
atgtctgctgatttcggtttgattggtttggccgtcatgggtcaaaacttgatcttaaacgctgctgatcacggtttcactgtttgtgcttacaacagaactcaatccaaggttgaccatttcttggctaacgaagccaaaggtaagtctatcattggtgctacttccattcaagatttcatttccaagttgaagagacctagaaaggtcatgcttttggttaaagccggtgctccagtcgacgccttgatcaaggaaattgttccacttttggaaaagggcgacatcatcatcgatggtggtaactcccatttcccagactctaacagacgttacgaagaattgaagaagcacggtattcttttcgtcggttccggtgtctctggtggtgaagatggtgcccgttatggtccatctttgatgccaggtggttctgaagaagcttggccacacatcaagaacatcttccaatctatctccgcaaagtctgatggtgaaccatgttgtgaatgggtcggcccagctggtgccggtcactacgtcaaaatggtccacaacggtatcgaatatggtgacatgcaattgatttgtgaagcttacgatatcatgaagagattgggtggattcactgacaaagaaatcagtgaagttttcaccacatggaacaagggtgtccttgactctttcttgattgaaattaccagagatatcttgaaattcgacgatgtcgacggtaagccattggtggaaaaaatcatggatactgccggccaaaagggtaccggtaagtggactgccatcaacgccttggacttgggtatgccagtcaccttgatcggtgaagctgtctttgctcgttgtctatctgccttgaagaatgaaagagtcagagcttctaaggttttgccaggcccacaagttccaaaggacgccgtcaaggacagaaagcaatttgtcgatgatttggaacaagctttgtacgcttctaagatcatctcctacgctcaaggtttcatgttgatccgtgaagccgctgccacatacggatggaaactaaacaaccctgctattgctttgatgtggagaggtggttgtatcattagatctgttttcttggccgaaatcaccaaggcttatagacaagaaccagacctagaaaacttgttgttcaacaagttcttcgccgatgctgttaccaaggctcaatctggttggagaaaatccattgcattggctaccacatacggtatcccaaccccagccttttccactgctttgaccttctacgacgggtacagatctgaaagattaccagccaacttactacaagctcaacgtgattacttcggtgctcacactttcagagtcttgccagaatgtgcatccgaaaacttgccagaagacaaggatattcatatcaactggaccggtcatggtggtaacgtttcttcctcaacataccaagcttaa

SEQ ID NO: 11979 - protein, 489 aa, Saccharomyces bayanus
MSADFGLIGLAVMGQNLILNAADHGFTVCAYNRTQSKVDHFLANEAKGKSIIGATSIQDFISKLKRPRKVMLLVKAGAPVDALIKEIVPLLEKGDIIIDGGNSHFPDSNRRYEELKKHGILFVGSGVSGGEDGARYGPSLMPGGSEEAWPHIKNIFQSISAKSDGEPCCEWVGPAGAGHYVKMVHNGIEYGDMQLICEAYDIMKRLGGFTDKEISEVFTTWNKGVLDSFLIEITRDILKFDDVDGKPLVEKIMDTAGQKGTGKWTAINALDLGMPVTLIGEAVFARCLSALKNERVRASKVLPGPQVPKDAVKDRKQFVDDLEQALYASKIISYAQGFMLIREAAATYGWKLNNPAIALMWRGGCIIRSVFLAEITKAYRQEPDLENLLFNKFFADAVTKAQSGWRKSIALATTYGIPTPAFSTALTFYDGYRSERLPANLLQAQRDYFGAHTFRVLPECASENLPEDKDIHINWTGHGGNVSSSTYQA

SEQ ID NO: 11980 - DNA, 1449 bp, Vibrio parahaemolyticus
  CDS (1)..(1449)
atgaaaggtgatatcggtgtaattggcctagcagtaatgggtcaaaaccttatcctaaacatgaacgaccacggttttaaagtggtagctcacaaccgtactgctgccaaagtagacgagtttctggaaggaccagcgaaaggcacgaacatcatcggtgcatactctctagaagaactagtagagaagctagaaacgccacgtaaagtgatgctaatggttcgcgcaggtgacgttgtcgataaattcatcgacgctctagtccctctactagacaaaggcgacatcatcatcgacggtggtaacacgaactacccagatacaaaccgtcgcgttgcagcactacgtgaaaaaggcatccacttcatcggtactggcgtatctggtggcgaagaaggtgcccgttttggcccatctatcatgcctggcggcgctccagaagcttgggaagcggttaagcctatcttccaaggtatttctgcgaaaactgacgcaggcgagccatgttgtgattgggttggtaacgatggtgcaggtcacttcgtgaagatggttcacaacggcatcgagtacggcgacatgcagctgatcactgaagcttaccagttcatgaaagacggtcttggtatgtctgcagatgaaatgcaagcggtattcgctgagtggaacaacactgagctaaatagctacctagttgaaatcaccgctgacatccttggctacaaagacgaagatggtgaacctctagttgaaaaaatcctagacactgctggccaaaaaggtacaggtaaatggacgggtatcaacgcactagacctaggtattccactaacgcttatctctgagtcagtattctctcgttgcctatctgcactaaaagatcaacgtgttgaagctgagaaactgttcggtaagaccatcacgccagtagaaggtgacaagcaagagtgggttgacgcactacgtcaagcgcttctagcgtctaagatcatctcttacgctcaaggctttatgctaatgcgcgaagcatcaaacgagaatggctgggatctaaactacggtaacgttgctcttatgtggcgtggtggttgtatcatccgttctgcgttcctaggcaacatccgtgatgcatatgaagcaaacccagaactagcattcctaggctctgatgattacttcaaaggtatcctacaaagcagcctagtagcatggcgtaaagttgcagctaagtctctggaagcaggcatcccaatgccatgtacgacttctgcactaacgttcctagacggctacacaacagctcgtctacctgcgaacctactgcaagctcaacgtgactacttcggtgctcacacttacgagcgtatcgaccgtgagcgtggtgaattcttccacactaactggacgggtacaggcggtaacacagcgtctacaacttacgacgtgtaa

SEQ ID NO: 11981 - protein, 482 aa, Vibrio parahaemolyticus
MKGDIGVIGLAVMGQNLILNMNDHGFKVVAHNRTAAKVDEFLEGPAKGTNIIGAYSLEELVEKLETPRKVMLMVRAGDVVDKFIDALVPLLDKGDIIIDGGNTNYPDTNRRVAALREKGIHFIGTGVSGGEEGARFGPSIMPGGAPEAWEAVKPIFQGISAKTDAGEPCCDWVGNDGAGHFVKMVHNGIEYGDMQLITEAYQFMKDGLGMSADEMQAVFAEWNNTELNSYLVEITADILGYKDEDGEPLVEKILDTAGQKGTGKWTGINALDLGIPLTLISESVFSRCLSALKDQRVEAEKLFGKTITPVEGDKQEWVDALRQALLASKIISYAQGFMLMREASNENGWDLNYGNVALMWRGGCIIRSAFLGNIRDAYEANPELAFLGSDDYFKGILQSSLVAWRKVAAKSLEAGIPMPCTTSALTFLDGYTTARLPANLLQAQRDYFGAHTYERIDRERGEFFHTNWTGTGGNTASTTYDV

SEQ ID NO: 11982 - DNA, 975 bp, Pseudomonas syringae
  CDS (1)..(975)
atgcaacttgggattattggactgggccgcatgggcggcaacattgcacggcgactgatgctggatggtcacactacagtggtgtatgaccgcgatgaggcatcacgcggcgccttggccaatgagggctctactgccgtcgctgatctggcggaactggtgagtgcactggaaaagccccgtgcagtctgggtcatgctcccggcaggcgctccgaccgaagacaccattcagaccctcagtcagttgcttgaagccgacgacgtgatcatcgatggcggtaacaccttctacaaggacgacattcgtcgtgcgcaggaactgagcgaaaaaggcctgcactatgtcgatgtcggcacgtccggtggcgtctggggccttgaacgcggctactgcatgatgatcggtggcgacgtggcggcagtcgagcgtcttgatccgctgttcgcgtccctcgcacccggccttggttcgatcgagcgcactcgcggtcgtacctcgaccgacgaccgcgcagagcgtggctacatccactcaggccctgcaggttcggggcatttcgtgaagatgatccacaacggcatcgagtacggaatgatgcaggccttcgccgaaggcttcgacctgctcaagcagaaaaactccgagcatctgccggccgagcagcgtttcgacctcaacactgcagacattgccgaggtctggcgtcgtggcagtgtggtttcatcctggctgctcgacctgaccgccgatgccctggcgactgacccgcaactcgacgctttttccggctcggtcgccgacagtggtgaaggacgctggaccatcgaggcggcgatcgagcaggccgtaccggttccggtgctctccagcgccttgttcgcgcgcttccgctcccgtcagacaagctcgtatgcagacaagatgctgtctgccatgcgctttggatttggtggccacaaggaacccaagtaa

SEQ ID NO: 11983 - protein, 324 aa, Pseudomonas syringae
MQLGIIGLGRMGGNIARRLMLDGHTTVVYDRDEASRGALANEGSTAVADLAELVSALEKPRAVWVMLPAGAPTEDTIQTLSQLLEADDVIIDGGNTFYKDDIRRAQELSEKGLHYVDVGTSGGVWGLERGYCMMIGGDVAAVERLDPLFASLAPGLGSIERTRGRTSTDDRAERGYIHSGPAGSGHFVKMIHNGIEYGMMQAFAEGFDLLKQKNSEHLPAEQRFDLNTADIAEVWRRGSVVSSWLLDLTADALATDPQLDAFSGSVADSGEGRWTIEAAIEQAVPVPVLSSALFARFRSRQTSSYADKMLSAMRFGFGGHKEPK

SEQ ID NO: 11984 - DNA, 984 bp, Pseudomonas putida
  CDS (1)..(984)
atgcaactgggaatcatcgggctgggccgtatgggcggcaatatcgcaaggcgcctgatgcgcgccggtcaccgcaccgtggtgcacgaccgcaaccgtgatgccatcaccggcctggagggcgaaggcgcccagggtgcgcatgacctcggtgcactggtacaaaagctgaaagcgccgcgcgcggtatgggtgatgctgccggctggtgacgccaccgagcagaccatcgcccagctggccgaaatgctggagccgggcgatgcgatcatcgacggcggcaacaccttctacaaggacgacatgcgccgcgctgcagaactggccaagcgcggcctgcattatctggacgtcgggacttccggcggcgtgtggggcctggaccgcggctactgcatgatgatcggcggcgaaaaggacgtgttcgagcgcctggaaccgctgttcaaggcgctggcgccgggcgtgggcgacatcccgcgtacccatggccgcagcggcgagcaccagcgtgccgagcacggctacatccatgccggtccaccgggcgccgggcactacgtgaaaatggtgcataacggcatcgagtacggcctgatgcaggcctatgccgaaggcttcgacctgctgcgcagcaaaggcggcaacgagttgcccgaagaccagcgcttcgacctgaacgtagccgaaattgccgaagtgtggcgacgcggcagcgtggtgacctcgtggctgctcgaccttaccgccgatgcgctggtggccgaccctcagctgtcgcaattcagtggctcggtgtccgacagtggcgaaggccgctggaccatcgacgccgccgtcgagcaggcggtgccggtgccggtgttgtccagcgcactgttcgcgcgcttccgttcgcgccagcaacagggcacctacggtgacaagatcctctcggccatgcgcctgggcttcggtggccacgtcgagaagaaaggcgaatga

SEQ ID NO: 11985 - protein, 327 aa, Pseudomonas putida
MQLGIIGLGRMGGNIARRLMRAGHRTVVHDRNRDAITGLEGEGAQGAHDLGALVQKLKAPRAVWVMLPAGDATEQTIAQLAEMLEPGDAIIDGGNTFYKDDMRRAAELAKRGLHYLDVGTSGGVWGLDRGYCMMIGGEKDVFERLEPLFKALAPGVGDIPRTHGRSGEHQRAEHGYIHAGPPGAGHYVKMVHNGIEYGLMQAYAEGFDLLRSKGGNELPEDQRFDLNVAEIAEVWRRGSVVTSWLLDLTADALVADPQLSQFSGSVSDSGEGRWTIDAAVEQAVPVPVLSSALFARFRSRQQQGTYGDKILSAMRLGFGGHVEKKGE

SEQ ID NO: 11986 - DNA, 1437 bp, Lactobacillus plantarum
  CDS (1)..(1437)
atgagtaatgaaaaaccacaaattggtgtcattgggatggccgtcatgggtaagaacctggcgttgaacatcgaaagccgcggctacaaggttgcgatttttaatcggactggtgccaaaactgaaaaggtcgttaaggaccatgctgacaagcaattagtaccaagttataagatcgaagacttcgtggcttcacttgaaacgccacgacggattatcatgatggttaaggctggtaagccaaccgatgccgttatcgatgaattattaccactattagataaaggcgacgtcttgattgatggtgggaacaccaactttaatgacacgatggcacgtaacgcccgcttagataaatccggaatcaactttattggtatgggtgtttccggtggtgaattaggtgccttacaaggtccttcattgatgcctggtggtcaaaaggaagcttatgatttagttgccccaatcttggaaaagatttctgctaaagcgcctcaagacggtgcaccatgtgtgacttacatcggcccgaacggtgctggtcactacgttaagatggtccacaacgggattgaatacggtgatgaagagttaatcgatgaatcatacaatatcatgcgcaacgtcgcgggcttgtccgttgatgaaatgtccgatatttttacggactggaacaaaggcgaattgagcagttacttgatcgaaatcaccgctgacattttgtcacgtaaggatgatttaggtgcggataagactaagccaatcgttgacatgatcttagaccgtgggaacaacaaaggaactggtaagtggagttccgaagatgccttgaacgttcaagtgccacaatccgttattacggaagcggtctatgcgcgttacatctcaatgatgaagaacgaacgggttgccgcttctaagaaattagctggcccaaccgctgacgttgacttgccagccaaggaagaattggttgagaagattcgtcaagccctctacttcagtaagattatgagttatgcgcaaggcttcgaacaacttcgtttcgcttctgaacattatggttgggacttgaagttcggtgaacttgcccaaatctggcgtgctggttgtatcatccgggcccaattcttacaaaacatcacggatgcttttgataagaagcctgatttaaataacttattgatggacgactactttgccgacatcgccgccaagtatcaacaatcaacacgtgaagtgcttagcttagcaatccaagctggtgtaccggtaccatcatttagtgcggcattgtcatactacgactcataccgggccgaagtgttacctgctaacttgttgcaagcgcaacgggactactttggtgcgcatacgtatgaacggactgaccgtgaagggttataccattacagttggtacgaagaacaataa

SEQ ID NO: 11987 - protein, 478 aa, Lactobacillus plantarum
MSNEKPQIGVIGMAVMGKNLALNIESRGYKVAIFNRTGAKTEKVVKDHADKQLVPSYKIEDFVASLETPRRIIMMVKAGKPTDAVIDELLPLLDKGDVLIDGGNTNFNDTMARNARLDKSGINFIGMGVSGGELGALQGPSLMPGGQKEAYDLVAPILEKISAKAPQDGAPCVTYIGPNGAGHYVKMVHNGIEYGDEELIDESYNIMRNVAGLSVDEMSDIFTDWNKGELSSYLIEITADILSRKDDLGADKTKPIVDMILDRGNNKGTGKWSSEDALNVQVPQSVITEAVYARYISMMKNERVAASKKLAGPTADVDLPAKEELVEKIRQALYFSKIMSYAQGFEQLRFASEHYGWDLKFGELAQIWRAGCIIRAQFLQNITDAFDKKPDLNNLLMDDYFADIAAKYQQSTREVLSLAIQAGVPVPSFSAALSYYDSYRAEVLPANLLQAQRDYFGAHTYERTDREGLYHYSWYEEQ

SEQ ID NO: 11988 - DNA, 897 bp, Lactobacillus plantarum
  CDS (1)..(897)
atgaaattaggattgattggcttaggtaaaatgggaatgaacttagcgttgaacatgcaggataacgggcacacgccagtgggaatggatcttaaccccactaatcttagtaccgccagtgctcacgggttggcgacggccacggatctcaccaatttgcttgaccagttgccaacaccacggatcgtgtggatcatggtacccgctggtaaggcaaccaacagcgttatcgaacagttagcccagactttaagtgcaggtgacatcgtcctcgatggcggtaattcgcactatcaagatagtatccgccacggcgaattactggcaagtcaccacatcaacttcttagacgtcgggacgtcgggcggtcaagctggtgcacgccacgacggcaattttatgattggtggcgacctcgccactttccaagtcgtcgaaccactatttaaagcgattgccgctcccgatgggtatttgtacaccggccctgttggcagtggtcattacctgaagatggtccacaacggaattgagtatggtatgatggcagcaataggtgaaggctttgacgttttacagcatagtcagttcacttacgacaacgcggccgtcgccaaaatgtggaataacggctcagtcattcgcagctggttaatgggcttagctcaagatgcattcagcaaggatggtaatctagatgacatcaagggtgttatgcattcatccggtgaaggtcgctggaccttagacacggccctagaccaacaagtcgccaccccggtcattgcgatggccttgatgatgcgctaccgttcagaaaccgatgacacattcactggtaaagttgttgccgccctacgtaacgagtttggtggccacgctgtcgatcacgaatag

SEQ ID NO: 11989 - protein, 298 aa, Lactobacillus plantarum
MKLGLIGLGKMGMNLALNMQDNGHTPVGMDLNPTNLSTASAHGLATATDLTNLLDQLPTPRIVWIMVPAGKATNSVIEQLAQTLSAGDIVLDGGNSHYQDSIRHGELLASHHINFLDVGTSGGQAGARHDGNFMIGGDLATFQVVEPLFKAIAAPDGYLYTGPVGSGHYLKMVHNGIEYGMMAAIGEGFDVLQHSQFTYDNAAVAKMWNNGSVIRSWLMGLAQDAFSKDGNLDDIKGVMHSSGEGRWTLDTALDQQVATPVIAMALMMRYRSETDDTFTGKVVAALRNEFGGHAVDHE

SEQ ID NO: 11990 - DNA, 1422 bp, Clostridium tetani
  CDS (1)..(1422)
atgaataaacaggatattggattaattggtttatctgtaatgggaagtaatttagcattaaatatggcagataaggggtataaagttgctatatttaatcgtaccactacagtaatagatgaagtattagaaaaatataagcattctaacttatttgggaaatatagtttaaaacaattgatggactcccttgaaagaccaagaaaaattataatgatgattaaatcaggggagcctgtagatatgcttattgaacaaatattaccttatttggatgaggaagatattttaattgatggcggaaattcttattttaaggatactcaaagaagaagtaaatatttaaaagaaaaaggaataaaatttttaggtgttggaatttcaggaggggaagaaggtgcaagatttggtcctgctataatgccgggaggagattttggctcttatgaaaaagtaaaatgtatttttgaagatattgcagcaaaggtaaatggtgaaccctgttgcaattatgtaggagaaaatggagctggacattatgttaagatggtgcataatggtatagaatatgctgatatgcagttaattagtgaagcttatatgctattaaaacatttaggaaagtttaataataaagaattacatggaatttttgcaaaatggaatgaaggggaattagaaagttatttaattaaaattacttctaatatatttacagtaaaggatagagaaactaataattatcttttggatatgattttagataaggcatctcaaaagggaactggaaagtggactaatatggaagcaatagatttaggggtagatgtatccattataacaagtgctttaaatggtagatttatgtccaatttaaaagaagaaagattaagagcaagtaaaatcttaaatggtaaagtagaaagttctattaatatagaaaaagaagaatttgcagaacttgtaagacgtagtttatatttaagcaagatagcatgctatgcacaaggatttcaattattaaaagttgcttcaaagacttataactgggatttacaatatggaaatattgcaaggatttttagaggtggatgtattattcaagctagatttttaaaggatataattagtgcctatgaagaaaataataatgcttgcaatctaatgattacaaaggttttttcaaaggttataaatgaatatgataagagtttgagaaagactatatccattgcaattaatcagggaattcctgtaactgctatgagtagtgccctaggatatatggacacatatagaagttacaatttaggtgcaaatttaatacaggctcaaagggactattttggagcacatacttttcaacgcatagataaagaaggaaattttcattatgattgggtgaataactatgaaaaataa

SEQ ID NO: 11991 - protein, 473 aa, Clostridium tetani
MNKQDIGLIGLSVMGSNLALNMADKGYKVAIFNRTTTVIDEVLEKYKHSNLFGKYSLKQLMDSLERPRKIIMMIKSGEPVDMLIEQILPYLDEEDILIDGGNSYFKDTQRRSKYLKEKGIKFLGVGISGGEEGARFGPAIMPGGDFGSYEKVKCIFEDIAAKVNGEPCCNYVGENGAGHYVKMVHNGIEYADMQLISEAYMLLKHLGKFNNKELHGIFAKWNEGELESYLIKITSNIFTVKDRETNNYLLDMILDKASQKGTGKWTNMEAIDLGVDVSIITSALNGRFMSNLKEERLRASKILNGKVESSINIEKEEFAELVRRSLYLSKIACYAQGFQLLKVASKTYNWDLQYGNIARIFRGGCIIQARFLKDIISAYEENNNACNLMITKVFSKVINEYDKSLRKTISIAINQGIPVTAMSSALGYMDTYRSYNLGANLIQAQRDYFGAHTFQRIDKEGNFHYDWVNNYEK

SEQ ID NO: 11992 - DNA, 999 bp, Bradyrhizobium japonicum
  CDS (1)..(999)
atgcaactcggcatgatcggcctcggccggatgggcggcaacatcgttcgccggctgatgcgccacggccattcgaccgtggtctatgacaaggacgccaaggccgtcgccggccttgccgcagacggcgcggtaggctcggcgacgctggaggagttcgtcgcaaagctggagcggccgcgcacggcctgggtgatgctgcctgcgggacgcatcaccgagacgacgatcgacacgatcgcgggcgtgatgcaggaaggcgacgtcatcatcgacggcggcaacaccttctggcaggacgacgtccgccgcggcaaggcgctgaaggcacgcggcatccactatgtcgacgttggcacctccggcggcgtctggggtctcgaccgcggctattgcatgatgatcggcggcgagaaacaggtggtcgaccggctcgatccgatcttcgccgcgctcgcgcccggcgccggcgacattccgcgcacggaaggacgtgaggggcgcgatccccgcatcgagcagggctatatccacgccggccccgtcggcgccggccacttcgtcaagatgatccacaacggcatcgaatacggcctgatgcaggcctatgccgaagggttcgacatcctcaagaacgccaacatcgatgccttgccggcggaccatcgctacgatttcgatctcgccgacatcgcagaagtctggcggcgcggcagcgtgatcccgtcctggctgctcgatctcacctcgacggcgctcgccgacagcccggcattggcggaatattccggcttcgtcgaagattccggcgaaggccgctggaccgtgaatgcggcgatcgacgaagcggtgccggccgaagttctgaccgcggcgctctacacacgtttccgttcccgcaaggaacacaccttcgccgaaaaaattctctccgcgatgcgcgcgggtttcggcggccacaaggagccgaagcagccgggcgcttcgaagcccaaataa

SEQ ID NO: 11993 - protein, 332 aa, Bradyrhizobium japonicum
MQLGMIGLGRMGGNIVRRLMRHGHSTVVYDKDAKAVAGLAADGAVGSATLEEFVAKLERPRTAWVMLPAGRITETTIDTIAGVMQEGDVIIDGGNTFWQDDVRRGKALKARGIHYVDVGTSGGVWGLDRGYCMMIGGEKQVVDRLDPIFAALAPGAGDIPRTEGREGRDPRIEQGYIHAGPVGAGHFVKMIHNGIEYGLMQAYAEGFDILKNANIDALPADHRYDFDLADIAEVWRRGSVIPSWLLDLTSTALADSPALAEYSGFVEDSGEGRWTVNAAIDEAVPAEVLTAALYTRFRSRKEHTFAEKILSAMRAGFGGHKEPKQPGASKPK

SEQ ID NO: 11994 - DNA, 1476 bp, Bacteroides thetaiotaomicron
  CDS (1)..(1476)
atggcaaatcagaataaaacagatatcgggttgatcggtctggcagtgatgggtgagaaccttgctttgaatatggaaagcaagggctggcacgtctctgtttacaatcgtaccgtccccggagtggaagaaggagtagtagaccgcttcatgaatggtcgtgcaaaaggtaaaaacattgaaggttttacagatataaaggcttttgtggaatcaatcgccacccctcgcaagattatgatgatggtacgtgccggcagtccggtagacgaactgatggatcagcttttccctttgctttctcccggagatattctgattgacggtggtaattctaattacgaagataccaatcgccgtgtaaaattagcagaatcgaaaggcttcttgtttgtaggaagcggagtgtcgggcggtgaggaaggtgcgttgaacggtgcttccatcatgcccggaggatcggagaaagcgtggccggaagtgaagcctgtcttgcagagcatcgcggcgaaagcgccggacggaactccctgttgccagtgggtaggccctgccggatcgggacattttgtgaagatgattcacaatggtatcgaatacggtgatatgcagttgatcgccgaggcttactgggtgatgaagaatctcattgatctgacgaatgaggagatggcggacgtttttgcccgttggaatgaagggaagttgcgcagttatctgattgagattacttctaatattttgcgtcacaaggataaatccggtgggtatctgatcgataagattctcgatgctgccggacagaaggggacgggaaagtggtctgtcatcaatgcgatggagttggggatgccgttgggcttgattgccacggcggtgttcgaacgcagtctgtcggctcagaaggagttgcgtcatctggcttccaagcagttcttgtgcaagcatacattacctatatataataaggcggaattggtgaaggagatattttctgcgctttacgcttccaagctggtgtcgtatgcgcagggttttgctgtgttgcagcgggcttctgattctttcggatggaatctggatttggcttccattgcccgtatgtggcgtgggggatgtatcatccgcagtattttcctgaatgatatagctgctgcttttgaggcggcggataagccgaagcatttgttgctggctccttacttccgtgaggagatcaagtctttgctccccggatggaagaatctggtggcggaggcgatgaaggaggaattgcctgttccggctttctcttcggctttgaattatttttattcgctgacttctgacaatttacctgccaatctggtgcaggcgcaacgagattatttcggtgcgcatacgtttgagaggaaggatgagctgcgcggacagttctttcatgagaattggacggggcacggaggggagacgaagtcggggacttataatgtatga

SEQ ID NO: 11995 - protein, 491 aa, Bacteroides thetaiotaomicron
MANQNKTDIGLIGLAVMGENLALNMESKGWHVSVYNRTVPGVEEGVVDRFMNGRAKGKNIEGFTDIKAFVESIATPRKIMMMVRAGSPVDELMDQLFPLLSPGDILIDGGNSNYEDTNRRVKLAESKGFLFVGSGVSGGEEGALNGASIMPGGSEKAWPEVKPVLQSIAAKAPDGTPCCQWVGPAGSGHFVKMIHNGIEYGDMQLIAEAYWVMKNLIDLTNEEMADVFARWNEGKLRSYLIEITSNILRHKDKSGGYLIDKILDAAGQKGTGKWSVINAMELGMPLGLIATAVFERSLSAQKELRHLASKQFLCKHTLPIYNKAELVKEIFSALYASKLVSYAQGFAVLQRASDSFGWNLDLASIARMWRGGCIIRSIFLNDIAAAFEAADKPKHLLLAPYFREEIKSLLPGWKNLVAEAMKEELPVPAFSSALNYFYSLTSDNLPANLVQAQRDYFGAHTFERKDELRGQFFHENWTGHGGETKSGTYNV

SEQ ID NO: 11996 - DNA, 1398 bp, Oceanobacillus iheyensis
  CDS (1)..(1398)
atgaattctattggagtatttggactaggtgtgatgggtgcaaatcttgcgatgaacatggcaaataaaggagaaaaagttgccgtttataactatacatctgacctaacagaaaaatttaaatccaattttacaagtgataatgcagaggcacattatgacttagagcgttttgtaaattcattagaaaaaccaagaaaagtatttttaatggtaacagcaggtcccgttattgattcggttattgattccttagtacctctactagataaagatgacattatgatggacggaggaaattctaattttaatgattcgaaccgtcgttatcatcgcttaaaagaagctggtatacattttgtcagtgtaggtgtttctggtggagaagaaggagcgcttcatggaccagcacttatgccgagtggtgatgaaaaagtatatcaagaagttgcacctatcttagaaaaaatagcagcacaagttgatggtaaagcatgttgtggttatttaggtaaagaaggttctggacattatgtgaaaatggtgcataacggcattgaatatgctgatatgcagctgatcacagaggcttatcagttcttgcgtgaaagactgggtctatcagttgaagaaatcgcaactacatttcgtgagtggaatgaaggagaactagaaagctatttaatggaaataacgagtgatattttaacgcatgtcgatgaagaaacgaataagccaatggttgatgttattttagataaatccggtcaaaaaggtactgggaaatggacaagccaaaatgcattggatgtaggtgttccgttatctattattacagaatcagtatttgcacgattcttatcgggcttaaaagaagaacgtgtacgggcggatcaaatgttgtcaggtccaacgaaactagaccaagacctcgataagcaagcgtggttagaacttgtgagaaaagcactgtttatgggcaaaatatgtgcgtatgcacaagggtttcaccaatataagcaagcatctgaagcctatggttgggatttaaaactagaagaaattgcgttgatatttagaggtggatgcattatccgagctggtattctgaatgaaattagtgatgcatttaaagcagataaacaactaccgaacttattgctatcgccattcttccaagagaagatgaatgactatcaagcttcattacgtaaagttgttataaaagggatggaaagtggactttccttaccaagtttaggagcatctttaacttactatgatgggtaccgctcttctcaaagtggcgccaatatgattcaagcacagcgggactattttggtgcacatacgtatgagcgagtggataaaaaaggaactttccatacagcgtggtaa

SEQ ID NO: 11997 - protein, 465 aa, Oceanobacillus iheyensis
MNSIGVFGLGVMGANLAMNMANKGEKVAVYNYTSDLTEKFKSNFTSDNAEAHYDLERFVNSLEKPRKVFLMVTAGPVIDSVIDSLVPLLDKDDIMMDGGNSNFNDSNRRYHRLKEAGIHFVSVGVSGGEEGALHGPALMPSGDEKVYQEVAPILEKIAAQVDGKACCGYLGKEGSGHYVKMVHNGIEYADMQLITEAYQFLRERLGLSVEEIATTFREWNEGELESYLMEITSDILTHVDEETNKPMVDVILDKSGQKGTGKWTSQNALDVGVPLSIITESVFARFLSGLKEERVRADQMLSGPTKLDQDLDKQAWLELVRKALFMGKICAYAQGFHQYKQASEAYGWDLKLEEIALIFRGGCIIRAGILNEISDAFKADKQLPNLLLSPFFQEKMNDYQASLRKVVIKGMESGLSLPSLGASLTYYDGYRSSQSGANMIQAQRDYFGAHTYERVDKKGTFHTAW

SEQ ID NO: 11998 - DNA, 1407 bp, Oceanobacillus iheyensis
  CDS (1)..(1407)
atgaaacaacaaattggtgttatcggcttagccgttatgggaaaaaatatcgcacttaacatggaaagcaaaggcttttctgtagctgtttttaatcgttcttacgagaagacagagaacttcttagcgaatgaagcaagcgggaaaaaatttattggtgcaaaaacaattgaagaatttgtggattcattggaaaaaccacgtaagatcatgttgatggtaaaagctggtccagcaacggatgctacgattgaatcattgaaaccacatcttgataaaggcgatattcttatcgacggtggaaatacattatatgaagatacgattcgtcgtaataaagaattagatgagtctggaattcatttcattgggacaggtgtttctggtggcgaagagggagctttaaatggtccttctattatgccaggtggacaagcagaagcgtataaattagttgctcctatttttgaagcgatatctgcaaaagtagataaagatccatgtgtaacctatattgggccaaatggcgcggggcactttgtgaaaatggttcataatggaattgaatatggagatatgcaattaatcgcagaagcatatgatttaatgaaaaatgttctaggacttgatgcaaaagagcttcacaacgtattcaaggaatggaatgatggagaattagacagttatctgattgaaataactgcagatatcttcactaaagtggatgaagagactgggaagcctctagtggaggtaattctagataaagcaggtcaaaaagggactggaaaatggacgagtaaaaatgcacttgatttaggagtaccgcttccattaattacagagtctgtgtttgcacgctttatttcatccttaaaagatgagcgtgttcgtgcaagcaaagaattgagtggaccaacgaatgcaatgctaggtgaaagtaaagaggagcttatcgaagcaatccgtcaagcactttatatgagtaagatcgtatcttatgcgcaagggtttgctcaaatgcgagcagcttctgatgagtacgattggaatttaagttatggtgacatcgcaatgatttggcgtggcggatgtatcattcgtgcgaagttcctacaaaagatcaaagatgcctatgacagagattctcaattaccgaacttaatgctcgacccttacttcaaggaaattgtagaaggctaccagtcttcattacgaaaagttgtatctctagcggttgcacatggtattgcagttccaacgttctcaagtgcaattgcatactatgatagctatcgttcagaagatttaccagcaaatcttattcaagcacaacgtgactactttggtgcacacacgtatgagcgaaaagataaagacggcatattccactctcagtggttttaa

SEQ ID NO: 11999 - protein, 468 aa, Oceanobacillus iheyensis
MKQQIGVIGLAVMGKNIALNMESKGFSVAVFNRSYEKTENFLANEASGKKFIGAKTIEEFVDSLEKPRKIMLMVKAGPATDATIESLKPHLDKGDILIDGGNTLYEDTIRRNKELDESGIHFIGTGVSGGEEGALNGPSIMPGGQAEAYKLVAPIFEAISAKVDKDPCVTYIGPNGAGHFVKMVHNGIEYGDMQLIAEAYDLMKNVLGLDAKELHNVFKEWNDGELDSYLIEITADIFTKVDEETGKPLVEVILDKAGQKGTGKWTSKNALDLGVPLPLITESVFARFISSLKDERVRASKELSGPTNAMLGESKEELIEAIRQALYMSKIVSYAQGFAQMRAASDEYDWNLSYGDIAMIWRGGCIIRAKFLQKIKDAYDRDSQLPNLMLDPYFKEIVEGYQSSLRKVVSLAVAHGIAVPTFSSAIAYYDSYRSEDLPANLIQAQRDYFGAHTYERKDKDGIFHSQWF

SEQ ID NO: 12000 - DNA, 1443 bp, Synechococcus elongatus
  CDS (1)..(1443)
atgtcacagcaagatttcggcgtcattggcctcgccgtcatgggggaaaaccttgccctcaacgtagagcgaaatggattttccgtggcggtttataatcgcacacctgcccgcaccgaagcgttcatggccgaacgagccgcaggccgtcgcttcaaggccacctatactcttgaggaattggttgcctccctgtcacgtcctcgccgcattttggcaatggtcaaagcagggcaacctgtggatgatctgatccagcagctcaagcccctccttgaacccggtgatatcctcattgatgggggcaactccctctataccgatacggaacgccgcgttgccgaaatggagtcagcaggactttgcttctttggtatgggggtcagcggtggtgaagaaggtgcccttaatggcccaagtctgatgccgggcggtagtcgtgaagcctaccaagccctcgaacccattctcaccaaaattgcagcacaagtggatgatggcccctgtgtcacctacattggaccggggggctcggggcactttgttaagatggtgcacaacggtattgagtatggcgatatgcaactcattgccgaggcctatgacctcctaaaaaacctccttggtctcaatcaccagcaactccatgaagtcttcaagagctggaatgaaacccccgaactcaactcatttttgattgaaattactagccagattttcacctatattgacccagaaacccatctgcccctggtggatgtcattgtggatgcggcaggtcaaaagggaactggtcgctggacggtggaaagtgctcttgagatgggggtggcgattccaacaattaccgctgccgtgaatgctcgcataatgtcctccatcaaagccgaacggatggcggctgcccaagtgctccctggtcctgcggctcactttagcggcaataccgaagaattcattggcaaaattcgcgatgccctctactgctcgaaaatctgctcctatgctcaaggcatggccctgattgccaaaggctcccaagagctctttgatcaccaactgaacctgagtgagattgcccgcatctggaaagggggctgcattattcgggctggcttcctcaataagatcaagcaggcctacagcgaaaatcctcaattggccaatttgctgctggcgccggagtttcgccagaccatcctggataagcaggcggcgtggcgggaggttttggtggaagcgacccgtgcaggaattgctgtacccgcctttggtgcctccctagaatacttcgatagctatcggcgcgatcgcctaccgcagaatctcacccaagcgcagcgggacttctttggtgcccacacctatgagcgaatcgacaaaccgggaaccttccatacggagtgggtaccgattcaggaggcgggcaaagcctctgtttga

SEQ ID NO: 12001 - protein, 480 aa, Synechococcus elongatus
MSQQDFGVIGLAVMGENLALNVERNGFSVAVYNRTPARTEAFMAERAAGRRFKATYTLEELVASLSRPRRILAMVKAGQPVDDLIQQLKPLLEPGDILIDGGNSLYTDTERRVAEMESAGLCFFGMGVSGGEEGALNGPSLMPGGSREAYQALEPILTKIAAQVDDGPCVTYIGPGGSGHFVKMVHNGIEYGDMQLIAEAYDLLKNLLGLNHQQLHEVFKSWNETPELNSFLIEITSQIFTYIDPETHLPLVDVIVDAAGQKGTGRWTVESALEMGVAIPTITAAVNARIMSSIKAERMAAAQVLPGPAAHFSGNTEEFIGKIRDALYCSKICSYAQGMALIAKGSQELFDHQLNLSEIARIWKGGCIIRAGFLNKIKQAYSENPQLANLLLAPEFRQTILDKQAAWREVLVEATRAGIAVPAFGASLEYFDSYRRDRLPQNLTQAQRDFFGAHTYERIDKPGTFHTEWVPIQEAGKASV

SEQ ID NO: 12002 - DNA, 1527 bp, Shewanella oneidensis
  CDS (1)..(1527)
atgcaaaaccacagcaatcttaatgacattggcgtgattggacttggtgtgatgggtaaaaacctcgcgctaaacatcgccgacaatcaatatcgcgtcagtgtcttcgatctcgatcctgttaaagtcaacggggttttacaacaagaaaaacaagagcgtgtaggacaggaactacgtataacaggctgtgctaatctttcagaaatgttagccagcctcactaaacctcgtattctggtactctctgtccccgcaggtgcgcctgtggatggggtatgtgctgctttaatttctgccggtatcgaagctgacgatatcgttatcgatacgggtaatagtctttggacagacaccgttgagcgtgaacaacattaccaaggacagtttattttcttcagctcagccgtttcgggtggtgaagtgggggcacgttttggcccttcgttaatgccaagtggcgatcttggcgcttggcaacatgtggcaccgatttggaaggctatcgccgctaaggtcaaccctcaaactgggttgccgattgagcgttttgaaccgggtaatccagtaacagaaggcgagccttgcaccacttatattggccctgctggtgctgggcactatgtgaagatggtgcataacggcattgaatatgccgatatgcagctgatttgcgaagcttatcaattattgcatgatggccttggcatgagtgccgctgaagtgggcgaggtgtttgaacgctggaatcagggcagtttaaacagttatctcatgggcattagtgcagaggtattaaagcaagcagatccattaacaggcaaaccgttagttgagatgatcctcgataaagcgggacagaagggtacgggcctttggactgctgtgagcagtctgcaaattggttgtccggctcccaccattgccgaagccgtttatgctcgcgcggtaagcacccaaaaatccctacgtgttgagcttagtaaaaagctcgctggccctctatctccagcgatggatgaaaaccaaaaagccaacttaatcgatgccctagagagtgccctttattgcgctaaagtctgttgctacgcccaaggtttccaactgatggcgatgacggctctggagcaaaaatggcagctcgattttgctgagatcgcgaaaatctggcgtgcgggttgtattattcgtgccaccttcttgcaatcgataacccaggcttatcaagctgatgcgaacttaagttgtttattgatggccgatacttttgccagcactttatcggaaaaacaaaccgagtggcgcattgcagtggctgcggcgattatgcaagggatcccagtgccttgtattagttcggcgctcgcttattacgacagttatcgcagtgagaccctgcctgccaatttacttcaagggcaacgtgacttttttggcgcgcatacctttgaacgcttagataagcctgcaggtgagaaatatcatctagattggagcgcacaagaaagggttttaattaaactctaa

SEQ ID NO: 12003 - protein, 508 aa, Shewanella oneidensis
MQNHSNLNDIGVIGLGVMGKNLALNIADNQYRVSVFDLDPVKVNGVLQQEKQERVGQELRITGCANLSEMLASLTKPRILVLSVPAGAPVDGVCAALISAGIEADDIVIDTGNSLWTDTVEREQHYQGQFIFFSSAVSGGEVGARFGPSLMPSGDLGAWQHVAPIWKAIAAKVNPQTGLPIERFEPGNPVTEGEPCTTYIGPAGAGHYVKMVHNGIEYADMQLICEAYQLLHDGLGMSAAEVGEVFERWNQGSLNSYLMGISAEVLKQADPLTGKPLVEMILDKAGQKGTGLWTAVSSLQIGCPAPTIAEAVYARAVSTQKSLRVELSKKLAGPLSPAMDENQKANLIDALESALYCAKVCCYAQGFQLMAMTALEQKWQLDFAEIAKIWRAGCIIRATFLQSITQAYQADANLSCLLMADTFASTLSEKQTEWRIAVAAAIMQGIPVPCISSALAYYDSYRSETLPANLLQGQRDFFGAHTFERLDKPAGEKYHLDWSAQERVLIKL

SEQ ID NO: 12004 - DNA, 1473 bp, Corynebacterium efficiens
  CDS (1)..(1473)
atgcgtatgatcataactatgacaaacccagattccctcgcccagatcggtgtggtcggcctcgctgtaatggggtccaacctcgcccgcaacttcgcccgcaacggtcacaccgtcgctgtctacaaccgcagcaccgacaagaccgacaagctcatctccgattatgccaccgacggcaacttcatccccaccaagaccgtcgaggatttcgtcgccgccctggagaagccccgccgcgccatcgtcatggtgcaggccggtgccgccaccgacgccgtgatcaaccagcttgcggatgcgatggaggagggagacatcatcatcgatggtggtaacgctctctacaccgacaccgtgtgccgtgagaaggagatggcagcccgtggccgtcacttcgtcggtgccggtatctccggtggcgaggaaggtgccctcaacggcccgtccatcatgcccggtggcccgaaggaatcctgggaggctctcggcccgttgctggagtccatcgccgccaaggtggacggcgttccctgtgtgacccacatcggccctgatggagcgggccacttcgtcaagatggtccacaacggcatcgagtacgccgacatgcaggtcatcggcgaggcctaccagctgctgcgcttcggtgctggcatggagccggccgagatcgccgatgtcttcgccgagtggaacaagggcgatctggactcctacctcatcgagatcaccgccgaggtcctgcgccaggtcgacgccgagaccggcaagccgcttgtcgacgtcatcctcgacgccgcaggccagaagggcaccggccgttggacggtcaaggaggccctcgacctcggagtccctgtcaccggcatcggcgaggccgtcttcgcccgcgcactatcctcctccctcgatcagcgcaaggccgcacagggcaacctgccgaccggtgccctgaccacctttgaggagctgggtctggacaaggcggaattcgtcgaggatgtccgtcgcgcactgtacgcctccaagctggtggcctactcccagggcttcgatgagatcaaggccggttccgatgagcacaactggggtgttgacccccgcgacctggccaccatctggcgcggtggctgcatcatccgggcgaagttcctcaaccgcatcgtcgaggcctacgacaacgacccggagctgccctccctgctgctcgacccgtacttcaagggtgagctcgaggacctgatggactcctggcgccggatcgtcatctacgtcacccagctgggtctgccggcaccggtgttcacctcctccctggcctactacgactccctgcgtgccgagcgtctgccggccgccatcatccagggccagcgtgacttcttcggtgcacacacctaccaccgcatcgacaagccaggctccttccacaccctgtggtccggtgaccgcagcgagctggaggtctag

SEQ ID NO: 12005 - protein, 490 aa, Corynebacterium efficiens
MRMIITMTNPDSLAQIGVVGLAVMGSNLARNFARNGHTVAVYNRSTDKTDKLISDYATDGNFIPTKTVEDFVAALEKPRRAIVMVQAGAATDAVINQLADAMEEGDIIIDGGNALYTDTVCREKEMAARGRHFVGAGISGGEEGALNGPSIMPGGPKESWEALGPLLESIAAKVDGVPCVTHIGPDGAGHFVKMVHNGIEYADMQVIGEAYQLLRFGAGMEPAEIADVFAEWNKGDLDSYLIEITAEVLRQVDAETGKPLVDVILDAAGQKGTGRWTVKEALDLGVPVTGIGEAVFARALSSSLDQRKAAQGNLPTGALTTFEELGLDKAEFVEDVRRALYASKLVAYSQGFDEIKAGSDEHNWGVDPRDLATIWRGGCIIRAKFLNRIVEAYDNDPELPSLLLDPYFKGELEDLMDSWRRIVIYVTQLGLPAPVFTSSLAYYDSLRAERLPAAIIQGQRDFFGAHTYHRIDKPGSFHTLWSGDRSELEV

SEQ ID NO: 12006 - DNA, 1455 bp, Bifidobacterium longum
  CDS (1)..(1455)
atggccgaagctacagcaaacattggtgtgattggactggccacgatgggctccaatctggcgcgtaatctggcgcaccatggcaacacggtggcgttgttcaaccgccactactcgcgtaccgagaagctcatgaacgagcatggcaccgaaggcaacttcgtgccggccgaaacgctcgaggaattcgccgcgtccctgaagcgtccgcgtaccgccatcatcatggtcaaggccggtgctccgaccgacgcgaccatcgcgcagctggaagaggtgttcgaaccgggcgacatcatcgtcgacggtggcaactccttcttcaaggacaccatcaagcgtgagaaggaagtacgtgccaagggcttccacttcgtgggttgcggcgtgtccggtggtgaggaaggcgcgctcaacggcccgtctctgatgcccggtggcactgcggaatcctggaagaccttgggcccgattcttcagtccatcgccgccaaggtgaacggcgaaccgtgcgtgacccacatcggcaccgatggtgccggccactttgtcaagatggtgcacaacggcatcgagtatgccgatatgcaggtgattggtgaggcgtatgacattctgcgccgtggactcggcatggatgccgaggagattggcgacgtgttcgctgaatggaacaagggcgaccttgactcctacctgatcgagatcaccgctgagattctgcaccacaaggatgccgagaccggcaagccgttcgtggacgtggtcgtggatcatgccggcatgaagggtactggtacgtggaccgtgcagactggtctggaatgtggttctcctgtggctgccatcggtgaagccgtgttcgctcgtgcactgtcttcgcacggtgagctgcgtgaagacgctcagaaggaaggtctggctggaccgaacaagaccatcgatctggccggagaagacaaggccgcgttcgtcgaggacgtgcgcaaggctctgttcgcttccaaggtcgtggcctatgctcagggcctgaacgagattcaggacggtgccaaggaatacggctgggatatcaacctgtccgaagtggcccgcatttggcgtggcggctgcattattcgcgcccagttcctgctcgaccgcatcaccgaggccttcaggggcgataacccgccggcttccctgctgttcgatccgtacttcgagaagatcatcggcgaatcgcaggatgcatggcgtcgtgtaatcgtgcgtgccgtggaggccggtatcccgaccccggtgttctccagctccctggcgtactacgatggtctgcgctccaagcgcctgcctaccgctctgacccagtcccagcgtgacttcttcggtgcccacacctacggccgcgtagacaagcccggcgtgttccacacgctgtgggctgaagaaggcaagcctgaaatcgaggcgtag

SEQ ID NO: 12007 - protein, 484 aa, Bifidobacterium longum
MAEATANIGVIGLATMGSNLARNLAHHGNTVALFNRHYSRTEKLMNEHGTEGNFVPAETLEEFAASLKRPRTAIIMVKAGAPTDATIAQLEEVFEPGDIIVDGGNSFFKDTIKREKEVRAKGFHFVGCGVSGGEEGALNGPSLMPGGTAESWKTLGPILQSIAAKVNGEPCVTHIGTDGAGHFVKMVHNGIEYADMQVIGEAYDILRRGLGMDAEEIGDVFAEWNKGDLDSYLIEITAEILHHKDAETGKPFVDVVVDHAGMKGTGTWTVQTGLECGSPVAAIGEAVFARALSSHGELREDAQKEGLAGPNKTIDLAGEDKAAFVEDVRKALFASKVVAYAQGLNEIQDGAKEYGWDINLSEVARIWRGGCIIRAQFLLDRITEAFRGDNPPASLLFDPYFEKIIGESQDAWRRVIVRAVEAGIPTPVFSSSLAYYDGLRSKRLPTALTQSQRDFFGAHTYGRVDKPGVFHTLWAEEGKPEIEA

SEQ ID NO: 12008 - DNA, 1407 bp, Plasmodium falciparum
  CDS (1)..(1407)
atgtgtgatattggtttgataggtttggctgtcatgggccagaatttaagtttgaatatttcaagcaaaggttttaaaattggtgtttataataggacatatgaaagaacagaagaaacaatgaaaagagcaaaagaagagaatttggttgtttatggttataaaacagtagaagaattaataaataatttgaaaaaaccaaggaaagttattttattaatcaaagcaggtccagctgtagatgagaatattagtaatatattaaaacattttgaaaaaggagatataataattgatggtgggaatgaatggtatattaattcagaaagaagaataaaattatgtaaagaaaaagatgtagaatatttagctatgggtgtgagtggaggtgaagcaggtgcaagatatggttgttcatttatgcctggtggttctaaatatgcatatgattgtgtgaaagaaatattagaaaaatgttcagctcaagttggaaattctccttgtgttacttatataggtccaggttcctcagggaattatgtaaaaatggtacataatggaatagaatatggagatatgcaattaatatcagaaagttatgtaattatgaaacatatattaaaatatgataatcagaaattatcagaagtttttaataaatggaatgaaggtatattaaattcttacttaattgaaattactgcaaatattcttgcaaaaaaagatgacttaacaaataattatttagttgatatgatattagatattgctggagcaaaaggtacagggaaatggactatgcttgaagctaccgaaagaggtatcccttgtccaactatgtgtgctgctttagatgcacgtaatataagtgtttttaaagaattaagaactaaagcagaatctaattttaataaagataatattcttattgacccaaatgaagatttaaatgattttgaaaatgatttattaaatgctctttattgttgtaaaattatttcatatactcaaggtcttttccttttaaaacaagtttctgaagaaatgaactggaaattaaatttgggagaaattgctagaatatggagaggtggttgtattataagagctgttttcttagatcgtatagcaaatgcttataaaaataatgaaaaattagaattattattcctagataatgaattctcagatgatattaaaaataaattaccttccttaagaaaaattgttcttatggctacaaaatattccataccaattcctgccttctcagctagtttagcatattttcaaatggtaacctcacaaaatttacctcttaatttagtgcaagcccaaagggattattttggatcacacacatataggagaacagatcgtgaaggaaattatcacaccttgtggtga

SEQ ID NO: 12009 - protein, 468 aa, Plasmodium falciparum
MCDIGLIGLAVMGQNLSLNISSKGFKIGVYNRTYERTEETMKRAKEENLVVYGYKTVEELINNLKKPRKVILLIKAGPAVDENISNILKHFEKGDIIIDGGNEWYINSERRIKLCKEKDVEYLAMGVSGGEAGARYGCSFMPGGSKYAYDCVKEILEKCSAQVGNSPCVTYIGPGSSGNYVKMVHNGIEYGDMQLISESYVIMKHILKYDNQKLSEVFNKWNEGILNSYLIEITANILAKKDDLTNNYLVDMILDIAGAKGTGKWTMLEATERGIPCPTMCAALDARNISVFKELRTKAESNFNKDNILIDPNEDLNDFENDLLNALYCCKIISYTQGLFLLKQVSEEMNWKLNLGEIARIWRGGCIIRAVFLDRIANAYKNNEKLELLFLDNEFSDDIKNKLPSLRKIVLMATKYSIPIPAFSASLAYFQMVTSQNLPLNLVQAQRDYFGSHTYRRTDREGNYHTLW

SEQ ID NO: 12010 - DNA, 888 bp, Chlorobium tepidum
  CDS (1)..(888)
atgggctccaatatggtcgagcatctgcttgaacttggtcacgaagtagttgcattcgatctctcggcggaagcggtcaaagcgattgcggccaaaggggcgacggcggccagttcgttgcagcatctggtcggtgaacttgccgcgccgcgcgtcgtgtggatgatggtgcctgccggtcgtccggtcgatgcggtgatcgacggtctcacgccgtttctcagagcgggtgacatcgttatcgacggcggcaactcgcgctacaccgactcggtcgcccgagcggaaaagcttcgcaagcagggcatccggatgctcgacatcggtaccagcggcgggctggacggcgcccggcacggggcgtgcatgatggccgggggcgaccgcgaggcctatgagcacgtcgagccggtgctgcgcgacctctgcgtcgagaacggctacggctatatgggcgcgtctggctccgggcacttcgtgaagatggtgcacaacggcatcgaatacggcatgatgcaggcgatcggcgaagggttcgagctgctccgggccagcggctacgacctcgataaccagaatgtggcgcgggtctggtcgaacggttcggtcatccgtggctggctcatggatctggcgggcaaggcgttcgctcagggtaacgatctcggctggcttggcggcaaggtggccgattctggcgaggggcgctggacggtcgaggcggccatcgaactcggcgtggcggtaccgatcatctctggttcgctgttccggcgcttccagtcgcagaacgaagaacacttttctgacaaggtggttgctgcgcttcgccacgagttcggcgggcacgcctacgagaaacctggcgaaggggagggcaaagcatga

SEQ ID NO: 12011 - protein, 295 aa, Chlorobium tepidum
MGSNMVEHLLELGHEVVAFDLSAEAVKAIAAKGATAASSLQHLVGELAAPRVVWMMVPAGRPVDAVIDGLTPFLRAGDIVIDGGNSRYTDSVARAEKLRKQGIRMLDIGTSGGLDGARHGACMMAGGDREAYEHVEPVLRDLCVENGYGYMGASGSGHFVKMVHNGIEYGMMQAIGEGFELLRASGYDLDNQNVARVWSNGSVIRGWLMDLAGKAFAQGNDLGWLGGKVADSGEGRWTVEAAIELGVAVPIISGSLFRRFQSQNEEHFSDKVVAALRHEFGGHAYEKPGEGEGKA

SEQ ID NO: 12012 - DNA, 1639 bp, Arabidopsis thaliana
  CDS (62)..(1522)
accaccaacctccgtcaaaaccctaaaccactatctctctctctctcttcatatcgcaacaatggagtccgtcgctctatctcgcatcggtctcgccggtctcgcagtcatgggacaaaacctcgccttaaacatcgccgataaaggattcccaatctccgtctacaatcgaaccactcccaaagtcgacgaaaccttagatcgtgcctccaacgaaggaaaactcccagtcgctggtcaatactcgcctcgcgatttcgttctctcgatccaacggcctagatccgttatcatccttgtcaaagccggtgctcccgttgaccaaaccatcactgctctctctgaatacatggagcctggtgattgtatcatcgacggtggaaatgagtggtatcagaacacagagcgacgaatcgttgaagctgagaagaaaggattgctttatttaggtatgggagtctccggtggtgaagaaggagctcgtaatggtccttctcttatgcctggtggatctttcactgcgtataacaatgttaaagatattcttgagaaagttgctgctcaagtcgaagatggtccttgtgttacatacattggagaaggtggatctgggaattttgtgaaaatggttcataatgggattgaatatggtgatatgcagctgatttcggaggcgtatgacgtgttgaagaacgttggtggattgagtaatgatgaattggctgagatcttcacggagtggaatcgaggtgagcttgagagtttcttggttgagattacttcggatatatttagggttaaggatgattatggtgatggagagttagtggataagattttggataagactggtatgaaaggtacagggaaatggacggttcagcaggcggctgagctttctgttgcggcgcctacgattgctgcgtcgttggattgtagatacttgagtggattgaaggatgagagggagaatgctgctaaagttttggaagaagctggattgaaggaggatatcggttctgcgtctcgtggtgttgataagaagaggttgattgatgatgtgaggcaagctttgtatgcttctaagatctgtagttatgctcaagggatgaatttgcttagggctaagagtttagagaaaggttgggacttgaatttgggtgaaatggctaggatttggaaaggtgggtgtattatcagggcggttttcttggacaggatcaagaaagcttaccagagaaacacgaatttggcgagcttagtggttgatcctgattttgctaaagagatggttcagaggcaagctgcatggaggagagtggtgggtcttgctatatctgctgggattagcacaccaggaatgtgcgcaagtttagcgtatttcgacacttacaggcgtgctagattacctgcgaatcttcaggcgcagagagatctctttggagctcatacatatgagagaaccgatcgtcctggtgcataccacactgaatggactaagcttgcaaggaagagtcagtaaagcatggacacagtcccttgatttgagggctttatttcatcatagaacacgaaaacaaattgtttcagcttatttttgttgagttataataagaaatgcaatgccccttgactctcc

SEQ ID NO: 12013 - protein, 486 aa, Arabidopsis thaliana
MESVALSRIGLAGLAVMGQNLALNIADKGFPISVYNRTTPKVDETLDRASNEGKLPVAGQYSPRDFVLSIQRPRSVIILVKAGAPVDQTITALSEYMEPGDCIIDGGNEWYQNTERRIVEAEKKGLLYLGMGVSGGEEGARNGPSLMPGGSFTAYNNVKDILEKVAAQVEDGPCVTYIGEGGSGNFVKMVHNGIEYGDMQLISEAYDVLKNVGGLSNDELAEIFTEWNRGELESFLVEITSDIFRVKDDYGDGELVDKILDKTGMKGTGKWTVQQAAELSVAAPTIAASLDCRYLSGLKDERENAAKVLEEAGLKEDIGSASRGVDKKRLIDDVRQALYASKICSYAQGMNLLRAKSLEKGWDLNLGEMARIWKGGCIIRAVFLDRIKKAYQRNTNLASLVVDPDFAKEMVQRQAAWRRVVGLAISAGISTPGMCASLAYFDTYRRARLPANLQAQRDLFGAHTYERTDRPGAYHTEWTKLARKSQ

SEQ ID NO: 12014 - DNA, 1551 bp, Aspergillus oryzae
  CDS (1)..(1551): n means a or g or c or t/u, s means g or c
atgccgtcagaagaccagaaccaacagttcaaacgcattggcatcgttggagccgggaacatgggctccatgatggcctttgcgttctcggagctcggtcttgatgtttctatctgggacgtcaagaaagagaatgttgaccagctcttgcaatcggctaaggatattaaaggccaaggaaagatcgaaggatttgaagatattggcgaattcacccagagcttagagggtcagggagagcggaaactgttcatcttctccatcactcatggcgatcccgcggactccgttcttagtaagatcaagcatgcattgaagaaaggcgacattatcctagacggtggaaatgagaactaccgacgcacggaaaggagacagaaggagtgcgaagaaatcggcgttagttggattggaacgggtgtttccggcggatatcaatccgctcgccgtgggccgsgcttgtctcctggtggcgatgagaaggcgctggagcttgtactacctcttttggagcgctacgcagccaaggaccgcaagaccggtcaaccgtgtgtagccagagttggtcctgcgggctcggggcattttgtcaagatggtacacaacggcatcgagggtggcatgctttcggcggtcgccgaggcttggtctattcttcattacgggctagggctcaagtatgatgagatcggagacatctttgatgaatggaatcagaagggcgaactaaggaataatttcctcctcgatattggagccgacgtatgccacaggagaaaatcccccgaaggagacggcaaaggcgaaggaatcggtgagaagaacgaatacgtccttgatgatgttctcgacaaggttgtgcaagatgacgacgacaccgaaggcaccccctactggtgtgtgatggagacggccaatcgtcatgtttctgcaccgaccattgcaaccggtcattacatgcgtatcgccagtggtaatcgtgcagaacggctgcgagtggcggaaaaattgcgaatgccaaagcccaagcccattgagggcatcaaggaccgacggcttttcattgaagatctacggcgagcagtgtactgttgcttcctgtcgtccttctgtcagggtctcgaactaattgcccgcgcctctgatgacgaaggatggaatattgacctgagcaaatgtctccagatctggcgtggcggttgtattattcagtcagaagctattgccgaccttctacagcctttgcttaaaaaggacgtgcactatacaaatctgaaagacatcgacgaagtcgctcgtgcattgaaacataattttgactctctcaaacggattgtaattgactcgacagtgttcgatcaatacatcccggcgatttccgcgaccttggagtacctgaaatatgcgggtgggacgatgctaccaacgaaattcatggaagcccagatggacttattcggtgcccatgcatattacaagccaggagtacccggtgaggatccaggaccggtcaagaagggtcctcatcactatgagtggcggccagcttaa

SEQ ID NO: 12015 - protein, 516 aa, Aspergillus oryzae
  Xaa in position 153 is unknown
MPSEDQNQQFKRIGIVGAGNMGSMMAFAFSELGLDVSIWDVKKENVDQLLQSAKDIKGQGKIEGFEDIGEFTQSLEGQGERKLFIFSITHGDPADSVLSKIKHALKKGDIILDGGNENYRRTERRQKECEEIGVSWIGTGVSGGYQSARRGPXLSPGGDEKALELVLPLLERYAAKDRKTGQPCVARVGPAGSGHFVKMVHNGIEGGMLSAVAEAWSILHYGLGLKYDEIGDIFDEWNQKGELRNNFLLDIGADVCHRRKSPEGDGKGEGIGEKNEYVLDDVLDKVVQDDDDTEGTPYWCVMETANRHVSAPTIATGHYMRIASGNRAERLRVAEKLRMPKPKPIEGIKDRRLFIEDLRRAVYCCFLSSFCQGLELIARASDDEGWNIDLSKCLQIWRGGCIIQSEAIADLLQPLLKKDVHYTNLKDIDEVARALKHNFDSLKRIVIDSTVFDQYIPAISATLEYLKYAGGTMLPTKFMEAQMDLFGAHAYYKPGVPGEDPGPVKKGPHHYEWRPA

SEQ ID NO: 12016 - DNA, 1476 bp, Aspergillus oryzae
  CDS (1)..(1476)
atggctgaccaggcagttgctgacttcggtttgatcggtttggccgtcatgggccagaacctgatcatgaacgtcgccgatcacggtttcactgtttgcgcttacaaccgcacaacctccaaggttgaccgcttccttgaaaatgaggccaagggcaagtccattgtcggtgctcactccattgaggagttctgcgctaagctgaagcgtccccgccgtatcatgctcctggttatggctggaaagcccgtcgaccagttcattgagtctctcctgccccaccttgagaagggcgatatcatcattgatggtggtaactcccacttccccgacagcaaccgccgtaccaagtaccttgccgagaagggcatccgcttcgtcggtagcggtgtctctggtggtgaggagggtgcccgttacggtccctctctcatgcccggtggtaacgaggaggcctggcctttcattaaggatatcttccagagcattgccgccaagagcgaaggtgaggcttgctgcgactgggtcggtgatgagggtgccggccactacgtcaagatggtccacaacggtatcgagtatggtgacatgcagctgatctgtgaggcctatgatattctcaagcgtggtgttggcatgcccgtcaacgaaatcgccgaagtcttcgacaagtggaacaagggtgtcttggactccttcttgatcgaaatcacccgcgatgtcctccgcttcaacgatgacgacggcactcccctcgttgagaagatccttgacaaggccggccagaagggaaccggcaagtggaccgccatcaacgctcttgaccttggtatgcctgtcaccctgatcggtgaggctgtcttctctcgttgcctcagtgcccttaaggacgagcgtgtccgcgctagcagcctcctcccaggccccactcctcaattcaccggtgacaagcaggctttcgtcgatgatctggagcaggccctttatgcttctaagatcatctcctatgcccagggcttcatgctcatgcaggaggctgccaaggagtacggctggaagcttaacaagccttccatcgcccttatgtggcgtggtggctgcatcatccgctctgtcttcctgaaggacatcaccaacgcctaccgccagaaccccgaccttgagaacctcctcttcgacaagttcttcaacgaagccatcgccaaggcccagaacggctggagaaacgttgtcagcaagggtgctctctggggtatccctactcccgctttcagcactgctctcagcttctacgacggataccgcactcgggacctccccgccaacctgctgcaggctcagcgtgactacttcggtgcccacaccttccgcgtcaagcccgagcacgccaacgagacctaccctgagggcaaggacatccacgtcaactggactggacgtggtggtaatgtgtccgcctctacctacattgcttaa

SEQ ID NO: 12017 - protein, 491 aa, Aspergillus oryzae
MADQAVADFGLIGLAVMGQNLIMNVADHGFTVCAYNRTTSKVDRFLENEAKGKSIVGAHSIEEFCAKLKRPRRIMLLVMAGKPVDQFIESLLPHLEKGDIIIDGGNSHFPDSNRRTKYLAEKGIRFVGSGVSGGEEGARYGPSLMPGGNEEAWPFIKDIFQSIAAKSEGEACCDWVGDEGAGHYVKMVHNGIEYGDMQLICEAYDILKRGVGMPVNEIAEVFDKWNKGVLDSFLIEITRDVLRFNDDDGTPLVEKILDKAGQKGTGKWTAINALDLGMPVTLIGEAVFSRCLSALKDERVRASSLLPGPTPQFTGDKQAFVDDLEQALYASKIISYAQGFMLMQEAAKEYGWKLNKPSIALMWRGGCIIRSVFLKDITNAYRQNPDLENLLFDKFFNEAIAKAQNGWRNVVSKGALWGIPTPAFSTALSFYDGYRTRDLPANLLQAQRDYFGAHTFRVKPEHANETYPEGKDIHVNWTGRGGNVSASTYIA

SEQ ID NO: 12018 - DNA, 942 bp, Xanthomonas campestris
  CDS (1)..(942)
atggaactgggtatggtgggactgggccgcatgggcgccaacatggccgagcggctggtgcgcggcgggcatcgcgtgcatgggttcgatctgggcgctgcggcacgcaccagtgcgcaatccaagggcatccagacaaccgatgcgctggtcacgctggtctccgcactgccgagtccgcgcgtggtgtggctgatggtgccggccggcaagatcgtcgacgacacgctggcgcagctgctgccgttgctgcaggccggcgacatcgtcatcgacggcggtaattcgtattacaaggattcgcagcgccgcgccgcgcagctgcaatccagcggcattgcgtttgtcgattgcggcaccagcgggggcgtgtggggcttgcaggaaggctacagcctgatggtgggcggcgacgaagcggccgtgaccacgttgcatccggtgctggccacgttggcaccggcgccggacaagggctggggacgggtgggcccgagcggtgccggccacttcaccaagatggtccacaacggcatcgagtacggaatgatgcaggcctatgcggaaggcttcgcgctgctgcagcacaagaccgatttcgcgctggacctgcaccaggtcgccgagatctggcgcgatggcagcgtggtgcgttcgtggctgctggacctcaccgccgatgcgctggcgcacaacccgaccatgggcggcattgcgccgtatgtggccgattccggcgaaggccgttggacggtggcagaggccatcgacctggaagtctccgcgccggtgatcaccttgtcgctgatggagcggttgcggtcgcgcgacaaggattcgttcaccgataaattgctggcggcgatgcgcaatcagttcggtgggcatgcggtgctgaccaccacgccaaccccgacgccgatcggcagcaaggacgcctga

SEQ ID NO: 12019 - protein, 313 aa, Xanthomonas campestris
MELGMVGLGRMGANMAERLVRGGHRVHGFDLGAAARTSAQSKGIQTTDALVTLVSALPSPRVVWLMVPAGKIVDDTLAQLLPLLQAGDIVIDGGNSYYKDSQRRAAQLQSSGIAFVDCGTSGGVWGLQEGYSLMVGGDEAAVTTLHPVLATLAPAPDKGWGRVGPSGAGHFTKMVHNGIEYGMMQAYAEGFALLQHKTDFALDLHQVAEIWRDGSVVRSWLLDLTADALAHNPTMGGIAPYVADSGEGRWTVAEAIDLEVSAPVITLSLMERLRSRDKDSFTDKLLAAMRNQFGGHAVLTTTPTPTPIGSKDA

SEQ ID NO: 12020 - DNA, 942 bp, Xanthomonas axonopodis
  CDS (1)..(942)
atggaactgggtatggtgggactgggccgcatgggcgccaacatggccgagcgcttggtcaatggtgggcatcgcgtgcatggctacgatccgggcgcgaacgcgcgcaccagcgcgcaagccaagggcatcgtcaccgccgatgcgctggcagcgctggtgtccgcactgccgagcccgcgcgtggtgtggttgatggtgccggccggcaagatcgtcgatgacacgctggcgcagctgctgcccttgctgcaggccggcgacatcgtcatcgatggcggcaattcgtactacaaggattcgcagcggcgtgcggcattgctgcaggccagtggcatcgcgtttgtcgattgcggcaccagcggtggcatctggggtctgcaggaaggctatagcctgatggtgggtggcgacgaagcggcggtgacggggttgcatccgatcctggcaacgctcgcgccggcgccggacaagggctggggacgggttggcccgagcggtgcaggccacttcaccaagatggtccacaacggcatcgaatacggaatgatgcaggcctatgcggaaggcttcgcgctgatgcagcacaaggccgattttgcgctggatctgcaccaggttgccgaaatctggcgcgatggcagcgtggtgcgttcgtggttgctggatctgacggccgacgcgttgacgcataacccgaccatggccggcatcgcgccgttcgtggccgattcgggcgaaggccgctggacggttgcagaagcgatcgatctggaagtctctgcaccggtcatcacgttgtcgctgatggagcggctgcgctcgcgcgacaaggattcgtttaccgacaagctgctcgcggcgatgcgcaatcagttcggcggccacgcggtgatgaccacgacctcggcagcgccgacgatcggtagcaaggacgcgtaa

SEQ ID NO: 12021 - protein, 313 aa, Xanthomonas axonopodis
MELGMVGLGRMGANMAERLVNGGHRVHGYDPGANARTSAQAKGIVTADALAALVSALPSPRVVWLMVPAGKIVDDTLAQLLPLLQAGDIVIDGGNSYYKDSQRRAALLQASGIAFVDCGTSGGIWGLQEGYSLMVGGDEAAVTGLHPILATLAPAPDKGWGRVGPSGAGHFTKMVHNGIEYGMMQAYAEGFALMQHKADFALDLHQVAEIWRDGSVVRSWLLDLTADALTHNPTMAGIAPFVADSGEGRWTVAEAIDLEVSAPVITLSLMERLRSRDKDSFTDKLLAAMRNQFGGHAVMTTTSAAPTIGSKDA

SEQ ID NO: 12022 - DNA, 1404 bp, Thermoanaerobacter tengcongensis
  CDS (1)..(1404)
atgaatgatgtgggtttaataggattggcggtaatgggacaaaattttgccttgaacatggcaaggaaaggttatagagtttcggtttataataggacccctgagagaacaaagaagtttgttgaggaaaaagttagagacgaatcaatttttccgttttatactatagaagagtttgtgaaaagtttaaaaaaacctagaaaaataattctgatgataaaggctggaaaggctgtagatgacatgattgctgaaattcttccatatctggagctaggggaccttatagtagacagtgggaattcgcattttgctgatactgctagaaggctagaatatttatcgcaaaaaaacattttgtttctcggaatgggtatttctggaggagagtacggggctttacatggaccctcattaatgccaggtggtacaaaagaggcttatgacttaataaaagatattcttttaaaggctgcagcaaagacggaagatggaccttgctgtacatatgtgggaaagggttcagcaggtcattttgtgaaaatggttcataatggtattgaatatgctattatgcagttaattgctgaagtatatgattttatgaaaaaagtattgaatatgactaatgaacaaataggcgatgtctttgaaaaatggaataagggagaacttaattcctatttaatggaaatttcttataagattatgagatataaagacaaggagacaggaggatttttgatagactacattttggataaagcagaacaaaagggtactgggaaatggactgctcaaacttctttggatttaggggttcctacgccaacattgaatttggcggtagaagccagaattatttctcactataaagaagagagaaagattttatcgaaattatattcgaaagaaaagaatataatctctgtgaataaagaagaaatgatagagcatttaaagaaagcactgctttttggagtatttatgtctttctctcaaggcttatggctaattgacgaagcatccaagcaatataattatggaatagaccttagcgaaatattaagaatttggaaaggaggctgtattataagggccgaaattctagactttttgagggatatcattagagaaaatgaggaagatgcaaatcttttgcatagtgataaggctatagactttattaaagataaattaaattccatctaccaagttacagaaattgggaaaaattacagaatacctcttatgacaatgaattctgcacttgattattattttgctttaacagaagagaatctcccagcaaacattattcaagctcaacgggacttttttggagctcatacttacgaaagaattgacagagaagggatatttcatacagagtgggaaagataa

SEQ ID NO: 12023 - protein, 467 aa, Thermoanaerobacter tengcongensis
MNDVGLIGLAVMGQNFALNMARKGYRVSVYNRTPERTKKFVEEKVRDESIFPFYTIEEFVKSLKKPRKIILMIKAGKAVDDMIAEILPYLELGDLIVDSGNSHFADTARRLEYLSQKNILFLGMGISGGEYGALHGPSLMPGGTKEAYDLIKDILLKAAAKTEDGPCCTYVGKGSAGHFVKMVHNGIEYAIMQLIAEVYDFMKKVLNMTNEQIGDVFEKWNKGELNSYLMEISYKIMRYKDKETGGFLIDYILDKAEQKGTGKWTAQTSLDLGVPTPTLNLAVEARIISHYKEERKILSKLYSKEKNIISVNKEEMIEHLKKALLFGVFMSFSQGLWLIDEASKQYNYGIDLSEILRIWKGGCIIRAEILDFLRDIIRENEEDANLLHSDKAIDFIKDKLNSIYQVTEIGKNYRIPLMTMNSALDYYFALTEENLPANIIQAQRDFFGAHTYERIDREGIFHTEWER

SEQ ID NO: 12024 - DNA, 2241 bp, Chlamydomonas reinhardtii
  CDS (73)..(1545)
actcaaaacattacattgttgagaggccacttacaacccttccgctgtcttcgcagcaagggaaacgcaccgatggctgtcgccgaaatcggtctggttggcctggcggtcatgggccagaacttggccctgaacatcgcggagaagggctttcccatttcggtctacaaccgtagctatgacaagactgaggccgcggtgaagcgcgctcagaaggagggcctgggcgagaagctgcacggctacgagcaagtcaaggactttgtgcagagcctgcagaggccccggcgcgtcatcatcctggtgaaggccggcgcgcccgtggaccagaccattgaccaactgtgcgagttcatggagcctggtgacatcatcattgacggcggcaacgagtggtacgagaacacggagaagcgcatggccaaggttgccgccaagggcatcctgtacatgggcatgggcgtgtccggcggcgaggagggcgcccgcaggggtccctccatgatgcccggcggcagccctgaggcgtacagccacatcaagagtgtggtggagaaggtggcggcacaggtggacgacggcccctgcgtgatgtacattggtggcggcggcgcgggcaacttcgtcaagatggtgcacaacggcatcgagtacggcgacatgcagctcatcagcgaggcctacgacgtgctgaagacgctgggcggcctcaacaacgaggagctggcggcggtgttcaaggagtggaatgacgccgagctcaagtcattcctggtggagatcacggccatcattgtgaacaagaaggacgaccaggcgcccggatatctggtggaccagattgtggaccagaccggctccaagggcacaggcaagtggacggtgcagcaggcggctgagctggcggtggcggcgcccaccatggcctcggcactggacgcgcgctacatgagtgcgctcaagtcggagcgcgtggccgcctccaagtcgttcacaagctgtgtcacgcccggccctgttgcgggtgtggacaaggcgcagctgatcaacgacgtgcgcgcggcgctgtacgccagcaagatctgctcgtacgcgcagggcatgaacattatcaaggccaagagcgtggagatgaagtggaacgtcgacctgggcggcctggcgcgcatctggaagggtggctgcatcatccgcgcgcagttcctggaccgcatccgcgtcgcctacgagcgcaaccccgagctgccctcgctgctggtggaccccgacttcgccaaggagctcaccgctgccgaggcgtcctggcgccgcgtggccgcgctgtccatcacgcacggcgtgcccatcccctccatgacctcctccctgggctactttgacacctaccgccgcgagcgcctgcccgccaacctggtgcaggcgcagcgcgacttcttcggctcgcacacctaccagcgcttcgacaaggagggctggtaccacaccgtgtgggacgagaccttcggctccgccgactccatcaccaccagcggctacgtggtgtaaggcgaggcagcggggtggtgttgcgaagggcagagccactgctggtggcggcgtattgtcgtagcagacgtggcggtggtggttactggtcaaggcttacgcatctggacctgtcgcagggtcttgtgttgttatgcaaggtgaagaagagttgcgctggcgctgtgccgcttgtaccgtatgtgtttggtgctgttggaacggggccggcgtgattgcgcttgagcatttcaggcggccgccggctccaggagagcagtgtgatgtgcgtgctcgcgagggtcgtcggactgagaagggctatgggcggcatgcgtcgtgcccgatgccccagggtgtcggggcgcatgcaactggctgtagcgcttcaagccaggctggtcgacccctcacgtggctctcgagtggtttcggtagttcaactaccccgatgatgctattatcagttatgttccagggctcaattgggcgcctggtggtaccgtaccggtatgcatacattgtttctgggcagcggagaagtagtgcagttacggaggcaagtatttcttaggtcctaggaataactgcggggctgacccctatcgctcagtcccctgcgtgtttgtcccagcgcgtaatgcccaatgctcgaagatgagattgccacgaatatggctgtgtaaagctttgggactgaaaaaaaaaaaaaaaaaa

SEQ ID NO: 12025 - protein, 490 aa, Chlamydomonas reinhardtii
MAVAEIGLVGLAVMGQNLALNIAEKGFPISVYNRSYDKTEAAVKRAQKEGLGEKLHGYEQVKDFVQSLQRPRRVIILVKAGAPVDQTIDQLCEFMEPGDIIIDGGNEWYENTEKRMAKVAAKGILYMGMGVSGGEEGARRGPSMMPGGSPEAYSHIKSVVEKVAAQVDDGPCVMYIGGGGAGNFVKMVHNGIEYGDMQLISEAYDVLKTLGGLNNEELAAVFKEWNDAELKSFLVEITAIIVNKKDDQAPGYLVDQIVDQTGSKGTGKWTVQQAAELAVAAPTMASALDARYMSALKSERVAASKSFTSCVTPGPVAGVDKAQLINDVRAALYASKICSYAQGMNIIKAKSVEMKWNVDLGGLARIWKGGCIIRAQFLDRIRVAYERNPELPSLLVDPDFAKELTAAEASWRRVAALSITHGVPIPSMTSSLGYFDTYRRERLPANLVQAQRDFFGSHTYQRFDKEGWYHTVWDETFGSADSITTSGYVV

SEQ ID NO: 12026 - DNA, 1654 bp, Phytophthora infestans
  CDS (44)..(1513)
agctcagctccttcaccaactttctcctttctatctttccaccatggctgacctctcggacatcggacttttcggcctggccgttatgggccagaacttcgcgctcaacatggcgtcgcacggcttcaaggtgtcggtgtgcaaccgctcgcctgacaaagtggacgccactgtgcagcgcgccaaggacgagggcaacctcccgcttgtgggcttcaaggacatgaaggagtttgtggcctcgctcgcgcgcccccgtaaggttgtcatcctcgtggtggccggcaagcctgtggacttgaccatcgccgcgctctcggagttcatggagcctggtgacatcatcgtggacggcggtaacgagtggttccccaacagtgttcgtcgtgccagcgagctggagcccaagggcatccacttcgtgggcatgggcgtgtctggcggtgaggagggcgcccgcaacggcccttcgcttatgcctggtggccccaaggaggccttcgacgctctcgagcccattatcaccaagtgtgccgcccaggtggacgacggtgcctgcactacgtaccttggccccatcggttcgggcaactacgttaagatggtccacaacggcatcgagtacggtgacatgcagctgatcgccgaggcttacgacatcctcaagatcgctggtggcctcacgaacgatgagctggccagcgtctttgacgagtggaacaagggcgagctcgagtcgttcctcattgagatcacggctcagattttcgccaaaaaggacgatctgacggacgatggctacgtcgttgacaagatcctagacaagactggcatgaagggcactggtcgctggaccgtgcaggaggctgctgagcgctccatcgccgcccccaccatcactgcgtctctggacgctcgttacctaagcgcccgcaaggacgagcgcgtgttcgcctccaagatcctgtcgggtccgtctgagatccctgctgtggacaagcagcagctcatcgacgacgtgcgtcaggctctgtacgcctccaagatctgctcgtacgctcagggcctgaacctcatccgtgaggctggtgtccaaatgggctggaacgttgacttgggtgagtgtgctcgcatctggaagggcggctgcatcatccgtgccaagttcttggaccgtatcaagtcggcttacactaaggacgcgtcattgatctcgctgctggtggatccggacttcgccgccgagctgcaggctcgccagtattcgtggcgtcgcgtggtgtccctggctgtggctagtggcatccctgcgccctcgttctcgggctcgctcaactactacgacacgttccgtcgtgagcgtctgcccgccaacctgactcaggcccagcgtgacttcttcggcggccacacctatgagcgcacggaccgtgagggtctgtaccactgcgcctggtccgccgctcaccacagcattggtgacgtctcggagcgtatccgtggcaacctgtaagcgtctctagagacgcgaacagaggaaaaagtacggtagttatctgtgcggctccacaaaagctgccatttgcaggccccatgagtttgatatgatcagaatgccagcctagtctttttaacaattaaaaaaaaaaaaaaa

SEQ ID NO: 12027 - protein, 489 aa, Phytophthora infestans
MADLSDIGLFGLAVMGQNFALNMASHGFKVSVCNRSPDKVDATVQRAKDEGNLPLVGFKDMKEFVASLARPRKVVILVVAGKPVDLTIAALSEFMEPGDIIVDGGNEWFPNSVRRASELEPKGIHFVGMGVSGGEEGARNGPSLMPGGPKEAFDALEPIITKCAAQVDDGACTTYLGPIGSGNYVKMVHNGIEYGDMQLIAEAYDILKIAGGLTNDELASVFDEWNKGELESFLIEITAQIFAKKDDLTDDGYVVDKILDKTGMKGTGRWTVQEAAERSIAAPTITASLDARYLSARKDERVFASKILSGPSEIPAVDKQQLIDDVRQALYASKICSYAQGLNLIREAGVQMGWNVDLGECARIWKGGCIIRAKFLDRIKSAYTKDASLISLLVDPDFAAELQARQYSWRRVVSLAVASGIPAPSFSGSLNYYDTFRRERLPANLTQAQRDFFGGHTYERTDREGLYHCAWSAAHHSIGDVSERIRGNL

SEQ ID NO: 12028 - DNA, 1377 bp, Encephalitozoon cuniculi GB
  CDS (1)..(1377)
atgcctcaaaccccgaaaatggagatcggcctaattggcttgggagtgatgggacatagtcttgcattgaacattgtctcaaggggatacaggctgcatgttttcaacaggacatcctcgaagacggacgaccttgtgagggagaggagagacatctgcccccattattccgtggaggacctggttgtgggcatcaagacttctccgagggtcattcttctgatgctgacctctggaaaagtggtggatgtctttctcgaggagctcagcagatacctgggcaaggacgatgttgtcattgacgggggaaactcctcatacaaagacaccatcagaagaaatagatacaagtttggattcgtcgggtgtgggatttctggaggagaagagggagccaggtacgggccgtccatcatggtcgggtgtgacaaggattcctgggaaaaggtccaaggatttcttacggatatttctgcagtcgaggtctctggaagcaagcgctgctgcgtatggcttggggagggaggggccggacactttgtcaagatggttcataacggaatcgagtacggggacatggcaataatctccgagacatatctagtcctgaagtccctggggttgagcaacatggagatatcctcactgtttgacagttggaacggaatggagtctgaaagctatctccttagaatctcgtgctcgatcttgagaatggagaacgagagaggaagcgtgcttgaccagatagcagacgtctcggggcagaagggcactggaatggaagcagtggtgtcgtcaatggagatggggcagcccattccagcaataatggaggcagttgcatccaggatggtatcatatgcaaagaagaaaaggtgctggctctccgaaaggttagagggtgggaagggaaggagggagatgtctctggatgcggccagaagggggttttaccttgcaagaatggtttcgtgcgtgcagggattcaacctgctgatgagagccaggaagaagcatgggtggccatacaccatcgaagatatctcgcaagtgtggagcaatggatgcatcctcaggggaaagctgttggacgtggttaggagcatggggaaggagagacaggatgattttgagcttacgtctgaatttgtgtctctgtgcaacgaatactaccaagacctcaaggaaatggttctgtactctactgagtgcgaggtgccaactccaacgatctcgtcttgcctaatgtaccttaacgggatgaagaaggaggagggaggggggaacatgattcaggcaatgagggactatttcggggcccacatggtgacgatgaaaggagaggatgaggctgtgcatgtacggtggaactag

SEQ ID NO: 12029 - protein, 458 aa, Encephalitozoon cuniculi GB
MPQTPKMEIGLIGLGVMGHSLALNIVSRGYRLHVFNRTSSKTDDLVRERRDICPHYSVEDLVVGIKTSPRVILLMLTSGKVVDVFLEELSRYLGKDDVVIDGGNSSYKDTIRRNRYKFGFVGCGISGGEEGARYGPSIMVGCDKDSWEKVQGFLTDISAVEVSGSKRCCVWLGEGGAGHFVKMVHNGIEYGDMAIISETYLVLKSLGLSNMEISSLFDSWNGMESESYLLRISCSILRMENERGSVLDQIADVSGQKGTGMEAVVSSMEMGQPIPAIMEAVASRMVSYAKKKRCWLSERLEGGKGRREMSLDAARRGFYLARMVSCVQGFNLLMRARKKHGWPYTIEDISQVWSNGCILRGKLLDVVRSMGKERQDDFELTSEFVSLCNEYYQDLKEMVLYSTECEVPTPTISSCLMYLNGMKKEEGGGNMIQAMRDYFGAHMVTMKGEDEAVHVRWN

SEQ ID NO: 12030 - DNA, 1597 bp, Dictyostelium discoideum
  CDS (64)..(1545)
tttataataataaaaataaataaaaataaaataaaaaaaataaaaataaataaataaataaaaatgacagaagcaaaaggtgatattggtttaattggtttagccgttatgggtgaaaatttagtattaaatatggaaagtcgtggattcacatgttcagtctataatagaactacatccaaagttgacgaatttgttcaaggtagaggtaaaggaaagaaattcattggttgtcactcattagaaactttagttcaatcattaaaaaccccacgtagagttatgttgatggttaaagctggtgaagtcgttgatcatttcattcaactcttattaccattattagaaaagggtgatatcatcattgatggtggtaattcattatataccgattcagatcgtcgtacaaaggatttagatgccaagggtatccttttcattggtaccggtgtttctggtggtgaagaaggtgctctcctcggtccatcaatcatgccaggtggtaacccaaaggcatgggaacatgttaaaccaatcttccaagcaatctctgccaaagttcaaccaggtgatcaaccatgttgtgattgggttggtgatggtggtgctggtcattacgtcaagatggtacacaatggtatcgaatatggtgatatgcaattgatcagtgaagcctatttcatcctcaaacattacctcggtctcagcaatgatgaattacaaaaaacttttgccaaatggaacactggtgatcttgacagctatttaatcgaaatcactgccgatattttcgcaaagaaatgtgaaaaggatccaaacacctacgttgtcgatacaattttagattctgccggtcaaaaaggtactggtaaatggactgctatcaatgctttagatgtcggtatcccattaactttggttgccgaaagtgttttcgccagatgtgtatcttctttcaaagaggaaagagttaaagcttcaaccattctcgctggtccaaatccaaacgaagccaacaagaaattcacaggtgacaaagaacaagttatcgaagccgttagacaagctttattcgcttcaaaattggtttcatacgctcaaggtttcaccatgatgaaagctgccgccaaagaatataaatggaacctcaactatggtaatatcgccctcttatggagaggtggttgtatcattcgttcaactttcctcggtgaaatcaagggagcctttgataagaatccacaacttgacaatcttttaaccgattgttggttcagagataaattagctgccgctcaagatggttggagacaagttgcctcaatttcagtactccacggtatcccaactccagctttcacctctgccctctcctactatgacagttatcgttgtgctaaactctctgccaatctcgttcaagctcaaagagattactttggtgctcataccttccagttacttgatgatccaaaaggtgctccagttcatgtaaattggactggtagaggtggttcaactcattctactacttatagtatttaaaaaaaaaaattataaaaaaataaaaaaataaaaaaaattaaaaaatttaaaa

SEQ ID NO: 12031 - protein, 493 aa, Dictyostelium discoideum
MTEAKGDIGLIGLAVMGENLVLNMESRGFTCSVYNRTTSKVDEFVQGRGKGKKFIGCHSLETLVQSLKTPRRVMLMVKAGEVVDHFIQLLLPLLEKGDIIIDGGNSLYTDSDRRTKDLDAKGILFIGTGVSGGEEGALLGPSIMPGGNPKAWEHVKPIFQAISAKVQPGDQPCCDWVGDGGAGHYVKMVHNGIEYGDMQLISEAYFILKHYLGLSNDELQKTFAKWNTGDLDSYLIEITADIFAKKCEKDPNTYVVDTILDSAGQKGTGKWTAINALDVGIPLTLVAESVFARCVSSFKEERVKASTILAGPNPNEANKKFTGDKEQVIEAVRQALFASKLVSYAQGFTMMKAAAKEYKWNLNYGNIALLWRGGCIIRSTFLGEIKGAFDKNPQLDNLLTDCWFRDKLAAAQDGWRQVASISVLHGIPTPAFTSALSYYDSYRCAKLSANLVQAQRDYFGAHTFQLLDDPKGAPVHVNWTGRGGSTHSTTYSI

SEQ ID NO: 12032 - DNA, 2180 bp, Mus musculus
  CDS (63)..(1514)
gcctcggagcgctcggtccttcgtgtttctttctcctcgactctgcttcgtctgcctccgccatggcccaagctgacattgcactgatcggactggctgtcatgggccagaacttaattttgaacatgaatgatcatggatttgtggtctgtgctttcaataggacagtctccaaagtcgatgacttcttggccaacgaggcgaagggcaccaaggtggttggtgcacagtccttaaaggacatggtctccaaactaaagaagccccgccgggtcatcctgcttgtgaaggccgggcaagccgtggatgatttcatcgagaaattagtacccttgttggacacgggtgacatcatcatcgatggaggaaattctgaataccgggacacgacaagaagatgccgggacctcaaggccaagggcatcttgtttgtggggagcggagtcagtggtggtgaggaaggggctcggtacgggccgtcactcatgccaggagggaacaaagaggcttggccccacatcaaggcgatcttccaagccatcgctgcaaaagtgggaaccggagaaccctgctgtgactgggtgggagatgagggggcggggcactttgtgaagatggtgcacaacgggatagagtatggagacatgcagctcatctgtgaggcttaccatttgatgaaggatgttctgggcatgcggcatgaggagatggctcaggcatttgaagaatggaacaagacagagctggactcattcctgattgaaatcactgctaacattctcaagtaccgggacactgacggcaaagagctgttgccaaagatccgggacagtgctgggcagaagggcactgggaagtggaccgccatctcggcgctggagtacggcatgcccgtcaccctcattggagaagctgtctttgctcggtgcttgtcctctctgaaggaggagcgggttcaggccagccaaaagctgaagggtcctaaggtggtccagctggaaggcagtaagaagtcattcctggaggacatccgtaaggccctctatgcttccaagatcatctcctacgcccaaggctttatgctgctcagacaggcagccactgagtttggctggaccctcaattatggcgccattgccctgatgtggagagggggctgcatcatccgaagtgtgttcctgggaaaaattaaagatgcatttgagcgaaacccagaacttcagaacctactgctagatgacttctttaagtcagcagttgacaactgccaggactcctggcggcgggtgatcagcactggggtgcaagcaggcattcccatgccctgcttcactactgccctctccttctatgatgggtacagacacgagatgctgccagcaaacctcatccaggctcaacgggattactttggggctcacacctatgaactcttaaccaaaccgggagaatttatccacaccaactggacgggccacgggggcagtgtgtcatcctcttcatacaatgcctagtaggcctgtggcttgccctccctcccagcaataggacagccccgtggcgctcagcaccccccctttgccctagttcctgctcttagccaagtgttggctgtgattgctgaagaagtcaccgaggtctatagtttctgaaccaccacatgctccacctccgtctctgtgctgcccaggacctgaccctgtgctgccactgcgtgacctgaccctgtgcgccactgcgtgaccactccctgactgagccgtgccatgtggaccagacaagctgcagctcttagctcacagagggggtgggtgtgtgggatcgtacaacctggacgtggaccatgcgtgtgggctctgctgtcctccagtcagtgaagtgtatatggttacactctctgggtgtgcctggcagaacgatctgcactgagttcactattgcaaattgatttgttttcctttagccttgttcacttttaactccggctttttttaaagactccaaataaaacaggacaggtagtgagtaaatctggagggaggtgcagagccgaggagtcggtgggcagaggctctcctgtcgggtatttcttactggcacagtaggtacctggatgttcacagagcatccgccccgtcccacttgtaataaacttttagactggtaaaaaaaaaaaaaaa

SEQ ID NO: 12033 - protein, 483 aa, Mus musculus
MAQADIALIGLAVMGQNLILNMNDHGFVVCAFNRTVSKVDDFLANEAKGTKVVGAQSLKDMVSKLKKPRRVILLVKAGQAVDDFIEKLVPLLDTGDIIIDGGNSEYRDTTRRCRDLKAKGILFVGSGVSGGEEGARYGPSLMPGGNKEAWPHIKAIFQAIAAKVGTGEPCCDWVGDEGAGHFVKMVHNGIEYGDMQLICEAYHLMKDVLGMRHEEMAQAFEEWNKTELDSFLIEITANILKYRDTDGKELLPKIRDSAGQKGTGKWTAISALEYGMPVTLIGEAVFARCLSSLKEERVQASQKLKGPKVVQLEGSKKSFLEDIRKALYASKIISYAQGFMLLRQAATEFGWTLNYGAIALMWRGGCIIRSVFLGKIKDAFERNPELQNLLLDDFFKSAVDNCQDSWRRVISTGVQAGIPMPCFTTALSFYDGYRHEMLPANLIQAQRDYFGAHTYELLTKPGEFIHTNWTGHGGSVSSSSYNA

SEQ ID NO: 12034 - DNA, 930 bp, Mus musculus
  CDS (1)..(930)
atggcccaagctgacattgcactgatcggactggctgtcatgggccagaacttaattttgaacatgaatgatcatggatttgtggtctgtgctttcaataggacagtctccaaagtcgatgacttcttggccaacgaggcgaagggcaccaaggtggttggtgcacagtccttaaaggacatggtctccaaactaaagaagccccgccgggtcatcctgcttgtgaaggccgggcaagccgtggatgatttcatcgagaaattagtacccttgttggacacgggtgacatcatcatcgatggaggaaattctgaataccgggacacgacaagaagatgccgggacctcaaggccaagggcatcttgtttgtggggagcggagtcagtggtggtgaggaaggggctcggtacgggccgtcactcatgccaggagggaacaaagaggcttggccccacatcaaggcgatcttccaagccatcgctgcaaaagtgggaaccggagaaccctgctgtgactgggtgggagatgagggggcggggcactttgtgaagatggtgcacaacgggatagagtatggagacatgcagctcatctgtgaggcttaccatttgatgaaggatgttctgggcatgcggcatgaggagatggctcaggcatttgaagaatggaacaagacagagctggactcattcctgattgaaatcactgctaacattctcaagtaccgggacactgacggcaaagagctgttgccaaagatccgggacagtgctgggcagaagggcactgggaagtggaccgccatctcggcgctggagtacggcatgcccgtcaccctcattggagaagctgtctttgctcggtgcttgtcctctctgaaggaggagagggggctgcatcatccgaagtgtgttcctgggaaaaattaa

SEQ ID NO: 12035 - protein, 309 aa, Mus musculus
MAQADIALIGLAVMGQNLILNMNDHGFVVCAFNRTVSKVDDFLANEAKGTKVVGAQSLKDMVSKLKKPRRVILLVKAGQAVDDFIEKLVPLLDTGDIIIDGGNSEYRDTTRRCRDLKAKGILFVGSGVSGGEEGARYGPSLMPGGNKEAWPHIKAIFQAIAAKVGTGEPCCDWVGDEGAGHFVKMVHNGIEYGDMQLICEAYHLMKDVLGMRHEEMAQAFEEWNKTELDSFLIEITANILKYRDTDGKELLPKIRDSAGQKGTGKWTAISALEYGMPVTLIGEAVFARCLSSLKEERGLHHPKCVPGKN

SEQ ID NO: 12036 - DNA, 1431 bp, Rhizobium meliloti
  CDS (1)..(1431)
atgtcacaggcggaaatcggcctaatcggtctcggagtcatgggctcgaacctggcgctcaacatcgctgaaaaaggcaacaggatcgccgttttcaaccgcacggtcgacgcgacacgcaaattctacgctgaggccggcgcactcaaggaccagatcgtcccctgcgaaacgatcgaagaattcgtcgccgccatccgcccgccgcgtccgatcattatcatgatcaaggccggtgatccggtcgaccagcagatggaggccctgaagccccatctcgccaagggcgacatcatgatcgatgcgggcaacgccaatttccgcgacacgatgcgccgtttcgatgcgctgaaggactcgggtctcaccttcatcggcatgggcgtctccggtggcgaggaaggcgcgcgccacgggccctcgatcatggtcggcggcacggaagaatcctatcggcgcgtcgagaaggttctgacctcgatcgctgcgaaatatgatagcgacccctgcgtcgcctggctcggcgagaacggggcggggcacttcgtcaagacgatccacaacggcatcgaatatgccgatatgcagatgatcgccgagatttacgggatcctgcgtgacggattgaagatgacggcacaggagatcggcgaggtcttcggcgcctggaacaagggccggctcaactcctacctgatcgaaatcaccgagaaggtcttgaaggccgccgatccgctgaccggcaagcccatcgtcgatatgatcctcgacaaggccggtcagaagggcaccggcaaatggtcggtgatcgaggcgcagaacatgggcgtgcctgcgaccgcaatcgaagcggcggtcgcagcgcgcagcatctcctcggcgaaggaagagcgggaagccgccgaaaaggttctcggtctgccgccggtcggcgaaatcaaggtggccgacagggacggcttcatcaaggacctggaaaacgcgctgctcgccgccaagatcggcgcctatgcgcaaggcttcgcagtgatggcggcggcgtcgaaggagttcggctggaacctgccgatgccgacgatcgcaaagatctggcgcgccggctgcattatccgctcgcagttcctcgacgagatcaccaccgcctttaccaaagcaccggatgccgcgaacctgatcgtcacccccgccttcgccgccatggtcaaggagagcgacggcgcgttgcgacgggtggtttcgacggccgtcctcggcggtctgccggtgcctgcgctggcctcggcgctcggctatttcgacagctaccgccgcggccgcggcacggccaacgtcatccaggcgcagcgcgacttcttcggcgcccacggtttcgaccgtgtcgatggcgcagacagccatcacggtccatggggcagcggtctgaacgcttga

SEQ ID NO: 12037 - protein, 476 aa, Rhizobium meliloti
MSQAEIGLIGLGVMGSNLALNIAEKGNRIAVFNRTVDATRKFYAEAGALKDQIVPCETIEEFVAAIRPPRPIIIMIKAGDPVDQQMEALKPHLAKGDIMIDAGNANFRDTMRRFDALKDSGLTFIGMGVSGGEEGARHGPSIMVGGTEESYRRVEKVLTSIAAKYDSDPCVAWLGENGAGHFVKTIHNGIEYADMQMIAEIYGILRDGLKMTAQEIGEVFGAWNKGRLNSYLIEITEKVLKAADPLTGKPIVDMILDKAGQKGTGKWSVIEAQNMGVPATAIEAAVAARSISSAKEEREAAEKVLGLPPVGEIKVADRDGFIKDLENALLAAKIGAYAQGFAVMAAASKEFGWNLPMPTIAKIWRAGCIIRSQFLDEITTAFTKAPDAANLIVTPAFAAMVKESDGALRRVVSTAVLGGLPVPALASALGYFDSYRRGRGTANVIQAQRDFFGAHGFDRVDGADSHHGPWGSGLNA

SEQ ID NO: 12038 - DNA, 1440 bp, Streptomyces coelicolor
  CDS (1)..(1440)
atgagcactacagcgcagatcggcgtcacgggtctcgcggtcatgggccgcaacctcgcccgcaacttcgcccgcaacggctacacggtcgcggtgcacaaccggaccgcgtcgcgcacgcacgcgctggtggaggagttcgggagcgagggcgatttcgtggcgaccgagaccgccaaggagttcgtggccgcgctggagcgcccgcgacgcctggtgatcatggtgaaggcgggtgacccgaccgacgcggtgatccgggagttcgccccgctcctcgagcccggggacatgatcatcgacgggggcaacgcgcacttcgcggacacccggcgccgggagcgcgaactgcgcgagcagggcatccatttcgtgggcaccggcatctcgggcggcgaggagggcgcgctgcacgggcccagcatcatgccgggcggctcgaaggagtcgtacgagtctctgggcccgatgctggagaagatctcggcgaaggccgcggacgaggcgccctgtgtgacgcacgtcggtcccgacggcgcaggtcacttcgtcaagatggtgcacaacggcatcgagtacgccgacatgcagttgatcggcgaggcgtaccagctgctgcgcgacgtcgccgggtactcccccgcgcagatcgcggagatcttccgcgcctggaacaccggccgcctggactcgtacctgatcgagatcacggcggaggtgctgtcgcacgtggacggggcgacgggcaagccgttcgtggacgtggtggtcgaccaggcggagcagaagggcaccggccgctggacggtgcagatcgcgctggacctgggcgtgccggtgtcgggcatcgcggaggccgtcttcgcgcgctccctgtcggggcacgcggcgctgcgtgacgcctcgcgcggcctggccggcccgcaggcgtccccgctcggcgagtcggaggcggccgccttcgccgaccgcgtcgagcaggcgctgtacgcctcgaagatcgtgtcgtacacgcagggcttccacgagatcgccgcgggcagcgaggagtacgactgggacatcgacctcggcgccgtctcggcgatttggcgcggcggctgcatcatccgggcggccttcctggaccgcatccgggcggcctacgacgcccggccggacctgccgagcctgctgtcggacgagacgttcgcccaggagatcgccgccgcgcaggacgactggcgcgaggtcctggtcgccgcgacccggcagggcgtgccgacgccgggcttcgccgccgccctcgcctactacgacgccctgcgcgccgagcggctccccgccgcgctgacccaggggcagcgggacttcttcggggcgcacacgtaccgcaggacggaccgggacggcgccttccacacgctgtggggcggtgaccggtccgaggtcaccgcgtag

SEQ ID NO: 12039 - protein, 479 aa, Streptomyces coelicolor
MSTTAQIGVTGLAVMGRNLARNFARNGYTVAVHNRTASRTHALVEEFGSEGDFVATETAKEFVAALERPRRLVIMVKAGDPTDAVIREFAPLLEPGDMIIDGGNAHFADTRRRERELREQGIHFVGTGISGGEEGALHGPSIMPGGSKESYESLGPMLEKISAKAADEAPCVTHVGPDGAGHFVKMVHNGIEYADMQLIGEAYQLLRDVAGYSPAQIAEIFRAWNTGRLDSYLIEITAEVLSHVDGATGKPFVDVVVDQAEQKGTGRWTVQIALDLGVPVSGIAEAVFARSLSGHAALRDASRGLAGPQASPLGESEAAAFADRVEQALYASKIVSYTQGFHEIAAGSEEYDWDIDLGAVSAIWRGGCIIRAAFLDRIRAAYDARPDLPSLLSDETFAQEIAAAQDDWREVLVAATRQGVPTPGFAAALAYYDALRAERLPAALTQGQRDFFGAHTYRRTDRDGAFHTLWGGDRSEVTA

SEQ ID NO: 12040 - DNA, 1643 bp, Spinacia oleracea
  CDS (85)..(1536)
ggcacgagattgaacccacatcgttaaattttctgggttttcatttgatttctgatcaaccaattttccgagcaggaataagcaatggctcctcctacaaggattggtcttgctggtctggctgtgatgggtcaaaatcttgcactaaacattgctgaaaaaggattccccatttctgtttacaaccgtacaacctcaaaggttgatgagaccgttgaacgagctaaacaagaaggaaatcttcctctgtatgggtttcatgaccctgaatcctttgtgaattcaatccagaaaccccgtgtcataatcatgcttgttaaggctggggctccagttgatgcaaccatcaaaactttgtctgcctatttggagaaaggagactgcatcatcgatggtggcaatgagtggtatgagaataccgagaggagagagaaagcaatggaggaaaagggactgctctacctcggaatgggagtttcaggaggtgaagagggtgcaagaaatggaccctctatgatgcctggtggttcattcgatgcttacaaaaacatcgaggatattctaaccaaggttgccgcacaggttgatagtggcccttgtgtaacctatattggcaaaggaggttctggcaattttgttaaaatgattcacaacggaattgaatatggtgacatgcagttgattgcagaggcttatgatgtgctgaaatcagttggaaagctctctaatgaagagttgaaggaagtttttgcagagtggaacagaggagagcttcttagcttcttgattgaaatcacagcagatatttttggaattaaggatgacaaaggtgaaggatatttggtagacaaagtgttggataaaaccggtatgaagggtacaggaaaatggacagttcaacaagctgctgagttatctgttgctgcccctaccattgcatcatctttggactcgagatttctgagcggtctaaaagatgaaagagttgaagctgccaaggtgttcaaagctggaggggttgaggatacactctctgaccaagttgttgataaaaagaaattgatagatgatgttagacaagccctttatgctgcgaaaatatgtagctatgcacaaggaatgaacttgattcgtgcaaaaagtgttgagaaagagtgggatttgaaactcggggagctagctaggatctggaagggtggatgcatcatccgtgctatgtttctggaccggattaagaaggcttatgacaggaacccaaacctctcaaacctacttattgacccagaattttcaaaggagatgattgagcgtcaatctgcttggcgtagggttgtctgccttgctatcggtgctggtatcagcacccctggtatgtcatcaagtcttgcttattttgattcatataggagggaaaggttgcctgctaatttggtgcaggctcaaagagattattttggagcccatacctatgagagaattgatattcctggtgctttccataccgagtggttcaaactcgctaaatccaagatctaaggcggagattgatttgtggtcactctcttaattatttactctaataatcagcttgtggctgccacatttgagttatgcattttattcaatgatttttcctcgtgccg

SEQ ID NO: 12041 - protein, 483 aa, Spinacia oleracea
MAPPTRIGLAGLAVMGQNLALNIAEKGFPISVYNRTTSKVDETVERAKQEGNLPLYGFHDPESFVNSIQKPRVIIMLVKAGAPVDATIKTLSAYLEKGDCIIDGGNEWYENTERREKAMEEKGLLYLGMGVSGGEEGARNGPSMMPGGSFDAYKNIEDILTKVAAQVDSGPCVTYIGKGGSGNFVKMIHNGIEYGDMQLIAEAYDVLKSVGKLSNEELKEVFAEWNRGELLSFLIEITADIFGIKDDKGEGYLVDKVLDKTGMKGTGKWTVQQAAELSVAAPTIASSLDSRFLSGLKDERVEAAKVFKAGGVEDTLSDQVVDKKKLIDDVRQALYAAKICSYAQGMNLIRAKSVEKEWDLKLGELARIWKGGCIIRAMFLDRIKKAYDRNPNLSNLLIDPEFSKEMIERQSAWRRVVCLAIGAGISTPGMSSSLAYFDSYRRERLPANLVQAQRDYFGAHTYERIDIPGAFHTEWFKLAKSKI

SEQ ID NO: 12042 - DNA, 2054 bp, Spinacia oleracea
  CDS (217)..(1830)
gcacgagcaaaaaccctccgcaaaccccccatttccctccctcctcgttgcagcacgacagtcgacaccatctctttctctctcctccttcaacaatggcggctgttcgctctgcaattctgaaatacatgagggtgccagtagcccaaaacacttactctccatcttcgatttcatcttccatcaactccttcttctctcgccgcaacttttccgatgaggtccgaggttccttcctcgacgagtccgtcctttctctctcctccatttatacatcttccccttctttctctctcctcaccaactccccttccacactcttcctcctccactttctctctcttctcaacaatggcggcttctcaaatcggtctcgtcggcctcgccgtaatgggccaaaacctcgccctcaacatcgccgagaaaggcttccctatttccgtctacaatcgcacagcctccaaggtcgatgaaaccctagaccgcgccaagtcagaaggcgatctcccgctctctggccactacactcctcgcgatttcgtcctctccatagaacgccccagatccatcgttatcctcgtcaaagccggctcccccgttgatcaaactatcgcttctcttgcctcctttatggaacctggtgacactatcatcgacggaggtaacgagtggtaccaaaacacagagcgtcgtttatctgacgctcactccaacggcctcctctacctcggtatgggcgtctctggtggcgaagaaggcgctcgttttggcccctcgctcatgcccggcggagatttccaggcgtacgacaatatccaacacattttgaagaaggttgctgctcaagtcgatgatgggccttgtgttacatacatcggagaaggtgggtccgggaatttcgtgaagatggtgcacaatgggattgagtatggtgatatgcagctgatttcggaggcttatgatgtgttgaagaatgtgggtggattgagcaatgaggaattgggtcagatttttgatgagtggaataagagtgagcttgagagctttttggttgagattactgcggatatctttaaggtgaaggatgatttagcggatggaggtttggttgataagattttggataagactgggatgaaaggtactggcaaatggactgttcaacaagctgctgaactctctgttgctgctcctaccattgctgcttctttggattgcaggtatctaagtgggttgaaagaggagagagaaaatgcagccaagatattggaagctgcagggatgaaggaagaggttaatgcgattagaggtggggttgataagaagaggttgattgatgatgtgaggcaagcgttgtatgcttcaaagatctgtagttatgctcaagggatgaatttattgagggcgaagagtgctgagatgggttgggatttgaatttaggggagttggcgaggatttggaaaggtgggtgtattattagggcagttttcttggacagcattaagcaggcatatcagaggaaccccaacttagctagtttggtggttgatcctgagtttgctaaggagatggtacagaggcaagcagcttggagaagggttgtgggtttggcagtctctgctgggataagtacacctggaatgtgcgccagtcttgcttatttcgatacttacaggcgtgccagacttccagctaaccttgttcaagctcagagggactactttggcgctcatacctatgagagggttgatctccctggctcttaccacactgagtggtcgaagcttgctcgtaagagtgaccccaatgttgctgctgccctccactgagctacgcctttttcccttcccctgtgttttcttaccatgtatttctgttgtttccaattgaaattgggattttgtgcctccaacaatgatccctttttaggcataggaattgttacagtattgttttagctcattagaaatggtagcgggaactgatgttaataagagcatgtctttcggaatatcaatacaaagaggtgttgtgtgaactaaatctcgtgccg

SEQ ID NO: 12043 - protein, 537 aa, Spinacia oleracea
MRSEVPSSTSPSFLSPPFIHLPLLSLSSPTPLPHSSSSTFSLFSTMAASQIGLVGLAVMGQNLALNIAEKGFPISVYNRTASKVDETLDRAKSEGDLPLSGHYTPRDFVLSIERPRSIVILVKAGSPVDQTIASLASFMEPGDTIIDGGNEWYQNTERRLSDAHSNGLLYLGMGVSGGEEGARFGPSLMPGGDFQAYDNIQHILKKVAAQVDDGPCVTYIGEGGSGNFVKMVHNGIEYGDMQLISEAYDVLKNVGGLSNEELGQIFDEWNKSELESFLVEITADIFKVKDDLADGGLVDKILDKTGMKGTGKWTVQQAAELSVAAPTIAASLDCRYLSGLKEERENAAKILEAAGMKEEVNAIRGGVDKKRLIDDVRQALYASKICSYAQGMNLLRAKSAEMGWDLNLGELARIWKGGCIIRAVFLDSIKQAYQRNPNLASLVVDPEFAKEMVQRQAAWRRVVGLAVSAGISTPGMCASLAYFDTYRRARLPANLVQAQRDYFGAHTYERVDLPGSYHTEWSKLARKSDPNVAAALH

SEQ ID NO: 12044 - DNA, 1017 bp, Rhizobium loti
  CDS (1)..(1017)
atgcagatcggaatgatgggactgggccggatgggcgccaacatggtgcggcgcctgatgcgagacggccatgaatgcgtcgtctacgacatcaacccggcaagcgtcgcggctctggtcagcgacggcgcgctcggcgcggcctccctgacggaattcgtcggcaagctcgccaagccgcgctgtgtctggctgatgctgccggcggcgatcaccggcaagattatcgatcaggtctcggccctgatggaacccggcgacatcgtcatcgacggcggcaattcctactatcacgacgccgtcaaccaggcggccaaactggccgccaagggcatccatcttgtcgatgttggcaccagcggcggtgtctggggcctggagcgcggctactgcctgatgatcggcggtcccgacgtagcggtgcagcacctcgattcgatcttcgccacgctagcgcccggcgccgatgccggcgcgccggctcccgacaaggccgccggaaccgcgcccttcggctacctgcattgcgggccgagcggcgccggccatttcgtcaagatggtgcacaacggcatcgagtatggcgtcatggccgcctatgccgaaggcatgaacatcttgaagtcggccaatgccggcaagcggcaacgcacggccgacgccgagaccagcccgctggaaaacccgcaatattatcagttcgacatcgacctcccgcaggtggccgaggtctggcggcatggcagcgtcatcggctcctggctgctcgatctcaccgccggcgcgctgaagagcgatccgggcctggcccagttcggcggccgcgtctcggattccggcgaaggacgctggacgctgaaggcggcgatcgacaccggcgtgccggcgccggtgctgtcctcggcgctgttcgaccgcttctcctcgcaaggcgaatccgaattcgccgacaagctgttgtccgccatgcgctatgccttcggcggccatgtcgaaaagccgaaggccggcaagtga

SEQ ID NO: 12045 - protein, 338 aa, Rhizobium loti
MQIGMMGLGRMGANMVRRLMRDGHECVVYDINPASVAALVSDGALGAASLTEFVGKLAKPRCVWLMLPAAITGKIIDQVSALMEPGDIVIDGGNSYYHDAVNQAAKLAAKGIHLVDVGTSGGVWGLERGYCLMIGGPDVAVQHLDSIFATLAPGADAGAPAPDKAAGTAPFGYLHCGPSGAGHFVKMVHNGIEYGVMAAYAEGMNILKSANAGKRQRTADAETSPLENPQYYQFDIDLPQVAEVWRHGSVIGSWLLDLTAGALKSDPGLAQFGGRVSDSGEGRWTLKAAIDTGVPAPVLSSALFDRFSSQGESEFADKLLSAMRYAFGGHVEKPKAGK

SEQ ID NO: 12046 - DNA, 1428 bp, Rhizobium loti
  CDS (1)..(1428)
atggaaaaagccgaaatcggcctgatcggccttggcacgatgggctccaacctggcgctgaacatcgccgaacacggacaccgcatcgccgtcttcaatcgcaccagggcacgtaccgacgctttcgtcgagaatgccggcgcgctgaaggacatggtggtgccctgctacagcctggaagaacttgccgccgcgatccggccgccgcgcccgatcatcatcatggtgctggccggcaagccggtcgatgagcagatcgaagccttgcgtggcgtgctgtccggcaacgacatcgtcatcgatgccggcaacgccaatttccgcgatacgatgcggcgcttctccgaactgtccggttccgggctgaccttcatcggcatgggcgtgtccggcggcgaggagggcgcgcgccatggtccgtcgatcatggtcggcggcacggaggattcgtggaagcgggtcgagaaagtgctgaccgccatctccgccaagttcaaggacgagccctgtgccgcctggctcggcaccgatggcgccgggcatttcgtcaagaccatccacaacggcatcgaatatgccgacatgcagatgattgccgagatctacggcatcctgcgtgatgggctcggcatggggccgaaggacatcggcacggtgttctccaactggaacaagggccggctcaactcctacctgatcgagatcaccgccaaggtgctggccgccgacgatcccaagaccggcaagccggtggtcgacattatcctcgaccgcgccggccagaagggcaccggcaaatggtccgtcatcgaggcgcagcagctcggcattccggcgacagcgatcgaggcggccgtggcggcccgcgtgctgtcgtcgatcaaggacgagcggctggcggccgagaaagcctacggtaacatcggggtatcgaagatttccggcgacaaggatgcgctgctgaaagatctcgaactggcgctgttcgccggcaagatcgcggcctatgcgcagggcttcgcggtgatgagcggcgcctcgaaggagttcaactggaacctgccgatgccgaccatcgcccggatctggcgcgccggctgcatcatccgctcgcagatgctggatacgatggccgaggccttcagcagcggcggcgcttcgaccaatcttttgatggcgccggctttcatcagcttgatgcaggaagcgcatccgtcgctgcggcgcatcgtggcaaaggcttccgaggccggcgcgccggtgccggcgctgtcttcggcacttgcctatttcgacagctatcgccagggccgcggcacttcgaacctgatccaggcacagcgcgacttcttcggcgcgcatggcttcgaacgcatcgacgagcagggtgccttccacggcccgtggggcagcggcgccgccggttag

SEQ ID NO: 12047 - protein, 475 aa, Rhizobium loti
MEKAEIGLIGLGTMGSNLALNIAEHGHRIAVFNRTRARTDAFVENAGALKDMVVPCYSLEELAAAIRPPRPIIIMVLAGKPVDEQIEALRGVLSGNDIVIDAGNANFRDTMRRFSELSGSGLTFIGMGVSGGEEGARHGPSIMVGGTEDSWKRVEKVLTAISAKFKDEPCAAWLGTDGAGHFVKTIHNGIEYADMQMIAEIYGILRDGLGMGPKDIGTVFSNWNKGRLNSYLIEITAKVLAADDPKTGKPVVDIILDRAGQKGTGKWSVIEAQQLGIPATAIEAAVAARVLSSIKDERLAAEKAYGNIGVSKISGDKDALLKDLELALFAGKIAAYAQGFAVMSGASKEFNWNLPMPTIARIWRAGCIIRSQMLDTMAEAFSSGGASTNLLMAPAFISLMQEAHPSLRRIVAKASEAGAPVPALSSALAYFDSYRQGRGTSNLIQAQRDFFGAHGFERIDEQGAFHGPWGSGAAG

SEQ ID NO: 12048 - DNA, 1455 bp, Pasteurella multocida
  CDS (1)..(1455)
atgtcagtaaaaggtgacatcggcgttatcggcttagcggtaatgggtcaaaacttaattttaaatatgaatgatcacggctttaaagtagttgcatttaaccgtacgacttcgaaagtcgatgagtttttgcaaggtgcggcaaaaggcacgaatattattggtgcgtattcgttggaagatcttgccaataaattggagaaaccgcgtaaagtgatgctgatggtgcgtgccggtgaagtcgtggatcaattcattgaggcattattaccacacttagaagaaggcgacatcattattgatggtggtaacacgaattacccagatacaaaccgccgtgtcgcgtatttacgtgaaaaagggatccgttttattggaacgggcgtatctggtggtgaagaaggggcacgtttcggaccttctattatgccgggcggtgatgaatctgcatgggaacacgtgaaaccaattttacaagcgatttcagccaaaacagataaaggcgaagcttgttgtgattgggttggtcgtgatggtgctgggcatttcgtcaaaatggtgcataacgggattgaatacggcgatatgcaattaatttgcgaagcgtatcaattcttaaaagaaggcgtaggcttatctgatgacgaattagaagcaactttcaaagcgtggcgtaacaccgaattagatagctatttaattgatatcacagcggatattcttggctataaagatgaagatggcagccgtttagtcgacaaaattttggataccgcaggtcaaaaaggaacaggtaaatggacggggattaatgcccttgatttcggcattccattgactttaatcacggaatctgtctttgcccgttgcgtctcgtctttcaaagaacagcgtgtgcaagcctctcgcctattcaataaagtggtcggcaaagtagaaggcgacaaagcagcttgggttgaagcggtgcgtaaagccttattagcctccaaaattatttcttatgctcaaggttttatgctgattcgtgaagcgtcagaaaactttggctggcacattaactacggcggtacagcattattatggcgtgaaggttgtattatccgtagccgtttcttaggtaatatccgggatgcttatgaagccaatccggatctgattttcttaggttcagatgcctacttcaaaggtatcttagaaaatagcttaggcgaatggcgtaaagtggtggcgaagtcgatcgaagtgggtattccaatgccttgtatggcgtctgcgatcactttcttagacagctatacgagtgaacgtttaccagcgaacttactccaagcacaacgtgactatttcggtgcacatacttatgaacgtacggataaaccacgtggtgagttcttccataccaattggacaggtcgtggtggtgatgctgcatcgaccacttatgatgtgtaa

SEQ ID NO: 12049 - protein, 484 aa, Pasteurella multocida
MSVKGDIGVIGLAVMGQNLILNMNDHGFKVVAFNRTTSKVDEFLQGAAKGTNIIGAYSLEDLANKLEKPRKVMLMVRAGEVVDQFIEALLPHLEEGDIIIDGGNTNYPDTNRRVAYLREKGIRFIGTGVSGGEEGARFGPSIMPGGDESAWEHVKPILQAISAKTDKGEACCDWVGRDGAGHFVKMVHNGIEYGDMQLICEAYQFLKEGVGLSDDELEATFKAWRNTELDSYLIDITADILGYKDEDGSRLVDKILDTAGQKGTGKWTGINALDFGIPLTLITESVFARCVSSFKEQRVQASRLFNKVVGKVEGDKAAWVEAVRKALLASKIISYAQGFMLIREASENFGWHINYGGTALLWREGCIIRSRFLGNIRDAYEANPDLIFLGSDAYFKGILENSLGEWRKVVAKSIEVGIPMPCMASAITFLDSYTSERLPANLLQAQRDYFGAHTYERTDKPRGEFFHTNWTGRGGDAASTTYDV

SEQ ID NO: 12050 - DNA, 1407 bp, Escherichia coli
  CDS (1)..(1407)
atgtccaagcaacagatcggcgtcatcggtatggctgtgatggggcgcaacttggctctaagcatcgagagccgtggttataccgtatccgtctataatcgctcgcgtgaaaaaactgaagaggttgttgccgaaaacccaggtaagaaactggtcccttattacacggttaaagagttcgtcgagtctcttgaaactccacgccgtatcctgttaatggtcaaagcgggtgctggcactgatgctgcgattaattccctgaagccctatctagataaaggcgacatcatcattgatggcggtaataccttctttcaggacacaattcgtcgtaaccgtgaactttccgcggaaggctttaactttatcggggccggggtttcaggtggtgaagagggcgcgctgaaaggcccatctatcatgcctggtggccagaaagatgcgtatgaaatggttgtgccaatcctgaccaagattgccgcgatagctgaagatggtgaaccgtgcgtgacgtatattggtgcggatggtgcaggtcattacgtgaagatggtgcacaacggtatcgaatatggcgatatgcaattgatagctgaagcctattctctgctgaaaggtgccctaaatctgtctaatgaagagttagcctctatctttaatgaatggaatgaaggcgagctgagcagctatctgattgacatcactaaggatatcttcaacaaaaaagatgaagagggtaaatacttggttgatgtgattttggacgaagctgcgaacaaaggtacaggcaaatggaccagccagagctctcttgatctaggcgaaccgctgtcgttgatcaccgaatccgtatttgcccgctacatctcctctctgaaagaccagcgtgttgcggcctctaaagtgctgtctggcccgcaggctaaactggctagtgataaagctgagtttgttgagaaagtacgccgtgccttgtacctaggcaaaattgtctcttatgcccaaggcttttctcaacttcgtgccgcatcagagcaatacaactgggatttgaactacggtgaaatcgcgaaaattttccgcgcaggctgcattattcgtgcacagttcctccagaaaatcaccgacgcttatgctgaaaacaaagatattgcaaacctgctgcttgctccgtatttcaaacatatcgctgatgaatatcaacaagccctccgtgatgtagtgtcttatgctgtgcagaacggtattccggtaccgactttctccgccgctgtagcttactacgacagctaccgttctgcggttctgccggctaacttgatccaagcacagcgtgattatttcggtgcgcacacgtataaacgcattgataaagaaggtgtttttcatacagaatggctagaataa

SEQ ID NO: 12051 - protein, 468 aa, Escherichia coli
MSKQQIGVIGMAVMGRNLALSIESRGYTVSVYNRSREKTEEVVAENPGKKLVPYYTVKEFVESLETPRRILLMVKAGAGTDAAINSLKPYLDKGDIIIDGGNTFFQDTIRRNRELSAEGFNFIGAGVSGGEEGALKGPSIMPGGQKDAYEMVVPILTKIAAIAEDGEPCVTYIGADGAGHYVKMVHNGIEYGDMQLIAEAYSLLKGALNLSNEELASIFNEWNEGELSSYLIDITKDIFNKKDEEGKYLVDVILDEAANKGTGKWTSQSSLDLGEPLSLITESVFARYISSLKDQRVAASKVLSGPQAKLASDKAEFVEKVRRALYLGKIVSYAQGFSQLRAASEQYNWDLNYGEIAKIFRAGCIIRAQFLQKITDAYAENKDIANLLLAPYFKHIADEYQQALRDVVSYAVQNGIPVPTFSAAVAYYDSYRSAVLPANLIQAQRDYFGAHTYKRIDKEGVFHTEWLE

SEQ ID NO: 12052 - DNA, 1842 bp, Arabidopsis thaliana
  CDS (62)..(1525)
accaccaacctccgtcaaaaccctaaaccactatctctctctctctcttcatatcgcaacaatggagtccgtcgctctatctcgcataggtctcgccggtctcgcagtcatgggacaaaacctcgccttaaacatcgccgataaaggattcccaatctccgtctacaatcgaaccacttccaaagtcgacgaaaccttagatcgtgcctccaacgaaggaaaactcccagtcgctggtcaatactcgcctcgcgatttcgttctctcgatccaacggcctagatccgttatcatccttgtcaaagccggtgctcccgttgaccaaaccatctctgctctctctgaatacatggagcctggtgattgtatcatcgacggtggaaatgagtggtatcagaacacagagcgacgaatcgttgaagctgagaagaaaggattgctttatttaggtatgggagtctccggtggtgaagaaggagctcgtaatggtccttctcttatgcctggtggatctttcactgcgtataacaatgttaaagatattcttgagaaagttgctgctcaagtcgaagatggtccttgtgttacatacattggagaaggtggatctgggaattttgtgaaaatggttcataatgggattgaatatggtgatatgcagctgatttcggaggcgtatgacgtgttgaagaacgttggtggattgagtaatgatgaattggctgagatcttcacggagtggaatcgaggtgagcttgagagtttcttggttgagattacttcggatatatttagggttaaggatgattatggtgatggagagttagtggataagattttggataagactggtatgaaaggtacagggaaatggacggttcagcaggcggctgagctttctgttgcggcgcctacgattgctgcgtcgttggattgtagatacttgagtggattgaaggatgagagggagaatgctgctaaagttttggaagaagctggattgaaggaggatatcggttctgcgtctcgtggtgttgataagaagaggttgattgatgatgtgaggcaagctttgtatgcttctaagatctgtagttatgctcaagggatgaatttgcttagggctaagagtttagagaaaggttgggacttgaatttgggtgaaatggctaggatttggaaaggtgggtgtattatcagggcggttttcttggacaggatcaagaaagcttaccagagaaacccgaatttggcgagcttagtggttgatcctgattttgctaaagagatggttcagaggcaagctgcatggaggagagtggtgggtcttgctatatctgctgggattagcacaccaggaatgtgcgcaagtttagcgtatttcgacacttacaggcgtgctagattacctgcgaatctggttcaggcgcagagagatctctttggagctcatacatatgagagaaccgatcgtcctggtgcataccacactgaatggactaagcttgcaaggaagagtcagtaaagcatggacacagtcccttgatttgaggttattctctctctctctctctcacactctgtttttgtgcttattctgaattcaatgtttccatgttgttgtgtagggctttatttcatcatagaacacgaaaacaaattgtttcagcttatttttgttgagttataataagaaatgcaatgccccttgactctctgtatctgtctgttgatgatatctggagagtttcctttattttctcttatgtatggcttggttcatttttcgaatttgaatttgatatctatgttgaaattttggaagctgaagtcttcataatt

SEQ ID NO: 12053 - protein, 487 aa, Arabidopsis thaliana
MESVALSRIGLAGLAVMGQNLALNIADKGFPISVYNRTTSKVDETLDRASNEGKLPVAGQYSPRDFVLSIQRPRSVIILVKAGAPVDQTISALSEYMEPGDCIIDGGNEWYQNTERRIVEAEKKGLLYLGMGVSGGEEGARNGPSLMPGGSFTAYNNVKDILEKVAAQVEDGPCVTYIGEGGSGNFVKMVHNGIEYGDMQLISEAYDVLKNVGGLSNDELAEIFTEWNRGELESFLVEITSDIFRVKDDYGDGELVDKILDKTGMKGTGKWTVQQAAELSVAAPTIAASLDCRYLSGLKDERENAAKVLEEAGLKEDIGSASRGVDKKRLIDDVRQALYASKICSYAQGMNLLRAKSLEKGWDLNLGEMARIWKGGCIIRAVFLDRIKKAYQRNPNLASLVVDPDFAKEMVQRQAAWRRVVGLAISAGISTPGMCASLAYFDTYRRARLPANLVQAQRDLFGAHTYERTDRPGAYHTEWTKLARKSQ

SEQ ID NO: 12054 - DNA, 1929 bp, Arabidopsis thaliana
  CDS (280)..(1740)
ctcaaatccatctccgcgatacgaacaggtttgtttctccgatcatactctctctctttttgttttttccccaatcaattttggtttggtatctgattgttccaatcacttttcgatataaatgatgtgtaccgaaatttcagaaaaaattatttaacttttatgtgatccagcatttttgtgtgattccgttgaaaattcccattatgttgtttagatcggtgttttaagtaatcgaatcttcgctcttgttgttagtagagaagaagacttagaaaaatggctgttcaacctacaagaataggtctagctggacttgctgtgatgggtcagaacctagctctcaacattgcagagaaaggcttcccaatctctgtttacaacagaactacttccaaagttgatgagaccgtcgaacgagccaaaaaggaaggcaatcttcctctttacggcttccatgaccccgagtcttttgtcaagtccattcagaagccacgcgttattatcatgcttgttaaggctggttctcccgttgaccagaccatcaagaccctctctgcttatttggagaaaggtgactgtattgtcgatggtggtaatgaatggtatgagaacactgagaggagagaaaaagccgtggcggagaacggtttcctctaccttggaatgggagtttctggtggtgaagaaggtgctcgtaatggcccatctatgatgcctggaggctcttatgaagcctacaagaatatcgaagacattgttctcaaggttgctgctcaggttagggatagtggtccctgtgtgacttatatcggtaagggcgggtctggaaactttgtcaaaatggtccacaatgggatcgagtacggtgatatgcagctgattgcagaagcttatgacgtcctcaagtctgttggtaaattatcgaatgaggagcttcacagtgtcttctctgactggaacaaaggtgagcttgagagtttcttggtagagatcacagcagatattttcgggatcaaggacgataagggagatgggcatttggttgacaaggtcttggacaaaaccggcatgaaaggcacaggaaagtggaccgtgcagcaagctgctgagctatctgttcctgctcccaccattgaatcctctcttgatgcgaggttccttagcgggcttaaagatgaacgtgtgcaagcagctaaagtcttcaaggcaggtgggtttggagatatcttgaccgatcagaaagttgacaagaaacagctagtcgatgacgtgaggaaggctctttacgcatccaaaatctgcagctacgcacaaggcatgaaccttatccgtgccaagagcatagaaaaggggtggggattgaagctaggtgagttagctagaatctggaaaggaggctgcatcatcagagcaatcttcctagacaggatcaagcaagcttatgacaggaacgcagagctagctaacctcttggtggatccagagtttgcgaaagagataatcgagagacagtccgcgtggagaagagtcgtctgcttagctatcaactcgggtatcagcacaccgggtatgtctgcgagtctagcctactttgattcttacaggagagagagattgccggcaaatctagtccaagcacagagagactactttggtgctcatacatatgaaaggactgatgtggaaggatctttccacaccgagtggttcaagattgcaagacaatctaagatctgagatctctcatcctcttgtattcttcttctccttcaataataagttccacacagtatgtttctttcctcaatgtgtgagataccttggcttatttatgattgtagaactgagtttctcatctttgtgtttctttttcttaaaaagattaaaactgaagtctttggttataattttttacttttggtttca

SEQ ID NO: 12055 - protein, 486 aa, Arabidopsis thaliana
MAVQPTRIGLAGLAVMGQNLALNIAEKGFPISVYNRTTSKVDETVERAKKEGNLPLYGFHDPESFVKSIQKPRVIIMLVKAGSPVDQTIKTLSAYLEKGDCIVDGGNEWYENTERREKAVAENGFLYLGMGVSGGEEGARNGPSMMPGGSYEAYKNIEDIVLKVAAQVRDSGPCVTYIGKGGSGNFVKMVHNGIEYGDMQLIAEAYDVLKSVGKLSNEELHSVFSDWNKGELESFLVEITADIFGIKDDKGDGHLVDKVLDKTGMKGTGKWTVQQAAELSVPAPTIESSLDARFLSGLKDERVQAAKVFKAGGFGDILTDQKVDKKQLVDDVRKALYASKICSYAQGMNLIRAKSIEKGWGLKLGELARIWKGGCIIRAIFLDRIKQAYDRNAELANLLVDPEFAKEIIERQSAWRRVVCLAINSGISTPGMSASLAYFDSYRRERLPANLVQAQRDYFGAHTYERTDVEGSFHTEWFKIARQSKI

SEQ ID NO: 12056 - DNA, 912 bp, Methylobacillus flagellatum
  CDS (1)..(912)
atgaaacttgcaattatcggcttgggaaaaatgggcggcaacatggcacgccgtctccttaaacatggcatcgaagtcgtaggcttcgactttaatcaggatgcggtcaaccagatttccctgactaacggcatgattcctgccagctctgtcgaggatgctgtctccaagctgtcgggggaaccccggaaaattgtgtggatcatgctgcctagcggcgacatcaccgaaaaccagatcaaggaccttgtccccttgttgagcaaaggcgacatcatcgttgatggcggaaactcgaattacaaacatagtcagcgccgcggcgcttggctggccgagcacggcattgaattcattgactgtggtacctccggcggcatctggggcctagataatggctactgtctgatgtatggcgggagcaaggatgctgccgatgccgtggtgcccatcatgcaggcgctcgcacatgcagatcgcggctgggcgcatgtcggaccagtcggctccggccacttcaccaagatgatccacaacgggattgagtacggcatgatgcaggcatttgccgaaggcctcgacctgctcaagggcaaggaagagttcaaccttgacctcgcgcagatcacggagctttggcgccatggttctgtcgtccgcagctggctactcgacctgacagcggaagcgctggcgcacgatcaggagttgtccgcgattgcaccatacgttgcagattccggcgaaggccgctggacagtggtcgaggctgttgaccagggtgttgccgcccctgtgctgaccctggcattgcaaatgcgcttcgccagccaggaggatactggctacagctacaagctgctatccatgatgcgcaacgcctttggcggacatgccgtcaaaaccaagtaa

SEQ ID NO: 12057 - protein, 303 aa, Methylobacillus flagellatum
MKLAIIGLGKMGGNMARRLLKHGIEVVGFDFNQDAVNQISLTNGMIPASSVEDAVSKLSGEPRKIVWIMLPSGDITENQIKDLVPLLSKGDIIVDGGNSNYKHSQRRGAWLAEHGIEFIDCGTSGGIWGLDNGYCLMYGGSKDAADAVVPIMQALAHADRGWAHVGPVGSGHFTKMIHNGIEYGMMQAFAEGLDLLKGKEEFNLDLAQITELWRHGSVVRSWLLDLTAEALAHDQELSAIAPYVADSGEGRWTVVEAVDQGVAAPVLTLALQMRFASQEDTGYSYKLLSMMRNAFGGHAVKTK

SEQ ID NO: 12058 - DNA, 1440 bp, Leishmania major
  CDS (1)..(1440)
atgtcgaacgacctcggcattatcggtctcggcgtcatgggcgcgaatctcgccctgaacatcgccgagaagggatttaaagttgccgtcttcaaccgcacctacgcgaagacgacgtcgtttctcaaggagcatgagagcgagaaatttgccgccaacctgaatggatacgggaccatgaaggagttcgctgcgtccctcaagaagccgcgccgcgcgttcattctcgtccaggccggcgccgctactgactctacaatcgagcagctcaaggaagtgttcgagaacggcgacatcataatcgacactggtaatgcgaacttcaaggaccaggacaagcgcgcggctcagttggagagccagggtctccgcttcctcggcatgggcatctccggtggtgaggagggtgcgcgcaaggggccggccttcttcccgggtggcacaccaagcgtgtgggaggaggtgcgcccgatcgtggaggcggctgcggccaaggctgaggacggacgcccgtgcgtgactttcaacggcaagggcggcgctggctcctgcgtgaagatgtatcacaacgctggggagtacgccgtgctgcagatctggggtgaggcgtacagcgccctgcttgccttcggcttcgacaacgatcagatcgccgacgtgttcgagtcgtggaaggcggatggcttccttaaatcctacatgctcgacatctccgttgccgcttgccgagcgagggaggcaacaggcaactatttgtcagagaaggtcaaggaccgcatcggctccaagggcaccggcctctggtctgcccaggaggctctggagattggtgtgccagcgccctcgctcaacatggccgtcatctcacgccagatgaccatgtacaaaggggagcgcatcgccaactgcaaggcgtttcctaacttccctcgtggcccttctgaggaagccacggacaagtccccgaactcccccgaagcgaagaagctgtaccacgccgtcagcctttgtatcatcgcgagctacgcgcagatgttccagtgcttgcgcgagctggacaaggtgtatggattcggcctgaacctgcccgccacgatcgccaccttccgcgccggctgcattctgcagggctacctgctagggcctatgaccaaggccttcgaggagaacccgaacctgcccaacctgatggacgccttcaccaaggagatagcggcgggccttgatgactgccgtcagattctcgccaagctcacagagaacacggcagtgtcactgccggtcatgatggcctcactgtcctacatcaacgccatgtacacggagactcttccgtacggacagctggtgtcgttgcagcgcgacgtctttggccgccacggctacgagcgcacggacaaggacggtcgtgagtcgttcgaatggcccgcactgcagtag

SEQ ID NO: 12059 - protein, 479 aa, Leishmania major
MSNDLGIIGLGVMGANLALNIAEKGFKVAVFNRTYAKTTSFLKEHESEKFAANLNGYGTMKEFAASLKKPRRAFILVQAGAATDSTIEQLKEVFENGDIIIDTGNANFKDQDKRAAQLESQGLRFLGMGISGGEEGARKGPAFFPGGTPSVWEEVRPIVEAAAAKAEDGRPCVTFNGKGGAGSCVKMYHNAGEYAVLQIWGEAYSALLAFGFDNDQIADVFESWKADGFLKSYMLDISVAACRAREATGNYLSEKVKDRIGSKGTGLWSAQEALEIGVPAPSLNMAVISRQMTMYKGERIANCKAFPNFPRGPSEEATDKSPNSPEAKKLYHAVSLCIIASYAQMFQCLRELDKVYGFGLNLPATIATFRAGCILQGYLLGPMTKAFEENPNLPNLMDAFTKEIAAGLDDCRQILAKLTENTAVSLPVMMASLSYINAMYTETLPYGQLVSLQRDVFGRHGYERTDKDGRESFEWPALQ

SEQ ID NO: 12060 - DNA, 1809 bp, Arabidopsis thaliana
  CDS (125)..(1588)
ggctccatcgacgagtccgtcattttcacagtataaatatctccacccactctctctcatcactcccactacctcatttttctctctctacctaaccaatcctaagctcatctctctatctccaatggagtccgccgcactatcccgaatcggtctcgccggactcgccgtgatgggccaaaacctcgccttaaacatcgccgagaaaggtttcccaatctcagtctacaatcgaaccacttccaaagtcgacgaaaccctagatcgagccgccgtcgaaggaaacctcccagtctccggccaatactctccccgcgatttcgtcctctcgatccaacggcctagatctctcatcatcctcgtcaaagctggagctcccgttgaccaaacaatcgacgccttctccgaatacatggagccaggagattgcatcatcgacggtggaaacgaatggtatcagaacacagagcgacggatctccgaagctgagcaaaaaggattgctctatttaggtatgggagtctccggcggcgaagaaggagctcgtaacggtccttcgttaatgcctggtggatcatttcaagcttatgataacatcaaagatattttggagaaagtcgcagctcaagttgaagatggaccttgtgttacttacatcggagaaggtggatctggaaatttcgtgaagatggttcataatgggattgagtatggagatatgcaattgatctctgaagcttatgatgtgttgaagaacgttggtggattaagcaacgaggagcttgctgagattttcactgagtggaattcaggtgagcttgagagtttcttggttgagataacttctgatatatttagggttaaggatgagtttggtgatggagagttagttgataagattttggataagactggtatgaaaggtactgggaaatggacggtgcagcaagcggcggagctgtctgttgcagctccgacgattgctgcttcgttggattgtaggtatttgagtgggttgaaagatgagagggagaatgcagcgaaagtgttgagggaagctggattgaaagaagagattggttctgcgtcgagtggaatcgataagaagagattggttgatgatgttaggcaagctttgtatgcttccaagatttgtagttatgctcaagggatgaatttgcttagagctaagagtttagagaagagttggaacttgaattttggtgaattggctaggatttggaaaggtggttgtattataagagcggttttcttggataggatcaagaaagcttaccagaggaacccggacttggctagtcttgtggttgatcctgagtttgctaaagagatggttcagagacaagctgcttggagaagagttgttggtttggctgtttctgctgggattagcacgcctggaatgtgtgctagtcttgcgtatttcgatacttatagacgtgctagattgccggcgaatctggttcaggcgcagagagatctctttggagctcacacttatgagagaaccgatcgtcctggtgcgtaccatactgaatggactaagcttgccaggaagaaccattgaaaaatccctttctgtttttgtaaaagccctatttgtcttgcttatttttgagcaattggaaatgggatttcaaaccacattgtttaacacgagtattttgttcagatttcagaataagaaatgcagcagcaccttgatttttgtttttgtttctgaacatctttgcttttaaatttgtaaaacatatctcccctgtctttaatagatcgaatgtctagacg

SEQ ID NO: 12061 - protein, 487 aa, Arabidopsis thaliana
MESAALSRIGLAGLAVMGQNLALNIAEKGFPISVYNRTTSKVDETLDRAAVEGNLPVSGQYSPRDFVLSIQRPRSLIILVKAGAPVDQTIDAFSEYMEPGDCIIDGGNEWYQNTERRISEAEQKGLLYLGMGVSGGEEGARNGPSLMPGGSFQAYDNIKDILEKVAAQVEDGPCVTYIGEGGSGNFVKMVHNGIEYGDMQLISEAYDVLKNVGGLSNEELAEIFTEWNSGELESFLVEITSDIFRVKDEFGDGELVDKILDKTGMKGTGKWTVQQAAELSVAAPTIAASLDCRYLSGLKDERENAAKVLREAGLKEEIGSASSGIDKKRLVDDVRQALYASKICSYAQGMNLLRAKSLEKSWNLNFGELARIWKGGCIIRAVFLDRIKKAYQRNPDLASLVVDPEFAKEMVQRQAAWRRVVGLAVSAGISTPGMCASLAYFDTYRRARLPANLVQAQRDLFGAHTYERTDRPGAYHTEWTKLARKNH

SEQ ID NO: 12062 - DNA, 3158 bp, Laminaria digitata
  CDS (68)..(1660)
ctcaaccgagcttgacaatctcgataagtgctaaggatcgagagaggttctacgcgactcatccaagatgtccgcttccgcgctgtccgacgttggcctctatggcttggcggtcatgggacagaacttcgcgctcaacatggcgagccacggcttctccgtgtctgtgagcaaccggtcgcccgagaaggttgacgctaccgttgcgcgcgccaaggaggagggcaacctccccttgaggggcttcaaggaccccaagagcttcgtggactccctctcgaaacctcgcaagatcgtcctgctcgttcaggccggcgccgccgtagacgccaccatcgccacgctttccgagctcttggaggaaggagacatcctcgtcgacggtggcaacgagtggttccccaactcgcagcgccgcgcgaaggagctggagccgaagaagatcatgttcgtcggcatgggtgtctccggcggagaggaaggcgcgcgcaacggcccctcgcttatgcccggtgggcctagggaggcgtacgacgcgctttcgcccatcatttcgaagtgtgctgctcaggtcgacggaccgtgcacaacttacctgggcagcatcggctcaggaaactacgtgaagatggtccacaacggcatcgagtacggagacatgcagctcattgccgaggtgtacgacgtactcaagcacgtggctggcttgaccaacgacgagctttcggctacgttcacggactggaaccagggagagctccagagctttttgatcgagatcacggccgtgattttttcgaggaaggacgacctcacgtccagcggccacgtcgtagacaagatcctcgacaagacaggcatgaagggcactgggcgatggacggtccaggaagccgccgaacgcagcaccgccgcgcctaccatggccgccgcactcgatgcccgctacatgagcggccgcaagggcgagcgtgttgaagctgccaagactctcaagggacccagcacgatcccccaggtgcctaaggcgcagctgatcgaggacatgaaggccgccctttactgctccaagatctgctcatacgcacagggcatgaacctcatcaaggccgcatccgagcacttcgagtggggcgtggacctcggagagtgtgcccgtatctggaagggcggctgcatcatccgggctgcgttccttgacgacatcaagaacgcctatatcaagaacgccgacctcgacaaccttcttgtcgaccccttcatcacctctcagatcttggagcgccaggcggcctggaggcgtgtggtgaccctctgcgtggcaagcggcatcgctgcccctgccatgaccgcgtctctgtcctacttcgactcctaccgccgcgctcgcttgccagccaaccttgttcaggctcagcgcgacttcttcggagcgcacacgtacgagcgcgtggacaaggagggagtcttccactgcctctgggacgacacccacaaggaaatcgcgacatcgccggcgcatggcgggcgaactctaataggatcgctcccaaacttgttccgtcctttgtgtatggggtgtctaaattggagcagcacggtcgtgtctgtagcatactgcggtatgaagtattacatagggagcctgagttttacgtaggcgttagcgtttttttgtgcaatatttgtgcaatacgcatgtttttgtagtcgcttgggtaatcgatggtgtagttgcactagttgtggattacagatggcctcgagtccacgttacagtaccagtgctactttactttgactgagaacagccaaattgcttgcttcgagctacgcaatggtgatcgctgactccaaccggacgagctgttgagactgattgaaccatctctgtagggaaatggattcggtcaagagcaaccgtgtattggtagccagtttacggtagaaataagtaaagacaagggttactgttatgcgtgttgagcttgccttggaaaccaaacaagtaaaaattacacattcctgcacacttttgtcgcgtttgagggaggaagggcatgccaaaatatcggggatgattttcctgcaccccaattttgcttaagggccggggggggggggatggtgatagtcgatttagtcccgaggtaatagtcgtttagtcccgagagacttttcgtctcgtcggtatgtaggtcagacgtcacgaattaaagtaaatataaaaaaaaaaaaaaaaaacctcgtgccgaattcggcgactcgtggccaatcggccagggcccggagtctaccccctacaagggggatgctggatggtcaacgtgtactttccgcccaactacccttctgttgcccccgacctccggttcaacacccccatccggcactgcaacatcaacgcccacgggagggtatgccactccctcctcgaccggtcgtggacgccaagcacgtccgtgtcgtccatcttgggctgcgtgtacggactgctgctctatcctgaccacgacgaccccctagattcaaccctgacgctgcagatgtatgattccaacggggaatacgaggcggccatcatcgagcacgtcatggcccacgccagcaagccgcggaaggtgtgggcgacggagctggaggccgagggtatgtcggaggaggacaggttggccccgtgcttgaggactctggacgaagccgagaaggctctcaagttggcaacttggacgaggcaaggcaggaagcgtgggtggcgtcggtcttggcagctggcggacccgcgcccatcacggtagccccttccatcacaaaaaagcagcacgaagctcacctcccggccctggaggtcgcccgcgcctccgcgtgcatggtggttgcctgggcggcgctgaaggagcctatcccaaagctggacgaagccgagggcatcgtggcaaaagcgcgccgccacaacggcgaaagctcggacgccagcgcttgcctcgcgaaggtggcccaacttcgctggaagaggtgcacgccgttcccggctggggattgccaggctcagggacgccatcgcacggcaaacgtcctatttgcatatggcagacatcaagtcgggcgccatggaggaggcgaggaaagacctacttgctcttcagaccgagctcgag

SEQ ID NO: 12063 - protein, 530 aa, Laminaria digitata
MSASALSDVGLYGLAVMGQNFALNMASHGFSVSVSNRSPEKVDATVARAKEEGNLPLRGFKDPKSFVDSLSKPRKIVLLVQAGAAVDATIATLSELLEEGDILVDGGNEWFPNSQRRAKELEPKKIMFVGMGVSGGEEGARNGPSLMPGGPREAYDALSPIISKCAAQVDGPCTTYLGSIGSGNYVKMVHNGIEYGDMQLIAEVYDVLKHVAGLTNDELSATFTDWNQGELQSFLIEITAVIFSRKDDLTSSGHVVDKILDKTGMKGTGRWTVQEAAERSTAAPTMAAALDARYMSGRKGERVEAAKTLKGPSTIPQVPKAQLIEDMKAALYCSKICSYAQGMNLIKAASEHFEWGVDLGECARIWKGGCIIRAAFLDDIKNAYIKNADLDNLLVDPFITSQILERQAAWRRVVTLCVASGIAAPAMTASLSYFDSYRRARLPANLVQAQRDFFGAHTYERVDKEGVFHCLWDDTHKEIATSPAHGGRTLIGSLPNLFRPLCMGCLNWSSTVVSVAYCGMKYYIGSLSFT

SEQ ID NO: 12064 - DNA, 1422 bp, Buchnera aphidicola
  CDS (1)..(1422)
atgttaaagcaacaagttggtgttataggaatggcagtaatgggaagaaatttagcattaaacattgaaagtaagaagtatacggtatctatttttaatagaactcaatctgtaaccgaagaagttatcaataataacaaagaaaaaaaaatttttccatatttttctattaaagattttgtaaattcattaagaaaacctagatgtattttactcatggtaaaatcagggcaacctacagatgaaactattcaatttattcttccttatttaaataaaggagatatattgattgatggtggaaataccttttataaagactctattagaagaagtaatgatttaatgaaatgtggcattaattttatcggaatgggtgtatctggaggcgagttaggagcattaaatggtccatctattatgccaggtggatccagggaagcatatgatctagtttcttctatgttaaagaaaatatctgcgaaatttaaaaatgaaccatgtgttagttatattggtccaaatggcgctggtcattatgttaaaatgattcacaatggtattgaatatggtgatatgcaattaatatcagaatcatattttatattaaaaaatgtattgaatatgaaaaatgaggaattatctaatacattttctcaatggaataaaggtgagttaaatagttatttaattgaaataacaaaaaatatttttcttaaaaaagaaaaagatggtattcattatttaatagattctatattagatcacgcagaagataaaggcaccggtaaatggattagtcaagatgctttagaacttcatgaaccgctctcactcattactgaatctgttttcgcaagatatttgtcttctcttaaagatcaacgtcttattgcatcaaaaattttaaaaggtccgattttaaaatgtatatcttctcagaataaagaactttttgttgaagaagtacgaagagctttatatttaggtaaaataatttcctatgcacaaggtttctctcaattaaaaaaagcttcagaaaaatattcttggaatttacaatatggtaaaattgctaagatttttagagctggttgtattattcgcgctgattttttagaaagaataactgatgcatttaaaagtaacaatgtaactaacttgttattgacaccttatttttcagaaatatctaataaatatgaaaaatctttacgttatattacctcatatgcaataaaatacggtattcctgttcctacttttgcatccgctatatcatattacgataattatcgaacaatgtcttcgtctgcaaatttaattcaagctcaaagagattattttggagcacatacttatagaagaactgataaaaaaggatattttcatacgaattggttaactaaaaaagagctttaa

SEQ ID NO: 12065 - protein, 473 aa, Buchnera aphidicola
MLKQQVGVIGMAVMGRNLALNIESKKYTVSIFNRTQSVTEEVINNNKEKKIFPYFSIKDFVNSLRKPRCILLMVKSGQPTDETIQFILPYLNKGDILIDGGNTFYKDSIRRSNDLMKCGINFIGMGVSGGELGALNGPSIMPGGSREAYDLVSSMLKKISAKFKNEPCVSYIGPNGAGHYVKMIHNGIEYGDMQLISESYFILKNVLNMKNEELSNTFSQWNKGELNSYLIEITKNIFLKKEKDGIHYLIDSILDHAEDKGTGKWISQDALELHEPLSLITESVFARYLSSLKDQRLIASKILKGPILKCISSQNKELFVEEVRRALYLGKIISYAQGFSQLKKASEKYSWNLQYGKIAKIFRAGCIIRADFLERITDAFKSNNVTNLLLTPYFSEISNKYEKSLRYITSYAIKYGIPVPTFASAISYYDNYRTMSSSANLIQAQRDYFGAHTYRRTDKKGYFHTNWLTKKEL

SEQ ID NO: 12066 - DNA, 1407 bp, Buchnera aphidicola
  CDS (1)..(1407)
atggctaagcaacaaattggtgttataggtatggcggtaatgggacgtaatttagcattaaatatggaacgaaatcaatatacagtatctatatttaatcgatcattagatattactgagaagattatattaaataatcctaacaaaaatttatttccatttttttctataaaagattttgttctttctttaatagtacctagatgtattgtattaatgataaaatcaggagtagctactgacgatacgattaaatcgctaattccttatttaagcaaaggagatattattattgatggtggaaatacattttataaagatactattcaacgtggttatgaattattaaaaataggagtaaatttaattggagctggtttttcaggaggagaaaaaggtgcattatatggtccgtcaatcatgccaggtggtcgtcaagaagcttataattatgtatcacctattttaaaaaaaatagcttcaaattctgaaggaataccatgtgttacgtatattggtcctgatggatctggtcattatgttaaaatggttcataatggtattgaatatggtgatatgcaactgatagctgaatcttattttattttaaaaacattgttgcgactagacaatcaaagcatttcaaaaatttttgatatttggaatcaaggagaattaaacagttatttaattgatatcactaaagatattttaattaaaaaggatgatcagaataattatttaatagattgtatattagacgaaggaagtagcaaaggaacaggtacttggaccactaaaagtgctttagatctgaatgaaccgttaactctaattactgaatcagttttttttaggtatttatcttcattaaaatctcaacgtttattagcgtctaagatattgtgtggtcctaaagatttttttatagttttgaatcgcgatgattttattgaaaaaattcgacaggctttatatttaggaaaaataatttcatatgctcaaggattttcacaattaaatagtgcatctcaaaaatataattggaatttaaagttaggtgaaatttctagaatttttcaatcaggatgtattattcgagcaaaattacttaaaaatattactcaagaatattctagtaataataattttgttaatttattacttacaccttatttcagagaaattgctaatacatatcatagttcgttacgtgaaatcgtgtctatttcagttaaatatggaattcctatacctgctttgtcatctgctatttcatattttgatagttatagatcggcattcttaccttctaatttaattcaggcacaacgagatttttttggagcacacacgtataaaagaattgataaatcaggaatttttcacactaattggtattcttaa

SEQ ID NO: 12067 - protein, 468 aa, Buchnera aphidicola
MAKQQIGVIGMAVMGRNLALNMERNQYTVSIFNRSLDITEKIILNNPNKNLFPFFSIKDFVLSLIVPRCIVLMIKSGVATDDTIKSLIPYLSKGDIIIDGGNTFYKDTIQRGYELLKIGVNLIGAGFSGGEKGALYGPSIMPGGRQEAYNYVSPILKKIASNSEGIPCVTYIGPDGSGHYVKMVHNGIEYGDMQLIAESYFILKTLLRLDNQSISKIFDIWNQGELNSYLIDITKDILIKKDDQNNYLIDCILDEGSSKGTGTWTTKSALDLNEPLTLITESVFFRYLSSLKSQRLLASKILCGPKDFFIVLNRDDFIEKIRQALYLGKIISYAQGFSQLNSASQKYNWNLKLGEISRIFQSGCIIRAKLLKNITQEYSSNNNFVNLLLTPYFREIANTYHSSLREIVSISVKYGIPIPALSSAISYFDSYRSAFLPSNLIQAQRDFFGAHTYKRIDKSGIFHTNWYS

SEQ ID NO: 12068 - DNA, 1610 bp, Candida albicans
  CDS (29)..(1582)
aaatataaaaataaatcaaaaaaggaaaatgaaaaattttaatgccttatcaagattatcaatcttgtcaaaacaattatcgttcaataatactaacagttctattgctagaggtgatatcggtttaattggtttagccgttatgggtcaaaacttgattcttaacatggccgaccatggttacactgttgttgcttacaacagaaccactgccaaagttgatcgtttcttagaaaacgaagctaaaggtaaatccatcctcggtgctcactccatcaaggaattggttgatcaattaaagagaccaagaagaattatgcttttggtcaaagctggtgctccagttgatgaattcattaaccaattattgccatacttggaagaaggtgatatcatcattgacggtggtaactcccatttcccagattctaacagaagatacgaagaattggccaagaaaggtattttgtttgttggttccggtgtttctggtggtgaagaaggtgctagaactggtccatctttgatgccaggtggtaacgaaaaagcttggccacacattaaagagatcttccaagatgttgccgccaagagtgatggtgaaccatgttgtgactgggttggtgatgccggtgctggtcattacgtcaagatggtccacaatggtattgaatatggtgatatgcaattgatttgtgaagcttacgatcttatgaagagagttggtaaatttgaagacaaagaaattggtgacgtgtttgccacatggaacaaaggtgttttggattctttcttgattgaaatcaccagagacattttatactacaatgacccaactgacggtaaaccattggttgaaaaaatcttggatactgctggtcaaaaaggtactggtaaatggactgctgtcaatgcccttgatttgggtatcccagttactttgattggtgaagctgtcttttctagatgtctttctgccatgaaagccgaaagagttgaagcctctaaagccttgaaaggtccacaagttactggtgaatctccaattactgacaaaaaacaatttattgatgatttagaacaagctttgtatgcttccaagattatctcctacacccaaggtttcatgttgatgaaccaagctgctaaggattacggctggaaattgaacaatgctggtattgccttgatgtggagaggtggttgtattatcagatcagttttcttggctgaaattactgctgcttacagaaagaaaccagacttggaaaacttgttgctttacccattctttaacgacgctatcactaaagctcaatctggatggagagcttctgttggtaaggctattcaatatggtattccaactccagctttctctactgctttggctttctacgatggtttaagatctgaaagattaccagctaacttgttacaagctcaaagagattactttggtgctcatactttcaaggtcttgccaggtcaagaaaatgaattgttgaagaaagatgaatggattcacattaactggactggtagaggtggtgatgtttcttcaactacttacgatgcttagagaaaatagtgttaacatgaatttttga

SEQ ID NO: 12069 - protein, 517 aa, Candida albicans
MKNFNALSRLSILSKQLSFNNTNSSIARGDIGLIGLAVMGQNLILNMADHGYTVVAYNRTTAKVDRFLENEAKGKSILGAHSIKELVDQLKRPRRIMLLVKAGAPVDEFINQLLPYLEEGDIIIDGGNSHFPDSNRRYEELAKKGILFVGSGVSGGEEGARTGPSLMPGGNEKAWPHIKEIFQDVAAKSDGEPCCDWVGDAGAGHYVKMVHNGIEYGDMQLICEAYDLMKRVGKFEDKEIGDVFATWNKGVLDSFLIEITRDILYYNDPTDGKPLVEKILDTAGQKGTGKWTAVNALDLGIPVTLIGEAVFSRCLSAMKAERVEASKALKGPQVTGESPITDKKQFIDDLEQALYASKIISYTQGFMLMNQAAKDYGWKLNNAGIALMWRGGCIIRSVFLAEITAAYRKKPDLENLLLYPFFNDAITKAQSGWRASVGKAIQYGIPTPAFSTALAFYDGLRSERLPANLLQAQRDYFGAHTFKVLPGQENELLKKDEWIHINWTGRGGDVSSTTYDA

SEQ ID NO: 12070 - DNA, 1923 bp, Ceratitis capitata
  CDS (222)..(1667)
agttatcgcgcgattgccaacaagttcggtacgggaactaaagtgagctgtgaagaaacgagtgtctagaagctagtttgttcaagcggtgaataaactttgtgcgaaaaaacgtttgtagtgatcgacaaaagtgtggaataaaagggcaaagggaacgttttagaacgtaaagtaaaggcatattttagaaatacaagcaaagcaataacaaaataatcatgtcagctaaagcggatattgcactgatcggtttggccgttatgggtcagaatctcgtattgaatatgaatgataaaggctttgtggtttgcgcctacaatcgcacggtcgagaaggtcaatcaatttctaaagaacgaggccaagggtacaaatgtgatcggtgccacatcgctgcaggatatggtgaacaaattgaagttgccacgcaaaattatgcttttggtcaaggccggtagcgctgtggatgatttcattcagcaattggtgccactattatcgcccggtgatgttattatcgatggtggtaactccgagtaccaggataccgcacgccgttgcgatgaattgcgcgccaagaagatattgtatgttggctctggtgtgagtggtggcgaagagggtgcacgtcatggtccatctcttatgcctggtggtcatcccgaagcgtggccacttatccaacccattttccaatctatctgcgcgaaggcagacaaagaaccctgctgtgagtgggtgggtgaaggcggcgccggacactttgttaaaatggtacacaatggcatcgagtatggtgatatgcagttgatttgcgaagcttatcaaattatgaaagcgcttggactctcacaagctgagatggctactgagtttgagaaatggaatagtgaagaattggattctttccttatcgaaatcacacgtgatattctcaattatcaagacgatagaggctacttgttggaacgtattcgtgatacagccggtcagaagggtactggaaagtggaccgcaatctctgcactacaatatggtgtgcctgttacgctaatcggtgaggcggtattctcacgttgtctctctgcattgaaggatgaacgtgtagcggctagcaaacaattgaagggaccaaatgttaatgccaaagtcgaggatttgccaaaattcttgaatcacattaaacatgccctttactgctcgaaaatcgtgtcctacgcacaaggtttcatgctgatgcgtgaggcagccaaggagaacaactggaacttgaattatggtggtattgcattgatgtggcgtggtggttgtatcattcgcagtgtcttcttgggcaacatcaaggacgcttacacccgcaacccacaactttcgaacttattgttggatgatttcttcaagaaggctatcgaggttggacaaaactcttggcgccaggtggtggccaatgcattcctctggggtattcctgtaccagctctctcaaccgccctctccttctacgatggctaccgtacagagaaattgcccgccaacttgttgcaagcgcagcgtgattatttcggcgcacacacctatgaactcttgggcgctgagggcaaatttgtgcataccaattggaccggcactggtggcaatgtctctgcaagtacataccaggcgtaaggtcgttatgtacatatgtagatacatacaaatcatgaagaaaataccgaaaatattcaggttccccaaaagggcattccacttatttagaaattaattagaacttaattttatattcaagcgtttgtgagtacttgaagatatgtacatacgtatgtacatacatatgtagatataaataaatggtgtaaataaagcaaataattacgcaaatgggtattaaacgaatgaaatacttaaaaaaaaaaaaaaaaaa

SEQ ID NO: 12071 - protein, 481 aa, Ceratitis capitata
MSAKADIALIGLAVMGQNLVLNMNDKGFVVCAYNRTVEKVNQFLKNEAKGTNVIGATSLQDMVNKLKLPRKIMLLVKAGSAVDDFIQQLVPLLSPGDVIIDGGNSEYQDTARRCDELRAKKILYVGSGVSGGEEGARHGPSLMPGGHPEAWPLIQPIFQSICAKADKEPCCEWVGEGGAGHFVKMVHNGIEYGDMQLICEAYQIMKALGLSQAEMATEFEKWNSEELDSFLIEITRDILNYQDDRGYLLERIRDTAGQKGTGKWTAISALQYGVPVTLIGEAVFSRCLSALKDERVAASKQLKGPNVNAKVEDLPKFLNHIKHALYCSKIVSYAQGFMLMREAAKENNWNLNYGGIALMWRGGCIIRSVFLGNIKDAYTRNPQLSNLLLDDFFKKAIEVGQNSWRQVVANAFLWGIPVPALSTALSFYDGYRTEKLPANLLQAQRDYFGAHTYELLGAEGKFVHTNWTGTGGNVSASTYQA

SEQ ID NO: 12072 - DNA, 1594 bp, Cunninghamella elegans
  CDS (28)..(1485)
gaattcgcggccggtcgacaaacaatcatggttgaagctgttgctgatattggtcttattggtttagccgttatgggtcaaaacttgattttgaacatgaacgaccacggttttgttgtttgtgcttataaccgtactacttctaaagttgatgacttcttagctaatgaagctaaaggtactaatgttgttggtgctcactctgttgaagaactctgtgccaaattaaaacgccctagaaaggtcatgttacttgttaaggctggttctgccgttgatgctttcattgatcaacttttacctcatttagaagaaggtgatattatcattgatggtggtaattctcatttccctgattctatccgtcgtactaaggaattagaagctaaaggtattcttttcgttggttccggtgtttctggtggtgaagaaggtgctcgttatggtccttctttaatgcctggtggtaattctaaagcttgggaacatattcaacctatcttccaagctatcgctgctaaggctcccgatggtgcttcttgttgtgaatgggtaggtgaaactggtgctggtcattatgttaagatggtacacaacggtattgaatatggcgatatgcaattgatcactgaagtttatcaaattttacatgaaggtcttggtttaagtcacgatgaaatggctgatatctttgaagaatggaacaagggagatttagattccttcttaattgaaattacacgtgatatccttagattcaaggatactgatggtcaaccattagttaccaagattcgtgatacagctggtcaaaaaggtactggtaaatggactgctattgattctttagatcgtggtatccctgtcactttaattggtgaagccgtttattcccgttgtttatcttctcttaaagatgaacgtgttcgtgcttccaagatcttacaaggtccctcttcatccaaattcactggtgataagaaaaccttcattgctcaattaggacaagctctttatgctgccaagattgtttcttatgctcaaggttatatgttaatgcgtcaagctgctaaggattatgaatggaagttaaataatgctggtattgctttaatgtggcgtggtggatgtatcatccgttccgtcttcttaggaaagattcgtgatgcttacaccaagaaccctgaattagaaaatttattattcgatgatttcttcaaggatgctactgctaaggcccaagatgcttggagaaacgttactgctcaagctgtgcttatgggtatccctacccctgctttatctactgctttgaacttctatgatggtcttcgtcatgaaatcttacctgctaacttacttcaagctcaacgtgattactttggtgctcacacttatgaattattacatactcctggtaaatgggtacacactaactggactggtcgtggtggtaatgtttctgcttctacctatgatgcttaaaaaaataataatacaaaaatcatcatcctttctaatgaaatattattagtaattttaatttaataagatattattaataagaaaaaaaaaaaaaaaaaaaaaaaaaaaa

SEQ ID NO: 12073 - protein, 485 aa, Cunninghamella elegans
MVEAVADIGLIGLAVMGQNLILNMNDHGFVVCAYNRTTSKVDDFLANEAKGTNVVGAHSVEELCAKLKRPRKVMLLVKAGSAVDAFIDQLLPHLEEGDIIIDGGNSHFPDSIRRTKELEAKGILFVGSGVSGGEEGARYGPSLMPGGNSKAWEHIQPIFQAIAAKAPDGASCCEWVGETGAGHYVKMVHNGIEYGDMQLITEVYQILHEGLGLSHDEMADIFEEWNKGDLDSFLIEITRDILRFKDTDGQPLVTKIRDTAGQKGTGKWTAIDSLDRGIPVTLIGEAVYSRCLSSLKDERVRASKILQGPSSSKFTGDKKTFIAQLGQALYAAKIVSYAQGYMLMRQAAKDYEWKLNNAGIALMWRGGCIIRSVFLGKIRDAYTKNPELENLLFDDFFKDATAKAQDAWRNVTAQAVLMGIPTPALSTALNFYDGLRHEILPANLLQAQRDYFGAHTYELLHTPGKWVHTNWTGRGGNVSASTYDA

SEQ ID NO: 12074 - DNA, 1419 bp, Lactococcus lactis
  CDS (1)..(1419)
atggcacaagcaaactttggtgttgtcggaatggctgtaatgggtaaaaaccttgcactcaatgttgagtcacgtggttataccgttgctatctacaaccgtacgacttcaaaaactgaagaagtttttaaagaacatcaagataaaaatcttgttttcacaaaaacacttgaagaatttgtcggaagtcttgaaaaaccacgtcgtatcatgctcatggttcaagcgggagctgctactgatgcaaccatcaaatcactcttaccacttttggacataggcgacatcttgattgatggtgggaatactcatttcccagatacaatgcgtcgtaatgctgaacttgctgactcaggaatcaacttcattggtactggtgtttcaggtggagaaaaaggagcgctcttgggcccttctatgatgcctggtggacaaaaagaagcttatgatttagtagctccaatttttgaacaaatcgcagctaaagctcctcaagacggtaaaccatgtgttgcttatatgggagccaatggtgcgggacattacgttaaaatggttcataacggaattgagtatggcgacatgcaattgattgctgaatcttatgaccttttgaaacgtattcttggacttagcaacgcagaaattcaagccatttttgaagaatggaatgaaggcgaacttgatagctacctcatcgaaatcacaaaagaagtattgaaacgtaaagatgatgaaggcgaaggctatatcgttgataaaattcttgataaagcaggaaataaaggaactggtaaatggacttcagaatctgcccttgaccttggtgtaccacttccattgattacagaatcagtatttgctcgttacatttcaacctataaagatgaacgtgttaaagcaagcaaagttttgtctggcccagctcttgatttctcaggcgataaaaaagaagtaatcgaaaaaatccgcaaagcactttatttctcaaaaattatgagttatgctcaaggatttgctcaacttcgcaaagcttctgaagaatttgattgggacttgccatacggtacaattgctcaaatttggcgtgctggatgtatcatccgtgcagaattcctccaaaacattactgatgctttcgataaagatagcgaacttgaaaacctcttgcttgatgactactttgtagacatcacaaaacgttatcaagaagctgttcgtgatgtggtttcacttgctgttcaagcaggaactccaattccaacattcacctcagcaattagctactacgatagctatcgctctgaaaatcttcctgcaaacttgattcaagctcaacgtgactatttcggtgctcacacttatgaacggactgataaagcaggaattttccattacgactggtatacagaagattaa

SEQ ID NO: 12075 - protein, 472 aa, Lactococcus lactis
MAQANFGVVGMAVMGKNLALNVESRGYTVAIYNRTTSKTEEVFKEHQDKNLVFTKTLEEFVGSLEKPRRIMLMVQAGAATDATIKSLLPLLDIGDILIDGGNTHFPDTMRRNAELADSGINFIGTGVSGGEKGALLGPSMMPGGQKEAYDLVAPIFEQIAAKAPQDGKPCVAYMGANGAGHYVKMVHNGIEYGDMQLIAESYDLLKRILGLSNAEIQAIFEEWNEGELDSYLIEITKEVLKRKDDEGEGYIVDKILDKAGNKGTGKWTSESALDLGVPLPLITESVFARYISTYKDERVKASKVLSGPALDFSGDKKEVIEKIRKALYFSKIMSYAQGFAQLRKASEEFDWDLPYGTIAQIWRAGCIIRAEFLQNITDAFDKDSELENLLLDDYFVDITKRYQEAVRDVVSLAVQAGTPIPTFTSAISYYDSYRSENLPANLIQAQRDYFGAHTYERTDKAGIFHYDWYTED

SEQ ID NO: 12076 - DNA, 1407 bp, Shigella flexneri
  CDS (1)..(1407)
atgtcaaagcaacagatcggcgtagtcggtatggcagtgatggggcgcaaccttgcgctcaacatcgaaagtcgtggttataccgtctctattttcaaccgctcccgcgaaaagacggaagaagtgattgctgaaaatccaggcaagaaactggctccttactatacggtgaaagagtttgttgaatctctggaaacgcctcgtcgcatcctgttaatggtgaaagcaggtgcaggcacggatgctgcgattgattccctgaaaccatatctcgataaaggtgacatcatcattgatggtggtaataccttcttccaggacaccattcgtcgtaatcgtgagctttcagcagagggctttaacttcatcggtaccggtgtttccggcggtgaagagggcgcgctgaaaggtccttctattatgcctggcgggcagaaagaggcttatgagctggttgcgcctatcctgactaaaatcgctgccgtggcagaagacggcgagccatgcgttacttatattggtgccgacggcgcaggccattatgtgaagatggttcacaatggtattgaatacggagatatgcagctcattgctgaagcgtattctctgctcaaaggtggcctgaatctatctaatgaagaactggcccagactttcaccgagtggaataacggtgaacttagcagctacctgatcgacatcactaaagatatcttcaccaaaaaagatgaagacggtaactacctggttgatgtgattctggatgaagcagcaaacaaaggcaccggtaaatggaccagccagagcgcgctggatctcggcgaaccgctgtcgctgattaccgagtctgtgtttgcacgttatatctcttctctgaaagatcagcgcgttgccgcatctaaagttctctctggtccgcaagctcagtcagcaggcgacaaggctgagttcatcgaaaaagttcgcagtgcgctgtatctgggcaaaatcgtttcttacgctcagggcttctctcagctgcgtgctgcgtctgaagaatacaattgggatctgaactacggcgaaatcgcgaagattttccgtgctggctgcatcatccgtgcgcagttcctgcagaaaatcaccgatgcttatgccgaaaatccgcagatcgctaacctgctgctggccccgtacttcaagcaaattgccgatgactaccagcaggcgctgcgcgatgtcgtcgcttatgcagtacagaacggtatcccggttccgaccttcgccgctgcggttgcctattacgatagctaccgtgccgcggttctgcctgcgaacctgatccaggcacagcgtgactatttcggggcgcatacttataagcgcattgataaagaaggtgtgttccatactgaatggctggattaa

SEQ ID NO: 12077 - protein, 468 aa, Shigella flexneri
MSKQQIGVVGMAVMGRNLALNIESRGYTVSIFNRSREKTEEVIAENPGKKLAPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQSAGDKAEFIEKVRSALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 12078 - DNA, 1425 bp, Staphylococcus epidermidis
  CDS (19)..(1425)
acaagagaggtaagtaatatgacacaacaaattggagtagtgggtttagcagtaatggggaaaaacctagcttggaatattgaatcacgtggttatagtgtttctgtttataaccgatcaagacaaaaaactgatgaaatggttaaagaatcgcctggaagagaaatttacccaacatactcattagaagaatttgtagaatctttagagaaacctcgtaagattttattaatggtaaaagctggacctgcaacagatgccactatagatggtttattacctttattagacgatgatgatattttaattgatggtggtaatactaattaccaagatacgattcgtcgaaataaagctttagctgaaagtagtattaactttattggtatgggagtttctggtggagaaatcggcgcactcacgggcccttctttaatgccaggtggtcaaaaagatgcttataacaaagtcagcgatatcttggacgcaattgctgctaaggcacaagatggtgcttcatgtgtaacttacattggccctaatggtgcaggacattatgttaagatggtacacaatggtatcgaatatgcagatatgcaattaattgctgaaagttatgcaatgatgaaagatttattaggcatgtcacataaagaaatttctcaaacttttaaagaatggaatgctggagaacttgaaagttatttaatagaaattacaggtgatattttcaataaattagatgatgacaatgaagcacttgtagaaaaaatattagatactgcaggtcaaaaaggcacaggtaaatggacttcaattaacgcactagaattaggtgttcctttaacaatcattacagaatctgtatttgcgagattcatctcatcaattaaagaagaacgtgttactgcttctaaatctttaaaaggacctaaagcacattttgaaggcgataaaaaaacattcttagaaaaaatacgtaaggcactttatatgagtaaaatatgctcatatgcacaaggtttcgctcaaatgagaaaagccagtgaagataatgagtggaatttgaaattaggcgaattagcaatgatttggcgtgaaggttgtattattcgtgcacaattcctacaaaaaattaaagatgcctacgataataatgaaaacttacaaaacttattattagacccttacttcaaaaacattgttatggaatatcaagatgcactacgtgaagtagtagctactagcgtgtacaatggcgtgccaacacctggtttttcagcaagtataaattattatgatagttatcgctcagaggatttacctgcaaacttaattcaagcacaacgtgattactttggcgcacatacttatgaacgtaaagaccgtgaaggtattttccatacacaatgggtagaagaataa

SEQ ID NO: 12079 - protein, 468 aa, Staphylococcus epidermidis
MTQQIGVVGLAVMGKNLAWNIESRGYSVSVYNRSRQKTDEMVKESPGREIYPTYSLEEFVESLEKPRKILLMVKAGPATDATIDGLLPLLDDDDILIDGGNTNYQDTIRRNKALAESSINFIGMGVSGGEIGALTGPSLMPGGQKDAYNKVSDILDAIAAKAQDGASCVTYIGPNGAGHYVKMVHNGIEYADMQLIAESYAMMKDLLGMSHKEISQTFKEWNAGELESYLIEITGDIFNKLDDDNEALVEKILDTAGQKGTGKWTSINALELGVPLTIITESVFARFISSIKEERVTASKSLKGPKAHFEGDKKTFLEKIRKALYMSKICSYAQGFAQMRKASEDNEWNLKLGELAMIWREGCIIRAQFLQKIKDAYDNNENLQNLLLDPYFKNIVMEYQDALREVVATSVYNGVPTPGFSASINYYDSYRSEDLPANLIQAQRDYFGAHTYERKDREGIFHTQWVEE

SEQ ID NO: 12080 - DNA, 2156 bp, Trypanosoma brucei brucei
  CDS (140)..(1579)
ttttatacatatatttactaccacataaattgttgatatcattacgaagtggcctgtggtgcaaacaacaggaaacacctgtggaaaggcataaaaataactgttgttactttcaggaaggggaaaaagacggaagatcatgtcaatggatgtcggtgttgtcggcctcggggtgatgggtgcgaacctggccttgaacattgcggagaaagggtttaaagttgctgtgttcaaccgtacgtactctaagagcgaggaattcatgaaagcgaatgcctctgctccatttgcgggtaatttgaaggcgtttgaaactatggaggcatttgcagcgtcactcaagaaacctcgaaaggccctcatcctggtgcaggcgggcgcggctacggactcaacaaccgaacaacttaagaaagtgtttgagaagggagatatcctcgttgataccggtaacgcgcattttaaggatcagggacgccgcgcccagcagctggaggcggcaggtctccggtttcttgggatgggcatatccgggggcgaggagggtgcacgcaaagggccagcctttttccctggagggacgcttagtgtgtgggaggaaatacgaccaattgttgaggccgccgcagctaaggcagatgatggccggccctgtgtgacgatgaacggcagcggcggcgcgggatcatgcgtgaagatgtaccacaattcgggtgaatacgccattttgcaaatctggggtgaggtttttgacatccttcgggcaatgggactgaacaacgatgaagttgctgccgttcttgaagattggaaatcaaagaacttcttgaagtcttatatgctcgatatctcaattgcagccgcgcgggcaaaggataaggatggaagttatcttacggagcacgtgatggatcgtattggatcgaagggcaccggcttatggtccgcccaagaggctctcgagattggagtccctgcgcccagtttgaacatggctgtcgtatcgcggcagttcacaatgtataaaactgagcgtcaagcgaatgccagcaatgcacccggtattactcaatcccctggatacactctcaaaaacaaaagccccagtgggcccgaaattaagcagctctacgactctgtgtgcattgccattatctcatgctacgctcaaatgtttcagtgcctgcgtgagatggacaaggtgcataacttcggactcaatcttccagctaccattgcaactttccgcgccggttgcattttgcagggctaccttttaaaacccatgactgaggcattcgaaaagaatcccaacattagcaatctcatgtgtgcattccaaaccgagatcagggcaggactacagaattaccgcgatatggtggcacttatcacatcaaagttggaagtgtccattcctgtgctgtcagcctccctcaattacgttactgcgatgtttacgccaacactcaagtatgggcaacttgtgtcgttgcagcgggatgtgttcggtcggcacggctacgaaagggtggataaagacggccgcgaatcattccaatggcctgagttgcaataacatactttgcctcatattctcttcgtcctttcctctgttctattaacagaaatctacgatgtgacatggagcgattgtgtgatacgggggttgatcggatgtacacgcgcgtattttcatacacaatttgtcgtgcaacaacctcgtggaacaaccgaaagggaaaaggagagagacaaaaggtgtcgaagggggaacggaaaaaatgtgcgtgtgggcaaggcggatgtgcaaaaggtagctgaatagcggaaggggagaggagggttgtggtttattgttatactggtgcaaaagttgggagggagaagagtgacactggggttctttctttttcttttttcaatgctctgaagcaccttccgccttctcacttcgccgatgtcgtgcacatcataaaccccttttgagtaattaactttttattttgccgtgggaaagatctgtgtggcgctgatttttcttttaccattacaatttattatattattttgaaaaaaaaaacgcctggtgaattttctaacgacatgtttgtttagtttgtctttttccaacactatttggagtactttgttta

SEQ ID NO: 12081 - protein, 479 aa, Trypanosoma brucei brucei
MSMDVGVVGLGVMGANLALNIAEKGFKVAVFNRTYSKSEEFMKANASAPFAGNLKAFETMEAFAASLKKPRKALILVQAGAATDSTTEQLKKVFEKGDILVDTGNAHFKDQGRRAQQLEAAGLRFLGMGISGGEEGARKGPAFFPGGTLSVWEEIRPIVEAAAAKADDGRPCVTMNGSGGAGSCVKMYHNSGEYAILQIWGEVFDILRAMGLNNDEVAAVLEDWKSKNFLKSYMLDISIAAARAKDKDGSYLTEHVMDRIGSKGTGLWSAQEALEIGVPAPSLNMAVVSRQFTMYKTERQANASNAPGITQSPGYTLKNKSPSGPEIKQLYDSVCIAIISCYAQMFQCLREMDKVHNFGLNLPATIATFRAGCILQGYLLKPMTEAFEKNPNISNLMCAFQTEIRAGLQNYRDMVALITSKLEVSIPVLSASLNYVTAMFTPTLKYGQLVSLQRDVFGRHGYERVDKDGRESFQWPELQ

SEQ ID NO: 12082 - DNA, 1878 bp, Brachydanio rerio
  CDS (76)..(1527)
ttcagcagagaccgaataacagcagtcaaaaccctcatcgaaactctcatttttgaacggaaccaaacttcaacaatggctcaagcagatattgctctcattggtctggctgtgatgggtcagaatctgatcctgaacatgaatgaccatggatttgtggtctgtgcattcaacagaaccgtctccaaagtccatgacttcttaaacaatgaagccaaaggcactaaggtgatcggggccgaatcgcttgaagacatggtgtcaaaactcaaaaaacctcgccgcatcatcctgctggtcaaggcaggacaggctgttgatgacttcatcgataaactggttcctcttcttgagcctggagacatcatcattgatggtggaaattcagagtacagagatacaacgagacgttgtaagagcctgaaggagaagaatcttctgtttgtgggtagtggagtaagtggaggagaagatggggcacgttacggaccctcgctgatgcccggaggacataaagatgcctggccacacttaaaagacatttttcagagcattgctgccaaagtgggcaccggagagccgtgctgcgactgggttggagatgaaggagcgggtcattttgttaaaatggtccacaacggtattgaatacggggacatgcagctgatctgtgaggcctatcatctgatgaaggacgtgctttgtatgaaccatgatgaaatggctcaggtcttcgaacagtggaataagacagagctggactccttcctcatcgagatcacagccaacatcctaaaattcaaggacgcagacggcactaacctgctgcccaaaattagagacagcgccgggcagaagggcacagggaaatggacggctatctctgctctggaatacggcacacctgtcacactgatcggggaagctgtctttgccagatgcctctcgtctctgaaggatgaaagagttcaggccagtaagagcctcagcggccctcagggtgtcaagttcactggaaacaaagaacagttccttgaagacattagaaaggccttgtatgcctctaagatcatttcgtatgctcaaggcttcatgctgctgcgtcaggctgcgctggagttcggctggtctctgaattatggtgctattgctctgatgtggagaggaggctgcatcatccgcagtgttttcttgggaaagatcaaggaagcgtttgaccggaacccagagctgcagagtttgttgctggacagcttcttcagtaaggctgtacaggattgtcaggactcgtggcgtagggttgtgagtacaggtgtgcagcagggaatccccatgcccagtttcaccaccgcactgtccttctatgacgggtacagacacgagatgctcccagcaaacctgctgcaggcacagagagactactttggtgcgcacacgtatgagctgctatcaaaccctgggactttcatccacactaactggacaggacacggtgggaaagtgtcatcttcatcctataatgcctaaaatcaagaagccaccattggtaaaacagcagacaacatcccctcttgatgaaggaccagagcagctgatcacattcctgcagaagagctggagttcttactgaatgagtgttcaaacacacatttctatttatactagatcatagtatacacactatttgtacactttcgttcttgtagttttaaggtgcactgttgcaaacacactatcttcgagtgtgtgagatttttcctgctgtaaaccagtcatactttgcccccggagttcacagcgttaaccctggattacggtgactattgcactgcattaggctaaataaagatttcaatccctaaaaaaaaaaaaaaaaaa

SEQ ID NO: 12083 - protein, 483 aa, Brachydanio rerio
MAQADIALIGLAVMGQNLILNMNDHGFVVCAFNRTVSKVHDFLNNEAKGTKVIGAESLEDMVSKLKKPRRIILLVKAGQAVDDFIDKLVPLLEPGDIIIDGGNSEYRDTTRRCKSLKEKNLLFVGSGVSGGEDGARYGPSLMPGGHKDAWPHLKDIFQSIAAKVGTGEPCCDWVGDEGAGHFVKMVHNGIEYGDMQLICEAYHLMKDVLCMNHDEMAQVFEQWNKTELDSFLIEITANILKFKDADGTNLLPKIRDSAGQKGTGKWTAISALEYGTPVTLIGEAVFARCLSSLKDERVQASKSLSGPQGVKFTGNKEQFLEDIRKALYASKIISYAQGFMLLRQAALEFGWSLNYGAIALMWRGGCIIRSVFLGKIKEAFDRNPELQSLLLDSFFSKAVQDCQDSWRRVVSTGVQQGIPMPSFTTALSFYDGYRHEMLPANLLQAQRDYFGAHTYELLSNPGTFIHTNWTGHGGKVSSSSYNA

SEQ ID NO: 12084 - DNA, 25 bp, Primer
atgtcaaaggcagtaggtgatttag

SEQ ID NO: 12085 - DNA, 25 bp, Primer
ttaagcttggtaggttgaggaagat

SEQ ID NO: 12086 - DNA, 1851 bp, Saccharomyces cerevisiae; identical to SEQ ID NO: 161
  CDS (1)..(1851)

SEQ ID NO: 12087 - protein, 616 aa, Saccharomyces cerevisiae; identical to SEQ ID NO: 162

SEQ ID NO: 12088 - DNA, 1575 bp, Homo sapiens (man); identical to SEQ ID NO: 163
  CDS (1)..(1575)

SEQ ID NO: 12089 - protein, 524 aa, Homo sapiens (man); identical to SEQ ID NO: 164

SEQ ID NO: 12090 - DNA, 1764 bp, Kluyveromyces marxianus var. lactis, Candida sphaerica; identical to SEQ ID NO: 165
  CDS (1)..(1764)

SEQ ID NO: 12091 - protein, 587 aa, Kluyveromyces marxianus var. lactis, Candida sphaerica; identical to SEQ ID NO: 166

SEQ ID NO: 12092 - DNA, 2655 bp, Saccharomyces cerevisiae; identical to SEQ ID NO: 167
  CDS (1)..(2655)

SEQ ID NO: 12093 - protein, 884 aa, Saccharomyces cerevisiae; identical to SEQ ID NO: 168

SEQ ID NO: 12094 - DNA, 1491 bp, Homo sapiens (man); identical to SEQ ID NO: 169
  CDS (1)..(1491)

SEQ ID NO: 12095 - protein, 496 aa, Homo sapiens (man); identical to SEQ ID NO: 170

SEQ ID NO: 12096 - DNA, 1770 bp, Arabidopsis thaliana (mouse-ear cress); identical to SEQ ID NO: 171
  CDS (108)..(1589)

SEQ ID NO: 12097 - protein, 493 aa, Arabidopsis thaliana (mouse-ear cress); identical to SEQ ID NO: 172

SEQ ID NO: 12098 - DNA, 1449 bp, Bacillus subtilis; identical to SEQ ID NO: 173
  CDS (1)..(1449)

SEQ ID NO: 12099 - protein, 482 aa, Bacillus subtilis; identical to SEQ ID NO: 174

SEQ ID NO: 12100 - DNA, 1644 bp, Arabidopsis thaliana (mouse-ear cress); identical to SEQ ID NO: 175
  CDS (1)..(1644)

SEQ ID NO: 12101 - protein, 547 aa, Arabidopsis thaliana (mouse-ear cress); identical to SEQ ID NO: 176

SEQ ID NO: 12102 - DNA, 1395 bp, Bacillus subtilis; identical to SEQ ID NO: 177
  CDS (1)..(1395)

SEQ ID NO: 12103 - protein, 464 aa, Bacillus subtilis; identical to SEQ ID NO: 178

SEQ ID NO: 12104 - DNA, 1527 bp, Arabidopsis thaliana (mouse-ear cress); identical to SEQ ID NO: 179
  CDS (1)..(1527)

SEQ ID NO: 12105 - protein, 508 aa, Arabidopsis thaliana (mouse-ear cress); identical to SEQ ID NO: 180

SEQ ID NO: 12106 - DNA, 1566 bp, Arabidopsis thaliana (mouse-ear cress); identical to SEQ ID NO: 181
  CDS (1)..(1566)

SEQ ID NO: 12107 - protein, 521 aa, Arabidopsis thaliana (mouse-ear cress); identical to SEQ ID NO: 182

SEQ ID NO: 12108 - DNA, 1536 bp, Arabidopsis thaliana (mouse-ear cress); identical to SEQ ID NO: 183
  CDS (1)..(1536)

SEQ ID NO: 12109 - protein, 511 aa, Arabidopsis thaliana (mouse-ear cress); identical to SEQ ID NO: 184

SEQ ID NO: 12110 - DNA, 1410 bp, Clostridium acetobutylicum; identical to SEQ ID NO: 185
  CDS (1)..(1410)

SEQ ID NO: 12111 - protein, 469 aa, Clostridium acetobutylicum; identical to SEQ ID NO: 186

SEQ ID NO: 12112 - DNA, 2234 bp, Saccharomyces cerevisiae; identical to SEQ ID NO: 187
  CDS (1)..(1845)

SEQ ID NO: 12113 - protein, 614 aa, Saccharomyces cerevisiae; identical to SEQ ID NO: 188

SEQ ID NO: 12114 - DNA, 2890 bp, Saccharomyces cerevisiae; identical to SEQ ID NO: 189
  CDS (818)..(2443)

SEQ ID NO: 12115 - protein, 541 aa, Saccharomyces cerevisiae; identical to SEQ ID NO: 190

SEQ ID NO: 12116 - DNA, 1602 bp, Emericella nidulans, Aspergillus nidulans; identical to SEQ ID NO: 191
  CDS (1)..(1602)

SEQ ID NO: 12117 - protein, 533 aa, Emericella nidulans, Aspergillus nidulans; identical to SEQ ID NO: 192

SEQ ID NO: 12118 - DNA, 1704 bp, Kluyveromyces marxianus var. lactis, Candida sphaerica; identical to SEQ ID NO: 193
  CDS (1)..(1704)

SEQ ID NO: 12119 - protein, 567 aa, Kluyveromyces marxianus var. lactis, Candida sphaerica; identical to SEQ ID NO: 194

SEQ ID NO: 12120 - DNA, 2211 bp, Saccharomyces cerevisiae; identical to SEQ ID NO: 195
  CDS (508)..(2211): n means a or g or c or t/u, s means g or c

SEQ ID NO: 12121 - protein, 567 aa, Saccharomyces cerevisiae; identical to SEQ ID NO: 196

SEQ ID NO: 12122 - DNA, 2160 bp, Saccharomyces cerevisiae; identical to SEQ ID NO: 197
  CDS (216)..(1928)

SEQ ID NO: 12123 - protein, 570 aa, Saccharomyces cerevisiae; identical to SEQ ID NO: 198

SEQ ID NO: 12124 - DNA, 2037 bp, Saccharomyces cerevisiae; identical to SEQ ID NO: 199
  CDS (157)..(1869)

SEQ ID NO: 12125 - protein, 570 aa, Saccharomyces cerevisiae; identical to SEQ ID NO: 200

SEQ ID NO: 12126 - DNA, 3025 bp, Saccharomyces cerevisiae; identical to SEQ ID NO: 201
  CDS (510)..(2288)

SEQ ID NO: 12127 - protein, 592 aa, Saccharomyces cerevisiae; identical to SEQ ID NO: 202

SEQ ID NO: 12128 - DNA, 1641 bp, Saccharomyces cerevisiae; identical to SEQ ID NO: 203
  CDS (1)..(1641)

SEQ ID NO: 12129 - protein, 546 aa, Saccharomyces cerevisiae; identical to SEQ ID NO: 204

SEQ ID NO: 12130 - DNA, 1695 bp, Saccharomyces cerevisiae; identical to SEQ ID NO: 205
  CDS (1)..(1695)

SEQ ID NO: 12131 - protein, 564 aa, Saccharomyces cerevisiae; identical to SEQ ID NO: 206

SEQ ID NO: 12132 - DNA, 3277 bp, Saccharomyces cerevisiae; identical to SEQ ID NO: 207
  CDS (802)..(2505)

SEQ ID NO: 12133 - protein, 567 aa, Saccharomyces cerevisiae; identical to SEQ ID NO: 208

SEQ ID NO: 12134 - DNA, 1710 bp, Saccharomyces cerevisiae; identical to SEQ ID NO: 209
  CDS (1)..(1710)

SEQ ID NO: 12135 - protein, 569 aa, Saccharomyces cerevisiae; identical to SEQ ID NO: 210

SEQ ID NO: 12136 - DNA, 1701 bp, Kluyveromyces marxianus var. lactis, Candida sphaerica; identical to SEQ ID NO: 211
  CDS (1)..(1701)

SEQ ID NO: 12137 - protein, 566 aa, Kluyveromyces marxianus var. lactis, Candida sphaerica; identical to SEQ ID NO: 212

SEQ ID NO: 12138 - DNA, 1809 bp, Saccharomyces cerevisiae; identical to SEQ ID NO: 213
  CDS (1)..(1809)

SEQ ID NO: 12139 - protein, 602 aa, Saccharomyces cerevisiae; identical to SEQ ID NO: 214

SEQ ID NO: 12140 - DNA, 2064 bp, Saccharomyces cerevisiae; identical to SEQ ID NO: 215
  CDS (290)..(1912)

SEQ ID NO: 12141 - protein, 540 aa, Saccharomyces cerevisiae; identical to SEQ ID NO: 216

SEQ ID NO: 12142 - DNA, 3323 bp, Saccharomyces cerevisiae; identical to SEQ ID NO: 217
  CDS (1189)..(2883)

SEQ ID NO: 12143 - protein, 564 aa, Saccharomyces cerevisiae; identical to SEQ ID NO: 218

SEQ ID NO: 12144 - DNA, 3143 bp, Saccharomyces cerevisiae; identical to SEQ ID NO: 219
  CDS (962)..(2686)

SEQ ID NO: 12145 - protein, 574 aa, Saccharomyces cerevisiae; identical to SEQ ID NO: 220

SEQ ID NO: 12146 - DNA, 4409 bp, Saccharomyces cerevisiae; identical to SEQ ID NO: 221
  CDS (1233)..(3524)

SEQ ID NO: 12147 - protein, 763 aa, Saccharomyces cerevisiae; identical to SEQ ID NO: 222

SEQ ID NO: 12148 - DNA, 1704 bp, Saccharomyces cerevisiae; identical to SEQ ID NO: 223
  CDS (1)..(1704)

SEQ ID NO: 12149 - protein, 567 aa, Saccharomyces cerevisiae; identical to SEQ ID NO: 224

SEQ ID NO: 12150 - DNA, 1830 bp, Saccharomyces cerevisiae; identical to SEQ ID NO: 225
  CDS (1)..(1830)

SEQ ID NO: 12151 - protein, 609 aa, Saccharomyces cerevisiae; identical to SEQ ID NO: 226

SEQ ID NO: 12152 - DNA, 1710 bp, Saccharomyces cerevisiae; identical to SEQ ID NO: 227
  CDS (1)..(1710)

SEQ ID NO: 12153 - protein, 569 aa, Saccharomyces cerevisiae; identical to SEQ ID NO: 228

SEQ ID NO: 12154 - DNA, 2020 bp, Beta vulgaris (beet); identical to SEQ ID NO: 229
  CDS (190)..(1662)

SEQ ID NO: 12155 - protein, 490 aa, Beta vulgaris (beet); identical to SEQ ID NO: 230

SEQ ID NO: 12156 - DNA, 2340 bp, Schizosaccharomyces pombe; identical to SEQ ID NO: 231
  CDS (55)..(1722)

SEQ ID NO: 12157 - protein, 555 aa, Schizosaccharomyces pombe; identical to SEQ ID NO: 232

SEQ ID NO: 12158 - DNA, 1674 bp, Schizosaccharomyces pombe; identical to SEQ ID NO: 233
  CDS (1)..(1674)

SEQ ID NO: 12159 - protein, 557 aa, Schizosaccharomyces pombe; identical to SEQ ID NO: 234

SEQ ID NO: 12160 - DNA, 1596 bp, Schizosaccharomyces pombe; identical to SEQ ID NO: 235
  CDS (1)..(1596)

SEQ ID NO: 12161 - protein, 531 aa, Schizosaccharomyces pombe; identical to SEQ ID NO: 236

SEQ ID NO: 12162 - DNA, 1800 bp, Schizosaccharomyces pombe; identical to SEQ ID NO: 237
  CDS (50)..(1657)

SEQ ID NO: 12163 - protein, 535 aa, Schizosaccharomyces pombe; identical to SEQ ID NO: 238

SEQ ID NO: 12164 - DNA, 1641 bp, Schizosaccharomyces pombe; identical to SEQ ID NO: 239
  CDS (1)..(1641)

SEQ ID NO: 12165 - protein, 546 aa, Schizosaccharomyces pombe; identical to SEQ ID NO: 240

SEQ ID NO: 12166 - DNA, 1913 bp, Schizosaccharomyces pombe; identical to SEQ ID NO: 241
  CDS (240)..(1913)

SEQ ID NO: 12167 - protein, 557 aa, Schizosaccharomyces pombe; identical to SEQ ID NO: 242

SEQ ID NO: 12168 - DNA, 1767 bp, Neurospora crassa; identical to SEQ ID NO: 243
  CDS (1)..(1767)

SEQ ID NO: 12169 - protein, 588 aa, Neurospora crassa; identical to SEQ ID NO: 244

SEQ ID NO: 12170 - DNA, 1596 bp, Aspergillus parasiticus; identical to SEQ ID NO: 245
  CDS (1)..(1596)

SEQ ID NO: 12171 - protein, 531 aa, Aspergillus parasiticus; identical to SEQ ID NO: 246

SEQ ID NO: 12172 - DNA, 1711 bp, Amanita muscaria; identical to SEQ ID NO: 247
  CDS (38)..(1600)

SEQ ID NO: 12173 - protein, 520 aa, Amanita muscaria; identical to SEQ ID NO: 248

SEQ ID NO: 12174 - DNA, 1425 bp, Tetragenococcus halophilus; identical to SEQ ID NO: 249
  CDS (1)..(1425)

SEQ ID NO: 12175 - protein, 474 aa, Tetragenococcus halophilus; identical to SEQ ID NO: 250

SEQ ID NO: 12176 - DNA, 2846 bp, Pichia stipitis; identical to SEQ ID NO: 251
  CDS (175)..(1836)

SEQ ID NO: 12177 - protein, 553 aa, Pichia stipitis; identical to SEQ ID NO: 252

SEQ ID NO: 12178 - DNA, 2054 bp, Beta vulgaris subsp; identical to SEQ ID NO: 253
  CDS (94)..(1731)

SEQ ID NO: 12179 - protein, 545 aa, Beta vulgaris subsp; identical to SEQ ID NO: 254

SEQ ID NO: 12180 - DNA, 1758 bp, Debaryomyces hansenii; identical to SEQ ID NO: 255
  CDS (1)..(1758)

SEQ ID NO: 12181 - protein, 585 aa, Debaryomyces hansenii; identical to SEQ ID NO: 256

SEQ ID NO: 12182 - DNA, 1608 bp, Debaryomyces hansenii; identical to SEQ ID NO: 257
  CDS (1)..(1608)

SEQ ID NO: 12183 - protein, 535 aa, Debaryomyces hansenii; identical to SEQ ID NO: 258

SEQ ID NO: 12184 - DNA, 1764 bp, Debaryomyces hansenii; identical to SEQ ID NO: 259
  CDS (1)..(1764)

SEQ ID NO: 12185 - protein, 587 aa, Debaryomyces hansenii; identical to SEQ ID NO: 260

SEQ ID NO: 12186 - DNA, 1839 bp, Debaryomyces hansenii; identical to SEQ ID NO: 261
  CDS (1)..(1839)

SEQ ID NO: 12187 - protein, 612 aa, Debaryomyces hansenii; identical to SEQ ID NO: 262

SEQ ID NO: 12188 - DNA, 1842 bp, Debaryomyces hansenii; identical to SEQ ID NO: 263
  CDS (1)..(1842)

SEQ ID NO: 12189 - protein, 613 aa, Debaryomyces hansenii; identical to SEQ ID NO: 264

SEQ ID NO: 12190 - DNA, 1638 bp, Debaryomyces hansenii; identical to SEQ ID NO: 265
  CDS (1)..(1638)

SEQ ID NO: 12191 - protein, 545 aa, Debaryomyces hansenii; identical to SEQ ID NO: 266

SEQ ID NO: 12192 - DNA, 1638 bp, Debaryomyces hansenii; identical to SEQ ID NO: 267
  CDS (1)..(1638)

SEQ ID NO: 12193 - protein, 545 aa, Debaryomyces hansenii; identical to SEQ ID NO: 268

SEQ ID NO: 12194 - DNA, 1620 bp, Debaryomyces hansenii; identical to SEQ ID NO: 269
  CDS (1)..(1620)

SEQ ID NO: 12195 - protein, 539 aa, Debaryomyces hansenii; identical to SEQ ID NO: 270

SEQ ID NO: 12196 - DNA, 1533 bp, Debaryomyces hansenii; identical to SEQ ID NO: 271
  CDS (1)..(1533)

SEQ ID NO: 12197 - protein, 510 aa, Debaryomyces hansenii; identical to SEQ ID NO: 272

SEQ ID NO: 12198 - DNA, 1665 bp, Debaryomyces hansenii; identical to SEQ ID NO: 273
  CDS (1)..(1665)

SEQ ID NO: 12199 - protein, 554 aa, Debaryomyces hansenii; identical to SEQ ID NO: 274

SEQ ID NO: 12200 - DNA, 1749 bp, Debaryomyces hansenii; identical to SEQ ID NO: 275
  CDS (1)..(1749)

SEQ ID NO: 12201 - protein, 582 aa, Debaryomyces hansenii; identical to SEQ ID NO: 276

SEQ ID NO: 12202 - DNA, 1737 bp, Debaryomyces hansenii; identical to SEQ ID NO: 277
  CDS (1)..(1737)

SEQ ID NO: 12203 - protein, 578 aa, Debaryomyces hansenii; identical to SEQ ID NO: 278

SEQ ID NO: 12204 - DNA, 1584 bp, Debaryomyces hansenii; identical to SEQ ID NO: 279
  CDS (1)..(1584)

SEQ ID NO: 12205 - protein, 527 aa, Debaryomyces hansenii; identical to SEQ ID NO: 280

SEQ ID NO: 12206 - DNA, 1674 bp, Debaryomyces hansenii; identical to SEQ ID NO: 281
  CDS (1)..(1674)

SEQ ID NO: 12207 - protein, 557 aa, Debaryomyces hansenii; identical to SEQ ID NO: 282

SEQ ID NO: 12208 - DNA, 1659 bp, Debaryomyces hansenii; identical to SEQ ID NO: 283
  CDS (1)..(1659)

SEQ ID NO: 12209 - protein, 552 aa, Debaryomyces hansenii; identical to SEQ ID NO: 284

SEQ ID NO: 12210 - DNA, 1632 bp, Debaryomyces hansenii; identical to SEQ ID NO: 285
  CDS (1)..(1632)

SEQ ID NO: 12211 - protein, 543 aa, Debaryomyces hansenii; identical to SEQ ID NO: 286

SEQ ID NO: 12212 - DNA, 2196 bp, Debaryomyces hansenii; identical to SEQ ID NO: 287
  CDS (1)..(2196)

SEQ ID NO: 12213 - protein, 731 aa, Debaryomyces hansenii; identical to SEQ ID NO: 288

SEQ ID NO: 12214 - DNA, 1647 bp, Debaryomyces hansenii; identical to SEQ ID NO: 289
  CDS (1)..(1647)

SEQ ID NO: 12215 - protein, 548 aa, Debaryomyces hansenii; identical to SEQ ID NO: 290

SEQ ID NO: 12216 - DNA, 1659 bp, Debaryomyces hansenii; identical to SEQ ID NO: 291
  CDS (1)..(1659)

SEQ ID NO: 12217 - protein, 552 aa, Debaryomyces hansenii; identical to SEQ ID NO: 292

SEQ ID NO: 12218 - DNA, 1623 bp, Yarrowia lipolytica; identical to SEQ ID NO: 293
  CDS (1)..(1623)

SEQ ID NO: 12219 - protein, 540 aa, Yarrowia lipolytica; identical to SEQ ID NO: 294

SEQ ID NO: 12220 - DNA, 1602 bp, Yarrowia lipolytica; identical to SEQ ID NO: 295
  CDS (1)..(1602)

SEQ ID NO: 12221 - protein, 533 aa, Yarrowia lipolytica; identical to SEQ ID NO: 296

SEQ ID NO: 12222 - DNA, 1701 bp, Yarrowia lipolytica; identical to SEQ ID NO: 297
  CDS (1)..(1701)

SEQ ID NO: 12223 - protein, 566 aa, Yarrowia lipolytica; identical to SEQ ID NO: 298

SEQ ID NO: 12224 - DNA, 1779 bp, Yarrowia lipolytica; identical to SEQ ID NO: 299
  CDS (1)..(1779)

SEQ ID NO: 12225 - protein, 592 aa, Yarrowia lipolytica; identical to SEQ ID NO: 300

SEQ ID NO: 12226 - DNA, 1620 bp, Yarrowia lipolytica; identical to SEQ ID NO: 301
  CDS (1)..(1620)

SEQ ID NO: 12227 - protein, 539 aa, Yarrowia lipolytica; identical to SEQ ID NO: 302

SEQ ID NO: 12228 - DNA, 1737 bp, Yarrowia lipolytica; identical to SEQ ID NO: 303
  CDS (1)..(1737)

SEQ ID NO: 12229 - protein, 578 aa, Yarrowia lipolytica; identical to SEQ ID NO: 304

SEQ ID NO: 12230 - DNA, 1548 bp, Yarrowia lipolytica; identical to SEQ ID NO: 305
  CDS (1)..(1548)

SEQ ID NO: 12231 - protein, 515 aa, Yarrowia lipolytica; identical to SEQ ID NO: 306

SEQ ID NO: 12232 - DNA, 1698 bp, Yarrowia lipolytica; identical to SEQ ID NO: 307
  CDS (1)..(1698)

SEQ ID NO: 12233 - protein, 565 aa, Yarrowia lipolytica; identical to SEQ ID NO: 308

SEQ ID NO: 12234 - DNA, 1665 bp, Yarrowia lipolytica; identical to SEQ ID NO: 309
  CDS (1)..(1665)

SEQ ID NO: 12235 - protein, 554 aa, Yarrowia lipolytica; identical to SEQ ID NO: 310

SEQ ID NO: 12236 - DNA, 1740 bp, Yarrowia lipolytica; identical to SEQ ID NO: 311
  CDS (1)..(1740)

SEQ ID NO: 12237 - protein, 579 aa, Yarrowia lipolytica; identical to SEQ ID NO: 312

SEQ ID NO: 12238 - DNA, 1329 bp, Yarrowia lipolytica; identical to SEQ ID NO: 313
  CDS (1)..(1329)

SEQ ID NO: 12239 - protein, 442 aa, Yarrowia lipolytica; identical to SEQ ID NO: 314

SEQ ID NO: 12240 - DNA, 1602 bp, Yarrowia lipolytica; identical to SEQ ID NO: 315
  CDS (1)..(1602)

SEQ ID NO: 12241 - protein, 533 aa, Yarrowia lipolytica; identical to SEQ ID NO: 316

SEQ ID NO: 12242 - DNA, 2364 bp, Kluyveromyces lactis; identical to SEQ ID NO: 317
  CDS (1)..(2364)

SEQ ID NO: 12243 - protein, 787 aa, Kluyveromyces lactis; identical to SEQ ID NO: 318

SEQ ID NO: 12244 - DNA, 1434 bp, Kluyveromyces lactis; identical to SEQ ID NO: 319
  CDS (1)..(1434)

SEQ ID NO: 12245 - protein, 477 aa, Kluyveromyces lactis; identical to SEQ ID NO: 320

SEQ ID NO: 12246 - DNA, 1719 bp, Kluyveromyces lactis; identical to SEQ ID NO: 321
  CDS (1)..(1719)

SEQ ID NO: 12247 - protein, 572 aa, Kluyveromyces lactis; identical to SEQ ID NO: 322

SEQ ID NO: 12248 - DNA, 1536 bp, Kluyveromyces lactis; identical to SEQ ID NO: 323
  CDS (1)..(1536)

SEQ ID NO: 12249 - protein, 511 aa, Kluyveromyces lactis; identical to SEQ ID NO: 324

SEQ ID NO: 12250 - DNA, 2034 bp, Kluyveromyces lactis; identical to SEQ ID NO: 325
  CDS (1)..(2034)

SEQ ID NO: 12251 - protein, 677 aa, Kluyveromyces lactis; identical to SEQ ID NO: 326

SEQ ID NO: 12252 - DNA, 1596 bp, Candida glabrata; identical to SEQ ID NO: 327
  CDS (1)..(1596)

SEQ ID NO: 12253 - protein, 531 aa, Candida glabrata; identical to SEQ ID NO: 328

SEQ ID NO: 12254 - DNA, 2571 bp, Candida glabrata; identical to SEQ ID NO: 329
  CDS (1)..(2571)

SEQ ID NO: 12255 - protein, 856 aa, Candida glabrata; identical to SEQ ID NO: 330

SEQ ID NO: 12256 - DNA, 2289 bp, Candida glabrata; identical to SEQ ID NO: 331
  CDS (1)..(2289)

SEQ ID NO: 12257 - protein, 762 aa, Candida glabrata; identical to SEQ ID NO: 332

SEQ ID NO: 12258 - DNA, 1668 bp, Candida glabrata; identical to SEQ ID NO: 333
  CDS (1)..(1668)

SEQ ID NO: 12259 - protein, 555 aa, Candida glabrata; identical to SEQ ID NO: 334

SEQ ID NO: 12260 - DNA, 1695 bp, Candida glabrata; identical to SEQ ID NO: 335
  CDS (1)..(1695)

SEQ ID NO: 12261 - protein, 564 aa, Candida glabrata; identical to SEQ ID NO: 336

SEQ ID NO: 12262 - DNA, 1650 bp, Candida glabrata; identical to SEQ ID NO: 337
  CDS (1)..(1650)

SEQ ID NO: 12263 - protein, 549 aa, Candida glabrata; identical to SEQ ID NO: 338

SEQ ID NO: 12264 - DNA, 1602 bp, Candida glabrata; identical to SEQ ID NO: 339
  CDS (1)..(1602)

SEQ ID NO: 12265 - protein, 533 aa, Candida glabrata; identical to SEQ ID NO: 340

SEQ ID NO: 12266 - DNA, 1692 bp, Candida glabrata; identical to SEQ ID NO: 341
  CDS (1)..(1692)

SEQ ID NO: 12267 - protein, 563 aa, Candida glabrata; identical to SEQ ID NO: 342

SEQ ID NO: 12268 - DNA, 1707 bp, Candida glabrata; identical to SEQ ID NO: 343
  CDS (1)..(1707)

SEQ ID NO: 12269 - protein, 568 aa, Candida glabrata; identical to SEQ ID NO: 344

SEQ ID NO: 12270 - DNA, 1671 bp, Candida glabrata; identical to SEQ ID NO: 345
  CDS (1)..(1671)

SEQ ID NO: 12271 - protein, 556 aa, Candida glabrata; identical to SEQ ID NO: 346

SEQ ID NO: 12272 - DNA, 1650 bp, Candida glabrata; identical to SEQ ID NO: 347
  CDS (1)..(1650)

SEQ ID NO: 12273 - protein, 549 aa, Candida glabrata; identical to SEQ ID NO: 348

SEQ ID NO: 12274 - DNA, 1659 bp, Candida glabrata; identical to SEQ ID NO: 349
  CDS (1)..(1659)

SEQ ID NO: 12275 - protein, 552 aa, Candida glabrata; identical to SEQ ID NO: 350

SEQ ID NO: 12276 - DNA, 1728 bp, Yarrowia lipolytica; identical to SEQ ID NO: 351
  CDS (1)..(1728)

SEQ ID NO: 12277 - protein, 575 aa, Yarrowia lipolytica; identical to SEQ ID NO: 352

SEQ ID NO: 12278 - DNA, 1647 bp, Trichoderma reesei; identical to SEQ ID NO: 353
  CDS (1)..(1647)

SEQ ID NO: 12279 - protein, 548 aa, Trichoderma reesei; identical to SEQ ID NO: 354

SEQ ID NO: 12280 - DNA, 2048 bp, Equus caballus; identical to SEQ ID NO: 355
  CDS (178)..(1752): n means a or g or c or t/u, s means g or c

SEQ ID NO: 12281 - protein, 524 aa, Equus caballus; identical to SEQ ID NO: 356

SEQ ID NO: 12282 - DNA, 1629 bp, Aspergillus fumigatus; identical to SEQ ID NO: 357
  CDS (1)..(1629)

SEQ ID NO: 12283 - protein, 542 aa, Aspergillus fumigatus; identical to SEQ ID NO: 358

SEQ ID NO: 12284 - DNA, 1653 bp, Leptosphaeria maculans; identical to SEQ ID NO: 359
  CDS (1)..(1653)

SEQ ID NO: 12285 - protein, 550 aa, Leptosphaeria maculans; identical to SEQ ID NO: 360

SEQ ID NO: 12286 - DNA, 1542 bp, Aspergillus parasiticus; identical to SEQ ID NO: 361
  CDS (1)..(1542)

SEQ ID NO: 12287 - protein, 513 aa, Aspergillus parasiticus; identical to SEQ ID NO: 362

SEQ ID NO: 12288 - DNA, 1548 bp, Oryza sativa; identical to SEQ ID NO: 363
  CDS (1)..(1548)

SEQ ID NO: 12289 - protein, 515 aa, Oryza sativa; identical to SEQ ID NO: 364

SEQ ID NO: 12290 - DNA, 1584 bp, Oryza sativa; identical to SEQ ID NO: 365
  CDS (1)..(1584)

SEQ ID NO: 12291 - protein, 527 aa, Oryza sativa; identical to SEQ ID NO: 366

SEQ ID NO: 12292 - DNA, 1536 bp, Oryza sativa; identical to SEQ ID NO: 367
  CDS (1)..(1536)

SEQ ID NO: 12293 - protein, 511 aa, Oryza sativa; identical to SEQ ID NO: 368

SEQ ID NO: 12294 - DNA, 1891 bp, Plantago major; identical to SEQ ID NO: 369
  CDS (146)..(1738)

SEQ ID NO: 12295 - protein, 530 aa, Plantago major; identical to SEQ ID NO: 370

SEQ ID NO: 12296 - DNA, 1987 bp, Plantago major; identical to SEQ ID NO: 371
  CDS (116)..(1705)

SEQ ID NO: 12297 - protein, 529 aa, Plantago major; identical to SEQ ID NO: 372

SEQ ID NO: 12298 - DNA, 1677 bp, Ashbya gossypii; identical to SEQ ID NO: 373
  CDS (1)..(1677)

SEQ ID NO: 12299 - protein, 558 aa, Ashbya gossypii; identical to SEQ ID NO: 374

SEQ ID NO: 12300 - DNA, 1608 bp, Ashbya gossypii; identical to SEQ ID NO: 375
  CDS (1)..(1608)

SEQ ID NO: 12301 - protein, 535 aa, Ashbya gossypii; identical to SEQ ID NO: 376

SEQ ID NO: 12302 - DNA, 1641 bp, Ashbya gossypii; identical to SEQ ID NO: 377
  CDS (1)..(1641)

SEQ ID NO: 12303 - protein, 546 aa, Ashbya gossypii; identical to SEQ ID NO: 378

SEQ ID NO: 12304 - DNA, 1620 bp, Ashbya gossypii; identical to SEQ ID NO: 379
  CDS (1)..(1620)

SEQ ID NO: 12305 - protein, 539 aa, Ashbya gossypii; identical to SEQ ID NO: 380

SEQ ID NO: 12306 - DNA, 1644 bp, Ashbya gossypii; identical to SEQ ID NO: 381
  CDS (1)..(1644)

SEQ ID NO: 12307 - protein, 547 aa, Ashbya gossypii; identical to SEQ ID NO: 382

SEQ ID NO: 12308 - DNA, 1995 bp, Ashbya gossypii; identical to SEQ ID NO: 383
  CDS (1)..(1995)

SEQ ID NO: 12309 - protein, 664 aa, Ashbya gossypii; identical to SEQ ID NO: 384

SEQ ID NO: 12310 - DNA, 1642 bp, Drosophila melanogaster; identical to SEQ ID NO: 385
  CDS (119)..(1453)

SEQ ID NO: 12311 - protein, 444 aa, Drosophila melanogaster; identical to SEQ ID NO: 386

SEQ ID NO: 12312 - DNA, 1620 bp, Neurospora crassa; identical to SEQ ID NO: 387
  CDS (1)..(1620)

SEQ ID NO: 12313 - protein, 539 aa, Neurospora crassa; identical to SEQ ID NO: 388

SEQ ID NO: 12314 - DNA, 1968 bp, Neurospora crassa; identical to SEQ ID NO: 389
  CDS (1)..(1968)

SEQ ID NO: 12315 - protein, 655 aa, Neurospora crassa; identical to SEQ ID NO: 390

SEQ ID NO: 12316 - DNA, 1572 bp, Neurospora crassa; identical to SEQ ID NO: 391
  CDS (1)..(1572)

SEQ ID NO: 12317 - protein, 523 aa, Neurospora crassa; identical to SEQ ID NO: 392

SEQ ID NO: 12318 - DNA, 1614 bp, Neurospora crassa; identical to SEQ ID NO: 393
  CDS (1)..(1614)

SEQ ID NO: 12319 - protein, 537 aa, Neurospora crassa; identical to SEQ ID NO: 394

SEQ ID NO: 12320 - DNA, 1989 bp, Neurospora crassa; identical to SEQ ID NO: 395
  CDS (1)..(1989)

SEQ ID NO: 12321 - protein, 662 aa, Neurospora crassa; identical to SEQ ID NO: 396

SEQ ID NO: 12322 - DNA, 1557 bp, Neurospora crassa; identical to SEQ ID NO: 397
  CDS (1)..(1557)

SEQ ID NO: 12323 - protein, 518 aa, Neurospora crassa; identical to SEQ ID NO: 398

SEQ ID NO: 12324 - DNA, 1626 bp, Neurospora crassa; identical to SEQ ID NO: 399
  CDS (1)..(1626)

SEQ ID NO: 12325 - protein, 541 aa, Neurospora crassa; identical to SEQ ID NO: 400

SEQ ID NO: 12326 - DNA, 1752 bp, Neurospora crassa; identical to SEQ ID NO: 401
  CDS (1)..(1752)

SEQ ID NO: 12327 - protein, 583 aa, Neurospora crassa; identical to SEQ ID NO: 402

SEQ ID NO: 12328 - DNA, 1698 bp, Neurospora crassa; identical to SEQ ID NO: 403
  CDS (1)..(1698)

SEQ ID NO: 12329 - protein, 565 aa, Neurospora crassa; identical to SEQ ID NO: 404

SEQ ID NO: 12330 - DNA, 1647 bp, Neurospora crassa; identical to SEQ ID NO: 405
  CDS (1)..(1647)

SEQ ID NO: 12331 - protein, 548 aa, Neurospora crassa; identical to SEQ ID NO: 406

SEQ ID NO: 12332 - DNA, 1533 bp, Neurospora crassa; identical to SEQ ID NO: 407
  CDS (1)..(1533)

SEQ ID NO: 12333 - protein, 510 aa, Neurospora crassa; identical to SEQ ID NO: 408

SEQ ID NO: 12334 - DNA, 1695 bp, Neurospora crassa; identical to SEQ ID NO: 409
  CDS (1)..(1695)

SEQ ID NO: 12335 - protein, 564 aa, Neurospora crassa; identical to SEQ ID NO: 410

SEQ ID NO: 12336 - DNA, 1683 bp, Neurospora crassa; identical to SEQ ID NO: 411
  CDS (1)..(1683)

SEQ ID NO: 12337 - protein, 560 aa, Neurospora crassa; identical to SEQ ID NO: 412

SEQ ID NO: 12338 - DNA, 1794 bp, Neurospora crassa; identical to SEQ ID NO: 413
  CDS (1)..(1794)

SEQ ID NO: 12339 - protein, 597 aa, Neurospora crassa; identical to SEQ ID NO: 414

SEQ ID NO: 12340 - DNA, 1578 bp, Neurospora crassa; identical to SEQ ID NO: 415
  CDS (1)..(1578)

SEQ ID NO: 12341 - protein, 525 aa, Neurospora crassa; identical to SEQ ID NO: 416

SEQ ID NO: 12342 - DNA, 1614 bp, Neurospora crassa; identical to SEQ ID NO: 417
  CDS (1)..(1614)

SEQ ID NO: 12343 - protein, 537 aa, Neurospora crassa; identical to SEQ ID NO: 418

SEQ ID NO: 12344 - DNA, 1641 bp, Neurospora crassa; identical to SEQ ID NO: 419
  CDS (1)..(1641)

SEQ ID NO: 12345 - protein, 546 aa, Neurospora crassa; identical to SEQ ID NO: 420

SEQ ID NO: 12346 - DNA, 1644 bp, Neurospora crassa; identical to SEQ ID NO: 421
  CDS (1)..(1644)

SEQ ID NO: 12347 - protein, 547 aa, Neurospora crassa; identical to SEQ ID NO: 422

SEQ ID NO: 12348 - DNA, 1572 bp, Neurospora crassa; identical to SEQ ID NO: 423
  CDS (1)..(1572)

SEQ ID NO: 12349 - protein, 523 aa, Neurospora crassa; identical to SEQ ID NO: 424

SEQ ID NO: 12350 - DNA, 1509 bp, Mycobacterium bovis; identical to SEQ ID NO: 425
  CDS (1)..(1509)

SEQ ID NO: 12351 - protein, 502 aa, Mycobacterium bovis; identical to SEQ ID NO: 426

SEQ ID NO: 12352 - DNA, 2251 bp, Oryza sativa; identical to SEQ ID NO: 427
  CDS (152)..(1723)

SEQ ID NO: 12353 - protein, 523 aa, Oryza sativa; identical to SEQ ID NO: 428

SEQ ID NO: 12354 - DNA, 1648 bp, Orobanche ramosa; identical to SEQ ID NO: 429
  CDS (46)..(1605)

SEQ ID NO: 12355 - protein, 519 aa, Orobanche ramosa; identical to SEQ ID NO: 430

SEQ ID NO: 12356 - DNA, 1608 bp, Oryza sativa; identical to SEQ ID NO: 431
  CDS (1)..(1608)

SEQ ID NO: 12357 - protein, 535 aa, Oryza sativa; identical to SEQ ID NO: 432

SEQ ID NO: 12358 - DNA, 1617 bp, Oryza sativa; identical to SEQ ID NO: 433
  CDS (1)..(1617)

SEQ ID NO: 12359 - protein, 538 aa, Oryza sativa; identical to SEQ ID NO: 434

SEQ ID NO: 12360 - DNA, 2574 bp, Oryza sativa; identical to SEQ ID NO: 435
  CDS (569)..(2089)

SEQ ID NO: 12361 - protein, 506 aa, Oryza sativa; identical to SEQ ID NO: 436

SEQ ID NO: 12362 - DNA, 2710 bp, Kluyveromyces lactis; identical to SEQ ID NO: 437
  CDS (428)..(2014)

SEQ ID NO: 12363 - protein, 528 aa, Kluyveromyces lactis; identical to SEQ ID NO: 438

SEQ ID NO: 12364 - DNA, 1848 bp, Saccharomyces pastorianus; identical to SEQ ID NO: 439
  CDS (1)..(1848)

SEQ ID NO: 12365 - protein, 615 aa, Saccharomyces pastorianus; identical to SEQ ID NO: 440

SEQ ID NO: 12366 - DNA, 1927 bp, Prunus cerasus; identical to SEQ ID NO: 441
  CDS (56)..(1585)

SEQ ID NO: 12367 - protein, 509 aa, Prunus cerasus; identical to SEQ ID NO: 442

SEQ ID NO: 12368 - DNA, 2032 bp, Prunus cerasus; identical to SEQ ID NO: 443
  CDS (74)..(1690)

SEQ ID NO: 12369 - protein, 538 aa, Prunus cerasus; identical to SEQ ID NO: 444

SEQ ID NO: 12370 - DNA, 2012 bp, Malus domestica; identical to SEQ ID NO: 445
  CDS (104)..(1579)

SEQ ID NO: 12371 - protein, 491 aa, Malus domestica; identical to SEQ ID NO: 446

SEQ ID NO: 12372 - DNA, 1563 bp, Neurospora crassa; identical to SEQ ID NO: 447
  CDS (1)..(1563)

SEQ ID NO: 12373 - protein, 520 aa, Neurospora crassa; identical to SEQ ID NO: 448

SEQ ID NO: 12374 - DNA, 1614 bp, Neurospora crassa; identical to SEQ ID NO: 449
  CDS (1)..(1614)

SEQ ID NO: 12375 - protein, 537 aa, Neurospora crassa; identical to SEQ ID NO: 450

SEQ ID NO: 12376 - DNA, 1596 bp, Emericella nidulans; identical to SEQ ID NO: 451
  CDS (1)..(1596)

SEQ ID NO: 12377 - protein, 531 aa, Emericella nidulans; identical to SEQ ID NO: 452

SEQ ID NO: 12378 - DNA, 1407 bp, Bacteroides thetaiotaomicron; identical to SEQ ID NO: 453
  CDS (1)..(1407)

SEQ ID NO: 12379 - protein, 468 aa, Bacteroides thetaiotaomicron; identical to SEQ ID NO: 454

SEQ ID NO: 12380 - DNA, 1407 bp, Bacteroides thetaiotaomicron; identical to SEQ ID NO: 455
  CDS (1)..(1407)

SEQ ID NO: 12381 - protein, 468 aa, Bacteroides thetaiotaomicron; identical to SEQ ID NO: 456

SEQ ID NO: 12382 - DNA, 1404 bp, Staphylococcus epidermidis; identical to SEQ ID NO: 457
  CDS (1)..(1404)

SEQ ID NO: 12383 - protein, 467 aa, Staphylococcus epidermidis; identical to SEQ ID NO: 458

SEQ ID NO: 12384 - DNA, 1545 bp, Aspergillus niger; identical to SEQ ID NO: 459
  CDS (1)..(1545)

SEQ ID NO: 12385 - protein, 514 aa, Aspergillus niger; identical to SEQ ID NO: 460

SEQ ID NO: 12386 - DNA, 1584 bp, Aspergillus niger; identical to SEQ ID NO: 461
  CDS (1)..(1584)

SEQ ID NO: 12387 - protein, 527 aa, Aspergillus niger; identical to SEQ ID NO: 462

SEQ ID NO: 12388 - DNA, 1752 bp, Aspergillus niger; identical to SEQ ID NO: 463
  CDS (1)..(1752)

SEQ ID NO: 12389 - protein, 583 aa, Aspergillus niger; identical to SEQ ID NO: 464

SEQ ID NO: 12390 - DNA, 1593 bp, Aspergillus niger; identical to SEQ ID NO: 465
  CDS (1)..(1593)

SEQ ID NO: 12391 - protein, 530 aa, Aspergillus niger; identical to SEQ ID NO: 466

SEQ ID NO: 12392 - DNA, 1584 bp, Emericella nidulans; identical to SEQ ID NO: 467
  CDS (1)..(1584)

SEQ ID NO: 12393 - protein, 527 aa, Emericella nidulans; identical to SEQ ID NO: 468

SEQ ID NO: 12394 - DNA, 1599 bp, Aspergillus oryzae; identical to SEQ ID NO: 469
  CDS (1)..(1599)

SEQ ID NO: 12395 - protein, 532 aa, Aspergillus oryzae; identical to SEQ ID NO: 470

SEQ ID NO: 12396 - DNA, 1943 bp, Arabidopsis thaliana; identical to SEQ ID NO: 471
  CDS (139)..(1650)

SEQ ID NO: 12397 - protein, 503 aa, Arabidopsis thaliana; identical to SEQ ID NO: 472

SEQ ID NO: 12398 - DNA, 2234 bp, Kluyveromyces lactis; identical to SEQ ID NO: 473
  CDS (402)..(2102)

SEQ ID NO: 12399 - protein, 566 aa, Kluyveromyces lactis; identical to SEQ ID NO: 474

SEQ ID NO: 12400 - DNA, 1476 bp, Corynebacterium glutamicum; identical to SEQ ID NO: 475
  CDS (1)..(1476)

SEQ ID NO: 12401 - protein, 491 aa, Corynebacterium glutamicum; identical to SEQ ID NO: 476

SEQ ID NO: 12402 - DNA, 2187 bp, Drosophila melanogaster; identical to SEQ ID NO: 477
  CDS (198)..(1688)

SEQ ID NO: 12403 - protein, 496 aa, Drosophila melanogaster; identical to SEQ ID NO: 478

SEQ ID NO: 12404 - DNA, 1972 bp, Trichoderma harzianum; identical to SEQ ID NO: 479
  CDS (123)..(1754)

SEQ ID NO: 12405 - protein, 543 aa, Trichoderma harzianum; identical to SEQ ID NO: 480

SEQ ID NO: 12406 - DNA, 1830 bp, Arabidopsis thaliana; identical to SEQ ID NO: 481
  CDS (74)..(1522)

SEQ ID NO: 12407 - protein, 482 aa, Arabidopsis thaliana; identical to SEQ ID NO: 482

SEQ ID NO: 12408 - DNA, 1599 bp, Neurospora crassa; identical to SEQ ID NO: 483
  CDS (1)..(1599)

SEQ ID NO: 12409 - protein, 532 aa, Neurospora crassa; identical to SEQ ID NO: 484

SEQ ID NO: 12410 - DNA, 1860 bp, Oryza sativa; identical to SEQ ID NO: 485
  CDS (3)..(1736)

SEQ ID NO: 12411 - protein, 577 aa, Oryza sativa; identical to SEQ ID NO: 486

SEQ ID NO: 12412 - DNA, 1569 bp, Uromyces fabae; identical to SEQ ID NO: 487
  CDS (1)..(1569)

SEQ ID NO: 12413 - protein, 522 aa, Uromyces fabae; identical to SEQ ID NO: 488

SEQ ID NO: 12414 - DNA, 1620 bp, Aspergillus oryzae; identical to SEQ ID NO: 489
  CDS (1)..(1620)

SEQ ID NO: 12415 - protein, 539 aa, Aspergillus oryzae; identical to SEQ ID NO: 490

SEQ ID NO: 12416 - DNA, 1725 bp, Oryza sativa; identical to SEQ ID NO: 491
  CDS (1)..(1725)

SEQ ID NO: 12417 - protein, 574 aa, Oryza sativa; identical to SEQ ID NO: 492

SEQ ID NO: 12418 - DNA, 1440 bp, Zymomonas mobilis; identical to SEQ ID NO: 493
  CDS (1)..(1440)

SEQ ID NO: 12419 - protein, 479 aa, Zymomonas mobilis; identical to SEQ ID NO: 494

SEQ ID NO: 12420 - DNA, 1766 bp, Apium graveolens var; identical to SEQ ID NO: 495
  CDS (17)..(1558)

SEQ ID NO: 12421 - protein, 513 aa, Apium graveolens var; identical to SEQ ID NO: 496

SEQ ID NO: 12422 - DNA, 2041 bp, Mesembryanthemum crystallinum; identical to SEQ ID NO: 497
  CDS (118)..(1785)

SEQ ID NO: 12423 - protein, 555 aa, Mesembryanthemum crystallinum; identical to SEQ ID NO: 498

SEQ ID NO: 12424 - DNA, 1530 bp, Pichia angusta; identical to SEQ ID NO: 499
  CDS (1)..(1530)

SEQ ID NO: 12425 - protein, 509 aa, Pichia angusta; identical to SEQ ID NO: 500

SEQ ID NO: 12426 - DNA, 1864 bp, Spinacia oleracea; identical to SEQ ID NO: 501
  CDS (61)..(1716)

SEQ ID NO: 12427 - protein, 551 aa, Spinacia oleracea; identical to SEQ ID NO: 502

SEQ ID NO: 12428 - DNA, 1822 bp, Arabidopsis thaliana; identical to SEQ ID NO: 503
  CDS (65)..(1684)

SEQ ID NO: 12429 - protein, 539 aa, Arabidopsis thaliana; identical to SEQ ID NO: 504

SEQ ID NO: 12430 - DNA, 1653 bp, Pichia stipitis; identical to SEQ ID NO: 505
  CDS (1)..(1653)

SEQ ID NO: 12431 - protein, 550 aa, Pichia stipitis; identical to SEQ ID NO: 506

SEQ ID NO: 12432 - DNA, 2408 bp, Drosophila melanogaster; identical to SEQ ID NO: 507
  CDS (316)..(1839)

SEQ ID NO: 12433 - protein, 507 aa, Drosophila melanogaster; identical to SEQ ID NO: 508

SEQ ID NO: 12434 - DNA, 1506 bp, Oryza sativa; identical to SEQ ID NO: 509
  CDS (1)..(1506)

SEQ ID NO: 12435 - protein, 501 aa, Oryza sativa; identical to SEQ ID NO: 510

SEQ ID NO: 12436 - DNA, 1767 bp, Kluyveromyces lactis; identical to SEQ ID NO: 511
  CDS (1)..(1767)

SEQ ID NO: 12437 - protein, 588 aa, Kluyveromyces lactis; identical to SEQ ID NO: 512

SEQ ID NO: 12438 - DNA, 1557 bp, Schizosaccharomyces pombe; identical to SEQ ID NO: 513
  CDS (1)..(1557)

SEQ ID NO: 12439 - protein, 518 aa, Schizosaccharomyces pombe; identical to SEQ ID NO: 514

SEQ ID NO: 12440 - DNA, 2468 bp, Mus musculus; identical to SEQ ID NO: 515
  CDS (34)..(1605)

SEQ ID NO: 12441 - protein, 523 aa, Mus musculus; identical to SEQ ID NO: 516

SEQ ID NO: 12442 - DNA, 2355 bp, Canis familiaris; identical to SEQ ID NO: 517
  CDS (201)..(1688)

SEQ ID NO: 12443 - protein, 495 aa, Canis familiaris; identical to SEQ ID NO: 518

SEQ ID NO: 12444 - DNA, 1485 bp, Ovis aries; identical to SEQ ID NO: 519
  CDS (1)..(1485)

SEQ ID NO: 12445 - protein, 494 aa, Ovis aries; identical to SEQ ID NO: 520

SEQ ID NO: 12446 - DNA, 1638 bp, Candida albicans; identical to SEQ ID NO: 521
  CDS (1)..(1638)

SEQ ID NO: 12447 - protein, 545 aa, Candida albicans; identical to SEQ ID NO: 522

SEQ ID NO: 12448 - DNA, 2425 bp, Kluyveromyces lactis; identical to SEQ ID NO: 523
  CDS (539)..(2194)

SEQ ID NO: 12449 - protein, 551 aa, Kluyveromyces lactis; identical to SEQ ID NO: 524

SEQ ID NO: 12450 - DNA, 2099 bp, Saccharomyces cerevisiae; identical to SEQ ID NO: 525
  CDS (180)..(1910)

SEQ ID NO: 12451 - protein, 576 aa, Saccharomyces cerevisiae; identical to SEQ ID NO: 526

SEQ ID NO: 12452 - DNA, 1785 bp, Neurospora crassa; identical to SEQ ID NO: 527
  CDS (1)..(1785)

SEQ ID NO: 12453 - protein, 594 aa, Neurospora crassa; identical to SEQ ID NO: 528

SEQ ID NO: 12454 - DNA, 27 bp, Primer
atgaaaaatatcatttcattggtaagc

SEQ ID NO: 12455 - DNA, 27 bp, Primer
ttaacatttatcagctgcatttaattc

SEQ ID NO: 12456 - DNA, 1728 bp, Saccharomyces cerevisiae
  CDS (1)..(1728)
atgctatcagcaaggtgcctcaaatctatatacttcaagagatctttctcacaactgggacacatcaagccccccaagcacataagaaatgaacctgttaagccatttagaaacatagacttaaaagactgggacttactgagggcttccttgatgaaattcaaaagttcttctttagaagtgccactggtcatcaatggggaaaggatatatgacaataatgaaagagcgcttttcccgcagactaaccctgcgaaccatcaacaagtactggcaaacgtcacacaagccacggaaaaagatgtcatgaatgctgtaaaagccgccaaggatgccaaaaaggattggtacaatctaccgttttatgacagatctgcaatttttttgaaagccgctgacttaatttccaccaagtatcgttatgacatgttagctgctacaatgctgggccagggaaaaaatgtgtatcaggcagaaatcgactgtatcacggaattatctgacttttttagatactatgtcaagtatgcatcagacttgtatgctcaacaacccgtagagtcagcggatggtacttggaataaagctgaatacagacctttagagggatttgtgtatgctgtttcaccattcaactttactgctattgctgcaaacttgattggggctccagctttgatgggtaatacagttgtctggaaaccttcacaaaccgctgccctttcaaattacttattgatgactgttttggaagaagcgggattgccaaagggtgtcataaatttcattccaggtgatccagttcaagttactgaccaggtattagctgataaagattttggtgccttgcattttaccggttctacaaatgtctttaagagtttgtatggcaaaatacaaagtggcgttgttgaagggaagtacagagattacccccgtattattggtgagacaggtggtaaaaatttccatctagttcacccaagtgcaaatatatcacatgcagtactctctactattagaggcactttcgagttccaaggccaaaagtgctctgccgcttccaggttatatcttccagagtcaaaaagtgaagaattcttatccgatatgtttggcatattgcagtcacagaatgttgtcccaatgaacacatccgcaagtccaatttctggtgggaatttgcggggatttatgggtcctgtcatccatgaacaaagtttcgacaaattagttaaagtaattgaagatgcaaagaaagaccccgagttggaaattctttacggtggacaatacgataaaagccaaggttggtttgtcggacccacagtcataaaagccaagagaccagatcatccatatatgtcaacagaattttttggccctatattaactgtttacgagtatccagatactgaatttaatgaaatctgtgatattatcgataatacgagtcaatacgccttaactggtgctatttttgccaaagatcgtaaagcaattgaatacgcagatgagaagttgaagtttagcgcaggaaatttctacataaatgataagtgtactggtgccgttgtttctcagcaatggtttggtggcgcaagaatgagtggtaccgacgataaggctggtggtccaaacattttaagcagatttgtcagtattagaaacacaaaggagaacttctacgagttgactgatttcaaatatccatcgaattatgaataa

SEQ ID NO: 12457 - protein, 575 aa, Saccharomyces cerevisiae
MLSARCLKSIYFKRSFSQLGHIKPPKHIRNEPVKPFRNIDLKDWDLLRASLMKFKSSSLEVPLVINGERIYDNNERALFPQTNPANHQQVLANVTQATEKDVMNAVKAAKDAKKDWYNLPFYDRSAIFLKAADLISTKYRYDMLAATMLGQGKNVYQAEIDCITELSDFFRYYVKYASDLYAQQPVESADGTWNKAEYRPLEGFVYAVSPFNFTAIAANLIGAPALMGNTVVWKPSQTAALSNYLLMTVLEEAGLPKGVINFIPGDPVQVTDQVLADKDFGALHFTGSTNVFKSLYGKIQSGVVEGKYRDYPRIIGETGGKNFHLVHPSANISHAVLSTIRGTFEFQGQKCSAASRLYLPESKSEEFLSDMFGILQSQNVVPMNTSASPISGGNLRGFMGPVIHEQSFDKLVKVIEDAKKDPELEILYGGQYDKSQGWFVGPTVIKAKRPDHPYMSTEFFGPILTVYEYPDTEFNEICDIIDNTSQYALTGAIFAKDRKAIEYADEKLKFSAGNFYINDKCTGAVVSQQWFGGARMSGTDDKAGGPNILSRFVSIRNTKENFYELTDFKYPSNYE

SEQ ID NO: 12458 - DNA, 1548 bp, Bacillus subtilis
  CDS (1)..(1548)
atgacaacaccttacaaacacgagccattcacaaatttccaagatcaaaactacgtggaagcgtttaaaaaagcgcttgcgacagtaagcgaatatttaggaaaagactatccgcttgtcattaacggcgagagagtggaaacggaagcgaaaatcgtttcaatcaacccagctgataaagaagaagtcgtcggccgagtgtcaaaagcgtctcaagagcacgctgagcaagcgattcaagcggctgcaaaagcatttgaagagtggagatacacgtctcctgaagagagagcggctgtcctgttccgcgctgctgccaaagtccgcagaagaaaacatgaattctcagctttgcttgtgaaagaagcaggaaagccttggaacgaggcggatgccgatacggctgaagcgattgacttcatggagtattatgcacgccaaatgatcgaactggcaaaaggcaaaccggtcaacagccgtgaaggcgagaaaaaccaatatgtatacacgccgactggagtgacagtcgttatcccgccttggaacttcttgtttgcgatcatggcaggcacaacagtggcgccgatcgttactggaaacacagtggttctgaaacctgcgagtgctacacctgttattgcagcaaaatttgttgaggtgcttgaagagtccggattgccaaaaggcgtagtcaactttgttccgggaagcggatcggaagtaggcgactatcttgttgaccatccgaaaacaagccttatcacatttacgggatcaagagaagttggtacgagaattttcgaacgcgcggcgaaggttcagccgggccagcagcatttaaagcgtgtcatcgctgaaatgggcggtaaagatacggttgttgttgatgaggatgcggacattgaattagcggctcaatcgatctttacttcagcattcggctttgcgggacaaaaatgctctgcaggttcacgtgcagtagttcatgaaaaagtgtatgatcaagtattagagcgtgtcattgaaattacggaatcaaaagtaacagctaaacctgacagtgcagatgtttatatgggacctgtcattgaccaaggttcttatgataaaattatgagctatattgagatcggaaaacaggaagggcgtttagtaagcggcggtactggtgatgattcgaaaggatacttcatcaaaccgacgatcttcgctgaccttgatccgaaagcaagactcatgcaggaagaaattttcggacctgtcgttgcattttgtaaagtgtcagactttgatgaagctttagaagtggcaaacaatactgaatatggtttgacaggcgcggttatcacaaacaaccgcaagcacatcgagcgtgcgaaacaggaattccatgtcggaaacctatacttcaaccgcaactgtacaggtgctatcgtcggctaccatccgtttggcggcttcaaaatgtcgggaacggattcaaaagcaggcgggccggattacttggctctgcatatgcaagcaaaaacaatcagtgaaatgttctaa

SEQ ID NO: 12459 - protein, 515 aa, Bacillus subtilis
MTTPYKHEPFTNFQDQNYVEAFKKALATVSEYLGKDYPLVINGERVETEAKIVSINPADKEEVVGRVSKASQEHAEQAIQAAAKAFEEWRYTSPEERAAVLFRAAAKVRRRKHEFSALLVKEAGKPWNEADADTAEAIDFMEYYARQMIELAKGKPVNSREGEKNQYVYTPTGVTVVIPPWNFLFAIMAGTTVAPIVTGNTVVLKPASATPVIAAKFVEVLEESGLPKGVVNFVPGSGSEVGDYLVDHPKTSLITFTGSREVGTRIFERAAKVQPGQQHLKRVIAEMGGKDTVVVDEDADIELAAQSIFTSAFGFAGQKCSAGSRAVVHEKVYDQVLERVIEITESKVTAKPDSADVYMGPVIDQGSYDKIMSYIEIGKQEGRLVSGGTGDDSKGYFIKPTIFADLDPKARLMQEEIFGPVVAFCKVSDFDEALEVANNTEYGLTGAVITNNRKHIERAKQEFHVGNLYFNRNCTGAIVGYHPFGGFKMSGTDSKAGGPDYLALHMQAKTISEMF

SEQ ID NO: 12460 - DNA, 1662 bp, Aeropyrum pernix
  CDS (1)..(1662)
atgactattgtttggacaccggttaaagggtggttcctcgtggctttatggaggatagagaagcctaagaacgagcctttcctggagtttaggcctgggactaaggagagggagcttctaaagaagaagctcgaggaggttaagagtaagaccgtcgagatccccctgataatcggggggaaagaggtcaagactggtgagaccgtcgagatacgcgcgccccacgataaggatgccgtgctggctgtagcccaccttgctggggaggaggagataagggatgccatagagaaggccctggacgcttggacaaagtggtccgagatggagtggtaccacagggcctcagtcttcctgaaggctgcagacctgctggcggggccctacaggcttgaggccgatgctgtcataatgcttaaccactcgaagacgccgtgggaggcggagatagacctggcagaactcgtggacttctggaggtttggggcctactatgctagattcatcttcgaacagcagcctgagcaggctcccggcgagctaaacagggtcgagtggcggcctctagagggcttcgtattcgcagttcccccgttcaacttcttcagcataggaggtaacctgcccaccgcccccgcgctcgtggggaacgtgtcgatatggaagccttccagatgggttatatactccaactacataataatgaggatcctgatggaggctgggctacctccgggcgtggtaaacttcgttcccttcaacaccaagtactcgagcatagtgctctcccacccagacttcgcaggcctccacttcacagggagctactcaactttcgtcaggctctggaagatgatagcgcagaacctggacaagtacaggaacttccccaggatagtgggcgagacgggcggtaaagacttcattgtggtccacccgagcgcagacataaccgaggcagtggttgctacgataagaggagccttcgagtaccaggggcagaagtgcagcgctgcctccaggctattcgtacccaagagcatgtggcccaggttctgggaggccatgaaggcggagctggataaggttaaggtcgggccggttgacgacttcacagtattcatgggcgccataataagcgaggagcagtttaggaagatagtctcctacatagagtatgctaagcagcatcccgaggagtaccagataatctacggtggcaagtatgatgacagtaagggctacttcatatggcctactgtcgtgctcaccaacaacccgaagggcaagctgatgacagaagagatcttcggccctgtgctcacggtctacgtgtatgacgacgacaagtatgatgagatactgtgggttgtggacaaggcagctccctacggactaacagggtccgtgttcgcgaaggatagggaggccatactcaaggcggagaaggcgcttaggtatgcagcaggcaacttctacataaacgacaagccgacaggatccatagtggctagacagcccttcggaggcgccagatggtcgggcaccaacgacaaggcaggctggttcacaaacctcctaaggtggctgaacccgagatcgataaaggagaccctagtgccgccgaaagagtggagaagaccctatatgggagaggactag

SEQ ID NO: 12461 - protein, 553 aa, Aeropyrum pernix
MTIVWTPVKGWFLVALWRIEKPKNEPFLEFRPGTKERELLKKKLEEVKSKTVEIPLIIGGKEVKTGETVEIRAPHDKDAVLAVAHLAGEEEIRDAIEKALDAWTKWSEMEWYHRASVFLKAADLLAGPYRLEADAVIMLNHSKTPWEAEIDLAELVDFWRFGAYYARFIFEQQPEQAPGELNRVEWRPLEGFVFAVPPFNFFSIGGNLPTAPALVGNVSIWKPSRWVIYSNYIIMRILMEAGLPPGVVNFVPFNTKYSSIVLSHPDFAGLHFTGSYSTFVRLWKMIAQNLDKYRNFPRIVGETGGKDFIVVHPSADITEAVVATIRGAFEYQGQKCSAASRLFVPKSMWPRFWEAMKAELDKVKVGPVDDFTVFMGAIISEEQFRKIVSYIEYAKQHPEEYQIIYGGKYDDSKGYFIWPTVVLTNNPKGKLMTEEIFGPVLTVYVYDDDKYDEILWVVDKAAPYGLTGSVFAKDREAILKAEKALRYAAGNFYINDKPTGSIVARQPFGGARWSGTNDKAGWFTNLLRWLNPRSIKETLVPPKEWRRPYMGED

SEQ ID NO: 12462 - DNA, 1548 bp, Bacillus halodurans
  CDS (1)..(1548)
atgttgcaaccatataagcatgagccatttacagattttacggtggaagcgaatcgaaaagcgtttgaagaagcacttggacttgtagaaaaagagttaggcaaagagtatccattaattatcaatggtgagcgggttacaacagaggacaagatccaatcttggaaccctgctcgtaaagatcaattggttggttctgtttctaaagcgaatcaggaccttgcagagaaagctattcaatcagcagatgaagcgttccaaacttggcgcaacgtcaaccctgaggagcgtgcgaacattttagtgaaggctgctgcgatcatccgtcgccgcaagcatgagttttctgcatggcttgtacatgaagctgggaagccgtggaaggaagcggatgcggatacggcggaagcgatcgacttccttgaatattatgctcggcaaatgattgagcttaataggggaaaagagattcttagccgtccaggcgagcaaaaccgttacttctatacaccaatgggcgtgacagttacgatttctccatggaacttcgcccttgcgatcatggtcggtacggcagtagctccgattgtgacaggaaacacagttgtccttaagcctgccagtacgacacctgtcgttgctgctaaatttgttgaagttcttgaggatgcagggttaccaaaaggcgttatcaactatgtaccaggaagcggcgctgaagtcggtgactaccttgttgatcatccgaaaacgagtcttattacgtttacgggctcaaaagatgtcggtgttcgtttatatgagcgggcagctgttgttcgaccaggacaaaaccacttgaagcgcgtcattgtagaaatgggtggaaaggataccgttgtcgtcgatcgcgatgctgatcttgatttggctgcagaatccatcctcgtctccgccttcgggttctcgggacaaaaatgttctgctgggtcacgggctgttatccacaaggatgtctacgatgaagtgttagaaaaaacggtcgcccttgcgaaaaacttaacggttggcgatcctacgaaccgcgacaactacatgggaccagtaattgatgaaaaagcgtttgaaaaaattatgtcatacattgaaattggtaaaaaagaaggccgtctcatgacgggcggagaaggagacagctctacaggcttcttcatccaaccgacgattattgctgaccttgatccagaagcggtgatcatgcaagaagaaatatttggaccggtggttgctttcagcaaagcgaacgattttgatcatgcactcgaaattgccaacaacacagagtatggcttaacaggagcggtgattacgagaaatcgcgcccacatcgagcaagcaaagcgagagttccatgtcggaaacttgtatttcaaccgtaattgcacaggagcaatcgttggctatcatccatttggcggctttaaaatgtctggtaccgattcaaaagcaggtggtcctgactatttagcgcttcatatgcaagcgaagacagtatcagaaatgtattaa

SEQ ID NO: 12463 - protein, 515 aa, Bacillus halodurans
MLQPYKHEPFTDFTVEANRKAFEEALGLVEKELGKEYPLIINGERVTTEDKIQSWNPARKDQLVGSVSKANQDLAEKAIQSADEAFQTWRNVNPEERANILVKAAAIIRRRKHEFSAWLVHEAGKPWKEADADTAEAIDFLEYYARQMIELNRGKEILSRPGEQNRYFYTPMGVTVTISPWNFALAIMVGTAVAPIVTGNTVVLKPASTTPVVAAKFVEVLEDAGLPKGVINYVPGSGAEVGDYLVDHPKTSLITFTGSKDVGVRLYERAAVVRPGQNHLKRVIVEMGGKDTVVVDRDADLDLAAESILVSAFGFSGQKCSAGSRAVIHKDVYDEVLEKTVALAKNLTVGDPTNRDNYMGPVIDEKAFEKIMSYIEIGKKEGRLMTGGEGDSSTGFFIQPTIIADLDPEAVIMQEEIFGPVVAFSKANDFDHALEIANNTEYGLTGAVITRNRAHIEQAKREFHVGNLYFNRNCTGAIVGYHPFGGFKMSGTDSKAGGPDYLALHMQAKTVSEMY

SEQ ID NO: 12464 - DNA, 2991 bp, Nostoc sp. PCC 7120
  CDS (1)..(2991)
atggtattacaagtacaaaccagcacctacgaagcgaaaactcaagaaattgctagacaattattaggagcaactcaagaaaatcgctcgttttttgcttctttacgtgatcaaatgcgttgggatgacaaattactggcttgggcgatgagtaatcccggtttacgggtgcaattatttcggtttattgatactttacccgcattgcatagtaaagcggaaattgctgcacatttacaagaatatttaggggatgaatctgtcgaacttcccgccgctttaaagggaatgctcaattttgctaaccctgactctgtgccgggacaagtggctgcaactaccgtctctacagcagttgagactttagctcataaatatatttctggtgaaaatattaaacaagtcatcaagacagttgaacgactacggaaagaaaaaatggccttcaccattgatttacttggtgaggcggtaattacagaaacagaggcgcaatcttatctagaacggtatctagaattaattgctcaattaacagaagcatcgaagaattggggaactattgcggctattgatgaagcagatggcgaacagctagcaaaagtccaggtttctgtcaaactaacagcgttttattcccaatttgacccattggatgctaaaggtagtgaggagaaagttagcgatcgcattcgtattttattacgtcgtgctaaggagttaggggcagctatccattttgatatggaacagtatgcttataaagacttaactttaaatattttgcaaaaaatcttattagaagatgagtttcgtcaacgcacagatattggcatcacaattcaagcatacctaagagatagtgagcaagatgccagaaatgcgatcgcttggttgaaacagcgcggttatcctttaactattaggctggtaaaaggggcgtattgggatcaagaaactattaaagctgcacaaaaacattggccgcagcctgtttttaatgataaagcagcgacagatgccaattttgaggcgataactcagttattactggaaaatcaccaatatgtttattctgccattggtagccataatgtgcgatcgcaagctttagctatggcaattgcggaaactttgaatgtcccccggcggcggtttgagatgcaggtgctgtacgggatgggggataagttagcgaaggctttggttgatcggggttatcgggtgcgggtttattgtccttatggtgacttattaccggggatggcttacctgattcggcgattgttggaaaatacggcgaatagttcgtttttacggcagaatttggagaatcggccggttgaggagttgctggcagcgccgaaagttgatttagcccaggcaaaggtgcattcgccggaggcattcccacagggtaaacactttgtgggggctgcggatacagattatgcagaggaggaggacagaacaaaggcggcgcgggcttttgctgtggtacgtggggagttaggcaagacttacttacctctaattaatggggagtatgtgcagactgctgaggtgattgattctgttaatccttctaattttagtgaggtgattggcaaggttggattgattagtgtggaacaggcagaacaggcgatgcaggcggcgaaggcggcttttcctggttggcggcgcacgtcggtgaaggaacgggcggggattttgcgtcgggctggtgatttgatggaacagcgccgggcggaattgtcggcttggatagttttagaggtggggaaacctgttaaagaagcagatggggaggtttcggaggcgatagatttttgccgctattatgctgatgagatggaacggttgcatcaaggtataaattatgatgtagatggggaaacgaatcgttatatttaccagccacggggtattgtggtagtgatttctccttggaattttcctttagcgatcgcctgtggaatgactgttgcagccttagttacaggcaattgtactctgctaaagcctgcggaaacttcttctgtcattactgccaaactaacggaaattttggtagaggctggcattcctaaaggtgtctttcaatacgtccctggtaagggttctcaagtcggtgcttacttggtaagtcatcctgatactcatctgattgcttttacaggttctcaggaagttggttgtcggatttacgccgaagccgctaccctgaaaccccaacaaaggcacatgaagcgggtaattgcggaaatgggcgggaagaatgccatcattgtggatgaaagtgctgatttagaccaagctgttgttggggtagtgcagtcagcctttggttacagtggacaaaaatgttctgcttgttcgcgggtggtggtagtagaagcaatttatgatgcttttatccaccgggtggtggaagcgacaaaatccttaaatattggcgaggcggagttaccaagtacccaagtcggccctgtgattgatgctaatgcgcgcgatcgcatccgcgagtatattgagaagggtaaggcagaatctcaggtggcgttggaattaagcgcacccaaccacggctattttgtcgggcctgtcatctttggggaagttccacctcatggcacaatagcccagcaggaaattttcggccctgtgctggcggtaatcaaagccaaagattttgcccaagctttagctattgctaatgataccgactacgccttgactggagggctttattcccgcacaccttcccatattcaacaagcccaggaagagtttgaagtgggtaacttatatatcaaccgtaacatcacaggggcgatcgttgcgagacagcctttcggtggctttaagctttccggtgtcggttccaaagcaggcggccctgattatctgttgcaattcctcgaaccaaggacaatcacagaaaacattcagcgccaaggttttgcacccattgaaggtgcagaataa

SEQ ID NO: 12465 - protein, 996 aa, Nostoc sp. PCC 7120
MVLQVQTSTYEAKTQEIARQLLGATQENRSFFASLRDQMRWDDKLLAWAMSNPGLRVQLFRFIDTLPALHSKAEIAAHLQEYLGDESVELPAALKGMLNFANPDSVPGQVAATTVSTAVETLAHKYISGENIKQVIKTVERLRKEKMAFTIDLLGEAVITETEAQSYLERYLELIAQLTEASKNWGTIAAIDEADGEQLAKVQVSVKLTAFYSQFDPLDAKGSEEKVSDRIRILLRRAKELGAAIHFDMEQYAYKDLTLNILQKILLEDEFRQRTDIGITIQAYLRDSEQDARNAIAWLKQRGYPLTIRLVKGAYWDQETIKAAQKHWPQPVFNDKAATDANFEAITQLLLENHQYVYSAIGSHNVRSQALAMAIAETLNVPRRRFEMQVLYGMGDKLAKALVDRGYRVRVYCPYGDLLPGMAYLIRRLLENTANSSFLRQNLENRPVEELLAAPKVDLAQAKVHSPEAFPQGKHFVGAADTDYAEEEDRTKAARAFAVVRGELGKTYLPLINGEYVQTAEVIDSVNPSNFSEVIGKVGLISVEQAEQAMQAAKAAFPGWRRTSVKERAGILRRAGDLMEQRRAELSAWIVLEVGKPVKEADGEVSEAIDFCRYYADEMERLHQGINYDVDGETNRYIYQPRGIVVVISPWNFPLAIACGMTVAALVTGNCTLLKPAETSSVITAKLTEILVEAGIPKGVFQYVPGKGSQVGAYLVSHPDTHLIAFTGSQEVGCRIYAEAATLKPQQRHMKRVIAEMGGKNAIIVDESADLDQAVVGVVQSAFGYSGQKCSACSRVVVVEAIYDAFIHRVVEATKSLNIGEAELPSTQVGPVIDANARDRIREYIEKGKAESQVALELSAPNHGYFVGPVIFGEVPPHGTIAQQEIFGPVLAVIKAKDFAQALAIANDTDYALTGGLYSRTPSHIQQAQEEFEVGNLYINRNITGAIVARQPFGGFKLSGVGSKAGGPDYLLQFLEPRTITENIQRQGFAPIEGAE

SEQ ID NO: 12466 - DNA, 6633 bp, Brucella melitensis
  CDS (1351)..(5007)
ggcgttgatggcggccatcacagtggcgtcgacggcggtcatcgcggcgacttcggtttagactaaattatagatattgaatcaatgtctgtttggtctgatgtatgggccagtggattatttgatgtatctctaattttcgcatcgccaagttgattgatcttatagaaataccaatacgaagccccgctctgcggggctttttcgtgatggggaaattttagatttcaggcaaaaaaagagccggactgggaagtccggccaagttatgaaggtgccacttgggcaaacctccagaggggaacacttaccgtgcgcaatgggaggaggcacaacggtaagtacctgtgatatggagcagaatgctctattcttcaaccccaaaacataattatttttgaccattcagaaaattttgaactttttggccctatcggctttcggaagccgaaaccgaagggtttcgcgttccgtttcggggcgggcaaaaagaaaaacccgaaatgatttccattggatcgttgacagagcggctcctgttttaacagaatcgccagaaccgctctatctctttgtttttagcacttttggctcgaaaatgctctgggctgtcgtgacgaatggaaatgttttcggactgcttgccgcaaactcttataaaaacaatcacaacgcgcccggatagaccctgatcgggcggttatcctttacggattccatcaccacgaaggtggatgtgcttgccacattgggcaggctggagattttttcgcccagcacctcgcggtagcgccggatgttgggtgtgcgcactttcaggagatagtcgaaggagctggcgatcatgtggcattcctctacctcgcgtatcttgcgcaccgccacattgaacgcttcaagtgctgcctcccgcgtatccgataatttgaccgttgtgaaagcgatatggtcgaggcccagtttttccgggtcgatggctgcgcgaaaacccagaatatagccttcatcgaccagtcttttcagtcgcgcctgacatggcgtcttggaaaggccgacccttttcgacagttccgtcaccgggatgcgcccatcttcgctcaggacctccagaatgcgccggtcgaactgatccatatcgtctagcgagtctatctttcgcattctataagccttcataggaggtaataataagatcggattgcctatttatagctaaaaagagggcagaatggaatttatgcggatgataatgtgcaactaaattaaagaagggctatccttgagtgacatctggggccttttcctttttgtgagcagtgcaccatgaccgataatatttctgtttccaaaatggccgttttccagaattttgcgccgccgatccgcgagcaaagcgcactgaggcaagcgatcactgccgcttatcgccgccccgaagccgaatgcgtttcagcgctggccgagcaggcaaccttgccggaggagacgcgccagcaaatccgttccaccgcccgcaagctgatcgaagcgctgcgtgccaagcataagggcaccggcatcgaaggtctggtgcatgaatattcgctgtcgagccaggaaggcgtggcgctgatgtgccttgccgaagccttgctgcgcattcccgatatggcgacgcgcgatgcgctgatccgcgacaagatatcgaatggcgactggaaatcccacattggcggcgggcgctcgcttttcgtcaatgctgcgacatggggcctggtcgttaccggcaagctcaccaataccgtcaatgatcgtggcctttccgccgctcttacccgcctcatcgcccgctgcggcgagccggtcatccgtcgcggcgtggacatggccatgcgcatgatgggcgagcagttcgtcaccggcgaaaccatcgatgaggcgttgaaacgcgccaaggagctggaagagcgcggcttccgctattcctacgacatgctgggcgaggccgcgaccaccgccgccgatgcagagcgttattataaggattatgaaaccgcgatccacgccatcggtcgtgcttccgcagggcgcggcatttatgatggtcccggcatttccatcaagctttcggcgcttcacccgcgttatacccgcgcgcaaagtgagcgcgtcatgggtgaacttctgccgaaggtgaaggcactcgcggccatcgccaagtcctataatatcggcctcaatatcgacgcggaggaggccgaccgtcttgaactgtcgctcgacctgttgcaaagcctttgcgaagaccctgatctggcaggctgggatggcatcggcttcgtggtgcaggcctatggcaagcgctgccccctcgtgcttgatttcatcatcgatctggctcgccgcaccaagcgccgcgtcatggtgcgtctggtgaagggcgcctattgggatgcggagatcaagcgtgcgcaggtggatgggctggaggattttccggtctatacccgcaaggtgcatacggacgtttcctatattgcctgcgcgcgcaagcttctggccgcgacggatgtgatctttccgcaatttgcgacccataacgcgcagacactcgccacgatctatcatctggccgggccggatttcaaaaccggtaagtttgagttccaatgcctgcacggcatgggtgagccgctttatgatgaagtcgtcggccccgaaaagctcggtcgcccggcccgcatttatgcaccggtcggcacgcatgaaacgctgctcgcctatctcgtccgccgccttcttgaaaacggcgcgaactcctccttcgtcaaccgtattggcgacaaaaacgtctcggtcgatgagctgatcgccgatccggtggaagtcgtccggtcgatggctgtcgtcggtgcgcgtcatgaccagattgcgctgccggaaaatctctatggcgcgcgccgcaattccgcaggctttgatctttccaatgaggtgacgcttgcggaactgagcaaaaccttgaaggaaacggcaggccgtgcatggaccgccgaaccgcaggtggcgggtgcaaaggtgaagggcgtaagccgtccggttctcaatcccggcgaccggaatgatgttgtcggcaccgtaacggaaatcgcagaggccgatgtggcaaaggcgatgaaggcagcgcaaaccgcgaccacaagctggtccgcggttgcgcccgcagaacgcgccgcctgtctggagcgcgcagccgatatcatgcagcgcgacatgccggctctgctcggcctcgtcatgcgcgaggcgggcaagtccatgccgaacgccattgccgaagtgcgtgaagccatcgatttcctgcgctattatgccgaacagacccgccgcacgcttggcgtcggccacaaggcgcttggccctgtcgtctgcatcagcccgtggaacttcccgctggcaatcttcaccggccagattgcggctgcacttgttgcaggcaatccggttctggcaaagcctgccgaggaaaccccgctgatcgccgctgagggcgtgcgcattctgcatgaggggggcattccggcggatgcgctccagcttctgccgggtgatggccgcattggcgccgcgctggttgcagcaccggaaacttgcggcgtaatgttcaccggctccaccgaggtggcgcggctcatccaggcgcagcttgcctcgcgcctgctgccgaacggaaagccggtcccgctcattgccgaaacgggcggtcagaacgccatgatcgtggattcctcggcacttgccgagcaggtggtgtttgatgtcatcgcttcggctttcgatagcgccggccagcgctgttcggcgctgcgtgtcctctgcttgcaggaagatgtggccgaccgcattctcaccatgctcaagggcgccttgcgtgagctttccattggccgcacggaccagctcaaggtcgatatcggcccggttatcaccgatgaggcgaagaacaccattgaaaagcatattcaggccatgcgcgatcttggccgcaaggtggaacagcttccccttggcccggaaacgcagaacggcacttttgttgcgccgacaatcatcgagattgaatcgctgcgcgatctcaagcgcgaagtgttcggcccggtcctgcatgtggttcgttacaagcgcgacgacatggaaagcctgatcgatgatatcaattcgaccggctatgggcttacttttggtttgcatacgcgccttgacgagacgattgccaatgttgcggatcgcatccgtgtcggcaatatctatatcaatcgcaacattatcggcgcagtggtgggcgtgcagcctttcggcgggcgtggcctttccggcaccggcccgaaggcgggcggtccgctctatcttggccgtctggtcgaaaccgcgccgatcccgccgcgtcacgcttcggttcataccgatgcggcgctgaaggactttgcccggtggctcggcaatcgcggcatgaacgatctggcgcaggcggcgcgcgataccggcagtgcttcggcgctcggtctcgaactcgaactgccgggcccggttggcgagcgcaatctctatgctctccacccgcgcgggcgcgtgcttctggtcccccagaccgaaattggcctctatcgccaattgacggcggtgctggcaaccggcaacactgcggtcatcgacgaggcttgcggtttgcgcgccgtgttgaaggatctgccggaaacagttgccgcgcgcgccatctggacgggcgactggcaggcggatgcgccttttgccggagcacttatcgaaggcgacagcgcgcgcatcaaggaggtgaactccaggatcgccgccctgccgggaccgctcgtactcacacaggcggcatcgccggaagatcttgcagccaatcaggatgcttattgcctcaactggctgcttgaggaagtctcgacctccatcaacaccacggcagcaggcggcaacgccagcctgatggcgatcggctgatttcttcgcatatgtgaggcagaaaaggcggctttccggccaccttttctttgcgccacgcaaggcttgcatggctgtgcagaaaaatcgacaacagaacgattagattattttctgaaaaatcggaataaaatttacaacgtgattgacagcccgatttaaaaggcgaagactatatatgcgctggcaaagcgtcggcgtggaggcgccgtatagagggaggaaaataatgcgttcagcattcatggttgcggcgctggccgctggggtatcgtcattcgcattctcggcccaggctgccggcaatctcaaccttatctgttcggcggatgtcgtcatctgcgaacagatgaaaaatatgttcgagaaagataccggaatcaaggtcaatatggtgcgcctttcttccggcgaaacctatgcgaaagtgcgtgccgaagcgcgcaatccgaagaccgatatctggtgggcaggcacgggcgacccgcaccttcaggccgcttccgaagggctgacgcttgaatataaatcgccgatgctcgaccagttgaatgattgggccaaaaaacaggctgaaagttccggcttccgcacggtcggggtttatgccggtgcgctgggctgggggtataacaccgatattttcgccaagaagaacctgaaggaaccgaagtgctgggccgatctcctggacccttcttataagggcgaaatccagatggccaatccgaattcttccggcacggcctatacggcgcttgccacgctggttcagatcatgggtgaggacaaaggctttgattatctgaagaaactcaacgccaatgtctcgcaatataccaagtccggttctgcgcctgtgaagtctgcggcgcgcggtgaaacgggcatcggcatcgtcttcatgcatgatgcggtggcgatgacggcggacggtttccccatcaagtctgtcgcgccatgcgaaggcacaggctatgaaatcggctcaatgtccatcatcaagggcgcgaagaaccttgaaaacgccaagaaatggtatgactgggcgctgaccgccgaggtgcagtcgcatatgaaggacgccaagtccttccagcttccctccaacaagtctgccgaggttccaaaggaatcgccgcgctttgaggatatcaagctcatcgattacgatttcaagacttatggcgaaccggccaagcgcaaggaattgctggagcgctgggacaatgaagtcggcgcagtcgccaactgatcgacctattgtaaaggcttgccgcacaagttgtcgcggcgggctgtcccggatggcgggcgcccggtttgaccgggcgcacgttatccttttcccggaaatcggcccggtagagaggggaagcggacgcactcatgacacaacataaccgcagactggatgccgttctggcaatcgcgctgatcgcctttgccctgctgccctggtatcgcattgaagacggcttcctgcatttcagctggattgaagttctgttcagcgaaagcgccgaggcgcccggcatattgcaaattttcgtcttcggacgttcgtggatcggggcgattgcccttctgatgctcatatgcgctgttgcgcgctttttcctgcct

SEQ ID NO: 12467 - protein, 1218 aa, Brucella melitensis
MAVFQNFAPPIREQSALRQAITAAYRRPEAECVSALAEQATLPEETRQQIRSTARKLIEALRAKHKGTGIEGLVHEYSLSSQEGVALMCLAEALLRIPDMATRDALIRDKISNGDWKSHIGGGRSLFVNAATWGLVVTGKLTNTVNDRGLSAALTRLIARCGEPVIRRGVDMAMRMMGEQFVTGETIDEALKRAKELEERGFRYSYDMLGEAATTAADAERYYKDYETAIHAIGRASAGRGIYDGPGISIKLSALHPRYTRAQSERVMGELLPKVKALAAIAKSYNIGLNIDAEEADRLELSLDLLQSLCEDPDLAGWDGIGFVVQAYGKRCPLVLDFIIDLARRTKRRVMVRLVKGAYWDAEIKRAQVDGLEDFPVYTRKVHTDVSYIACARKLLAATDVIFPQFATHNAQTLATIYHLAGPDFKTGKFEFQCLHGMGEPLYDEVVGPEKLGRPARIYAPVGTHETLLAYLVRRLLENGANSSFVNRIGDKNVSVDELIADPVEVVRSMAVVGARHDQIALPENLYGARRNSAGFDLSNEVTLAELSKTLKETAGRAWTAEPQVAGAKVKGVSRPVLNPGDRNDVVGTVTEIAEADVAKAMKAAQTATTSWSAVAPAERAACLERAADIMQRDMPALLGLVMREAGKSMPNAIAEVREAIDFLRYYAEQTRRTLGVGHKALGPVVCISPWNFPLAIFTGQIAAALVAGNPVLAKPAEETPLIAAEGVRILHEGGIPADALQLLPGDGRIGAALVAAPETCGVMFTGSTEVARLIQAQLASRLLPNGKPVPLIAETGGQNAMIVDSSALAEQVVFDVIASAFDSAGQRCSALRVLCLQEDVADRILTMLKGALRELSIGRTDQLKVDIGPVITDEAKNTIEKHIQAMRDLGRKVEQLPLGPETQNGTFVAPTIIEIESLRDLKREVFGPVLHVVRYKRDDMESLIDDINSTGYGLTFGLHTRLDETIANVADRIRVGNIYINRNIIGAVVGVQPFGGRGLSGTGPKAGGPLYLGRLVETAPIPPRHASVHTDAALKDFARWLGNRGMNDLAQAARDTGSASALGLELELPGPVGERNLYALHPRGRVLLVPQTEIGLYRQLTAVLATGNTAVIDEACGLRAVLKDLPETVAARAIWTGDWQADAPFAGALIEGDSARIKEVNSRIAALPGPLVLTQAASPEDLAANQDAYCLNWLLEEVSTSINTTAAGGNASLMAIG

SEQ ID NO: 12468 - DNA, 3972 bp, Yersinia pestis
  CDS (1)..(3972)
atggcgaataccacaatgggcgtaaagcttgatgaagcaacacgagaccgcatcaagagtgcagcacaacgtattgaccgcacaccacactggctcattaaacaggctattttcaactacttagaaaaactggaaagtaacagtgaattgccagaactggcaacaacaagttcactctctctgcaagacacagaagatgctataccgcaactcactgaaaacactcatcagccattcttggattttgcggaacacgtgctcccgcagtcggttacccgtgccgccattactgcggcttatcgtcgcccagaaaccgaagcgatccccatgttattggaacaagcacgcctacccgcagatttagcgcaagcaacacataaactggcctattccattgctgaaaaactgcgtaatcaaaaaagtgcccatggccgcgcgggcatggtacagggattgctgcaagagttctcactctcttcacaggaaggcgtggcattgatgtgtctggctgaagccctactacgtattcctgacaagccaacccgcgatgcactgatccgcgataaaattagcaacggcaactggcattcgcatctgggacgtagcccgtcaatgtttgtcaatgcagccacttggggcctgctatttactggccgcctagtctctacccataacgaagccaaactctccggctcactgaaccgaattatcggtaaagggggtgagccgttgattcgtaaaggcgtcgatatggcgatgcgcttgatgggcgagcaattcgtcaccggtgaaaccatttcggaagcattggcaaatgcccgtaaattagaagataaagggttccgctactcttacgatatgctgggcgaagcggcattaactgaagcagatgcacaggcttacctactctcttaccaacaggcaattcatgccattggtaaagcctcaaatggccgtggtatttacgaaggcccggggatttcaatcaaactttccgccctacacccccgttatagccgtgcgcaatatgagcgagtgatggacgagttatacccgcgtctgttatcgctaacattacaggcccgtcagtatgatatcggtatcaatattgatgccgaggaggctgatcgtctggaaatctctctcgacctgttggagaggctgtgcttcgaaccccaattggcaggttggaatggcattggttttgttattcaggcataccaaaagcgttgtccgtccactattgatgccgtgattgatatggcacaacgtagccgccgccgtctgatgattcgcctcgtcaaaggggcgtattgggacagcgaaattaaacgtgctcaaattgacgggttggaaggatacccggtttatactcgtaaggtttataccgatgtgtcctatctggcctgcgcccgcaaattattggctgttccaaacctgatctatccgcaatttgcgacgcataatgcgcatactctgtcagcgatttaccaccttgccgggcaaaattactaccccggccagtatgagttccaatgcctacacggcatgggggagccactgtatgagcaagtggtcgggaaagttgccgagggtaagctcaaccgcccatgccgtatttatgctccggtcggtacccatgaaacattgctggcttaccttgtgcgccgtctgttggaaaacggtgccaacacctcgtttgtcaatcgtatcgctgatgccacattaccccttgatgaactggttgcggacccggtcagtgcggtagaagccatggcggcggctgaaggtcaacttggtttacctcatccgcgtatccccttaccacgtgagctgtttggtaaagatcgcgccaactccagcggggtggatcttgccaacgaacaccgccttgcgtcgctctccagcgcgttgctggccagtgccagccaggtatggcgtgcggagcccgtcattgatgcagagcaggacaacggtgacgcgctaccggttatcaacccggcagaacctgccgatgtggttggctatgtccgcgaggcaaccgaaggtgaagttagccgtgcattggatgctgccgcccgtgctggcgctatctggtttgccacccccccggctgaacgggctgctatcttaatccgcgccgctgagttgatggaaaatcagatgcaaacgctgatgggaatattggtgcgtgaggcgggtaaaaccttcagtaatgccatcgccgaagtccgtgaagccgtggacttcttgcattattacgccggtatagtcagggataacttcgccaatgatagccatcgcccgctcggcccggttgtttgtatcagtccgtggaacttcccactggctatctttaccggtcaggttgccgccgcgttagcagcaggcaacagtgttttggcaaaaccagcggaacaaacaccactcattgccgcacaggccgtgcgtattctgctggacgcaggcatcccacagggtgttctgcaattgctacctggccgcggtgacagtgttggcgcgctactggttaatgatgcccgtgtgcgtgcagtgatgtttaccggttctaccgaagtagccactattttacaacgtagtatcgcaggccgtcttgatccacaggggcgtccaacaccgctgatcgcggaaaccggtggcctgaatgcgatgattgttgactcttcggcactgactgaacaagttgtgaccgatgttgtcgcctctgcctttgacagtgcaggccagcgttgttctgccctgcgtattctctgcattcaggatgatgtcgctgaacatacgctgcaaatgttgcgtggtgccatggcggaatgccggatgggcaatccagaacgcctgtctacggatattggtcccgttatcgacgccgaagcgaaaactggcattgagcgccatatccaagcgatgcgagccaaagggcgtaaagtttatcaggcagcccgtaccaacagcttggatgagaaagagtggcaacgtggaacatttatcaaaccgaccttgattgaattggacagttttgatgagctgcaaaaagaagtttttggcccagtgctacatgttgtacgcttccagcgtcagcatcttaatgagttagtcgatcaaattaatgcatctggctatggcttaaccttgggcatccacacccgtattgatgaaaccatcgcccgtgtcactgaaaaagcaaaagtaggcaacctctacgttaaccgtaatatggtcggtgccgttgtcggtgtacaaccttttggtggcgaggggttatcaggtaccggtcccaaagctggcggcccattgtatttgtatcgcctgctgagtagccgcccagacgacgcactggccaataccctggcgcatcaggatggcgaacagcaacaaaatgttgcaggccgtgaagcgctgctgaccgctcaccgcgcgttcactcaatgggccacggaacaacaacatgattcgctggccactctctgccaacgctatgcctctctggcacaaggtggaaccgtgcggttattgccaggcccgaccggtgagcgcaatacctatgccctgctgcctcgtgagcgagtcctttgtcttgccgataccgaaagcgatactcttacgcagttggctgcggtgttggcgaccgggagccaggttctatggccggagaatgacgtacagaaagcactgttgcctcaattgcctactgaagtgcaatcgcggatcacccttacccacgattggcaaaccgctaacatcaccttcgatgccgttatctatcacggcgatgcggatcaactacgcacgctatgtgagcaggttgcgcaaattgatggccccattgtctctgtacaaggcttcgctcgtggtgaaaccaatatcctgctggaacgcttattaattgagcattcattgagtgtcaatacagctgccgctggtggcaacgccagtctgatgactatcggctag

SEQ ID NO: 12469 - protein, 1323 aa, Yersinia pestis
MANTTMGVKLDEATRDRIKSAAQRIDRTPHWLIKQAIFNYLEKLESNSELPELATTSSLSLQDTEDAIPQLTENTHQPFLDFAEHVLPQSVTRAAITAAYRRPETEAIPMLLEQARLPADLAQATHKLAYSIAEKLRNQKSAHGRAGMVQGLLQEFSLSSQEGVALMCLAEALLRIPDKPTRDALIRDKISNGNWHSHLGRSPSMFVNAATWGLLFTGRLVSTHNEAKLSGSLNRIIGKGGEPLIRKGVDMAMRLMGEQFVTGETISEALANARKLEDKGFRYSYDMLGEAALTEADAQAYLLSYQQAIHAIGKASNGRGIYEGPGISIKLSALHPRYSRAQYERVMDELYPRLLSLTLQARQYDIGINIDAEEADRLEISLDLLERLCFEPQLAGWNGIGFVIQAYQKRCPSTIDAVIDMAQRSRRRLMIRLVKGAYWDSEIKRAQIDGLEGYPVYTRKVYTDVSYLACARKLLAVPNLIYPQFATHNAHTLSAIYHLAGQNYYPGQYEFQCLHGMGEPLYEQVVGKVAEGKLNRPCRIYAPVGTHETLLAYLVRRLLENGANTSFVNRIADATLPLDELVADPVSAVEAMAAAEGQLGLPHPRIPLPRELFGKDRANSSGVDLANEHRLASLSSALLASASQVWRAEPVIDAEQDNGDALPVINPAEPADVVGYVREATEGEVSRALDAAARAGAIWFATPPAERAAILIRAAELMENQMQTLMGILVREAGKTFSNAIAEVREAVDFLHYYAGIVRDNFANDSHRPLGPVVCISPWNFPLAIFTGQVAAALAAGNSVLAKPAEQTPLIAAQAVRILLDAGIPQGVLQLLPGRGDSVGALLVNDARVRAVMFTGSTEVATILQRSIAGRLDPQGRPTPLIAETGGLNAMIVDSSALTEQVVTDVVASAFDSAGQRCSALRILCIQDDVAEHTLQMLRGAMAECRMGNPERLSTDIGPVIDAEAKTGIERHIQAMRAKGRKVYQAARTNSLDEKEWQRGTFIKPTLIELDSFDELQKEVFGPVLHVVRFQRQHLNELVDQINASGYGLTLGIHTRIDETIARVTEKAKVGNLYVNRNMVGAVVGVQPFGGEGLSGTGPKAGGPLYLYRLLSSRPDDALANTLAHQDGEQQQNVAGREALLTAHRAFTQWATEQQHDSLATLCQRYASLAQGGTVRLLPGPTGERNTYALLPRERVLCLADTESDTLTQLAAVLATGSQVLWPENDVQKALLPQLPTEVQSRITLTHDWQTANITFDAVIYHGDADQLRTLCEQVAQIDGPIVSVQGFARGETNILLERLLIEHSLSVNTAAAGGNASLMTIG

SEQ ID NO: 12470 - DNA, 1467 bp, Listeria innocua
  CDS (1)..(1467)
atgagtattaaagaaacaagcttaccaaaagttcaaaccaaattatttattaatggaaaatggatagatggcgataataaagaaacaaaagatattgtaaatccagcaaacggcgaagtcatcgcgaaaattgctcaagcaggacctaaagaaacaaaacaagcgattaaagctgcaaaagatgcttttcctgattgggcgaaaatggaactagctgaccgcgttaaactcttgcataatattgctgatttaatggaagaacgagcagatactttagcaaaaattatgaccttagaacaaggtaaaccattaaaagaatcaaaaggagaagttttaaccggcgcggaaaacttccgattcgcagctgaagaagcaagaagactatacggtgaaacaatcccagctccaaacaaccacgcgtttattgttaaaaaacaaccaattggcgtagtagcagcaattactccgtggaatttcccgggtggaatggtgacacgaaaactcgcaccagcgctagctacaggtaataccatcgtgttaaaaccatctggagataccccgctttcggctttagctatctttgaaatttttgaagaagctggcttaccaaaaggtgttgctaatattgtcatgggaagctcgaaagaaatcggtgaaactttaacagatagtgatgatgtccgcaaattaacgtttacaggttcgacaaaagtcggtcaaacactatttaaacaatctgctgacaccttgaagaaaatctcgcttgagcttggggggcacgcaccatttatcgtgtttgcggatgctaaccttgaagctgcagtagatgatttaatcacagcaaaattccgtaacaatggtcaagtatgtgtatcaccaaaccgcatctttgtagcaaaagaaatcaaagaaaaattcactaaaacattagtcgctaaagtagaaaaactaaaagtcggtaacggtttagacgacgtaaatgttggtccgcttattcgcgaagatgccatcgacaaaatcgacaaacaacttaaaaacgcgacagataaaggcgccaaagtcctaactggtggcgaacgtttaactggctctgactacgacaaaggtaatttctataaaccaactgttttagataacgtcactcgtgaaatggacatcttttatgaagaaacattcggccccgtaattccgcttatcgtttttgaaaatgaagatgaagcaattgaaatggcgaatgatagcgaattcggtctagcatcttatttctatacaaaagatttagcacgcgttgaaaaagtcggtgcagctctagaatatggtatggttggtgcaaacgaaatcgctatatccaatccagaaactccatttggtggtgtaaaacattcaggatttggccgcgaaaatggtcattacggaatggaagaatacatccaagtgaaattcattaacttaaaatatcgtgattaa

SEQ ID NO: 12471 - protein, 488 aa, Listeria innocua
MSIKETSLPKVQTKLFINGKWIDGDNKETKDIVNPANGEVIAKIAQAGPKETKQAIKAAKDAFPDWAKMELADRVKLLHNIADLMEERADTLAKIMTLEQGKPLKESKGEVLTGAENFRFAAEEARRLYGETIPAPNNHAFIVKKQPIGVVAAITPWNFPGGMVTRKLAPALATGNTIVLKPSGDTPLSALAIFEIFEEAGLPKGVANIVMGSSKEIGETLTDSDDVRKLTFTGSTKVGQTLFKQSADTLKKISLELGGHAPFIVFADANLEAAVDDLITAKFRNNGQVCVSPNRIFVAKEIKEKFTKTLVAKVEKLKVGNGLDDVNVGPLIREDAIDKIDKQLKNATDKGAKVLTGGERLTGSDYDKGNFYKPTVLDNVTREMDIFYEETFGPVIPLIVFENEDEAIEMANDSEFGLASYFYTKDLARVEKVGAALEYGMVGANEIAISNPETPFGGVKHSGFGRENGHYGMEEYIQVKFINLKYRD

SEQ ID NO: 12472 - DNA, 3558 bp, Helicobacter pylori
  CDS (1)..(3558)
atgcaaaaaatcattgaggattcattagaattagctaaaaaactgcaagatagtatcagtaaccatttgagcgagcaagaaaaagcgttccattttaaaatgcaaaagcttttaaacaaccccgaaaacaaagtcatgcttatagagcttatggatcggagttttaggtgtttggacaataaagcccgctttgaaatgattgagcatgttttagacaaatacaaaagccgtgagattttttcttcgtttgaaaaatggcttttaatggggtttttaagctttgggaaaatgctgcctgatatgagcgtgcctttctttgtcaataaaatcagaagcgacacgaaagcaatggtcttggatcaagaagagagccaattaagagagcggattttaaaaagaaaaaatgagaaaatcattttgaacgtgaattttattggcgaggaagttttaggcgaagaagaagcgtctgcgcgttttgaaaaatactctcaagccctaaaatccaactacatccaatacatttccattaaaatcacaacgattttttctcaaatcaatatccttgattttgaatactctaaaaaagagattgtcaaacgcttagacgctctttatgctttagctttagaagaagaaaaaaagcaaggcatgcctaaattcatcaacttggatatggaggaatttagggatttagagcttacggtggaatcgtttatggagtctatcgccaaatttgatttgaacgccggtattgtgttgcaagcttatatccctgattcttatgaatatttgaaaaaactgcacgctttttctaaagaaagggttttaaaagggttaaagcctattaaaatccgctttgttaagggagcgaacatggagagcgaagagacgatcgcttctatgaaagactgggcgttacccacattttctagtaagcaagacaccgattctaattacaacaaaatgctggattttgttttagagggcgacaattataaatacattcatattggtgcagcgagccataatatttttgaaatcgcctatgtctatacgcgcatccatgcccttaatgaccctgttgtgttagagcattttagctttgaaatgctagagggcatgagcttgcaagcgagccaggaattaaaagagatgcacaaactcattctttatgcgccggtgtgcgatgaagcgcatttcaacaatgcaatcgcttacttggtgaggaggctagatgaaaacacttcaagcgataatttcatgaaagctttctttaacctcaaagtaggcacgagcgaatggaaagaccaagagcaacgctttttaaacagccttaaagggatcgccactttagacaataccacccacaggacccaagacagaaacgccaaacaaaccgggcataccacctacccaaaccactcctttaaaaacgaaagcgataccgattttattttaaaagccaaccgagaatgggctaaaaaagtgcgcgataaaatgcataacgcccctattttagagctttacccagaaatagatgggaggtttgaagatcctaatttaacccctttagaagtctttgatagaatccatcataaaaaaatcgccagcgtgcatttagcggataaagaagcgattttaaaagccctagaagtggctaaaagcgataagagccgtttcagtcaaaaaagcttcacagaaatccatgctttattgagtcaaaccgctcagctttttagagaaagaagaggcgatttaatagggatttccgctttagaagtgggtaagactttcgctgaaacggacgctgaagtgagcgaagccattgactttttagagttttacccttacagcttaagggtgttacaagagcaaaataaaaaaacgaaattcacccccaaaggcgtgggtgtggtcatcgctccatggaatttccctgtgggcatttctgtaggcactatcgctgcccccctagccgctggcaatcgggtgatttacaagccctcaagtttgtctagcgtaacgggttataagctttgcgagtgcttttgggatgcgggcgtgcctagagatgcgctcatttacttgccctctaaagggagcgatattagcgagcatcttttaaaagatgaaagcatcaagtttgccattttaacagggggtgaagacaccgcttataaaatgctcaaggctaaccccactttagccttaagcgctgaaacaggcggtaaaaacgccactattgtgagcaaaatggcagacagagaccaggcgattaagaatgttatccattcagcttttagcaattcggggcaaaaatgctccgccacttcgcttttagtgttagaaaaagaagtctatgaagatgagaatttcaaaaagactctaatagatgcgactctaagccttagcgtgggcgatccttttgatttcaaaaacaaaatcggtgctctagcggacaagcctaatgaaaaggtcatcaaagccatagatgaattgaaaagctatgaaaattacgaaatcccagcaagctttgttgatgataacccctatttgatgaagccaagcatcaaatacggcactaaaaaaggcgatttcacgcaccaaactgagctttttacgcccattttatccgtgatgaaagcaaaagatttagacgaggcgatagaaatagtcaattctaccggttacgggctgactagcgcgttagagtctttggacgaaagggagtgggaatattatttagaacgcattgaagccggtaatatctatatcaacaaacccaccacaggagcgattgtcttgcgccagccttttgggggggttaaaaaatccgctgtggggtttgggaggaaagtaggcattttcaactatatcacgcaatttgtgaatatccatcaagaagaagaagatgaaaacgccttaaaaaaccccttaagcgaagctttagagggcttgactcaaaaaggctatgatgaacacacgcatgagttgaaacgcgcgatttttatggcaaaaagctacgcttatcattataagcatgaattcagccaagctaaagactatgtcaaaatcagaggcgaagacaaccttttttcctacactaaagttacaagcgtgggctatcgcatcaccgaaaaggacactttaagcgacatgttaggcgttgctttagcatgcttaatttctcaaatccctttaacgatcagcatagaaaacgaacgagcgaacaaagatttaaccttttttttagaatgcttaaaagcactccaagcaaacgcccctatcgtttatgaaagcttgcaaaaatttagcgagaagttgaacgctttcaatcgtgtccgttatctcaaaagcgatttggatttattgcacgaacaagcaagcagattagggatggttttagccacggctaaaccctgcttgaatgggcgttttgaattgctgtattaccacttagagcgatcggttagcatttcgtatcatcgttatgggaatttaggctcaagggttttaaggcaacccacttgccacaaatcatgctgtgctgaaaaataa

SEQ ID NO: 12473 - protein, 1185 aa, Helicobacter pylori
MQKIIEDSLELAKKLQDSISNHLSEQEKAFHFKMQKLLNNPENKVMLIELMDRSFRCLDNKARFEMIEHVLDKYKSREIFSSFEKWLLMGFLSFGKMLPDMSVPFFVNKIRSDTKAMVLDQEESQLRERILKRKNEKIILNVNFIGEEVLGEEEASARFEKYSQALKSNYIQYISIKITTIFSQINILDFEYSKKEIVKRLDALYALALEEEKKQGMPKFINLDMEEFRDLELTVESFMESIAKFDLNAGIVLQAYIPDSYEYLKKLHAFSKERVLKGLKPIKIRFVKGANMESEETIASMKDWALPTFSSKQDTDSNYNKMLDFVLEGDNYKYIHIGAASHNIFEIAYVYTRIHALNDPVVLEHFSFEMLEGMSLQASQELKEMHKLILYAPVCDEAHFNNAIAYLVRRLDENTSSDNFMKAFFNLKVGTSEWKDQEQRFLNSLKGIATLDNTTHRTQDRNAKQTGHTTYPNHSFKNESDTDFILKANREWAKKVRDKMHNAPILELYPEIDGRFEDPNLTPLEVFDRIHHKKIASVHLADKEAILKALEVAKSDKSRFSQKSFTEIHALLSQTAQLFRERRGDLIGISALEVGKTFAETDAEVSEAIDFLEFYPYSLRVLQEQNKKTKFTPKGVGVVIAPWNFPVGISVGTIAAPLAAGNRVIYKPSSLSSVTGYKLCECFWDAGVPRDALIYLPSKGSDISEHLLKDESIKFAILTGGEDTAYKMLKANPTLALSAETGGKNATIVSKMADRDQAIKNVIHSAFSNSGQKCSATSLLVLEKEVYEDENFKKTLIDATLSLSVGDPFDFKNKIGALADKPNEKVIKAIDELKSYENYEIPASFVDDNPYLMKPSIKYGTKKGDFTHQTELFTPILSVMKAKDLDEAIEIVNSTGYGLTSALESLDEREWEYYLERIEAGNIYINKPTTGAIVLRQPFGGVKKSAVGFGRKVGIFNYITQFVNIHQEEEDENALKNPLSEALEGLTQKGYDEHTHELKRAIFMAKSYAYHYKHEFSQAKDYVKIRGEDNLFSYTKVTSVGYRITEKDTLSDMLGVALACLISQIPLTISIENERANKDLTFFLECLKALQANAPIVYESLQKFSEKLNAFNRVRYLKSDLDLLHEQASRLGMVLATAKPCLNGRFELLYYHLERSVSISYHRYGNLGSRVLRQPTCHKSCCAEK

SEQ ID NO: 12474 - DNA, 1632 bp, Mycobacterium tuberculosis
  CDS (1)..(1632)
atggacgcgatcacccaggtgccggttccggccaacgagccggtgcacgactatgcgccgaaatccccggaacggacccggctgcgcaccgaactggcctccctggccgatcaccccatcgacctgccgcacgtcatcggcggccgacaccggatgggcgacggcgagcgaatcgacgtcgtgcagccgcaccggcacgccgccaggctgggcaccctgaccaacgccacccacgccgacgccgcggccgccgtcgaagccgccatgtctgccaaaagtgactgggcggcactgccgttcgatgaacgtgccgcggtgttcctgcgcgccgccgatctgttggccgggccgtggcgggaaaagatcgccgccgcaaccatgctcggccaatccaagtcggtgtaccaggccgagatcgacgcggtctgcgagctgatcgacttctggcggttcaacgtcgctttcgcccgacagattttggagcagcagccgatcagtggcccgggggaatggaaccggatcgactaccgcccgctggacggtttcgtctacgcgatcacgccgttcaacttcacctcgatcgccggcaatctgccgaccgccccggctctgatgggcaacaccgtgatctggaagccgtcgatcacccagacgctggcggcctatctgaccatgcaactgctcgaggccgccgggttgccgcccggggtgatcaacctggtcactggcgacggattcgcggtttccgatgtggcactggccgatccacggctggccggcatccacttcaccgggtcgacggctaccttcggccacctatggcagtgggtgggtaccaatatcggccgctaccatagctatccgcgactggtcggcgagaccgggggcaaggacttcgtggtggcgcacgcctcggcccgcccggatgtgctgcgcacggccctgattcgcggagcattcgattaccagggccagaagtgctcggcggtgtcgcgagcgtttatcgcgcattcggtgtggcagcggatgggcgatgagttgctggccaaagccgccgagctgcgctacggtgacatcaccgacctgtccaactacggtggtgcgctgatcgaccagcgcgccttcgtcaagaacgtcgacgccatcgaacgggccaaaggcgcggccgcggtcaccgtcgccgtcggcggcgaatacgacgacagcgaaggctatttcgtgcgccccacggtgttgctctccgacgacccgaccgacgagtcgtttgtcatcgagtacttcggtccgctgctgtcggtgcatgtctaccccgacgagcgctacgagcagatcctcgacgtcatcgacaccggatcccgctacgcgctgaccggcgcggtcatcgccgacgaccggcaggccgtgctgaccgcgctggatcggctgcggttcgcggcggggaacttctatgtcaacgacaagccgacgggggcggtggtggggcgtcagccgttcggcggtgcacgcggatcgggcaccaacgacaaggccggttcgccgttgaacctgctgcggtggacgtcggcgcgcagcatcaaggagacgttcgtcgcggccaccgaccacatctacccgcacatggcggtcgactga

SEQ ID NO: 12475 - protein, 543 aa, Mycobacterium tuberculosis
MDAITQVPVPANEPVHDYAPKSPERTRLRTELASLADHPIDLPHVIGGRHRMGDGERIDVVQPHRHAARLGTLTNATHADAAAAVEAAMSAKSDWAALPFDERAAVFLRAADLLAGPWREKIAAATMLGQSKSVYQAEIDAVCELIDFWRFNVAFARQILEQQPISGPGEWNRIDYRPLDGFVYAITPFNFTSIAGNLPTAPALMGNTVIWKPSITQTLAAYLTMQLLEAAGLPPGVINLVTGDGFAVSDVALADPRLAGIHFTGSTATFGHLWQWVGTNIGRYHSYPRLVGETGGKDFVVAHASARPDVLRTALIRGAFDYQGQKCSAVSRAFIAHSVWQRMGDELLAKAAELRYGDITDLSNYGGALIDQRAFVKNVDAIERAKGAAAVTVAVGGEYDDSEGYFVRPTVLLSDDPTDESFVIEYFGPLLSVHVYPDERYEQILDVIDTGSRYALTGAVIADDRQAVLTALDRLRFAAGNFYVNDKPTGAVVGRQPFGGARGSGTNDKAGSPLNLLRWTSARSIKETFVAATDHIYPHMAVD

SEQ ID NO: 12476 - DNA, 1572 bp, Deinococcus radiodurans
  CDS (1)..(1572)
atgattaaagttcaggactaccgcccccagcctttcaccgacttcaccaaagaagaaaacgtccaggcgtaccaggccgccctcgccaaagttcggaaagaactccttggcaagcactacccgctgattatcgacgggcaggaagtggacaccgaagggaaaattcagagcatcaacccctgcgacacctccgaagtggtgggcaccaccgccaaagcgaccataggtgacgccgaaaacgctctacaaggcgcctggaaagctttcgagagctggaagaagtgggacatggacgcccgcgcccgcattctgctgaaggccgccgccatcctcaagcgccgccgcctggaagcctgcgccctgatgagcatcgaagtgggcaagaactacgctgaggccgacgtggaagtggccgaagcgattgactttctggagtactacgcccgcagcgccatgaagtacgcgggctttggcagcagcgaaacgacgtggtttgaaggcgaggaaaacggcctgatgagcattccgctgggcgtgggcgtcagcatcagcccctggaacttcccctgcgccattttcgtgggcatggcggcggcgcccatcgtggcgggcaactgcgtcgtggtgaaacccgccgaggatgcgggcctgatcgccgggttcatggtggacatcctgcgcgaggccgggctgccggccggcgtgctgcaattcctgcccggcgtgggcaaggaagtgggcgaatacctgaccacgcacgccaaaacccgcttcatcaccttcaccggcagccgtgcggtgggcctgcacatcaacgaggtggcggccaaagtgcagccgggccagaagtggatcaagcgcgtgatcatggaactcggcggcaaagacggcctgatcgtggacgaaaccgccgacatcgaaaacgccattaccgccgccacgcagggcgcgttcggcttcaacggccagaagtgcagcgccatgagccgcctgatcgtggtggacagcgtgtacgacgaagtggtcaacggcttcgtggaacgggctaaagccctcaagatggggacgggcgaggaaaacgccaacgtgaccgccgtcgtgaaccagatgagcttcaacaagatcaagggctatctggaactggcccccagcgaaggcaaagtgctgctgggcggcgaggccacgggcgaagcgaacggcaagcagggctactacattcagccgaccatcgtgggcgacgtagaccggaactcccgtctggcgcaggaagaaatcttcgggccagtggtcgccgtgctgcgggccaaagactggcaagacgcgctcgacatcgccaactccaccgagtacgggctgacggggggcgtgtgcagcaactcccgcgagcggctggagcaggcccgcgccgagtttgaagtgggcaacctgtacttcaaccgcaagatcaccggcgccatcgtgggcgtgcagcccttcggcggctacaacatgagcggcacggacagtaaggcgggcggcccggattacctgagcaacttcatgcagctcaagacggtgacggaacgctggtga

SEQ ID NO: 12477 - protein, 523 aa, Deinococcus radiodurans
MIKVQDYRPQPFTDFTKEENVQAYQAALAKVRKELLGKHYPLIIDGQEVDTEGKIQSINPCDTSEVVGTTAKATIGDAENALQGAWKAFESWKKWDMDARARILLKAAAILKRRRLEACALMSIEVGKNYAEADVEVAEAIDFLEYYARSAMKYAGFGSSETTWFEGEENGLMSIPLGVGVSISPWNFPCAIFVGMAAAPIVAGNCVVVKPAEDAGLIAGFMVDILREAGLPAGVLQFLPGVGKEVGEYLTTHAKTRFITFTGSRAVGLHINEVAAKVQPGQKWIKRVIMELGGKDGLIVDETADIENAITAATQGAFGFNGQKCSAMSRLIVVDSVYDEVVNGFVERAKALKMGTGEENANVTAVVNQMSFNKIKGYLELAPSEGKVLLGGEATGEANGKQGYYIQPTIVGDVDRNSRLAQEEIFGPVVAVLRAKDWQDALDIANSTEYGLTGGVCSNSRERLEQARAEFEVGNLYFNRKITGAIVGVQPFGGYNMSGTDSKAGGPDYLSNFMQLKTVTERW

SEQ ID NO: 12478 - DNA, 3489 bp, Campylobacter jejuni
  CDS (1)..(3489)
atgatacaaaaagctttagccttagctgaagaattacaaggacaaatagaagccaatatttcaaattctgaaaaagaatttcatgctaaaatgcaaaaacttcttaataatcccaaaaataaagttatgcttatagagcttttagatcgttcttttagatgtaaagataaaaatgcaagttttgagcttatagaatatactttgagtaaatatggcatagcggatttttttagcacttttgaaaaattcctactttttagctttttaaattttggcaaatttgctcctaatttaagtgtacctttttttgtcaaacatttaagagaagatactaaagctatggttctagatgcaaatcctagtgttttagaaccacatattaagaaaagaaaagagcaagataaaattaccttaaatgtgaatttaatcggcgaagaggttttaggtgaagctgagagtaaatatcgtatgcaaaaatacgaagaagccttaaaatcaagctatatcacttatatttccataaaaattactactattttttcacaaattaatattatagattttaattattctaaagaagaggtcgtaaaaagactagattatctttatgctttagccttagaagaagagaaaaaacaaggtgtatctaaatttatcaatcttgatatggaagaatttagggatttagagctcaccgttgcagcttttatggaaagtgtggctaaatttgatattaaagcagggattgttttgcaagcttatattcctgattcttataagtatcttaaaaaactttttgctttttcaaaagagagggttttaaaaggtatgaagtctattaagatccgttttgttaagggtgctaatatggaaagtgaagaaaccattgcgtctcaaaggggttgggagcttcctactttttacaaaaaaatagatactgatagtaattataataaaatgcttgattttattcttgaaggagataattataaatacatcaacataggaattgcaagtcataatatctttgagattgcttatgcttatacacgcataagtgaagtgggtgctttggattcttttacttttgaaatgcttgaaggtatgagtttgcaatgttcttatgaattatctaaaatgcatgatctaatcctttataccccagtttgcgatgaagcacattttaacaatgccattgcttatcttgtaagacgccttgatgaaaatacaagtgaagataattttatgcgttattttttcaatcttaaagtaggagataagaactggaatatccaaaaagaactttttttaaaatctttagaaggcataaaaactcttgataatactacacatcgtaagcaagatagaaataaagaatcaaatatcataagttcttatgaaggtaaaaaatttagcaatgaaagcgatacggattttattttagcacaaaatagagtgtgggctaaagaaattaaaactaaatatgaaaatttaaaagattatgatgtttatcctgttataggcgaacttgattttaaagcagaaaatttaaatgttttagaagttaaagataagatcgaagatagagttataggaaaggcttatttagcaggagaaaaagaaatcaaacaagctttagaagtagctaaaaattccaaatttacacaaaaaagtcatgatgaaatttatcaaattttagccaaaagtgcaaaactgatgagagaaagaagaggggatttgataggtttggcagctttagaagtgggcaaaacctttttagagatcgatcctgaagtaagcgaggctattgattttatagagttttatccgcactctttagaagagcttaaaaaacaaaatccaaaagttacattcacacctaaaggtataggggttaccatagctccttggaattttcctataggaatttcagtaggtactatagctgcaccactagccgcaggtaatgtggtgatttacaaaccttcttcactttcaactctaacaggttatatgctttgtaagtgtttttgggattcgggtattccaaaagatgctttgattttcttaccttcaaaaggaagtgatatttctaaatatttacttattgatgaagcgattaaattttcaattcttacaggaggagaggatactgcttatgccatgttaaaagctaatccaaccttgcttttaagtgctgaaactggcggaaagaatgcgactatagtttctaaatttgctgatcgtgatagtgcgattaaaaatatcattcattctgcttttagcaatagcggtcaaaaatgttcagctacttctttgctagtcttagaagaagaggtttatcatgatgaagaatttaaaaagactttagtggatgctgcgagttctatggcagtgggcaatccttttgaatttaaaaataaattaggtactttagctgataagccaagttctaaagttcaaaaggccttagatgaattacaaccttatgaagaatgggcattaaaacctaagtttttagaggataatccttatttgatgactccaggcataaaatatggcactaaaaagggtgattttactcatatgaatgaactttttgtaccgattttaagtgtgatgaaggctaaagacttaaaagaagctattgatatagtaaattccacaggttatggtttaactgcaggttttgaaagcttagatgaaagagaatgggagtattttcacactcacatagaagcaggaaatatttatatcaataaaccaaccacaggggctatagtgctgcgtcaaccttttggtgggattaaaaaatcagctataggtttgggtagaaaagtgggaatttataattatatcactcaatttttagagattaagcaagaagattttgatgatcatttaattgaagataaattttcaaaaaaattagcacaaatagatttaaaagaagcacaagattttataaacaatttaattaaaatgtctcaatcttatgcttatcattataaaaacgagtttagtgtttcaaaagattatgtcaatattcgtggagaagataatcttttttcttatactaaaataaagaatatggttttaagactttgtggaaatgaaagcttaaaagatgttttaggtgtggttttaggtgcaaatattgcaaatattgatctaagtatcagttatgatgaacaagatgttagtatgatagaacgaattgttcaaagcataggagcaaaagtattgtttttaaaagaaaataaagaaaattttatcaagagtattaaagaatatgaaagagtgcgttatttagcaaagccagatgtaaatgatgagatttataaagaggctgcaaagcttgctaaaatcattataagagaaaagccattattaaatggtcgttttgaacttttaaattattttaatgaaaaagctttaagtatatcttttcatcgttatggaaatttaggcattagagcaatatcttaa

SEQ ID NO: 12479 - protein, 1162 aa, Campylobacter jejuni
MIQKALALAEELQGQIEANISNSEKEFHAKMQKLLNNPKNKVMLIELLDRSFRCKDKNASFELIEYTLSKYGIADFFSTFEKFLLFSFLNFGKFAPNLSVPFFVKHLREDTKAMVLDANPSVLEPHIKKRKEQDKITLNVNLIGEEVLGEAESKYRMQKYEEALKSSYITYISIKITTIFSQINIIDFNYSKEEVVKRLDYLYALALEEEKKQGVSKFINLDMEEFRDLELTVAAFMESVAKFDIKAGIVLQAYIPDSYKYLKKLFAFSKERVLKGMKSIKIRFVKGANMESEETIASQRGWELPTFYKKIDTDSNYNKMLDFILEGDNYKYINIGIASHNIFEIAYAYTRISEVGALDSFTFEMLEGMSLQCSYELSKMHDLILYTPVCDEAHFNNAIAYLVRRLDENTSEDNFMRYFFNLKVGDKNWNIQKELFLKSLEGIKTLDNTTHRKQDRNKESNIISSYEGKKFSNESDTDFILAQNRVWAKEIKTKYENLKDYDVYPVIGELDFKAENLNVLEVKDKIEDRVIGKAYLAGEKEIKQALEVAKNSKFTQKSHDEIYQILAKSAKLMRERRGDLIGLAALEVGKTFLEIDPEVSEAIDFIEFYPHSLEELKKQNPKVTFTPKGIGVTIAPWNFPIGISVGTIAAPLAAGNVVIYKPSSLSTLTGYMLCKCFWDSGIPKDALIFLPSKGSDISKYLLIDEAIKFSILTGGEDTAYAMLKANPTLLLSAETGGKNATIVSKFADRDSAIKNIIHSAFSNSGQKCSATSLLVLEEEVYHDEEFKKTLVDAASSMAVGNPFEFKNKLGTLADKPSSKVQKALDELQPYEEWALKPKFLEDNPYLMTPGIKYGTKKGDFTHMNELFVPILSVMKAKDLKEAIDIVNSTGYGLTAGFESLDEREWEYFHTHIEAGNIYINKPTTGAIVLRQPFGGIKKSAIGLGRKVGIYNYITQFLEIKQEDFDDHLIEDKFSKKLAQIDLKEAQDFINNLIKMSQSYAYHYKNEFSVSKDYVNIRGEDNLFSYTKIKNMVLRLCGNESLKDVLGVVLGANIANIDLSISYDEQDVSMIERIVQSIGAKVLFLKENKENFIKSIKEYERVRYLAKPDVNDEIYKEAAKLAKIIIREKPLLNGRFELLNYFNEKALSISFHRYGNLGIRAIS

SEQ ID NO: 12480 - DNA, 1497 bp, Bacillus halodurans
  CDS (1)..(1497)
atgcaaaaaatctcaacaaacgatagcaaattaaatccaaggttagtggcgtttttaaacggtggaccaaagaagctatttattaatggggaatgggttgattcattctctggacaatcttttgaaacgatgaatccagcaaccggagaaacattagctctcgtagcagaagctgggtcagaggacatcgattttgcagtgaaagcggcaaggaaagcgttcgatgaagggccttggtctaaaatgagcgcagcggaaagaagtcgactcatatacaagctggctgatttgattgaggatcataaagaagcgttagctcagcttgagacgttagataatggtaagccaattcgtgagacggccaatgctgatattccattagtaattgaacactttcgttactttgcagggtgggcgacaaaaattgtgggccaaaccatccctgtacaaggccattattttaactacacgcgccatgaagccattggcgttgtgggccaaatcattccttggaatttcccgttattgatggctgcttggaaacttggtgccgctctagctacaggttgtacggttgtgttaaaaccggcagagcagactccactttccgccttatatttaggagaattgatcaatgaagcaggttttccaaaaggggttgtgaacattgtccctggatttgggcattcggctggaactccccttgtgaatcacccagctgtagataaagtggcttttacagggtcgactgatgtcggaaagttaattatgaaacaagcgagtgaatcattaaaaagagtaacgcttgaacttgggggcaagtcaccaaatatcattttacctgatgctgatttgtcaaaggccgttcctggctcacttatgggcattatgttcaatcaaggccaagtgtgttgcgcaggaagtcgtttatatgtacaaaagaaacagtatgatcatgtcgttgctgacctggtgtcgttaacgaacgagattcagcaaggggatggattattagaacaaacgaccatgggacctctgatttcaaatcaacaacaaagtcgagtgaaaaattacatcgatcgtggggttgaggaaggggcagaactactaacaggtgggaacattccgtatgatcaagggtattttgtcgccccaaccatttttgctgacgtggatcattccatgacgatcgccaaggaggaaatttttggtccagttgtagccgcaatgccgtttgatagcatagacgacctaattgataaagccaacgattctgattatggactagctgccggtgtttggacacaggatattaaaaaagcacactacattgcccaccgaatcaaggcagggaccatttgggtgaattgctacaatgtattcgatgccgcgagcccgtttggtggttacaaacaatcggggattggccgggaaatggggagctatgcattagaaaattatactgaagtgaaaagtgtttgggtgaatatggattaa

SEQ ID NO: 12481 - protein, 498 aa, Bacillus halodurans
MQKISTNDSKLNPRLVAFLNGGPKKLFINGEWVDSFSGQSFETMNPATGETLALVAEAGSEDIDFAVKAARKAFDEGPWSKMSAAERSRLIYKLADLIEDHKEALAQLETLDNGKPIRETANADIPLVIEHFRYFAGWATKIVGQTIPVQGHYFNYTRHEAIGVVGQIIPWNFPLLMAAWKLGAALATGCTVVLKPAEQTPLSALYLGELINEAGFPKGVVNIVPGFGHSAGTPLVNHPAVDKVAFTGSTDVGKLIMKQASESLKRVTLELGGKSPNIILPDADLSKAVPGSLMGIMFNQGQVCCAGSRLYVQKKQYDHVVADLVSLTNEIQQGDGLLEQTTMGPLISNQQQSRVKNYIDRGVEEGAELLTGGNIPYDQGYFVAPTIFADVDHSMTIAKEEIFGPVVAAMPFDSIDDLIDKANDSDYGLAAGVWTQDIKKAHYIAHRIKAGTIWVNCYNVFDAASPFGGYKQSGIGREMGSYALENYTEVKSVWVNMD

SEQ ID NO: 12482 - DNA, 3687 bp, Agrobacterium tumefaciens
  CDS (1)..(3687)
atggccgatggtgcaagcaatgccggtgtaactatccagcaggtgggaaacagtatcttccagaattttgcgccgccggtgcgcgaacagagcctgctgcgcaaggcggtcactgccgcctaccgccgggcagaagaagaatgcatggcgcctttgatcgaagcggcgacggtgacggctgaccaggcgaaagccattcgcgacaccgcccgcaagctgatcgaggcgctgcgtgccaaaaccaagggcacaggcgtcgaagggctggtgcaggaatattcgctttccagccatgagggcgtggcgctgatgtgccttgccgaagcgctgctgcgcattcctgacaccgccacccgcgacgcgctgatccgcgacaagatcgcgcgtggcgactggaagtcccatattggcggcgggcgttcgcttttcgtcaatgccgccacctggggtctcgtcatcacaggcaagctcacttcgaccgtcaatgacagcggcctttcagcggcgctgacgaagctgatcgcccgcgccggcgaacccgtcatccgccgtggcgtcgacatggcgatgcgtatgatgggcgagcagttcgtgaccggcgaaaccatcggtgaggcgatcaagcggtcgaagccgcttgaggagcagggcttccaatattcctacgacatgctgggcgaagccgcgaccaccgcaaaggatgccgagcgttattacaaggattatgaaaacgccatccacgccattggcaaggcctccgccggccgcggcatctatggcgggccgggcatttccatcaagctttcggcgctgcatccacgctacgcccgcgcgcaggccgagcgggtgatggcggagcttctgccgcgcgtgaaatcgctgatgctgctcagcaagacatacgatatcggcctcaatatcgatgcggaagaagccgaccggctggaactgtcactcgatcttctcgaagaactggcgctggacaaggaccttgctggctggaacggcctcggtttcgtggtgcaggcctatggccgccgctgccccttcgttctcgactacatcatcgacctcgcccgccgttcgggccgccgcatcatggtgcgcctcgtcaagggcgcttattgggatgcggaaatcaagcgcgcgcaggtggaggggctggaagacttcccggtctttacccggaaagtgcataccgatgtctcctacatcgcctgcgcccgcaagctgctcgacgcgcgcgatctggtcttcccgcaatttgcgacccacaatgcgcagtccatggcgaccatctatcacctcgccggtcccgatttcaaactcggcgactacgagttccagtgcctgcacggcatgggcgaaccgctttacagcgaagtcgtcggcaaaaagaaactcgaccgcccctgccgtttctatgcccctgtcggcacgcatgagacgctgctggcctatctcgtgcgccgccttctggagaacggcgcgaactcctccttcgtcaatcgcattgccgatccggccgtgccggtggattccctgctggaagacccggtcgcggtggtgaaggcctatgccgttcccggtgcgcagcacgaccgtatcgccgcccccgccgatctcttcggcccggaacggaaaaactccgccggcgtcgacctctccaatgaaacaacgctctctgccctcgacaaaacactgaaggcgggtgcagcaacggaatggaaggctgcggcgccacaggctggcggccagacgcgcccggtcctcaaccccggcgaccacagcgatatcgtcggccatgtgacggaacccaccgaggccgatgtcgaagcggccatgcagcgggcggcggcttcaagctggccctctatgccagtggaagaccgtgccgcctgcctggagcgcgcggccgacgccatgcaggccgaaatgcccacactgctcggcctcatcatgcgcgaggcgggaaaatccatgcccaacgccattgccgaggtgcgcgaagccatcgatttcctgcgttactacgcggcagaagcccgcaggaatttcaaatcggatgaaaaatcgctcggtcccgtcgtctgcattagcccgtggaacttcccgctcgccatcttcatcggtcaggtggccgcagcgctggtcgccggcaacccggttctggcaaaacccgctgaggagactccgctgatcgccgcgcagggtgtgcgcctgctccatgaggcgggcgttccgcaagacgccgtgcagcttctgccgggcgatggcaagacgggtgcggcgctggtcggctcaccactgacggcgggcgtgatgttcaccggctccactgaggtggcgcggctcattcaggggcagcttgccggccgggttctggccaatggccagccggtgccgctgattgccgagaccggtggtcagaacgccatgatcgtcgattcctccgcgcttgccgaacaggttgtcgccgatgtcatcgcgtctgccttcgacagtgccggacagcgctgctcggcactgcgcatcctctgcctgcaggaagatgtggcggaccgcacgctgaccatgctgaaaggcgcgctgcacgaattgcgcatcggccgcacggatcagctctccgtcgatgtcggccccgtcatcaccgccgaggccaagggcatcatcgaaaagcatattgacggcatgcggtcgctcggtcaccgcatcgagcagattgcgcttgcgggggaaaccggcaagggcaccttcgtaccgccaaccatcatcgagatgaaatcgctcgccgatctgaagcgcgaggtcttcgggccggtgctgcacgtcatccgcttcaagcgcgatcatctcgaccggctgatcgatgagatcaacgccaccggctacggcctgaccttcggcctgcatacgcgtctcgacgatacgatccagcatgtgctctcccgcgttgcggccggcaatctttatgtgaaccgcaacatcatcggcgcggtggtcggtgtgcagccctttggcggacgcggcctttccggcaccggccccaaggccggcggtccgctttatctcggccgcatgacggagaaagcgccaaagatagaccgcatcgccagccagcaggatcaggctgcggtcgatctcgcccgctggctggatgaaaatggtcagactgttgcggcagaagccgcacgccaggcggctgcgctttcaggccttggctttgagaccgagctggccggccccgtcggcgagcgcaatgtctatgcgctgcatccgcgcggcaagatcctgctggtgccggcaaccgaacaggggctttaccgtcagcttgcggcagcgctatctaccggcaactctgttgtcatcgacaatgcttcgggactggaaaaggcgatctacggcctgccggcaagcgtgacctcgcgcatcgtctgggcggatgactgggaaaaatcggcacccttcgccggtgcgctggtcgagggcgatgcggaacgcgtggttgcgatcaacaggaagatcgccgccctgcccggcccgctggttctctttcaggcagcgacgacggacgcactttccggcgaaagccagccctatactctcgactggctggtggaagaggtttcagtcagcgtcaacaccacggccgccggcggcaatgccagcctgatgagcattggctaa

SEQ ID NO: 12483 - protein, 1228 aa, Agrobacterium tumefaciens
MADGASNAGVTIQQVGNSIFQNFAPPVREQSLLRKAVTAAYRRAEEECMAPLIEAATVTADQAKAIRDTARKLIEALRAKTKGTGVEGLVQEYSLSSHEGVALMCLAEALLRIPDTATRDALIRDKIARGDWKSHIGGGRSLFVNAATWGLVITGKLTSTVNDSGLSAALTKLIARAGEPVIRRGVDMAMRMMGEQFVTGETIGEAIKRSKPLEEQGFQYSYDMLGEAATTAKDAERYYKDYENAIHAIGKASAGRGIYGGPGISIKLSALHPRYARAQAERVMAELLPRVKSLMLLSKTYDIGLNIDAEEADRLELSLDLLEELALDKDLAGWNGLGFVVQAYGRRCPFVLDYIIDLARRSGRRIMVRLVKGAYWDAEIKRAQVEGLEDFPVFTRKVHTDVSYIACARKLLDARDLVFPQFATHNAQSMATIYHLAGPDFKLGDYEFQCLHGMGEPLYSEVVGKKKLDRPCRFYAPVGTHETLLAYLVRRLLENGANSSFVNRIADPAVPVDSLLEDPVAVVKAYAVPGAQHDRIAAPADLFGPERKNSAGVDLSNETTLSALDKTLKAGAATEWKAAAPQAGGQTRPVLNPGDHSDIVGHVTEPTEADVEAAMQRAAASSWPSMPVEDRAACLERAADAMQAEMPTLLGLIMREAGKSMPNAIAEVREAIDFLRYYAAEARRNFKSDEKSLGPVVCISPWNFPLAIFIGQVAAALVAGNPVLAKPAEETPLIAAQGVRLLHEAGVPQDAVQLLPGDGKTGAALVGSPLTAGVMFTGSTEVARLIQGQLAGRVLANGQPVPLIAETGGQNAMIVDSSALAEQVVADVIASAFDSAGQRCSALRILCLQEDVADRTLTMLKGALHELRIGRTDQLSVDVGPVITAEAKGIIEKHIDGMRSLGHRIEQIALAGETGKGTFVPPTIIEMKSLADLKREVFGPVLHVIRFKRDHLDRLIDEINATGYGLTFGLHTRLDDTIQHVLSRVAAGNLYVNRNIIGAVVGVQPFGGRGLSGTGPKAGGPLYLGRMTEKAPKIDRIASQQDQAAVDLARWLDENGQTVAAEAARQAAALSGLGFETELAGPVGERNVYALHPRGKILLVPATEQGLYRQLAAALSTGNSVVIDNASGLEKAIYGLPASVTSRIVWADDWEKSAPFAGALVEGDAERVVAINRKIAALPGPLVLFQAATTDALSGESQPYTLDWLVEEVSVSVNTTAAGGNASLMSIG

SEQ ID NO: 12484 - DNA, 1548 bp, Bacillus halodurans
  CDS (1)..(1548)
atgttaacaccttataagcatgaaccgtttacagattttagtgtagaagaaaaccgcagcgcgtttgaggctgccttaaagaacgttgaaggggaattagggaaagactacccgttagtgatcaatggggaacgtgtgacgaccgatgataaaatcgtttccgtgaatcctgccatgaaagagcaagtgatcggcgtcgtctcaaaagcaagtcgcgagatagtagatgatgcatttaaatcggcagagacggcatttcatacgtggaaaaacgtcaatcctgaagagcgagcgaacatcttaatcagagcggccgcgatcattcgccggagaaagcatgagttttcggcatggctcgtgaaagaagcgggtaagccttggaaagaagccgatgcagacacagcggaagcgatcgactttttagagtactacgcccggcaaatgattacgctaaaggatggaaagccagtcaatagtcgcgagggtgagcataatcgctacttctatacaccgatcggggtatgtgtcacaatctcgccttggaatttcgccttggcgattatggctggaacgacggtagcgccaattgtaacagggaacaccgtcttactgaaaccagctagcacgacccctgttgtcgccgcaaagttcgtcgaagttcttgaagaagcaggtttgccaaagggtgtggtcaacttcgtcccaggaagtggaacagacatcggtgactacttgatcgatcatccaaaaacaagcttgatcacatttaccggttcgcgtgacgtgggagtccggctttatgaaagggcagcggttgttcatccaggtcaacagcatttgaagcgcgtcattgtagagatgggaggaaaagataccgttgttgtcgataaggatgccgatctcgatttagctgctcaatcgatcgtgacctcggccttcggcttttctggacaaaaatgttctgcaggttcgagagctgtcatccatcaagacgtctatgatgttgtgttagagaaggccgtggccctcacgaaacaactctcagtaggcgaaccgacggcacctgacgtctatatgggacctgtcgtcgatcaaggagctttttcgaaaattatgagctatatcgaagtggggaaagaggaaggccgattgatggtcggaggtgaaggagatgattcaaaaggcttcttcattcaaccgacgatctttgctgacgtagatccccatgcgcgaatcatgcaggaagagattttcggtccagtcgttgccttcagtaaggcaagggattttgatcatgcgctagaaatcgccaataataccgagtacggtctgacaggagctgtcattacaacgaaccgtcaccatatcgaaaaagcgaagcgagacttccatgtaggaaatctatactttaaccggaattgcacaggcgcgattgtcggctaccacccattcggcggctttaaaatgtcaggcaccgattcaaaagctggaggacctgattatttggcccttcatatgcaagcaaaaaccgtctccgaaatgtattaa

SEQ ID NO: 12485 - protein, 515 aa, Bacillus halodurans
MLTPYKHEPFTDFSVEENRSAFEAALKNVEGELGKDYPLVINGERVTTDDKIVSVNPAMKEQVIGVVSKASREIVDDAFKSAETAFHTWKNVNPEERANILIRAAAIIRRRKHEFSAWLVKEAGKPWKEADADTAEAIDFLEYYARQMITLKDGKPVNSREGEHNRYFYTPIGVCVTISPWNFALAIMAGTTVAPIVTGNTVLLKPASTTPVVAAKFVEVLEEAGLPKGVVNFVPGSGTDIGDYLIDHPKTSLITFTGSRDVGVRLYERAAVVHPGQQHLKRVIVEMGGKDTVVVDKDADLDLAAQSIVTSAFGFSGQKCSAGSRAVIHQDVYDVVLEKAVALTKQLSVGEPTAPDVYMGPVVDQGAFSKIMSYIEVGKEEGRLMVGGEGDDSKGFFIQPTIFADVDPHARIMQEEIFGPVVAFSKARDFDHALEIANNTEYGLTGAVITTNRHHIEKAKRDFHVGNLYFNRNCTGAIVGYHPFGGFKMSGTDSKAGGPDYLALHMQAKTVSEMY

SEQ ID NO: 12486 - DNA, 3183 bp, Pseudomonas aeruginosa
  CDS (1)..(3183)
atgttcaaagccagtcacgtcttgcagggcgaggaccagacccggtccgcagccgaattcttccctgtcatcagcgccaactacgcggtcgacgaggaagcctacctgggcgaactgctgcagctcgccgaccccggtcccgacggcatcgaggctatccgccgcaacgcccgcgcactgatcgaaaccgtgcgcagccgggacaacgccgtcgataccctcgacgcactcctgcgccaatacagcctggacacccaggaaggcctgatgctgatgtgtctggccgaggcgctgttgcgtgtgcctgacgcggcgaccgccgacgcgctgatccgcgacaagctgtccgccgccgactggcagcgccatctcggccagagcgacaacgttctggtcaatttcgccgcctggggcctggtgatgaccggcaaggtggtgaacatcgacgaacgcaccgacggccgcgccccgagcgtcatcagccggctggtgcagcgctctggcgaaccggtgatccgcgccgcgatgaaccaggcgatgaagctgatgggcaagcagttcgtgcttggccggaccatctccgaagcgctgaagaacggtcgtccatgccgcgagcagggctacacctattccttcgacatgctcggcgaggccgcgctgaccgccgccgacgccgagaaatacatggccgactaccgccaggccatcgacaccgtcggcgccgagccgcaggtcggtccggggccgcggccgtcgatctcgatcaagctctcggcgctgcatccgcgctacgaagtggcgcaacgcgagcgggtgctcagcgagctgttcgccaatgtcctggaactggcggtgcgcgcgcgcaagctgaacgtcggcatcaccatcgacgccgaggaagccgatcgcctggagctgtccctcgaactctacgagaagctgatgcgcgacccggccatcgccggctggggcgagttcggcctggtcatccaggcctactccaagcgctgcctgccggtgctggtatggctgaccctgctcggccgcgagcttggcgcacgcatcccgctgcgcctggtgaagggtgcctactgggacagcgagatcaagcagtgccaggtgcagggcgccgatggctaccccgtctacacccgcaaggaaggcaccgacacttcctacctggcctgcgcccgctacctgctcagcgagcacacccgcggggtgatctacccgcagttcgccagccacaacgcccacaccgtgaccgccatcctcgccctggccgacgaagccagggccgccggcggcgaggagcgcgacttcgagttccagcgcctgcacggcatgggcgacgcgctgtacgacacggtgatcgaaaagtaccgccgcaacgtgcgcatctacgccccggtcggcgcgcacaaggacctgctgccgtacctggtccgccgcctgctggagaacggcgccaactcttccttcgtgcacaagctggtggacccgcgcgtgccggtggagacgctgatccagcacccggttacccaactgcgccagttcaagacgctggccaacgaccgtatccctctgccccaggcgatcttcggcgccgggcggaaaaactcccagggcatcaacatgaacatccagaaccagtggaacgagctggagctcgcctacaagccgcacctgacccgccagtggcaagccgcgccgatcgtcaacggcgagaagctctccggcccggcccacgaagtgcgttgcccgtacgacctggagaggctggtcggcagcgtccagtacgcgtccgccgagcaggccggcaaggccctcgacgtgttgcaggcggcctggccgcgctggagcgccaccccggtggacgagcgtgccggcatcctcgagcgtctcgccgacctgctggaagcccagcgcggcgagctgatggcgctgtgcaccctggaagccggcaagtcgttgcaggatggtatcgacgagatccgcgaggcggtcgacttctgccgctactacgcccagcaggcccgccagcgcctggtccgcgaggaactgcgcggcccgaccggcgagcgcaacgagctgttctacgaaggccgcggcatcttcgcctgcgtcagcccgtggaacttcccgctggcgatcttcctcggccagatcagcgccgcgctggtggccggcaacaccgtgctggccaagccggccgagcagaccagcctgatcgccgcgcgcaccgtcgaactgatgttcgaagccggcctgccgaaggacgttatcgccctgctgccgggcgacggcgccaccctcggcggcgtgttctgccgtgacgcgcgggtcgccggggtggccttcaccggctccaccgacaccgcccgcatcatcaaccgccaactggccgagaagcccggcgccatcgccaccctgatcgccgagaccggcgggcagaacgcgatgatcgtcgattccaccgctttgccggaacaggtgatcaaggatgcggtacaatccgcgttcaccagcgccggccagcgctgctccgcgctgcgcgtgatgtacgtgcagcaggacatcgccgagcgggtgatcgagttgctgaagggcgccatggccgagctgaaggtcggcccgaccgaggtgcgcgtcagcgacgtcggcccggtgatcgacgccgaggccaaggccggcctggagcagcacatcgccgcgctgaaggccgccggcaagctgatcgccgagaccaaggtgccgggcaacctgaacggtcacttcgtcgctcccgtcgcgttcgagatcagcggcatcgacgagctgaagaaagagaacttcggcccggtgctgcacgtggtgcgttatgccgcgcaggacctggaaaaggtcgtgcaggcgatcaacgccaccggtttcggcctgaccatgggggtccatagccgcaacgaggaaaccgcccgtcgcatcgaagagctggcgcgggtcggcaacctctacatcaaccgcaaccagatcggcgcggtggtgggcgtgcaaccgttcggcggccacggcctgtccggcaccggtcccaaggccggcgggccgaactacctgctgcgtttcgtcagcgagcgcaccacgtcggtgaacaccaccgcggtgggcggcaacgcgtcgctgctgtcgctggccgacgccgagtga

SEQ ID NO: 12487 - protein, 1060 aa, Pseudomonas aeruginosa
MFKASHVLQGEDQTRSAAEFFPVISANYAVDEEAYLGELLQLADPGPDGIEAIRRNARALIETVRSRDNAVDTLDALLRQYSLDTQEGLMLMCLAEALLRVPDAATADALIRDKLSAADWQRHLGQSDNVLVNFAAWGLVMTGKVVNIDERTDGRAPSVISRLVQRSGEPVIRAAMNQAMKLMGKQFVLGRTISEALKNGRPCREQGYTYSFDMLGEAALTAADAEKYMADYRQAIDTVGAEPQVGPGPRPSISIKLSALHPRYEVAQRERVLSELFANVLELAVRARKLNVGITIDAEEADRLELSLELYEKLMRDPAIAGWGEFGLVIQAYSKRCLPVLVWLTLLGRELGARIPLRLVKGAYWDSEIKQCQVQGADGYPVYTRKEGTDTSYLACARYLLSEHTRGVIYPQFASHNAHTVTAILALADEARAAGGEERDFEFQRLHGMGDALYDTVIEKYRRNVRIYAPVGAHKDLLPYLVRRLLENGANSSFVHKLVDPRVPVETLIQHPVTQLRQFKTLANDRIPLPQAIFGAGRKNSQGINMNIQNQWNELELAYKPHLTRQWQAAPIVNGEKLSGPAHEVRCPYDLERLVGSVQYASAEQAGKALDVLQAAWPRWSATPVDERAGILERLADLLEAQRGELMALCTLEAGKSLQDGIDEIREAVDFCRYYAQQARQRLVREELRGPTGERNELFYEGRGIFACVSPWNFPLAIFLGQISAALVAGNTVLAKPAEQTSLIAARTVELMFEAGLPKDVIALLPGDGATLGGVFCRDARVAGVAFTGSTDTARIINRQLAEKPGAIATLIAETGGQNAMIVDSTALPEQVIKDAVQSAFTSAGQRCSALRVMYVQQDIAERVIELLKGAMAELKVGPTEVRVSDVGPVIDAEAKAGLEQHIAALKAAGKLIAETKVPGNLNGHFVAPVAFEISGIDELKKENFGPVLHVVRYAAQDLEKVVQAINATGFGLTMGVHSRNEETARRIEELARVGNLYINRNQIGAVVGVQPFGGHGLSGTGPKAGGPNYLLRFVSERTTSVNTTAVGGNASLLSLADAE

SEQ ID NO: 12488 - DNA, 1437 bp, Sulfolobus solfataricus
  CDS (1)..(1437)
atgaaatcgtatcagggattggctgacaagtggattaagggcagtggggaagaataccttgatattaatccggctgataaggatcacgtattagctaagataagattatatacaaaagatgacgttaaagaagctataaacaaggctgtagccaaattcgacgaatggtcaaggactccagcacctaaaagaggctcaatattacttaaggcaggggaattaatggaacaagaagcccaagagtttgcgctattgatgacattagaggagggtaagactctcaaggatagtatgtttgaagtgacaagaagttataatttactgaaattttatggagcattagcatttaagatatctgggaaaacgcttccttcagcagatcctaatactaggatatttacagtaaaggaacccttaggcgtagtagctttaattacgccgtggaatttcccattatcaataccagtatggaaattggctccagccttggctgcgggtaacactgcagtaataaaaccagcgacgaaaacaccgttaatggtagccaaattggtagaagtgttgtctaaagctggattgccagagggtgtcgtgaatttagtagttggtaagggaagtgaagtcggagataccatagtaagtgatgataatatagctgcagtatcatttactggatcaaccgaggtaggtaagagaatttacaaactcgtaggaaataaaaatagaatgacaagaattcaactagagctaggaggtaaaaacgcgttatatgtggataagagcgctgacttaacgttagctgctgaattagccgtaagaggaggatttggactaaccggtcaatcatgtactgcaactagtaggttaataattaacaaggatgtatatactcaatttaaacaaagactactagaaagagttaagaagtggagagtaggaccgggtactgaagatgttgatatgggtccagttgtagatgaaggtcaatttaagaaagacttagaatatatagaatacggaaagaatgtgggagcaaaactaatttatggtggaaatataataccagggaagggatatttcctagaacctacaattttcgaaggagtcacatctgatatgaggctatttaaagaagagattttcggtccagtacttagtgtcactgaggcaaaagatttagatgaggctataaggctagttaacgctgtagactatggacatacagctggaatagtcgcaagcgatatcaaggcgattaacgagttcgttagtagggtagaggcaggagttataaaggttaataagccaacagtcggactggaattgcaagcaccatttggtggttttaagaattctggagccactacgtggaaagagatgggagaagatgctttagagttctaccttaaggagaagacagtatacgaaggctggtaa

SEQ ID NO: 12489 - protein, 478 aa, Sulfolobus solfataricus
MKSYQGLADKWIKGSGEEYLDINPADKDHVLAKIRLYTKDDVKEAINKAVAKFDEWSRTPAPKRGSILLKAGELMEQEAQEFALLMTLEEGKTLKDSMFEVTRSYNLLKFYGALAFKISGKTLPSADPNTRIFTVKEPLGVVALITPWNFPLSIPVWKLAPALAAGNTAVIKPATKTPLMVAKLVEVLSKAGLPEGVVNLVVGKGSEVGDTIVSDDNIAAVSFTGSTEVGKRIYKLVGNKNRMTRIQLELGGKNALYVDKSADLTLAAELAVRGGFGLTGQSCTATSRLIINKDVYTQFKQRLLERVKKWRVGPGTEDVDMGPVVDEGQFKKDLEYIEYGKNVGAKLIYGGNIIPGKGYFLEPTIFEGVTSDMRLFKEEIFGPVLSVTEAKDLDEAIRLVNAVDYGHTAGIVASDIKAINEFVSRVEAGVIKVNKPTVGLELQAPFGGFKNSGATTWKEMGEDALEFYLKEKTVYEGW

SEQ ID NO: 12490 - DNA, 3606 bp, Neisseria meningitidis
  CDS (1)..(3606)
atgtttcattttgcatttccggcacaaactgccctgcgccaagcgataaccgatgcctaccgccgtaatgaaatcgaagccgtacaggatatgttgcaacgtgcacagatgagcgacgaagagcgcaacgccgcctccgagcttgcccgccgtttggttacccaagtccgcgccggccgcaccaaagccggcggcgtggatgcgctgatgcacgagttttcactctccagcgaagaaggcatcgcgctgatgtgtctggcagaagccctgctgcgtatccccgacaacgccacgcgcgaccgcctgattgccgacaagatttcagacggcaactggaaaagccatttgaacaacagcccttccctcttcgtcaatgctgccgcctggggcctgctgattaccggcaaactgaccgccacaaacgacaaacaaatgagttccgcactcagccgcctgatcagcaaaggcggcgcaccgctcatccgccaaggcgtaaattacgccatgcggcttctgggcaaacagttcgtaaccggacagaccattgaagaagccctgcaaaacggcaaagaacgcgaaaaaatgggctaccgcttctccttcgatatgttgggcgaagccgcctacacccaagccgatgccgaccgctactaccgcgactatgtcgaagccatccacgccatcggcaaagatgcggcaggacaaggcgtttacgaaggtaacggtatttccgtcaaactttccgccatccatccgcgctactcgcgcacccaacacggccgcgtgatgggcgaactgttgccgcgcctgaaagagctgttccttttgggtaaaaaatacgatatcggtatcaacatcgatgccgaagaagccaaccgtctggagctgtctttggatttgatggaggctttggtttcagaccctgacttggctggctacaaaggtatcggtttcgttgtccaagcctaccaaaaacgttgtccgttcgttatcgactacctgatcgaccttgcccgccgcaacaaccaaaaactaatgatccgcctcgtcaaaggcgcgtattgggacagcgaaatcaaatgggcgcaagtggacggcttgaacggctatccgacctacacccgcaaagtccacaccgacatctcctacctcgcctgcgcgcgcaaactgctttccgcgcaagacgcggtattcccgcaatttgccacccacaacgcctacactttgggcgcaatctaccaaatgggtaaaggcaaagattttgaacaccaatgcctgcacggtatgggcgaaaccctgtacgaccaagtcgtcggcccgcaaaacttaggccgccgcgtgcgcgtgtacgccccagtcggcacacacgaaaccctgctcgcctacttggtgcgccgcctgttggaaaacggcgcgaactcgtctttcgtcaaccaaatcgtcgatgaaaacatcagcatcgacacgctcatccgcagcccgttcgacaccatcgccgaacaaggcatccacctgcacaacgccctgccgctgccgcgcgatttgtacggcaaatgccgtctgaactcgcaaggcgtggacttgagcaacgaaaacgtattgcagcagcttcaagaacagatgaacaaagccgccgcgcaagacttccacgccgcatccatcgtcaacggcaaagcccgcgatgtcggcgaagcgcaaccgattaaaaaccctgccgaccacgacgacatcgtcggcacagtcagctttgccgatgccgcgcttgcccaagaagcggttggcgcagccgttgccgcgttccccgaatggagtgcgacacctgccgccgaacgcgccgcctgcctgcgccgttttgccgatttgctggagcagcacaccccagcactgatgatgcttgccgtgcgcgaagcaggcaaaacgctgaacaacgccattgccgaagtgcgcgaagccgtcgatttctgccgctactacgcaaacgaagccgaacataccctgcctcaagacgcaaaagccgtcggcgcgattgtcgccatcagcccgtggaacttcccgctcgccatctttaccggcgaagtcgtttccgcattggcggcaggcaacaccgtcatcgccaaacccgccgaacaaaccagcctgattgccggttatgccgtttccctcatgcacgaagccggcatcccgacttccgccctgcaactcgtcctcggcgcaggcgacgtgggtgcggcattgaccaacgatgcccgcatcggcggcgtgattttcaccggctcgaccgaagtggcgcgcctgatcaacaaagcccttgccaaacgcggcgacaatcccgtcctgattgccgaaaccggcggacaaaacgccatgattgtcgattccaccgcacttgccgagcaagtctgcgccgacgtattgaactccgccttcgacagcgcgggacaacgctgctccgccctgcgcattttgtgcgtccaagaagacgttgccgaccgtatgctcgacatgatcaaaggcgctatggacgaactcgtcgtcggcaaaccgattcagctcactaccgatgtcggccccgtcatcgatgccgaagcacagcaaaacctgttgaaccacatcaacaaaatgaaaggtgttgccaagtcctaccacgaagtcaaaaccgccgccgatgtcgattccaaaaaatccacgttcgttcgccccatcctgtttgaattgaacaacctcaacgaactgcaacgcgaagtcttcggtcccgtcctgcacgtcgtccgctaccgcgccgacgaactcgacaacgtcatcgaccaaatcaacagcaaaggctacgccctgacccacggcgtacacagccgcatcgaaggcacggtacgccacatccgcagccgcatcgaagccggcaacgtttacgtcaaccgcaacatcgtcggcgcagtcgtcggcgtacagcccttcggcggacacggtctgtccggcacaggccccaaagcaggcggttcgttctacctgcaaaaactgacccgcgccggcgaatgggttgccccgaccctgagccaaatcggacaggcggacgaagccgcactcaaacgcctcgaagcactggttcacaaactaccgttcaacgccgaagagaaaaaagccgcagcggccgctttgggacacgcccgcatccgcaccctgcgccgtgccgaaaccgtccttaccggaccgaccggcgagcgcaacagcatctcatggcacgcgcccaaacgcgtttggatacacggcggcagcacggttcaagcctttgccgcactgaccgaacttgccgcctccggcatacaggcagtggtcgaacccgacagccccttggcttcctacactgccgacttggaaggtctgctgctggtcaacggcaaacccgaaaccgccggcatcagccacgttgccgccctgtcgcctttggacagcgcgcgcaaacaggaacttgccgcccacgacggcgcactcatccgcatcctcccttcggaaaacggactcgacatcctgcaagtgtttgaagaaatctcttgcagcgtcaacaccacagccgccggcggcaacgccagcctgatggcggtcgccgactga

SEQ ID NO: 12491 - protein, 1201 aa, Neisseria meningitidis
MFHFAFPAQTALRQAITDAYRRNEIEAVQDMLQRAQMSDEERNAASELARRLVTQVRAGRTKAGGVDALMHEFSLSSEEGIALMCLAEALLRIPDNATRDRLIADKISDGNWKSHLNNSPSLFVNAAAWGLLITGKLTATNDKQMSSALSRLISKGGAPLIRQGVNYAMRLLGKQFVTGQTIEEALQNGKEREKMGYRFSFDMLGEAAYTQADADRYYRDYVEAIHAIGKDAAGQGVYEGNGISVKLSAIHPRYSRTQHGRVMGELLPRLKELFLLGKKYDIGINIDAEEANRLELSLDLMEALVSDPDLAGYKGIGFVVQAYQKRCPFVIDYLIDLARRNNQKLMIRLVKGAYWDSEIKWAQVDGLNGYPTYTRKVHTDISYLACARKLLSAQDAVFPQFATHNAYTLGAIYQMGKGKDFEHQCLHGMGETLYDQVVGPQNLGRRVRVYAPVGTHETLLAYLVRRLLENGANSSFVNQIVDENISIDTLIRSPFDTIAEQGIHLHNALPLPRDLYGKCRLNSQGVDLSNENVLQQLQEQMNKAAAQDFHAASIVNGKARDVGEAQPIKNPADHDDIVGTVSFADAALAQEAVGAAVAAFPEWSATPAAERAACLRRFADLLEQHTPALMMLAVREAGKTLNNAIAEVREAVDFCRYYANEAEHTLPQDAKAVGAIVAISPWNFPLAIFTGEVVSALAAGNTVIAKPAEQTSLIAGYAVSLMHEAGIPTSALQLVLGAGDVGAALTNDARIGGVIFTGSTEVARLINKALAKRGDNPVLIAETGGQNAMIVDSTALAEQVCADVLNSAFDSAGQRCSALRILCVQEDVADRMLDMIKGAMDELVVGKPIQLTTDVGPVIDAEAQQNLLNHINKMKGVAKSYHEVKTAADVDSKKSTFVRPILFELNNLNELQREVFGPVLHVVRYRADELDNVIDQINSKGYALTHGVHSRIEGTVRHIRSRIEAGNVYVNRNIVGAVVGVQPFGGHGLSGTGPKAGGSFYLQKLTRAGEWVAPTLSQIGQADEAALKRLEALVHKLPFNAEEKKAAAAALGHARIRTLRRAETVLTGPTGERNSISWHAPKRVWIHGGSTVQAFAALTELAASGIQAVVEPDSPLASYTADLEGLLLVNGKPETAGISHVAALSPLDSARKQELAAHDGALIRILPSENGLDILQVFEEISCSVNTTAAGGNASLMAVAD

SEQ ID NO: 12492 - DNA, 3558 bp, Helicobacter pylori
  CDS (1)..(3558)
atgcaaaaaatcattgacgattcgctagaattagctaaaaaactgcaagatagtatcagtaaccatttgagcgatcaggaaaaagcgttccactctaaaatgcaaaagcttttaaacaaccctgaaaacaaagtcatgctcatagagcttatggatcggagtttcaggtgcttggacaataaagcccgctttgaaatgattgagcatgttttagacaaatacaaaagccgtgagattttttctccgtttgaaaaagtgcttttaatggggtttttaagctttgggaaaatgctccctgatatgagcgtgcctttctttgtcaataaaatcagaagcgacacgaaagcgatggtcttggatcaagaagagagccagttaaaagagcggattttaaaaagaaaaaatgaaaaaatcattttgaatgtgaattttattggcgaagaggttttaggcgaagaagaagctaatgcgcgttttgaaaaatactctcaagccctaaaatccaactacatccaatacatttccattaaaatcacgacgattttttctcaaatcaatatccttgattttgaatactctaaaaaagagattgtcaaacgcctagacgctctttacgccctggctttagaagaagaaaaaaaacaaggcatgcctaaattcatcaatttggatatggaagaatttagggatttagagctaacagtggagtcgtttatggaatccatcgctaaatttgatttgaacgctggtattgtgctgcaagcctatattccggattcttatgaatatttgaaaaaactgcacgctttttctaaagaaagggttttaaaagggttgaagcccattaaaatccgctttgttaagggagcgaacatggagagcgaagaaactatcgcttccgtgaaagattgggcgttacccacattttccaataagcaagacaccgattctaattacaataaaatgttggattttgttttagagggcgataattataaatacattcatattggcgcagcgagtcataatatttttgaaatcgcttatgtctatacgcgtatccatgccattaatgatcctgttgtgttagagcatttcagctttgaaatgctagagggcatgagtttgcaagcgagccaggaactaaaagagatgcacaagctcattctttatgcgccggtgtgcgatgaagcgcattttaacaatgcgatcgcttacttggtgaggaggttagacgaaaacacctcaagcgataatttcatgaaggctttctttaacctcaaagtaggcacgagcgaatggaaagatcaagaacaacgctttttaaacagccttaaaggaattgccactttagacaatgccacccataggactcaagataggaacgccaaacaaagcgggcataccacttacccaaaccactcctttaaaaacgaaagcgataccgattttattttaaaagccaaccgagaatgggctaaaaaagtgcgcgagaaaatgcgtaacgctcctattttagagctttacccagagatggatgggaggtttgaagatcctaatctaacccctttagaagtctttgatagaatccatcataaaaaaatcgctagcgtgcatttagcggataaggaagcgattttaaaagccctagaagtggctaaaagcgataagagccgtttcagtcaaaaaagctttacagaaatccatgccttaatgagtcaaaccgcccagctttttagagaaagaagaggcgatttgatagggatttccgctttagaagtgggtaagactttcgctgaaacggacgctgaagtgagcgaagccattgactttttagagttttacccttacagcttaagggtgttgcaagagcaaaacacaaaaacgcaattcacccctaaaggcgtgggcgtggtcattgccccatggaatttccctgtgggcatttctgtaggcactatcgctgcccccctagctacgggcaatcgggtgatttacaagccctcaagtttgtctagcgtaacgggctataagctttgtgagtgcttttgggatgcgggcgtgcctagagatgcgctcatttacttgccctctaaagggagcgatattagcgaacatcttttaagagatgaaagcatccagtttgccattttaaccgggggcgaagacaccgcttataaaatgttaaaagctaaccccactttagccttgagcgctgaaacaggcggtaaaaacgccaccattgtgagcaaaatggcagacagagaccaggcgattaagaatgttatccattcagcttttagcaattcggggcaaaaatgctccgccacttcgcttttagtattagaaaaagaagtctatgaagatgagaactttaaaaagactctaatagatgcgactctaagccttagcgtgggcgatccttttgatttcaaaaacaaaatcggcgctctagcggacaagcctaatgaaaaggtcatcaaagccatagatgaattaaaaagctatgaaaattacgaaatcccggtaagctttgtcaatgataacccctatttgatgaagccaagcatcaaatacggcactaaaaaaggcgatttcacgcaccaaactgagctttttacgcccattttatccgtgatggaagcaaaagatttagacgaagcgatagaaatagccaattctaccggttacgggctgactagcgcgttagagtcgttggacgaaagggagtgggaatattatttagaacgcattgaagccggtaatatctatatcaacaagcccaccacaggagcgattgtcttgcgccagccttttgggggggttaaaaaatccgctgtggggtttgggaggaaagtaggcattttcaactatatcacgcaatttgtgaatatctgccaagaagaagaagacgaaaacgccttaaaaaaccccttaagcgaagccttagaaaacttaactcaaaaaggctatgatgagcatacgcatgagttgaagcgcgcgatttttatggcaaaaagctacgcttatcattacaaacatgaattcagccaaactaaagactatgtcaaaatcagaggcgaagacaaccttttttcctacactaaagttaaaagcgtgggctatcgcatcaccgaaaaggacactttaagcgacatgttaggcgttgctttagcatgtttaatttctcaaatccctttaacgctcagcatagaaaacgaacgaacgaacaaagatttaacctttttcttagaatgcttaaaagcgctccaagcaagcgcccctattgtttatgaaagcttgcaaaaatttagcgagaaattgaatactttcaatcgtgtccgttatctcaaaagcgatttggatttattgcacgaacaagcgagcgctttagggatggttttagccacggctaaaccatgcctaaatgggcgttttgaattgctgtattaccacttagagcgatcggttagcatctcttatcaccgttatgggaatttaggctcaagggttttaaggcaacccacttgccacaaatcatgctgtgctgaaaaataa

SEQ ID NO: 12493 - protein, 1185 aa, Helicobacter pylori
MQKIIDDSLELAKKLQDSISNHLSDQEKAFHSKMQKLLNNPENKVMLIELMDRSFRCLDNKARFEMIEHVLDKYKSREIFSPFEKVLLMGFLSFGKMLPDMSVPFFVNKIRSDTKAMVLDQEESQLKERILKRKNEKIILNVNFIGEEVLGEEEANARFEKYSQALKSNYIQYISIKITTIFSQINILDFEYSKKEIVKRLDALYALALEEEKKQGMPKFINLDMEEFRDLELTVESFMESIAKFDLNAGIVLQAYIPDSYEYLKKLHAFSKERVLKGLKPIKIRFVKGANMESEETIASVKDWALPTFSNKQDTDSNYNKMLDFVLEGDNYKYIHIGAASHNIFEIAYVYTRIHAINDPVVLEHFSFEMLEGMSLQASQELKEMHKLILYAPVCDEAHFNNAIAYLVRRLDENTSSDNFMKAFFNLKVGTSEWKDQEQRFLNSLKGIATLDNATHRTQDRNAKQSGHTTYPNHSFKNESDTDFILKANREWAKKVREKMRNAPILELYPEMDGRFEDPNLTPLEVFDRIHHKKIASVHLADKEAILKALEVAKSDKSRFSQKSFTEIHALMSQTAQLFRERRGDLIGISALEVGKTFAETDAEVSEAIDFLEFYPYSLRVLQEQNTKTQFTPKGVGVVIAPWNFPVGISVGTIAAPLATGNRVIYKPSSLSSVTGYKLCECFWDAGVPRDALIYLPSKGSDISEHLLRDESIQFAILTGGEDTAYKMLKANPTLALSAETGGKNATIVSKMADRDQAIKNVIHSAFSNSGQKCSATSLLVLEKEVYEDENFKKTLIDATLSLSVGDPFDFKNKIGALADKPNEKVIKAIDELKSYENYEIPVSFVNDNPYLMKPSIKYGTKKGDFTHQTELFTPILSVMEAKDLDEAIEIANSTGYGLTSALESLDEREWEYYLERIEAGNIYINKPTTGAIVLRQPFGGVKKSAVGFGRKVGIFNYITQFVNICQEEEDENALKNPLSEALENLTQKGYDEHTHELKRAIFMAKSYAYHYKHEFSQTKDYVKIRGEDNLFSYTKVKSVGYRITEKDTLSDMLGVALACLISQIPLTLSIENERTNKDLTFFLECLKALQASAPIVYESLQKFSEKLNTFNRVRYLKSDLDLLHEQASALGMVLATAKPCLNGRFELLYYHLERSVSISYHRYGNLGSRVLRQPTCHKSCCAEK

SEQ ID NO: 12494 - DNA, 1488 bp, Bacillus subtilis
  CDS (1)..(1488)
atgagttctttaacgatgcaagtgacgaaaaggctggagacatttttacagggaacaaagaagctttatattgacggaaagtttgttccgagtgcctcaggggcaacctttgacactccaaacccggcgaccggcgaaaccttgatgacgctgtatgaagcccaggctgcggatgtggacaaagctgttaaagctgcccggaaagcctttgaccaaggtgaatggagaacaatgtctccagcttcgagaagcagactgatgtataagctggcagacttaatggaagagcataaaactgagcttgctcagcttgaaacacttgataatgggaaaccgatcaatgaaacgactaatggagatattccgctggctattgagcatatgcgctattacgccggctggtgtacaaaaataacaggacagacgattccggtttccggcgcttattttaattatacgcgtcatgagcctgtcggtgtcgtcggccagatcattccatggaatttcccgctcctgatggcgatgtggaaaatgggcgcggcacttgcaacaggctgtacaatcgtcctcaaaccggctgaacaaacaccgctttcagctctttatttggcagaattaattgaccaagccggtttccctgccggtgtaatcaacatcatcccaggattcggtgaagatgcgggagaagcgctgacgaaccacgaagcggttgataaaattgcctttaccggttccactgaaatcggaaagaaaatcatgtccaccgcagcgaaaagcattaagcgtgtgacattggagctgggcggaaaatcgcctaatattcttctgccggatgcgaatttaaaaaaagccatcccgggcgctttaaacggtgtgatgtttaaccagggccaagtctgctgtgcgggctcacgtgtcttcattcataaagaccaatatgatgaagttgttgatgaaatggcatcctatgctgagtcactccgccaaggagcgggacttcataaagatactcaaatcgggcctctcgtaagcaaggaacagcatgagcgcgttctttcctatattcaaaaaggaaaagatgaaggagcaaaagcagtgaccggcggaagctgtccttttgaagcaggatattttgtcgcaccgactgtgtttgcgaatgttgaagacgaaatgaccatcgcaaaagaagaaattttcggacccgtgctgactgcaattccgtacgaaacagtcgatgaagttattgaacgggcaaaccattcagaatatgggcttgcagccggactatggacagagaacgtcaagcaggctcactatatcgcggaccgacttcaagccggaaccgtttgggtcaactgctataatgtgtttgacgcggcgtctccatttggcggttataaacagtcaggactcggacgagaaatgggatcatatgccttggataattacacagaagtcaaaagtgtatgggtaaaccttgaagactaa

SEQ ID NO: 12495 - protein, 495 aa, Bacillus subtilis
MSSLTMQVTKRLETFLQGTKKLYIDGKFVPSASGATFDTPNPATGETLMTLYEAQAADVDKAVKAARKAFDQGEWRTMSPASRSRLMYKLADLMEEHKTELAQLETLDNGKPINETTNGDIPLAIEHMRYYAGWCTKITGQTIPVSGAYFNYTRHEPVGVVGQIIPWNFPLLMAMWKMGAALATGCTIVLKPAEQTPLSALYLAELIDQAGFPAGVINIIPGFGEDAGEALTNHEAVDKIAFTGSTEIGKKIMSTAAKSIKRVTLELGGKSPNILLPDANLKKAIPGALNGVMFNQGQVCCAGSRVFIHKDQYDEVVDEMASYAESLRQGAGLHKDTQIGPLVSKEQHERVLSYIQKGKDEGAKAVTGGSCPFEAGYFVAPTVFANVEDEMTIAKEEIFGPVLTAIPYETVDEVIERANHSEYGLAAGLWTENVKQAHYIADRLQAGTVWVNCYNVFDAASPFGGYKQSGLGREMGSYALDNYTEVKSVWVNLED

SEQ ID NO: 12496 - DNA, 1581 bp, Deinococcus radiodurans
  CDS (1)..(1581)
atgtccaccctcttagacggcctgcttcccttccagcacgaaccctacttcgactttgccgaccccgctgtggccgaggcgcaaaccgccgcctacgcgcaggcccgtcagaaatacgccggacagacctttccgctgctcgtcggcgggcagcaggtgaagggcgacggcaccttgaccgtgaccaatcccgcgaccggcgaacagctctggcacttccagaacgcgacggcggcgcaactcgatgaggcggtcagggccgccaacgaggccttccagagctggcgcttttccgaccccctgcaacgcgcgagcatcttcttgcgggccgcgcaactgctgcgctcgcgccgcatggagctgaacgccgtcatgagcctcgaaaacggtaaaaactgggccgaggccgacggcgaaatcgccgagtgtgtggaccactgcgaggtgttcgcccgcgaaacgctgaagtgggcgcagggcaaacccgtctatcccatgcccgacgagcacgtgaccaccgtttacgagccgctcggcgccgtcgccgtcatcagcccctggaactatccgagcgcgattccgctggggatggccctcggcgcgctggcggcgggcaacacggtgatttggaaacccgcgagcgagacgccgctctcgtcctggctgctcattcgcctgctgttcgaggccgggctgccgcgtgactgcgttcagttcctcaccggaagcgacgatgtgctcggcgacccgctggtggaccacaaggacgtgcggatggtcgccttcaccgggagccgcgaaatcggctgccgcatctacgaacgggcggcgaaggtgcagcccggccagaaattccttaagcgcgtgattgccgaaatgggcggcaaggaccccaccgtggtctgcgctgatgccgacctagacgccgccgccgctggcatcgtcgcttccaccttcggctacagcggccagaagtgcagcgcgtgcagccgcgtcatcgctgaggcaagcgtgtacgacacactgcttgaaaaggtcaagacgctgaccgaagcgctgaaggtgggtttgcccgagcacaacgccgccgtcggcccggtcatccaccaggggagcgccaaccgaattcggcagtacatcgaaaacggcaaagggacggcccgcctcgtctgcggcggcggagaaatggaggtggcagacagtggcgaggcgagcgccaactacatccagcccaccatcttcgccgacgtggacgcgaaagacccgctgtttcaggaggaaattttcggcccggtcctcgccttcgctaaagccgacgactggcggcacgcgattgacctcgccaacgattcggactacggcctgaccgccgccttttattcgcgcgacccccacaaactgaccgaggcgcggcggctgatgcacgtcggcaacctctatctcaatcgcaaatgcactggtgcgctcagtggctcgcattccttcggcggctacggcatgagcggcacgaacgctaaggtgggcggccctgattacctgttttggttcctccagacgaagacggtggcgcaaaagtattga

SEQ ID NO: 12497 - protein, 526 aa, Deinococcus radiodurans
MSTLLDGLLPFQHEPYFDFADPAVAEAQTAAYAQARQKYAGQTFPLLVGGQQVKGDGTLTVTNPATGEQLWHFQNATAAQLDEAVRAANEAFQSWRFSDPLQRASIFLRAAQLLRSRRMELNAVMSLENGKNWAEADGEIAECVDHCEVFARETLKWAQGKPVYPMPDEHVTTVYEPLGAVAVISPWNYPSAIPLGMALGALAAGNTVIWKPASETPLSSWLLIRLLFEAGLPRDCVQFLTGSDDVLGDPLVDHKDVRMVAFTGSREIGCRIYERAAKVQPGQKFLKRVIAEMGGKDPTVVCADADLDAAAAGIVASTFGYSGQKCSACSRVIAEASVYDTLLEKVKTLTEALKVGLPEHNAAVGPVIHQGSANRIRQYIENGKGTARLVCGGGEMEVADSGEASANYIQPTIFADVDAKDPLFQEEIFGPVLAFAKADDWRHAIDLANDSDYGLTAAFYSRDPHKLTEARRLMHVGNLYLNRKCTGALSGSHSFGGYGMSGTNAKVGGPDYLFWFLQTKTVAQKY

SEQ ID NO: 12498 - DNA, 1548 bp, Bacillus subtilis
  CDS (1)..(1548)
atgacagtcacatacgcgcacgaaccatttaccgattttacggaagcaaagaataaaactgcatttggggagtcattggcctttgtaaacactcagctcggcaagcattatccgcttgtcataaatggagaaaaaattgaaacggaccgcaaaatcatttctattaacccggcaaataaagaagagatcattgggtacgcgtctacagcggatcaagagcttgctgaaaaagcgatgcaagccgcattgcaggcatttgattcctggaaaaaacaaagaccggagcaccgcgcaaatattctctttaaggcagcggctattttgcgcagaagaaagcatgaattttcaagctatcttgtgaaggaagcaggaaaaccgtggaaggaagcagatgcggacacggctgaagcgatagactttttagagttctacgcgcgccaaatgttaaagctcaaggaaggggctccggtgaagagccgtgctggcgaggtcaatcaatatcattacgaagcgcttggcgtcggcatcgtcatttctccatttaacttcccgctcgcgattatggcgggaacagcggtggcagcgattgtgacaggaaatacgattctcttaaaaccggctgacgcagccccggtagtggcagcaaaatttgtcgaggtcatggaggaagcgggtctgccaaacggcgttctgaattacattccgggagatggtgcggagatcggtgatttcttagttgagcatccgaagacacggtttgtctcatttacaggttcccgtgcagtcggctgccggatttatgagcgagctgccaaagtgcagccgggccaaaaatggctcaaacgggtaattgcagaaatgggcggaaaagacacagtgcttgtcgacaaggacgctgatcttgaccttgctgcatcctctatcgtgtattcagcatttggatattcaggacagaagtgttctgcgggctcccgcgcggtcattcatcaggatgtgtatgatgaagtggtggaaaaagctgtggcgctgaccaaaacgctgactgtcggcaatccagaagatcctgatacgtatatgggtcccgtgattcatgaagcatcctacaacaaagtgatgaaatacattgaaatcggcaaatctgaaggcaagctattggccggcggagaaggcgatgattcaaaaggctactttattcagccgacgatctttgcagatgttgatgaaaacgcccgcttgatgcaggaagaaattttcggcccggttgttgcgatttgcaaagcgcgtgatttcgatcatatgctggagattgccaataacacggaatacggattaacaggtgcgcttctgacgaaaaaccgtgcgcacattgaacgggcgcgcgaggatttccatgtcggaaacctatattttaacagaggatgtaccggagcaattgtcggctatcagccgttcggcggttttaatatgtcaggaacagactcaaaagcaggcggtcccgattacttaattcttcatatgcaagccaaaacaacgtccgaagctttttga

SEQ ID NO: 12499 - protein, 515 aa, Bacillus subtilis
MTVTYAHEPFTDFTEAKNKTAFGESLAFVNTQLGKHYPLVINGEKIETDRKIISINPANKEEIIGYASTADQELAEKAMQAALQAFDSWKKQRPEHRANILFKAAAILRRRKHEFSSYLVKEAGKPWKEADADTAEAIDFLEFYARQMLKLKEGAPVKSRAGEVNQYHYEALGVGIVISPFNFPLAIMAGTAVAAIVTGNTILLKPADAAPVVAAKFVEVMEEAGLPNGVLNYIPGDGAEIGDFLVEHPKTRFVSFTGSRAVGCRIYERAAKVQPGQKWLKRVIAEMGGKDTVLVDKDADLDLAASSIVYSAFGYSGQKCSAGSRAVIHQDVYDEVVEKAVALTKTLTVGNPEDPDTYMGPVIHEASYNKVMKYIEIGKSEGKLLAGGEGDDSKGYFIQPTIFADVDENARLMQEEIFGPVVAICKARDFDHMLEIANNTEYGLTGALLTKNRAHIERAREDFHVGNLYFNRGCTGAIVGYQPFGGFNMSGTDSKAGGPDYLILHMQAKTTSEAF

SEQ ID NO: 12500 - DNA, 2973 bp, Synechocystis sp
  CDS (1)..(2973)
atggttgcacaaatcgattcacaacaacagtatgaacaggccacccaggcgatcgccaaggaactattagcccagaccagggagaaaagatcgctgtgggacaaaattggcgataatctgcggctcgatgacaagttgctggattggaccatgggtcatcctggattgcgggtgcaattgttcaaatttatcgactgtctgccagcgttgcagagtaacagtgagattgccaaccatctccagcagtatatgagcgaagaggaggtggaattaccagaagcactgaaaaaattgttgaattttgccgatgcccactcgacgccggcccagattgcagcgggaacggtgagtaaagcgacggaacagttggcttttaaatacattgctggggaaacgatcgcccaggtgatcaaaacagtggaacggctccgcaaggaaaaaatgggctttaccattgatttactgggggaagcggtaattacggaatcggaggcggcggaatattggcaaaattatttggacctgatggcccagttatcccagcaagccaaatcctggtcgaaggtgccccaaattgatcaggcagacggggaaatattgccccaggtgcaggtatcggtaaagttaacggctttttattcccagtttgatcccctggaccccgcaggtagtaaagccaaggtttgtgagcggattcgggaattgttgcggcgagcccaagaattaggtgtcgctgttcactttgacatggagcagtaccactacaaagacctgattttaaatattctcaaggaattgttagtggaagaagagttccgctcccgcaccgatgtgggcattaccatgcaggcctatctgcgggattcgaccgaagatttggaagcattaattccctgggctaaacatcggggttatcccgtgactgtgcgcttggtgaaaggagcctattgggatcaagaaaccatcaaagcccaacagaatcattggcaaattccggtttatgtggaaaaagcccaaaccgatgccaactacgagcgcatgactcggctattactggaaaaccacgaatatttgtacgccgccattggtagtcataatgtccgttcccaagccctggcctgtgcgatcgccgaagagttgaatattcccaaacgtcgttatgaaatgcagattctttacggcatgggagaacccctggcccgggccattgttaaacggggtcatcgggtgcgggtctatgcaccctacggtcggctgttaccggggatggcttatttaatccgacgcttattggaaaatactgctaacagttcttttctacgccaaaacctagaagagcggcccattgaagaattaattgctccgccccaagttaaaggcattaatgacctacccaccaagggttatggcaacgctcccgacaccgattacgccgatgctgatttacgccagcaagcatttcaagccctaaccagggttaaacaacaattgggcaaaacctatctgccctacattaacggcgagtacgtggaaacggctaactacattgattccgttaatccctgtcgtccatcccaggcgatcgggaaagtggggttaatcagtgttgaacaggcagaccatgccctggaaatagccaaggctgcgtttcctgcttggaaaaaaactccagtacgggaacggtgtggcattctccgcaaagcggcagacattatggaagagcgtcgccatgagttaaacgcctggatttgtttggaagtgggcaaaattattccccaagctgatgcggaggtgtccgaggcgatcgatttttgtcgctactatgccgatgaaatggaacggctagaccaaggcgttaacctcgatattcccggtgaaaccaaccgttatttctatcaaccccggggcattgccctagtgatttccccctggaatttccccatggcgatcgccgttggtatgacggtggcggcgttggtgacgggcaattgtacgttactaaaaccagcggaaacttccacggtaattgcggctaaaattgcggaaattcttattgcagcgggggttccccctggggtcttccaatatgtacctggtaaggggtcggtggtgggttcccacatggtcaatcatcccgacgtacatttgattgctttcactggctccagggaagtgggctgtcgcatttacgccgatgccgctttggtacaaccaggacaaaaacacctcaaacgggtaattgcagaaatgggcggcaaaaacgccatcatcgttgatgaaagtgcggatctcgatcaagcggtggccggggcagtgtattccgcctttggttacacgggccaaaaatgttctgcctgttcccgggtggtggtgctttcccccgtacacgatgcctttgtggagcggtttgtagaggcaacccgttccctcaatgtgggccccaccgatgaccccagcacccaggttggtccggtaattgatgccaaggcccaagcccgcattcaggaatacatcgaacagggtaaggcggaatgtgaattggcgatcgcctgtgatgctcctagtgaaggctatttcgtcggtcccacggtgttcaaaaatgttgaccgccatgccaccattgcccaggaggaaatttttggtccagtggtaaccattattcgggcggccaattttgacgaagcgttggaaattgccaatggtaccgactacgctttaacggggggtctctattcccgtaccccagatcacattaatcgtgccgcggcggagtttgaagtaggcaatctttacatcaaccgcaccatcaccggggcgatcgtttcccgccaaccttttggggggttcaaaatgtctggggttggttccaaagcgggtggaccagattatttgttacagttcttagaaccacgccatgtaacggagaatattcaacggcaaggatttgcaccaattgagggggcagatcagtaa

SEQ ID NO: 12501 - protein, 990 aa, Synechocystis sp
MVAQIDSQQQYEQATQAIAKELLAQTREKRSLWDKIGDNLRLDDKLLDWTMGHPGLRVQLFKFIDCLPALQSNSEIANHLQQYMSEEEVELPEALKKLLNFADAHSTPAQIAAGTVSKATEQLAFKYIAGETIAQVIKTVERLRKEKMGFTIDLLGEAVITESEAAEYWQNYLDLMAQLSQQAKSWSKVPQIDQADGEILPQVQVSVKLTAFYSQFDPLDPAGSKAKVCERIRELLRRAQELGVAVHFDMEQYHYKDLILNILKELLVEEEFRSRTDVGITMQAYLRDSTEDLEALIPWAKHRGYPVTVRLVKGAYWDQETIKAQQNHWQIPVYVEKAQTDANYERMTRLLLENHEYLYAAIGSHNVRSQALACAIAEELNIPKRRYEMQILYGMGEPLARAIVKRGHRVRVYAPYGRLLPGMAYLIRRLLENTANSSFLRQNLEERPIEELIAPPQVKGINDLPTKGYGNAPDTDYADADLRQQAFQALTRVKQQLGKTYLPYINGEYVETANYIDSVNPCRPSQAIGKVGLISVEQADHALEIAKAAFPAWKKTPVRERCGILRKAADIMEERRHELNAWICLEVGKIIPQADAEVSEAIDFCRYYADEMERLDQGVNLDIPGETNRYFYQPRGIALVISPWNFPMAIAVGMTVAALVTGNCTLLKPAETSTVIAAKIAEILIAAGVPPGVFQYVPGKGSVVGSHMVNHPDVHLIAFTGSREVGCRIYADAALVQPGQKHLKRVIAEMGGKNAIIVDESADLDQAVAGAVYSAFGYTGQKCSACSRVVVLSPVHDAFVERFVEATRSLNVGPTDDPSTQVGPVIDAKAQARIQEYIEQGKAECELAIACDAPSEGYFVGPTVFKNVDRHATIAQEEIFGPVVTIIRAANFDEALEIANGTDYALTGGLYSRTPDHINRAAAEFEVGNLYINRTITGAIVSRQPFGGFKMSGVGSKAGGPDYLLQFLEPRHVTENIQRQGFAPIEGADQ

SEQ ID NO: 12502 - DNA, 4357 bp, Rhodobacter capsulatus
  CDS (966)..(4349)
gcatgcgatgaccgatgtgacgggcttcggccttggcggccatggtcttgaaatggcgcgcggatcgggctgcgacatcgagatttgctgggccgccgtgccgcgtctgcccggggtgatggaggccgccgccgagggccatctgaccggcgcttcggggcgcaactgggcgagttatggcgccgggatcgacctgcccgcggatctgggcgatctggaccgcgggatcctgaccgatccgcagacctcgggcgggcttctcgtcgcctgcgcgcccgaagcgctgggggaggtgcttgcgaccttccgccgtcacggcttcgatcacgccgcggcggtgggccgggtgctgggggaaagcgccacgccgcggctgcgcatcgtctgagctcacaggctggggctgttctgctccaccaccgcctccatcgcgacatagcttgaggttgccgcaacatgcggcagtgccgagagcttttcccccatgatcttgcggtattccgcaatgtcatggctgcgcaccttcagcaggtaatcaaagccgcccgcgatcatgtagcattcctcgacctcggggatttcgcgcacggcggcgttgaattgctccagcgctttttggcgcgtgtcgttcagcctcacctcgacataggtgacatggatcagccccagccggatcggcgagagcatcgcccggtagccggtgatcaggcccatctcctccattgcgcggatgcgggcggcgaccggggttttcgacagcccgaccttgcgagcaagctcggtgaccgggatgcgcgcattcgcgcaaagctcgtgcaggatgcgccggtcggtggcgtcgatcaggtcggtcatggtcttggcccctttttggtcggatcgcctgtgatgatggccttgaatggtcacatcgtccagcgccttgctggtatcatcggggaaacgcccaaggagtgccccgacccatgaccgacctttccgcccttggcccgaaggccaaattcgcccccgaggccgaggttctgcaggcgcttgtcgcgcaggcggcgctgccgcagccgcagcttgaccggatcgcggcacgcggcgccgatctggtggcgcggatccgggccgaggcgaagccgagcctgatggaacattttctggcgcaatacgggctgtcgacgcgcgagggcgtggcgctgatgtgtctggccgaggcgatgctgcgcgtgcccgacaccgccacgatcgacgcgctgatcgaggacaagatcgcgccctcggactggggcaagcatctgggcacggcggcctcctcgctggtcaatgcctcgacctgggccctgatgctgacgggcaaggtgctggatgacggcgcgggcggcatcgcgggcacgttgcggggcgccatgcggcggctgggcgagcccgtcatccgcgccgccgtgggtcaggcgatgcgcgagatgggccggcagtttgtcttgggcgaaaccattgaaaaggcgctggaacgcgccgaaaagcgcgaggcggagggctatacgttcagctatgacatgctgggcgaggcggcgctgacggcggcggatgccgagcgttaccggctggcctatgcgcaggcgatcacggcgatcggcaaggccgcgacccggggctcgatcgcggccaatccggggatttcgatcaagctttcggcgctgcatccgcgctatgaggtggcgcaggaggcgcgggtcatggccgagctggtgccggtcgtgcgcgatctggcgcgggcggcggcgcgggcggggattgcgctccatatcgacgccgaggaacaggaccggctggccttgtccctgcgggtgatggcggcggtgatcgccgatcccgagaccgcgggctgggagggctttggcgccgtcgtgcaggcctatggcaagcgcgccggggcggcgattgacgcgctcgccgcgatggcacgggcggccgggcggcgcatcaacatccggctggtgaagggcgcctattgggatgccgaaatgaagcgcgcccaggtcgaggggcacccgggctttccgcttttcacttcgaaaaccgggaccgatgtcgcctatatctgcctggctgcgaagctcttcgggctgaacgactgcatctatccgcaatttgcgacgcataatgcgcatacggtcgcggcggtgctggagatggcggcgggccgcccgttcgagttccagcgcctgcacgggatgggggcgcggctgcatgacatcgtgctgcgcgagaccggcgggcgctgccggatctacgcgccggtgggggcgcatcgcgacctgctcgcctatctggtgcggcggcttttggagaacggcgcgaattcgtctttcgtgaaccagatcgtcaatgaaagcgtgccgcctgccgaggtcgcggcctgtccctttgcggcgctgcccacggcgcgggcgccgcgcgggcttctggcgcctgcggatctgttcggcgcgggacgggtcaatgcgcaaggcttcgatctgagcgacccggaggttctggcgcggatcgaggcggcgcgggatgtgaccctgcccgatgcggcgccgatcgtggcggggccggtctcgggcaccttgcgcccggtgcggaacccggccaccggcgcggtcgtggcgcaggtgaccgaggccgatgcggcgacggtggctctggcgctggacgccgcgcaggtctggtcggcgcccgccgccacgcgggccgcggtgctgtgccgcgctgccgatctgtacgaggaaaacttcggcccgatctttgccgccttggcgcaagaggcgggcaagaccttgggcgatgccgtgtcggaactgcgcgaggctgttgatttcctgcgctattatgcggcagaaggggcggcggatacgcgccccccgcgcggtgccgtggtggcgatcagcccctggaactttccgcttgcgatcttcaccgggcaggtcgccgcggccctgatggcggggaatgcggtgctggccaagcccgccgaacagacgccgatcatcgcggcgctggcggtgcggctgctgcatcaggccggggttcccgagacggcgctgcagcttttgccgggcgatggccccaccgtcggcgccgcgctgacccgcgatccgcgcgtggcgggcgtggtcttcaccggctcgaccgagaccgcgcagatcatcgcccgtgccatggccgcgcatctggcgcccggcacgccgctgattgcggaaaccggcgggctcaatgcgatggtcgtcgacagcaccgcgctgcccgaacaggcggtgcgcgatgtcgtcgcctcggccttccgctcggccgggcaacgctgctcggcgctgcgctgtctttacgttcaggacgatatcgccccgcatctgatcgggatgctgaaaggcgcgatggaggagctggtttcgggcgatccggcgcggctttcgaccgatgtcggcccggtgatcgacgccgaggccaaggccgggatcgagacctatctggccgcgaacaaggcgcgcatcctgcatcgcagcaccgcgcccgagggcggccatttcgtcgccccggcgctgctgcaggtcggcggcattgccgatctggagcgcgaaatcttcggcccggtgttgcatcttgcaacattcgccgccgaggatctgcccgcggtgatcgcggcgatcaatgcgcgcggctacgggctgaccttcgggctgcattcgcgcatcgatgcccgtgtcgaaaccgtggccgagacgatccgggcgggcaacatctatgtgaatcgcaaccagatcggcgcggtcgtgggcagtcaaccctttggcggcgaggggctttccggcaccggcccgaaagcgggcgggccgctctatctgaaccgcttctacgcgccagagcctgtcgtggcggtcggcggctggacagaggctgcaacgcccatcctgcccgaagcgagagagacgcagctggacgagatcttcctgcccggcccgacgggcgagctgaaccggctgacgcggcatcaacgcggcccgatcctctgccttgggccgggggccgaagcagcttcggcgcaggcggcggcggttgtggcgctgggcgggcaggcggttcaggcaagcggggccgtgtcccccaaggctttggaaacgctgacacctttggccggtgtgctgtggtggggcgcggccgagatgggccgtgcctatgcgcaggcgctggcggtgcggcccgggccgctggtgccgctgatcactgccaaacccgatctggcccatgttgcgcatgaacgccatctctgcgtcgacacgacggccgcgggcggcaatgcggctttgctggccgggtgacttgccct

SEQ ID NO: 12503 - protein, 1127 aa, Rhodobacter capsulatus
MTDLSALGPKAKFAPEAEVLQALVAQAALPQPQLDRIAARGADLVARIRAEAKPSLMEHFLAQYGLSTREGVALMCLAEAMLRVPDTATIDALIEDKIAPSDWGKHLGTAASSLVNASTWALMLTGKVLDDGAGGIAGTLRGAMRRLGEPVIRAAVGQAMREMGRQFVLGETIEKALERAEKREAEGYTFSYDMLGEAALTAADAERYRLAYAQAITAIGKAATRGSIAANPGISIKLSALHPRYEVAQEARVMAELVPVVRDLARAAARAGIALHIDAEEQDRLALSLRVMAAVIADPETAGWEGFGAVVQAYGKRAGAAIDALAAMARAAGRRINIRLVKGAYWDAEMKRAQVEGHPGFPLFTSKTGTDVAYICLAAKLFGLNDCIYPQFATHNAHTVAAVLEMAAGRPFEFQRLHGMGARLHDIVLRETGGRCRIYAPVGAHRDLLAYLVRRLLENGANSSFVNQIVNESVPPAEVAACPFAALPTARAPRGLLAPADLFGAGRVNAQGFDLSDPEVLARIEAARDVTLPDAAPIVAGPVSGTLRPVRNPATGAVVAQVTEADAATVALALDAAQVWSAPAATRAAVLCRAADLYEENFGPIFAALAQEAGKTLGDAVSELREAVDFLRYYAAEGAADTRPPRGAVVAISPWNFPLAIFTGQVAAALMAGNAVLAKPAEQTPIIAALAVRLLHQAGVPETALQLLPGDGPTVGAALTRDPRVAGVVFTGSTETAQIIARAMAAHLAPGTPLIAETGGLNAMVVDSTALPEQAVRDVVASAFRSAGQRCSALRCLYVQDDIAPHLIGMLKGAMEELVSGDPARLSTDVGPVIDAEAKAGIETYLAANKARILHRSTAPEGGHFVAPALLQVGGIADLEREIFGPVLHLATFAAEDLPAVIAAINARGYGLTFGLHSRIDARVETVAETIRAGNIYVNRNQIGAVVGSQPFGGEGLSGTGPKAGGPLYLNRFYAPEPVVAVGGWTEAATPILPEARETQLDEIFLPGPTGELNRLTRHQRGPILCLGPGAEAASAQAAAVVALGGQAVQASGAVSPKALETLTPLAGVLWWGAAEMGRAYAQALAVRPGPLVPLITAKPDLAHVAHERHLCVDTTAAGGNAALLAG

SEQ ID NO: 12504 - DNA, 1647 bp, Schizosaccharomyces pombe
  CDS (1)..(1647)
atgtcacaatttgctgagttcaaattacctgccattaagaacgagcctcctaaacactatggtcccaatagtgctgacagagagggaatcgtcaaggcctacaaggagttagaggctgaattacctgtcactatccctgtcatcattgatggtaaggaagttgaaacgaataccattggtgagcagcgttgtccttttgagcacaaaaaggtcgttgctcgctatcaccgtgctggtgccaagcacgttgaagatgccattgaggcagcacttcgtggaaagaaggtctgggaatccttaccttttgctgaccgttctgccattttcttgaaggctgctcatttgataagcaccaagtaccgttacaagctcatggctgctacaatgattggccagggtaagaacatctggcaagctgaaattgacgctggaatggagatcattgacttccttcgcttcaataccaagtatgctagtgaattatatgccagccaacctcccgaaaacactcctggtgtctggaaccgtatggaatatcgtcctttggaaggtttcgtttatgccattactcctttcaactttacagctattgctggtaacttggctgctgccccccttctcatgggcaacgtcgttttaatgaagccttctgaccatgcagtcctttctagctacattgtttaccaaatcttccgtgaagctggtcttcccgctggagcacttcaatttatccctggtgacgctgttgaagtctccaaggtttgtttcaaccaccctgagtttgctggtcttcattttactggtagcacagccgtctttcgtagcctttggggaacaattggcgagaatgttgccaacggaaaataccgcacttaccccaaaatcgtcggtgagactggtggtaagaactttcatcttgtacattcttccgctgaaattaagagtgccgttgttaatgctgttcgtgctgctttcgaatatcaaggccaaaagtgctctgccctttctcgtctttacgtttctaagtatgcttgggaaaatggtttccgtgatgagcttaccaaacaggtcaagtctcttaaggtcggtgctcctttaactgattttgctaattttgtgggccctgttatccatcaagcaagctttaacaaactgaagaaggttcttgagagtgctgcttccgattctgaaattgaagttttggctggcggtaaagctgatgattccgaaggtttctttgttgaacctaccgttttactttctaaaaaccctaaacatgatatattcgttaacgaattgttcggccccgtactgtctgtttatgtatatgaggatgacaacttagacgctgtttgcgatctcatcgatactaccactccttatggtttaaccggatccatcttcgctcaggaccgtgttgttgtcagaaagttgactgaccgtctccgtaatgccgctggtaacttctatatcaatgataagtgtactggtgctgttgttggtgaacaaccttttggtggtgctcgtgccagtggtactaacgataaagctggtagcggaatgattctgtctcgattcgtttctcctcgctccatcaaagatacgtttgcttatgcagactctgttttatacccttccaacttttaa

SEQ ID NO: 12505 - protein, 548 aa, Schizosaccharomyces pombe
MSQFAEFKLPAIKNEPPKHYGPNSADREGIVKAYKELEAELPVTIPVIIDGKEVETNTIGEQRCPFEHKKVVARYHRAGAKHVEDAIEAALRGKKVWESLPFADRSAIFLKAAHLISTKYRYKLMAATMIGQGKNIWQAEIDAGMEIIDFLRFNTKYASELYASQPPENTPGVWNRMEYRPLEGFVYAITPFNFTAIAGNLAAAPLLMGNVVLMKPSDHAVLSSYIVYQIFREAGLPAGALQFIPGDAVEVSKVCFNHPEFAGLHFTGSTAVFRSLWGTIGENVANGKYRTYPKIVGETGGKNFHLVHSSAEIKSAVVNAVRAAFEYQGQKCSALSRLYVSKYAWENGFRDELTKQVKSLKVGAPLTDFANFVGPVIHQASFNKLKKVLESAASDSEIEVLAGGKADDSEGFFVEPTVLLSKNPKHDIFVNELFGPVLSVYVYEDDNLDAVCDLIDTTTPYGLTGSIFAQDRVVVRKLTDRLRNAAGNFYINDKCTGAVVGEQPFGGARASGTNDKAGSGMILSRFVSPRSIKDTFAYADSVLYPSNF

SEQ ID NO: 12506 - DNA, 3804 bp, Rhizobium meliloti
  CDS (130)..(3804)
tgtcgtggagaaacattcggccatcaggctaatttgccggatggatgttcggcgatggcacgcgtattttctgccacgacatcagggcgtcgaaagcgcccgctaccgttccgtggaggacagcgttcaatgagcccgaacccgcttcagaaacccgcgatcgacgccgcacctgcgcccttcgccgacttcgcaccgccagtccggccgcaaagcacgctgcgccgggcgatcacggccgcttaccgccgcccggaaacggaatgcctgccgcctctcgtcgaggcggccacgcaatcgaaggaaatacgggacgccgccgcaagcaccgcccgcaagctgatcgaggcgctgcgcggcaagcatagtggttccggcgtcgagggactggtgcaggaatattcgctttcgagccaggaaggcgtggcactcatgtgccttgcggaacggcctgtgcgcattcccgatacggcgacgcgcgacgcgctgatccgcgacaagattgccgacggcaactggaaatcgcatctcggcaggagccgttcgctcttcgtcaatgccgcgacctggggacttgtggtcaccggcaagctgacctcgacggtcaacgaccgcacgctcgcggcgcgcgtcacgcgtctcatctcgcgttgcggcgagccggtgatccggcgcggcgtcgacatggccatgcggatgatgggcgaacagttcgtcaccggcgagacgatcgaagcgctgaaacgttctaaggagctcgaggagaaaggcttcagctactcctacgacatgctgcgcgaacggcccacggccgccgacgccgaacgctattacagggactatgagagcgccattcacgcaactgcaaagcctcgcggccgcggcatctatgagggcccgggcatctccatcaagctctcggcgctgcatccccgctataggcaagccgcgcgcgtcatgggcgaattgttgccgagggtgaaggcgctcgctctcctcgccaagaattacgatatcggcctcaacatcgacgccgaggaagccgaccggctggaactgtcgctcgatctcctcgaggtgctctgcctcgacggcgatctctccggctggaacggcatgggcttcgtcgtgcaggcctatggcaaacgctgccccttcgttctcgacttcatcatcgatcttgcccggcgctccggccggcgcatcatggtgcggctggtgaagggtgcctattgggatgccgagatcaagcgggcgcagctcgacgggctcgcggatttcccggtcttcacgcgcaagatccacaccgacgtctcctatatgcctcggacccaagctgcttgccgcgaccgatgtggtgttccgcaattcgcgacacacaatgcccaaacgctcgccgccatctaccacatggccggcaaggactttcacgtgggcaaatacgaattccagtgcctgcacggcatgggcgagccgctttatgaagaggtcgtcggccgcggcaagctcgatcgcccctgccgcatctatgcgcctgtcggcacccatgagacgctgcttgcctatctggtccggcgcctcctcgaaaacggcgccaactcctccttcgtgcatcgcatcaacgacccgaaggtttcgatcgacgaactgatcgccgaccccgtcgaagtcgtccgcgccatgccggtcgtcggcgccaagcacgacaggatcgccttgccggccgtactcttcggcgatgcgcggaccaattccgccgggttcgatctttccaacgaggaaacgcttgcgtcgcttacggaagcgctgagggaaagcgcggcaatgaagtggaccgccctgccgcagttcgcaaccggccccgctgccggcgagacgcggacggttctgaaccccggcgaccatcgtgacgttgtcggctcggtgaccgagactcggaagaggacgcacggcgcgccgtgcgcttgccgcagacgcggcgccggattgggcggccgtctcgccgagcgggccgcctgcctcgaccgcgccgccgagctgatgcaggcccgcatgcccacgcttctcgggctgatcatccgcgaggcgggcaaatcggcgctgaacgccattgccgaggtgcgcgaggcgatcgatttcctgcgctactatgccgaacagacgcgccgcacgctcggcccggccacgccgctcggcccgatcgtctgcatcagcccatggaatttcccgctggcaatcttcaccgggcagatcgccgccgcactcgtcgccggcaatcccgtgctcgccaaacccgcggaagagacgccgctgatcgccgccgagggcgtgcgcatcctgcgtgaggccggcattccggcaagcgcgctgcagcttcttccgggcgacggacgcgtcggtgcggcgctggtcgccggccgagacgcgggcgtgatgttcaccggatcgacggaagtcgcgcggctgatccaggcacagcttgccgaccgcctttcgcccgccggccggccggtcccgctgatcgccgaaaccggtggccagaatgcgatgatcgtcgactcctcggcgcttgccggacaggtggtcggcgacgtgatcacctccgccttcgacagtgccggccagcgctgctcggcactgcgtgtgctgtgcctgcaggaggatgtggccggaccgcatcctgacgatgctgaagggcgcgctgcacgacactgcatatcggccgcaccgatcgtcttttccgtggatgtcggcccggtcatcacatcagaggcgaaggacaacatcgagaagcacatagagcggatgcgcgggctcggccgcaaggtcgagcagatcgggctcgcctcggagaccggagtgggcaccttcgtgccgccgacgatcatcgaactcgagaagctttccgatcttcaacgcgaggtcttcgggccggtgctgcacgtcatccgctaccggcgcgacgatctcgaccggctggtggacgacgtcaacgccaccggctacggcctgaccttcgggctccacacgcgcctcgacgagacgatcgcgcatgtgacgagccgtatcaaggcgggcaacctctacatcaaccgcaacatcatcggcgcggtcgtcggcgtccagcccttcggcggccgcggtctttccggtaccggtcccaaggccggcggtccgctttatctcggccgcctggttacgaccgcaccggtgccgccgcagcacagctcggtgcacacggacccggtccttctcgacttcgccaaatggctcgacggcaaaggcgcgcgcgcggaggtcgaagcggcccgcaacgccggcagcagctcggcacttggcctggatctggaactccccggccccgtcggcgaacgcaatctctatacgctccatgcgcgcggccgcatcctcctcgtgccggcgacggagagcggtctataccaccagctcgccgctgcgctcgcgaccggcaacagcgtcgcgatcgatgccgcctccggtctgcaggcttcgctgaagaacctgccgcagaccgtcggcctgcgtgtctcctggtccaaggactgggccgccgacggcccgttcgccggtgcgctggtcgaaggtgacgccgagcgcatccgcgcggtcaacaaggctatcgccgccctgcccggcccgctgctgctcgtgcaggccgcatcgagcggggagatcgcccgcaacccggacgcctattgcctgaactggctcgtggaagaggtttccgcctcgatcaacacggctgcagccggcgggaatgccagcctgatggcgatcggctga

SEQ ID NO: 12507 - protein, 1224 aa, Rhizobium meliloti
MSPNPLQKPAIDAAPAPFADFAPPVRPQSTLRRAITAAYRRPETECLPPLVEAATQSKEIRDAAASTARKLIEALRGKHSGSGVEGLVQEYSLSSQEGVALMCLAERPVRIPDTATRDALIRDKIADGNWKSHLGRSRSLFVNAATWGLVVTGKLTSTVNDRTLAARVTRLISRCGEPVIRRGVDMAMRMMGEQFVTGETIEALKRSKELEEKGFSYSYDMLRERPTAADAERYYRDYESAIHATAKPRGRGIYEGPGISIKLSALHPRYRQAARVMGELLPRVKALALLAKNYDIGLNIDAEEADRLELSLDLLEVLCLDGDLSGWNGMGFVVQAYGKRCPFVLDFIIDLARRSGRRIMVRLVKGAYWDAEIKRAQLDGLADFPVFTRKIHTDVSYMPRTQAACRDRCGVPQFATHNAQTLAAIYHMAGKDFHVGKYEFQCLHGMGEPLYEEVVGRGKLDRPCRIYAPVGTHETLLAYLVRRLLENGANSSFVHRINDPKVSIDELIADPVEVVRAMPVVGAKHDRIALPAVLFGDARTNSAGFDLSNEETLASLTEALRESAAMKWTALPQFATGPAAGETRTVLNPGDHRDVVGSVTETRKRTHGAPCACRRRGAGLGGRLAERAACLDRAAELMQARMPTLLGLIIREAGKSALNAIAEVREAIDFLRYYAEQTRRTLGPATPLGPIVCISPWNFPLAIFTGQIAAALVAGNPVLAKPAEETPLIAAEGVRILREAGIPASALQLLPGDGRVGAALVAGRDAGVMFTGSTEVARLIQAQLADRLSPAGRPVPLIAETGGQNAMIVDSSALAGQVVGDVITSAFDSAGQRCSALRVLCLQEDVAGPHPDDAEGRAARHCISAAPIVFSVDVGPVITSEAKDNIEKHIERMRGLGRKVEQIGLASETGVGTFVPPTIIELEKLSDLQREVFGPVLHVIRYRRDDLDRLVDDVNATGYGLTFGLHTRLDETIAHVTSRIKAGNLYINRNIIGAVVGVQPFGGRGLSGTGPKAGGPLYLGRLVTTAPVPPQHSSVHTDPVLLDFAKWLDGKGARAEVEAARNAGSSSALGLDLELPGPVGERNLYTLHARGRILLVPATESGLYHQLAAALATGNSVAIDAASGLQASLKNLPQTVGLRVSWSKDWAADGPFAGALVEGDAERIRAVNKAIAALPGPLLLVQAASSGEIARNPDAYCLNWLVEEVSASINTAAAGGNASLMAIG

SEQ ID NO: 12508 - DNA, 1509 bp, synthetic construct
  CDS (1)..(1509)
atgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcattgtag

SEQ ID NO: 12509 - protein, 502 aa, synthetic construct
MSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGPTAGAAISSHMDIDKVAFTGSTEVGKLIKEAAGKSNLKRVTLELGGKSPCIVLADADLDNAVEFAHHGVFYHQGQCCIAASRIFVEESIYDEFVRRSVERAKKYILGNPLTPGVTQGPQIDKEQYDKILDLIESGKKEGAKLECGGGPWGNKGYFVQPTVFSNVTDEMRIAKEEIFGPVQQIMKFKSLDDVIKRANNTFYGLSAGVFTKDIDKAITISSALQAGTVWVNCYGVVSAQCPFGGFKMSGNGRELGEYGFHEYTEVKTVTVKISQKNSL

SEQ ID NO: 12510 - DNA, 1692 bp, Caenorhabditis elegans
  CDS (1)..(1692)
atgctctcattcgcagctcgacgctccttaatcacacaaaaatgcgccgccagcacgtacagcggtctaacatcggcggattttctcaaaaagaagacaaatgagccgattttagagtatcgaaaaggaagcaaagaacgacaggatttggaggcagcgttggcgttctacagcaagaacatcacagaagttccattgagaattggcgacaagaaaatcacgaataaattggagcagaagcaagttattccctctgaccatcgttcaacacttgccaagtacacttatgccaccggagagcaaattcaagaagccatcgatgtggctcttcaggcgagaggcgcctgggagagaaaaccgcttaaagaacgagctgaaattttgctccgcgccgccgatttggccgctggaaagtaccgaatgaagctgaacgcctccacgatgctcggccagggaaagaatattattcaggctgaaattgacgccgcctgtgagctcatcgatttcttccgattcaacgcggttttcgctatggagctggagcattatgagccgatttccacgaaaatcaccaaaaatacgatgcagttccgtggaatggagggattcgtcgccgcaatcgcaccgttcaattttacggcgatcggaggaaatttgccgactgctccggcgcttatgggtaacgtctccctctggaagccatcgaacaccgccgtgctctccaattatataatctacgaactcctcgaggaagctggtatgccacctggaattctctcattcttgccatcagatggccccgttttcggtgacgtcatcaccgcatctccacacttgagcgctgtcaatttcactggctccgtgccaactttcaagacgatttggagaaaagtcgccgagaatttggataactatgtgacttttccgaaactcatcggagaatgcggcggaaaaaacttccactttgtgcatccatccgcccacgtggacgctgtcgccgctggaaccgcccgttccgcctgggaatattcgggacaaaagtgctcggcgtgctccaggatgtacgcgccaaaatcgatttggccaaagattctcgagaaaatctcggcgattcacaaagagatcaagcttggagatgttcgcgatggatccgtctttctgtcggctgtgatcgatgataaggcgtttgccaggctcaaggcctacattgactttgcgaaaaccggagccgacggagcaaatgtggtgctcggcggaaaatgtgacgacaaaacgggatacttcatcgagccgaccctgatcactgtgacggatccgaagagcaagcttctcactgaggaaatgttcggaccggtggtgacggtactggtctacgaggattcgaaggttgatgaggtgctcgcgactgtgaaagacgcgacaccttatgggctgactggcgccgttttttcgcaggataaggagttcctttatagagctcgcgatgttctccgcgacgccgtcggcaacatgtacctcaacgacaaatcaactggatcaatcgtcggccagcagccattcggaggctccagattgtccggaaccaatgataaggccggtggcccccactatgggctccgatggacctcgccgctgacgattaaggagacgtcggtgtcattgactgactggaaatatccatcaatggaataa

SEQ ID NO: 12511 - protein, 563 aa, Caenorhabditis elegans
MLSFAARRSLITQKCAASTYSGLTSADFLKKKTNEPILEYRKGSKERQDLEAALAFYSKNITEVPLRIGDKKITNKLEQKQVIPSDHRSTLAKYTYATGEQIQEAIDVALQARGAWERKPLKERAEILLRAADLAAGKYRMKLNASTMLGQGKNIIQAEIDAACELIDFFRFNAVFAMELEHYEPISTKITKNTMQFRGMEGFVAAIAPFNFTAIGGNLPTAPALMGNVSLWKPSNTAVLSNYIIYELLEEAGMPPGILSFLPSDGPVFGDVITASPHLSAVNFTGSVPTFKTIWRKVAENLDNYVTFPKLIGECGGKNFHFVHPSAHVDAVAAGTARSAWEYSGQKCSACSRMYAPKSIWPKILEKISAIHKEIKLGDVRDGSVFLSAVIDDKAFARLKAYIDFAKTGADGANVVLGGKCDDKTGYFIEPTLITVTDPKSKLLTEEMFGPVVTVLVYEDSKVDEVLATVKDATPYGLTGAVFSQDKEFLYRARDVLRDAVGNMYLNDKSTGSIVGQQPFGGSRLSGTNDKAGGPHYGLRWTSPLTIKETSVSLTDWKYPSME

SEQ ID NO: 12512 - DNA, 4501 bp, Agrobacterium tumefaciens
  CDS (706)..(4392)
gaattcgcaaagcattagacgggtaggctcatgcctgcccgtttttcttcgccgcgtcgtcagataccggtctccttgaccgactgcatcacgacgaatgtcgaagtgttggaaaccgatggaaggctggagattttttcgccgagcacccttcggtatttgcggatatcgctggtgcgcaccttcagtagataatcgaaggcgccggcgatcatgtggcattcctccacctccttgatcttgcgcaccgccgtgttgaattcctcaagcgccttttcgcgtgtgtcggaaagcttgacctcggcgaaggcgatatggtcgacgcccagtttctgcggattgagcaccgcacggaagcccagaatataaccttcatccaccaaccgcttgagccgcgtctggcacggcgtcttggagaggccgacccttttcgacagttgcagcaccgacatgcgcccgtcttcgctgagggcctcgagaatcttgagatcgaagtggtccagatcgtctgttttatgactattagccatgtgatttcacgccaattttgaataataaaagttcatatggcctgttctatcctcaaaataggaccatagcaatttttacggcaatgatattgtacacagcagaatgacaagcggcgagcggaggacacgctgccgctgacagtctgtcttcaacagctttttcaggattttcagaatggccgatggtgcaagcaaagccgatgtaaacccgcagcagacggtgaacggtattttccagaattttgcaccgcccgtgcgcgagcagagcccgttgcgcaaagcaattaccgccgcttaccgccgcccagaggaagagtgcctggcgcctctgatcgatgctgcgaccgtcacgcccgagcaggccgcagccattcgcaccacggcaaccaagctgatcgaggcgttgcgcgccaagacgaaaggcaccggcgtcgaggggctggtgcaggaatattcgctctccagccatgagggcgtggccctgatgtgccttgccgaagcactgctgcgcattcccgacaccgccacccgcgacgcgctgatccgcgacaagatcgcccgcggcgactggaagtcccacatcggcggcgggcgctcgctgttcgtcaacgccgcaacctggggtcttgtcatcaccggcaagctgacctcgacggtcaatgacagcggcctttcggcggcgctgaccaagctgatcgccagggctggcgaacccgtcattcgccgcggcgtcgatatggcgatgcgcatgatgggcgaccaattcgtgaccggcgaaacgattggggaagcgatcaagcgctcgaaaccgctggaggaacagggtttccaatattcctacgacatgctcggcgaagcggcgaccaccgccaaggatgcggagcgttattacaaggactacgaaaacgcgatccacgccattggcaaggcctccgccgggcgtggcatctatggtggccccggaatttccatcaagctttcggccctgcatccgcgttatgcccgtgtgcaggcagagcgggtaatggcggagcttctgccgcgtgtgaaatccctgatgctgctcagcaagaaatacgatatcggcctcaacattgacgccgaggaagccgaccggctggaactgtcgctcgatcttctggaggaactggcgctcgacaaggatcttgccggttggaacggcctaggcttcgttgtgcaggcctatggccgccgctgcccctttgttctcgactacatcatcgatctcgcccaacgtgccggtcgccgcatcatggtgcgtcttgtcaagggcgcctactgggatgcggagatcaagcgcgcacaggtggacgggctggaagacttcccggtcttcacccgcaaagtgcacacggatgtctcctatatcgcctgcgcccgcaagctgcttgccgcgcgtgacgtcgtgttcccgcaatttgcgacccacaacgcccagtccatggctaccatctaccatctcgctggtccggacttcaaactcggtgattacgagttccagtgcctgcacggcatgggcgaaccgctttacagcgaagtcgtcggcaagaaaaagctcgatcgtccctgccgcttttatgcgcctgttggcacccacgagacgctgcttgcctatctcgtccgccgtctgctggaaaacggcgcgaactcctccttcgtcaaccgcatagcagatcccgccgtgccggtggcttccctgctggaagatccggtcaccgtggtcaaggcttaccccgttcccggcgcacggcacgaccgcattgctgcacccgctggtctcttcggccccgaacgggcaaattccgccggcctcgatctttcgaatgaaacggcacttgccgcgctggacaacgtccttaaggcaggtgcgacgacggaatggaaagccgcagcaccgcatgcaggcggaaagacacgcccggtcctcaatcccggcgaccacaatgatgtcgtcggttatgtaaccgaaccgacagaggccgatgtcgaagcggcaatgcaacgggccgcagcctccaactggtcttccacgccggtcgaggagcgcgccgcctgcctggagcgcgctgccgaccggatgcaggccgaaatgccggccctgcttggcctcatcatgcgcgaggccggaaaatccatgccgaacgccattgccgaggtgcgcgaagcgattgacttcctgcgttattacgcagcggaagcccggaagaccttcaaggccaacgagacaccgctcggcccggtcgtctgcatcagcccgtggaacttcccgcttgccatcttcatcggccaggtaacggcagcactggttgccggtaatccggtactggcaaagcccgccgaagaaaccccgttgatcgccgcgcagggggtacgcctgctgcatgaggcaggcgttccgcaggacgccgtgcagcttctgccaggtgacggcaagaccggtgcggcactagtcggctcagcgctcacggcgggtgtgatgttcaccggatccactgaagtggcgcggctcatccagggtcaactcgcaggccgggttctcgcaaacggccagcccgttcccctgattgccgagaccggcggccagaacgccatgatcgtcgattcctcagcgcttgccgagcaggtcgtcgccgacgtcatcgcctctgccttcgacagtgccggccagcgttgctcggcgcttcgcattctctgcctgcaggaagatgtggccgaccgaaccctgacgatgctgaagggcgcgctgcacgaattgcgcatcgggcgcaccgatagcctttccgtcgatgtcggccccgtgatcaccgctgaagctaaaggcatcatcgaaaaacacgttgacagcatgcgcgcactcggccaccggatcgagcagatttcgcttgccggcgaaaccggcaagggcaccttcgtgccaccgacaatcatcgagatgaaatcgctcgccgatcttaagaaagaggtcttcgggccggtgctgcacgtcatccggttcaagcgcgacaatctcgaccggctgatcgacgagatcaacgccaccggctatggcctgaccttcggcctgcatacgcgtcttgacgataccatccagcatgtcctgtcgcgcgtcgcggccggtaatctctatgtgaaccgcaacatcatcggcgccgtggtcggcgtccagccctttggcgggcgaggcctctccggcaccggccccaaggcgggcggtccgctctatctcggccgcgtcacacaaaccgcgccgaagatcgaccgcgttgccagccagcaggaccaggcggctgtcgatctcgcccgctggctggatgaaaacggccagagcgttgcagccgaagccgcaagacaggccgcagccctatccggcctcggtttcgaaaccgaactggcaggcccagtcggcgaacgcaacgtctatgcgctgcatccgcgcggcaaggtgctgcttattccggccacggagcaagggctctatcgccagcttgcggcagcgcttgccaccggcaactcggtcgttatcgataatgcgtcggggctggaaaagtcgatctacggattgccggcaaccgtcacctcgcgcatcacatgggctgacagctgggaaaaatccgcaccgttcgccggcgcgctgatcgagggcgatgcggaacgtgtcgttgcgatcaacaagaaaatccccgccctgcccggtcctctggttctggttcaggccgccacgacggaagcgcttgaccgtgaaacccagccctacaatctcgactggctggtggaagaagtctccgtcagcgtcaacacaacggctgccggcggcaatgccagcctgatgagcatcggctgattatctggttccggcagggtctcgaccctgccggtccatcacatcacccaccgatttcaccacgaccgaaaagctggttcagaacctgctcttcaagccgcgcgaattc

SEQ ID NO: 12513 - protein, 1228 aa, Agrobacterium tumefaciens
MADGASKADVNPQQTVNGIFQNFAPPVREQSPLRKAITAAYRRPEEECLAPLIDAATVTPEQAAAIRTTATKLIEALRAKTKGTGVEGLVQEYSLSSHEGVALMCLAEALLRIPDTATRDALIRDKIARGDWKSHIGGGRSLFVNAATWGLVITGKLTSTVNDSGLSAALTKLIARAGEPVIRRGVDMAMRMMGDQFVTGETIGEAIKRSKPLEEQGFQYSYDMLGEAATTAKDAERYYKDYENAIHAIGKASAGRGIYGGPGISIKLSALHPRYARVQAERVMAELLPRVKSLMLLSKKYDIGLNIDAEEADRLELSLDLLEELALDKDLAGWNGLGFVVQAYGRRCPFVLDYIIDLAQRAGRRIMVRLVKGAYWDAEIKRAQVDGLEDFPVFTRKVHTDVSYIACARKLLAARDVVFPQFATHNAQSMATIYHLAGPDFKLGDYEFQCLHGMGEPLYSEVVGKKKLDRPCRFYAPVGTHETLLAYLVRRLLENGANSSFVNRIADPAVPVASLLEDPVTVVKAYPVPGARHDRIAAPAGLFGPERANSAGLDLSNETALAALDNVLKAGATTEWKAAAPHAGGKTRPVLNPGDHNDVVGYVTEPTEADVEAAMQRAAASNWSSTPVEERAACLERAADRMQAEMPALLGLIMREAGKSMPNAIAEVREAIDFLRYYAAEARKTFKANETPLGPVVCISPWNFPLAIFIGQVTAALVAGNPVLAKPAEETPLIAAQGVRLLHEAGVPQDAVQLLPGDGKTGAALVGSALTAGVMFTGSTEVARLIQGQLAGRVLANGQPVPLIAETGGQNAMIVDSSALAEQVVADVIASAFDSAGQRCSALRILCLQEDVADRTLTMLKGALHELRIGRTDSLSVDVGPVITAEAKGIIEKHVDSMRALGHRIEQISLAGETGKGTFVPPTIIEMKSLADLKKEVFGPVLHVIRFKRDNLDRLIDEINATGYGLTFGLHTRLDDTIQHVLSRVAAGNLYVNRNIIGAVVGVQPFGGRGLSGTGPKAGGPLYLGRVTQTAPKIDRVASQQDQAAVDLARWLDENGQSVAAEAARQAAALSGLGFETELAGPVGERNVYALHPRGKVLLIPATEQGLYRQLAAALATGNSVVIDNASGLEKSIYGLPATVTSRITWADSWEKSAPFAGALIEGDAERVVAINKKIPALPGPLVLVQAATTEALDRETQPYNLDWLVEEVSVSVNTTAAGGNASLMSIG

SEQ ID NO: 12514 - DNA, 1545 bp, Symbiobacterium thermophilum
  CDS (1)..(1545)
atgattcctccctatcgccctgagcccctgagcgacttccgcaacccggcggtcacggccgccttcgagcaggccctggccgcggtgaagacgcagttggggaagcgctatcccatgatcatcgccggccggcgcgtggagtccggcgagagcatcgtgtccgtcaacccgtcgcagcccgaccaggtggtgggctacgcagcccggggcggcgtcgccgaggccgaggcggccgtgcaggcggccctggcggccttcccggcctgggccgatacgcccgccgatgtccgggcccggatcctgttcaaggccgcggcgatcatgcgccgccgccggcacgagctgtcggcctggatgtgccacgaggtgggcaagaactgggccgaggccgatgccgataccgccgaggccatcgacttcctggagtactacggccggcagatgctgaagctggccgcgccgcagccgctcactccctatcccggtgaggagaaccacctctactaccggccgctgggggtgggggtggtccacagcccgttcaacttcccgctggcgatcctgaccgggatgaccgcggcggccatcgtcacgggcaacaccgtggtggtgaagccctccaccgaggcgccggtgatcgcggccaagctctttgagatcctggaggaggccgggctgccggcgggcgtggccaacctgctgtacgccgacccggtggagatgggcgattacctcacgacccacaaggaggtccgcttcatcaacttcaccggctcgcgccaggtcggctgccacatctacgagctggccgcgaaggtgcagcccgggcaggtcttcctccggcgggtgatcgcggagatgggcggcaaggacgccatcatcgtcgacggcaccgctgacctggacgaggcggccgccggcatcgtgacctccgccttcggcttcagcggccagaagtgctcggcctgctcccgggcggtggtgaccgccgacgtgtacgaccaggtgctggagaaggtggtggccaggacccgggcgctgaaggtggggccggccactgagaaggacaccgacgtcggccccgtggcggcggaacggttccagaagaagatcctggagtatatcgagatcggcaaggccgagggccgcttggtgctgggcggaaacgccctgcccgggggctattacgtggagccgaccatcttcgcggacgtggccccgaccgcccgcatcgcccaggaggagatcttcgggccggtgctggcgttcatcaaggcgagggacttcgacgacgccctgcgcatcgccaacaacaccccgtacgggctgaccgggtccgtgtactcccggagccgggagaacctggagcaggcccgccgccggttccgggtcgggaacctctacttcaaccgcaagtccaccggcgcgatcgtcggcgtccaccccttcggcgggttcaacatgagcggcaccgattccaaggccggcggccccgactacctgctgctcttcacccaggcgcaggcggtgtcggagaagctgtag

SEQ ID NO: 12515 - protein, 514 aa, Symbiobacterium thermophilum
MIPPYRPEPLSDFRNPAVTAAFEQALAAVKTQLGKRYPMIIAGRRVESGESIVSVNPSQPDQVVGYAARGGVAEAEAAVQAALAAFPAWADTPADVRARILFKAAAIMRRRRHELSAWMCHEVGKNWAEADADTAEAIDFLEYYGRQMLKLAAPQPLTPYPGEENHLYYRPLGVGVVHSPFNFPLAILTGMTAAAIVTGNTVVVKPSTEAPVIAAKLFEILEEAGLPAGVANLLYADPVEMGDYLTTHKEVRFINFTGSRQVGCHIYELAAKVQPGQVFLRRVIAEMGGKDAIIVDGTADLDEAAAGIVTSAFGFSGQKCSACSRAVVTADVYDQVLEKVVARTRALKVGPATEKDTDVGPVAAERFQKKILEYIEIGKAEGRLVLGGNALPGGYYVEPTIFADVAPTARIAQEEIFGPVLAFIKARDFDDALRIANNTPYGLTGSVYSRSRENLEQARRRFRVGNLYFNRKSTGAIVGVHPFGGFNMSGTDSKAGGPDYLLLFTQAQAVSEKL

SEQ ID NO: 12516 - DNA, 1641 bp, Desulfotalea psychrophila
  CDS (1)..(1641)
atgaatcttttgaataatgcagtaattaatacaccaaaacctattaatgaaccaatttatgattatgctccgggtagtcctgaacgaagagcactgaaggctgccttagaagagatgagtcagcttgttctggatattcctcttattattaatggcgaggagattcgtacgggcaatatcggacaggtggttatgccccatgatcacagacatgtgatggctcactatcacagggcaggggagaaggcggtacggctggccattgacgcagctcttgctgctcagtccaggtggcagtccatgcgttgggaagaacgttgtgcaattttcctgaaggctgcggaacttattgcaggtaaatatcgttataaaattaatgccggagccatgcttgctggcgggaaaacagcctatcaggcggaaattgatgcggcctgtgaactcatagattttcttcgttttaatgtcagctatgcagagcagatttataagaatcagcctgtctcctccccgggagtgtggaactttgttcagtaccgtcctcttgagggatttgtctttgccgtaacgccctttaactttaccgctattgccggtaaccttcccactgccccggccctgatgggcaacaccgtggtgtggaaacctgcctcttccctggtttacaccccctatctcttgatggaaatttttgcggaggccggtctgcccccgggcgttatcaattttgttcccggtgcaggtgcctctgtgggtgatatctgtcttgccgaccctaatcttgcaggtattcattttaccggttcaacggctgtctttcagtttatgtggaagacagtgggtaataatattgcaagctataaatcttatcctagaattgttggagaaacaggaggtaaggattttatctttgcccattcatcggcagatccccagcaaattgttacagccattgttcgtggtgcctttgagtatcagggacaaaagtgctcagccgcatctcgggcctatattccccgtactctttggctggtgatagaggagggtttgaagagagaaattgcaaaaataaaggtgggggcaactacagatttttctaattttataagtgcagtaattgataagggtgcatttagttcgattactagttatattgacttcgccaaggaaaatgagggtggagatgtgatcattggcggcggttatgatgatagtcttggctactttatcgaaccaacggttattctcgcaactgacccctgttttgagacgatggttgaagagatttttggtcctgttataagcatctatgtctatgaagatgaggattatatggagaccttagctctctgtgatagtacatctgtctatgctttaaccggagcaattttttcacgggacagagaggcgaccagtactgccctgacgaaacttgagcatgctgcaggaaatttctatatcaatgataagccaacgggaccagtggttggtcagcagccttttggcgggggtagggcttcgggtaccaacgacaaggccggcgcagccagtaatctgatgcgttgggtgtcccctcgaaccgttaaagagacctttgtcgctgccacagagttttcctatccatttatggatgaaaattaa

SEQ ID NO: 12517 - protein, 546 aa, Desulfotalea psychrophila
MNLLNNAVINTPKPINEPIYDYAPGSPERRALKAALEEMSQLVLDIPLIINGEEIRTGNIGQVVMPHDHRHVMAHYHRAGEKAVRLAIDAALAAQSRWQSMRWEERCAIFLKAAELIAGKYRYKINAGAMLAGGKTAYQAEIDAACELIDFLRFNVSYAEQIYKNQPVSSPGVWNFVQYRPLEGFVFAVTPFNFTAIAGNLPTAPALMGNTVVWKPASSLVYTPYLLMEIFAEAGLPPGVINFVPGAGASVGDICLADPNLAGIHFTGSTAVFQFMWKTVGNNIASYKSYPRIVGETGGKDFIFAHSSADPQQIVTAIVRGAFEYQGQKCSAASRAYIPRTLWLVIEEGLKREIAKIKVGATTDFSNFISAVIDKGAFSSITSYIDFAKENEGGDVIIGGGYDDSLGYFIEPTVILATDPCFETMVEEIFGPVISIYVYEDEDYMETLALCDSTSVYALTGAIFSRDREATSTALTKLEHAAGNFYINDKPTGPVVGQQPFGGGRASGTNDKAGAASNLMRWVSPRTVKETFVAATEFSYPFMDEN

SEQ ID NO: 12518 - DNA, 1719 bp, Yarrowia lipolytica CLIB99
  CDS (1)..(1719)
atgctccgatccgtttcgaaattcagagctcccctcgcccgatcttgtcgatccttcaccaccattggagtgcctggtaccccaggaaacggtaccttctccatccctgaaatcaagaacgagcccgtccgagactttgagccgggatccaaggaccgccagggcgtcctcaactccctgaagacaatcaaggagtctgtgcacgagatccccgtcgtcattgccggccgaaagtactggtccgagaagaccggatcccagtacaacccctacgacaagaaggagatcgccaaggtgtcccaggccacccccgaggacgtgaccttcgccatcgagaccgccatgggcgccaagaaggaatgggccaacgcctccttcgccgaccgagccgccgtcttcctcaaggccgctgagctcatcgctggcaagtatcgatacgacatgcttgctgccaccatgattggccagggcaagaacgtgtaccaggccgagatcgacaccacctgcgagctggccgacttcctgcgattcaacgttaagtacgcccaggagctctaccaggtccaacccgccgagaactcgcccggcgtgtggaaccgagctgagtaccgagccctcgacggtttcgtctacgccgtcacccccttcaacttcaccgctatcgctgccaacctggttggtgcccccgccctcatgggtaacactgtcgtgtggaagccctctgccgccgccgtgctctccaactactacctctaccagattctgattgaggccggtctgcccgagggagtcgtctcctttgtgcctggtaacgcccaggaggtgaccaagaccgttcttggctccgaggactttgcttctctgcacttcaccggctctactggtgtcttccagactcttaaccaggagattgctgcccacctgcccgagtacaactcctacccccgaattgttggtgagactggaggaaagaactaccatctcattcaccctactgccgacctgtcccacgctgtcaagtccaccgtccgaggtgcctttgagtaccagggccagaagtgctctgcctgctcccgagcctacgtccccgagaacatgtgggaggacttcaagaaggagatccaggccgaagtcaagaacgtgaccgtcggtgatgccaccacccccgagggctttgcatcttttgccggtcccgtcattcatcagcagtcctttgacaagctcaagggtgtcatcgatgctgccaagaaggacgactctctcgagctggtcgccggaggcaagtacgacgactccaagggcttctacgtcgagcccaccatctacgtgacccgggatcccgatcaccccaacctcaagaccgagttcttcggccccattctcaccgtctgcctgtacgacgaggtcaagttcctcgagacctgcgaggttgtcgacaagaccaccaagtacggactcaccggcgccatcttcgcctccgaccgatacgtcatctcccaggcttccgagcgactgcgatactccgctggaaacttctacatcaacgacaagtgcactggtgccgttgttggccagcagtggttcggaggaggccgacagtccggaaccaacgacaaggctggttccggcaacattctgtctcgatttgtttctatccgaaacatcaaggagaacttccgagagaccgacaacatcctctacccttccaactacaactaa

SEQ ID NO: 12519 - protein, 572 aa, Yarrowia lipolytica CLIB99
MLRSVSKFRAPLARSCRSFTTIGVPGTPGNGTFSIPEIKNEPVRDFEPGSKDRQGVLNSLKTIKESVHEIPVVIAGRKYWSEKTGSQYNPYDKKEIAKVSQATPEDVTFAIETAMGAKKEWANASFADRAAVFLKAAELIAGKYRYDMLAATMIGQGKNVYQAEIDTTCELADFLRFNVKYAQELYQVQPAENSPGVWNRAEYRALDGFVYAVTPFNFTAIAANLVGAPALMGNTVVWKPSAAAVLSNYYLYQILIEAGLPEGVVSFVPGNAQEVTKTVLGSEDFASLHFTGSTGVFQTLNQEIAAHLPEYNSYPRIVGETGGKNYHLIHPTADLSHAVKSTVRGAFEYQGQKCSACSRAYVPENMWEDFKKEIQAEVKNVTVGDATTPEGFASFAGPVIHQQSFDKLKGVIDAAKKDDSLELVAGGKYDDSKGFYVEPTIYVTRDPDHPNLKTEFFGPILTVCLYDEVKFLETCEVVDKTTKYGLTGAIFASDRYVISQASERLRYSAGNFYINDKCTGAVVGQQWFGGGRQSGTNDKAGSGNILSRFVSIRNIKENFRETDNILYPSNYN

SEQ ID NO: 12520 - DNA, 1455 bp, Erwinia carotovora
  CDS (1)..(1455)
atgtcaggaaaccatttacaggatcatgaactgtttaaaacgggctacttcgttgcggggaagtggcagcagggcgcagccactttcgaggtggtgaatccggcgacgggtgagtctattgcccgtgtagcgaaagcgggaaagaaagagacgcaggcggcgattgacgctgcccatgccgcattccccgcctggaagcgtaaaaccgcgaaggaacgttctgaaattctgtatcgctggtacgagctgattctggagaataaacgctatctggcggagttgatgaccgccgagcagggcaaaccggtgcaggaagccgaaggcgaagtcgtttatgcggcgaatttcattcagtggtttgctgagcagggaaaacgcgtcaacggcgaaattattccccccgccaagcccggttcgaagatttatgccacgcgtgaacccgttggcgtcgttgttgcgattacgccgtggaatttcccgctggcgatgttgacgcgtaagttaggaccggcgctggcggcggggtgtaccggcgtgataaaacccgcgaacaacacgccgctgtctgcatttgcactgttggcgctggcacaacaggcgggcgtaccggatggtgtactcaacggtgtcgcgggcgatacgcaggcgattagcgataccgtcatggcgagcgataaagtacgcaaaatctcctttactggctcaacggcagtagggaaaacgctggtgcgcaacgccgccgacaccatgaagaaagtgtcgatggaactgggtggtaacgcgccttatatcgtgtttgatgatgcggatattcaggccgcggtgaaaggcgcgatcgctaaccgctttcgtaatgcaggtcaggtttgcgtcagcgccaatcggttttatattcaggacggcgtctatgatgagtttgtttccctgcttgcggaagaagtgaaaaagctgaaggtcggcaacggtatggatgacggtgtcgtgctcggcccactgattgacgaggctgctgtcgagaaggtggaaaaacacgtcaatgatgcggtggagaaaggcggcaaggcgcttgttggcggtaaacgacacaagctgggccacagcttttttgaaccgacagtgattgttgacgctaacgaagcgatgctgcttgcgcaggaagaaacctttggcccggttgccccgtgttttcgtttcaaaacggaagaagaggtgattcaacgcgccaacaatacgccgtttggtctggcggcttatttctacagccagaatttgcagcgtgtgttccgcgtggcagaagcgttggagagcggcatgattggcattaacgaatgtgccgtttcgactgagcttgcgccatttggcggcgtgaaagaatcggggctaggccgcgaaggctctgtactggggctagacgagtttctggaagtgaaaacctggcacgtgggcgggttgtga

SEQ ID NO: 12521 - protein, 484 aa, Erwinia carotovora
MSGNHLQDHELFKTGYFVAGKWQQGAATFEVVNPATGESIARVAKAGKKETQAAIDAAHAAFPAWKRKTAKERSEILYRWYELILENKRYLAELMTAEQGKPVQEAEGEVVYAANFIQWFAEQGKRVNGEIIPPAKPGSKIYATREPVGVVVAITPWNFPLAMLTRKLGPALAAGCTGVIKPANNTPLSAFALLALAQQAGVPDGVLNGVAGDTQAISDTVMASDKVRKISFTGSTAVGKTLVRNAADTMKKVSMELGGNAPYIVFDDADIQAAVKGAIANRFRNAGQVCVSANRFYIQDGVYDEFVSLLAEEVKKLKVGNGMDDGVVLGPLIDEAAVEKVEKHVNDAVEKGGKALVGGKRHKLGHSFFEPTVIVDANEAMLLAQEETFGPVAPCFRFKTEEEVIQRANNTPFGLAAYFYSQNLQRVFRVAEALESGMIGINECAVSTELAPFGGVKESGLGREGSVLGLDEFLEVKTWHVGGL

SEQ ID NO: 12522 - DNA, 3789 bp, Acinetobacter sp
  CDS (1)..(3789)
atgtcattggaatttggcatgaatatgatggataacgaccctcaaatggacacagcaaaacctcattttggatatatttcagaatttaaagaaaaaactgaactggagcagcatatcaacgatgcttggcgtcgtcctgaaccagaaacagttgaaactttgctacaagctgcctctatttccgatgaactcaatcataaaatttatgagctggcttttgagctagccaatggactacgtgagcgcaaaacctcttctggaaaagctggaatcgttcaaggacttttacaggagttttcgctttcttctcaggaaggtattgctttaatgtgcctggcagaagctctgctacgtattcccgatgcagccacccgagatttattgattcgagataaaatcaatcaaggcaactggaaagatcatgtgggtcagagtagcctgatgtttgtcaatgctgcagcttgggggctcatgctgacaggcaaacttatggaaacgccgaaacaaggcagtttgtctgggttattaacttcaattttggcacgtagtggtcgaggtgtgattcgtaaagcagtcgatgttgcgatgcgaatgatgggtgaacaatttgttacgggtgaaaccattgaagaagcgctcgacaatgcaaaatctcatgaacataaaggatttcgttattcctacgacatgctgggtgaagccgctctaacaacgcatgatgccgaacgttattttaatgattatacgcaggccatccatgcgattggtcaggcatcgaatggcaaaggtgtgtatgatgggccaggaatttcaattaaactttcggcactgcatccacgctaccaacgttcacaaattgcacgagtgcatgatgaactctatggcaaagtgtttaatcttgccttactctccaaaaaatatgatattggtttaaatattgatgctgaagaagcagatcgccttgagatttctttagaattacttgaacgtctatgctttgagcccgaacttgcagactggaaagggatcggttttgtgattcaagcttatcaaaagcgttgtttctacgtcgttgattatgtcgttgatctggcaaaacgtagcaaaaaacgcctgatgattcgtttggtgaaaggtgcgtattgggatagtgaaatcaaaaaagcacaaattgatggtatgcacgattatccagtctttacccgtaaagtgcatactgatttatcttatattgcttgtgccaaaaaactgttagcagcacctgagcaaatctatccgcagtttgccacgcataatgcacaatcacttgctacaatttatgaacttgctgatccaggcaaatattatgcaggccaatacgaatttcaatgcttacatggcatgggcgaacccttatacgaacaagtagtaggttctcgcagtgacaaaaaactggggattccatgccgtatctatgcacctgtaggcaatcatgaaaccttacttgcctatctggtacgtcgattgctcgaaaatggtgctaacacatcatttgtgaatcgtattgctgatcaaaatctaaaaattgaagatttaatacaatcaccttttgatgaaattgcaattaacgcacaacgtgaaggtcaagctggattaaaacatcctgccattcctttaccacacaatttgtatggatcattacgtcaaaattcgaaaggttttgatcttgccaatgatgcaactttgacagcgttgaacgaaactgcacagcagcttgaacataaagtctgggaaagtagacctttactagctcaaactgttgatcaaattgatgtaagcccgcaagcgttgctaaatccagcggttcatttagatattgtgggctacgttcaggaagcgacgcttgagcaagttgatgttgcgctcgaatctgcaactcaggctcagcaggcctgggcaaataccgagaaaaaccatcgggcagctacactcaagaaagcggcaaacttgatggaatcacgtatgcaggaactcatggtcttgctgtgccgtgaagcaggtaaaacttatgcaaacgcaatttcagaagttcgtgaagcagtagatttcttacgttattatgccactcaaatcgaaagtctgaagcctactgctcaaatcgagccgttaggtacagtcctgtgcattagcccctggaactttccattggcaatttttacaggccagattgctgcggcacttggtgctggaaactgtgtcattgcaaaacctgccgaacagacaccattaattgcggcacaggctgtacatattttacatgaagcgggtattcctaaaagtgtactacagcttttaccaggccgtggtgaaactgtcggcgccaagctcagtagtgaccagcgtattcaaggtgtcatgtttactggctcaacagaagttgccaagattttgcaaaaaacggtagcaaaacgactttcgccttctggtcatcctattcctttaattgcggaaactggtggtcaaaatgccatgattgtcgactcatctgccttgacagagcaagtggtgattgatgtcttgaattcagcttttgacagtgcaggtcaacgttgttcagctttacgtattttatgcgtacaagaagacaattcaaaaacactagtgactatgctcaaaggtgcaatgcagcaactgattatgggtaatccatttctgctcaaaaccgatattggtccagtgattgatttagaggcaaaacaaaccattgatcaacatattcagaaaatgcgcagcaaaggttatcccgtatatcagttaatttttaatcatgaagcagcatcgcaagcgcaattgagccaaggaacatttgtcactccaaccttgattgaattacccaatcttgatgatctggaacgtgaagtatttggccctgtgttacatgtcattacttataaacatggtgaaataaaacagctacttcaacatattaatgccaaaggttatggtttgactatgggattgcatactcgtatcgatgaaaccatcaatacagtggtacaacatgccgaagtgggtaatctttacattaatcgtaatatcgtgggtgcagtggtaggtgtacaaccatttgggggtgaaggcttatcaggtacagggcctaaagcaggtggtccgctttacttatatcgtttaatggcatcttgcacagaaaaagcaatacagactccttttggtataccagcagaaaatgttgcagtgccattaacgcaactctcgttattccgcgagttttcggcgtggattaaaaagcagtatcctgcccatcaacttcctaatgtcgtgccattgaatgtcggtcatgcttttgacctacaaggcccgacaggtgaaaccaaccgctatatgatgttgccacgtaaacgtatactggcaatagcaagtaatgaattggaactatgtcatcaaatgctggcgatatttgcagtaaacagtcaagttgctttattagaaagtaatccttctttgcaaaaatttggacaggatttacccacagtagttcgtcaggcgattattgaaattcgtggtgttgagcatggcgattttgatgcagtcttacatcatggttcaactgaggagttgcaagttttacaaacacagattgcaaatcgtcaaggtccgattgtcggcattactcatttgcaaaattcagagcaagtcattccactcgagcgtctcgtcattgaacatgctattagtgtaaatacggcagcggctggtggtaatgcgagtttgatgaccatgtcggagtaa

SEQ ID NO: 12523 - protein, 1262 aa, Acinetobacter sp
MSLEFGMNMMDNDPQMDTAKPHFGYISEFKEKTELEQHINDAWRRPEPETVETLLQAASISDELNHKIYELAFELANGLRERKTSSGKAGIVQGLLQEFSLSSQEGIALMCLAEALLRIPDAATRDLLIRDKINQGNWKDHVGQSSLMFVNAAAWGLMLTGKLMETPKQGSLSGLLTSILARSGRGVIRKAVDVAMRMMGEQFVTGETIEEALDNAKSHEHKGFRYSYDMLGEAALTTHDAERYFNDYTQAIHAIGQASNGKGVYDGPGISIKLSALHPRYQRSQIARVHDELYGKVFNLALLSKKYDIGLNIDAEEADRLEISLELLERLCFEPELADWKGIGFVIQAYQKRCFYVVDYVVDLAKRSKKRLMIRLVKGAYWDSEIKKAQIDGMHDYPVFTRKVHTDLSYIACAKKLLAAPEQIYPQFATHNAQSLATIYELADPGKYYAGQYEFQCLHGMGEPLYEQVVGSRSDKKLGIPCRIYAPVGNHETLLAYLVRRLLENGANTSFVNRIADQNLKIEDLIQSPFDEIAINAQREGQAGLKHPAIPLPHNLYGSLRQNSKGFDLANDATLTALNETAQQLEHKVWESRPLLAQTVDQIDVSPQALLNPAVHLDIVGYVQEATLEQVDVALESATQAQQAWANTEKNHRAATLKKAANLMESRMQELMVLLCREAGKTYANAISEVREAVDFLRYYATQIESLKPTAQIEPLGTVLCISPWNFPLAIFTGQIAAALGAGNCVIAKPAEQTPLIAAQAVHILHEAGIPKSVLQLLPGRGETVGAKLSSDQRIQGVMFTGSTEVAKILQKTVAKRLSPSGHPIPLIAETGGQNAMIVDSSALTEQVVIDVLNSAFDSAGQRCSALRILCVQEDNSKTLVTMLKGAMQQLIMGNPFLLKTDIGPVIDLEAKQTIDQHIQKMRSKGYPVYQLIFNHEAASQAQLSQGTFVTPTLIELPNLDDLEREVFGPVLHVITYKHGEIKQLLQHINAKGYGLTMGLHTRIDETINTVVQHAEVGNLYINRNIVGAVVGVQPFGGEGLSGTGPKAGGPLYLYRLMASCTEKAIQTPFGIPAENVAVPLTQLSLFREFSAWIKKQYPAHQLPNVVPLNVGHAFDLQGPTGETNRYMMLPRKRILAIASNELELCHQMLAIFAVNSQVALLESNPSLQKFGQDLPTVVRQAIIEIRGVEHGDFDAVLHHGSTEELQVLQTQIANRQGPIVGITHLQNSEQVIPLERLVIEHAISVNTAAAGGNASLMTMSE

SEQ ID NO: 12524 - DNA, 1725 bp, Candida glabrata CBS138
  CDS (1)..(1725)
atgttgagtgctaggctataccgtgggagtgtgaggggtgttgcgcagtttgcgcgggcttcgattccgaagcatgtgacgaatgaggctgtgaagccgtttagcaaggatgctgacagcaaggactgggatttgttgcgggcgtcgcttatgaagttcaagagctcgtcgcttgaagttccgctggttatcaacggggagcgtgtgtatgctgaccggggccgtgctgtcttcgcgcagaccaaccctgctaaccatgagcaagtgttggcgaacgtagcgcaggccactcgcgatgacattaagagtgcaattggtgctgctaagcaggccaaggagaagtggtacaacatgccgttctatgacagggctgcgatattcatgaaggcagccgatctgatctctacgaagtacaggtacgatatgctggccgctaccatgctgggccaaggtaagaacgtctaccaagcggagatcgactgtatcactgagctgtcagacttcttcagatttaacgtcaagtatgcggacgagttgtacgctactcagccaattgagtcagtgcccggtatttggaacagggcagagtacagacctttggaaggctttgtgtatgcggtgtctccattcaacttcacggctattgccgcaaacctgattggtgcaccagctctgatgggtaacactgtggtatggaaaccatctcaaaccgctgcgctatctaactacctgttgctgactgtcttggaagaagctggtctccccaagggtgttattaactttgtgccaggtgacccagtagaaattacagatgaagtgttggcaagcagggatttctccgctttgcacttcacaggctctacagcagtgttcaagcaactgtacggtaagatccaaagcggcgttgccgaaaacaaatacagagactacccacgtatcgttggtgaaacaggtggtaagaactaccacttggttcacccttctgccaatgttccacacgcagtctttaacacgatcagaggtgcctttgagttccaaggccaaaaatgttctgctacttctagattgtacttgccaaagtccatgagcgaggaattcttcagagacatgtttggcacgttaagcaacaataaggttgttccagttaacacttctgctagtgccatcagcggtggtaacctgcacggattcatgggcccggttatccacgagcaaagtttcaacaagctatctgctgccatcgaggaagccaagaaagaccctgaactagagattctgtacggtggacaatacgataagagccaaggctggtacattggcccaacgattatcaggaccacaaacccaaaccataaattcttgaccacggagttctttggtcctatattgaccgtttacgagtaccaggactcccaattcaaggatatctgcgaactgataaatgaaaccggcgagtatggtttgaccggttccatcttctccagagaccgtgacgctataatctacgcctctgagaagctaaggttcagcgccggtaacttctacatcaatgacaaatgtacaggtgcagttgtagcacagcagtggttcggaggtgcacgcatgagcggtacaaacgacaaggccggtgggccaagcatcctaagcagattcgtgagtatcagaagcatcaaggagaacatgcaagaaatcaccgacttcagatacccatccaactacgagtaa

SEQ ID NO: 12525 - protein, 574 aa, Candida glabrata CBS138
MLSARLYRGSVRGVAQFARASIPKHVTNEAVKPFSKDADSKDWDLLRASLMKFKSSSLEVPLVINGERVYADRGRAVFAQTNPANHEQVLANVAQATRDDIKSAIGAAKQAKEKWYNMPFYDRAAIFMKAADLISTKYRYDMLAATMLGQGKNVYQAEIDCITELSDFFRFNVKYADELYATQPIESVPGIWNRAEYRPLEGFVYAVSPFNFTAIAANLIGAPALMGNTVVWKPSQTAALSNYLLLTVLEEAGLPKGVINFVPGDPVEITDEVLASRDFSALHFTGSTAVFKQLYGKIQSGVAENKYRDYPRIVGETGGKNYHLVHPSANVPHAVFNTIRGAFEFQGQKCSATSRLYLPKSMSEEFFRDMFGTLSNNKVVPVNTSASAISGGNLHGFMGPVIHEQSFNKLSAAIEEAKKDPELEILYGGQYDKSQGWYIGPTIIRTTNPNHKFLTTEFFGPILTVYEYQDSQFKDICELINETGEYGLTGSIFSRDRDAIIYASEKLRFSAGNFYINDKCTGAVVAQQWFGGARMSGTNDKAGGPSILSRFVSIRSIKENMQEITDFRYPSNYE

SEQ ID NO: 12526 - DNA, 1545 bp, Staphylococcus aureus
  CDS (1)..(1545)
atggtagtagaatttaaaaatgaacctggttacgatttttcagtccaagaaaatgtggatatgtttaagaaagcattgaaagacgtggaaaaagaattaggtcaagacataccattagtgattaatggagagaagattttcaaagatgacaaaattaaatcaatcaatcctgcagacacatcacaagtgattgcaaatgcatcaaaggcaacaaaacaagatgttgaagatgcgtttaaagcagcaaacgaagcttataaatcttggaaaacatggtcagcaaatgatcgtgcagagcttatgttacgtgtttcggcaattattcgtcgtcgaaaagcggaaattgcagcaattatggtttatgaagcaggtaagccatgggatgaagcagttggtgatgcagctgaaggtattgattttattgaatactatgcacgttcaatgatggacttggctcaaggtaagccagtacttgatcgtgaaggtgaacacaataaatatttctataaatcaattggtacaggtgttacaattccgccgtggaacttcccgtttgcgattatggctggtacaactttagcaccagttgtggcaggtaatatagtgttattgaaacctgctgaggatacaccttatatcgcttataaattaatgggaattttagaagaagcaggattaccaaaaggcgtagttaactttgttcctggtgatccgaaagaaattggtgattacttagttgatcataaagatacgcatttcgttacatttacaggatcacgtgcgacaggtactagaatttatgaacgtagtgccgttgttcaagaaggtcaaaacttcttgaaacgtgttatcgctgaaatgggtggtaaagatgccattgtagttgatgaaaatattgatacagatatggcagcagaagctattgtaacgtcagcatttggtttttctggtcaaaaatgttcagcatgttcacgtgcaattgtgcataaagacgtttatgacgaagtattagagaaatcaatcaaattaacaaaagaattaacgttgggcaatactgtagacaatacgtatatgggcccagttattaataaaaaacaatttgataagattaaaaattatattgagattggtaaagaagaaggtaaattagaacaaggtggcggcactgatgattcaaaaggttactttgtagaaccaacaatcatttcaggacttaaatctaaagatagaatcatgcaagaagaaatttttggtccagttgttggctttgtgaaagttaacgattttgatgaagcaattgaggttgcaaatgatacagattacggtttaactggtgcagtgattacaaataatcgcgagcattggattaaagcggtaaacgaatttgatgtaggcaatttataccttaacagaggctgtacttcagcagttgttggataccatccatttggtggtttcaaaatgtcaggtacggacgctaaaacaggtagtccagactacttattacacttcttagaacaaaaggttgtttcagaaatgttctaa

SEQ ID NO: 12527 - protein, 514 aa, Staphylococcus aureus
MVVEFKNEPGYDFSVQENVDMFKKALKDVEKELGQDIPLVINGEKIFKDDKIKSINPADTSQVIANASKATKQDVEDAFKAANEAYKSWKTWSANDRAELMLRVSAIIRRRKAEIAAIMVYEAGKPWDEAVGDAAEGIDFIEYYARSMMDLAQGKPVLDREGEHNKYFYKSIGTGVTIPPWNFPFAIMAGTTLAPVVAGNIVLLKPAEDTPYIAYKLMGILEEAGLPKGVVNFVPGDPKEIGDYLVDHKDTHFVTFTGSRATGTRIYERSAVVQEGQNFLKRVIAEMGGKDAIVVDENIDTDMAAEAIVTSAFGFSGQKCSACSRAIVHKDVYDEVLEKSIKLTKELTLGNTVDNTYMGPVINKKQFDKIKNYIEIGKEEGKLEQGGGTDDSKGYFVEPTIISGLKSKDRIMQEEIFGPVVGFVKVNDFDEAIEVANDTDYGLTGAVITNNREHWIKAVNEFDVGNLYLNRGCTSAVVGYHPFGGFKMSGTDAKTGSPDYLLHFLEQKVVSEMF

SEQ ID NO: 12528 - DNA, 1485 bp, Bacillus thuringiensis
  CDS (1)..(1485)
atgagtcaactagctgtaaatcttcatgaaaaggtagaaaagtttcttcaaggtacgaaaaagttatatgtgaatggatcattcattgaaagcgcttccggtaagacgtttaatacacctaatccagcaactggcgaaacacttgccgtcgtttctgaagccggtcgcgaagatattcataaagctgtagttgcagctcgcatggcttttgacgaaggtccttggtctcgcatgagcactgcggagcgaagccgtcttatgtacaagttagctgatttaatggaagaacataaagaagagcttgcacagctcgagacgttagataacggaaagccaatccgtgaaacaatggcagcagacataccacttgcaattgagcacatgcgctattatgctggctgggcgacaaaaatcgttggtcaaacaatccctgtttccggtgatttctttaactatacacgccatgaagctgttggtgtcgttggtcaaattatcccttggaacttcccgcttcttatggccatgtggaaaatgggagcagcgcttgctacaggatgtacaatcgttttaaaacctgcagaacaaactccactatctgctctatacttagctgaattaattgaagaagctggattcccgaaaggcgttattaatatcgttcctggattcggtgaatcagctggacaagctctcgttaatcatccactcgttgataaaattgcatttaccggttctactccagtcggtaaacaaattatgcgacaagcatctgaatccttgaaacgtgttactttagagcttggtggtaaatcaccgaacattattttaccagacgctgatttatctcgcgcaattcctggtgcactttctggtgttatgtttaaccaagggcaagtatgctctgctggatcacgcctatttgttccgaagaaaatgtatgataatgtcatggctgatctcgtcctctattctaaaaaactaaatcaaggtgtcggtcttgaccctgaaacgacaattggtcctctcgtttccgaagaacaacaaaaacgtgtaatgggctacattgaaaaagggattgaagaaggcgctgaagtactttgcggaggaaataatccattcgatcaaggctacttcatttctcctacagtattcgctgacgtaaatgacgaaatgacaatcgcaaaagaagaaattttcggtccagttatttctgcaataccttttaacgatattgatgaagtaattgaacgagcaaataaatcacaattcggcttagcggctggtgtgtggacagaaaatgttaaaacagcacactatgttgcaagtaaagtacgtgcaggtacagtatgggttaactgttacaacgtctttgatgcagcatctccatttggaggatttaaacaatctggtctcggccgtgaaatgggatcttacgcattaaataactatacagaagtgaagagcgtttggcttaacttaaattaa

SEQ ID NO: 12529 - protein, 494 aa, Bacillus thuringiensis
MSQLAVNLHEKVEKFLQGTKKLYVNGSFIESASGKTFNTPNPATGETLAVVSEAGREDIHKAVVAARMAFDEGPWSRMSTAERSRLMYKLADLMEEHKEELAQLETLDNGKPIRETMAADIPLAIEHMRYYAGWATKIVGQTIPVSGDFFNYTRHEAVGVVGQIIPWNFPLLMAMWKMGAALATGCTIVLKPAEQTPLSALYLAELIEEAGFPKGVINIVPGFGESAGQALVNHPLVDKIAFTGSTPVGKQIMRQASESLKRVTLELGGKSPNIILPDADLSRAIPGALSGVMFNQGQVCSAGSRLFVPKKMYDNVMADLVLYSKKLNQGVGLDPETTIGPLVSEEQQKRVMGYIEKGIEEGAEVLCGGNNPFDQGYFISPTVFADVNDEMTIAKEEIFGPVISAIPFNDIDEVIERANKSQFGLAAGVWTENVKTAHYVASKVRAGTVWVNCYNVFDAASPFGGFKQSGLGREMGSYALNNYTEVKSVWLNLN

SEQ ID NO: 12530 - DNA, 1425 bp, Bacillus thuringiensis
  CDS (1)..(1425)
atgaaaaagcatttatatataaatggagattggaagtctgtaaacacgtataaaccattatacgcaccatattctgaagaaacattagcggaaattgcgcaaggaacggaagaagatgtaaaagaggctgttgctgctgcaaaaaatgccatgaaagaaatgaatacattatctgcatatgatcgtgcgactattttagagaaagtcgcacaaaaaatggatgaaagaagagaagaatttgcagagattattgcaaaagaggctgcaaaaccaatacgtgctgcaaggggagaagtagatcgtaccgttcaaacatataaatttgcagctgaagaagcgaagcgtatatacggtgagacactgccacttgatgcagcacctggtgcagatgggcgtattgcatacacaatacgaaaaccgattggggttataggggctattacaccatttaattttccattaaatttagtggcacataaagttggtcctgcaattgctgctggaaatacagttgtattaaaaccagctgatcaaacgcctctatcatcttacgcattaatcgaactatttgaagaggcaggattgccaaaaggagctttaaatattatttctggccccggttcaactgttggtgaagcaatagttacaaatgatgatgtggcttccattacttttacaggaagtccgaaagttggaattggaattaaggcaaaggctgggttaaagcgagttacgttagaactaggatcaaatgctgcagttattattgatgaagatgtagaattaacagatgaattaattgaacgtgtaaaatggggagcatttgttaataatggacaagtttgtatttcggtgcaacgtgtttttgtacatgaagagagaatggatgactttctatcaaagttacggaaagcgatggaaacagttgttgttggtgatccgctgattgaggaaacggatgtatcagctttaatttcgaaaaaagatgtcgagcgtatcgataactgggtgcaagaagcggttaaagaaggagcaaacgttttatatggcggtaacaaacgtgatgaaagggtttttgaaccaactgtattaacaaatgtgccggagcatgtatctgtacagtgccaagaagtattcggcccacttatgacagtaaatacatttaaagaatttgatgaggccatagagcaagtaaataattcacgttacggtctacaagcaggcgtatttactaataatttgtttaaagcaatgcgtgcaattgatgaattagaagttggtggtgtcatgataaatgatattccgacgtttagagtagatcatatgccttacggtggtgtgaaagaaagcggtacagggcgtgaaggaattaaatatgcaatagaagaaatgacagaaatgaaattagtatgtattaaaaaataa

SEQ ID NO: 12531 - protein, 474 aa, Bacillus thuringiensis
MKKHLYINGDWKSVNTYKPLYAPYSEETLAEIAQGTEEDVKEAVAAAKNAMKEMNTLSAYDRATILEKVAQKMDERREEFAEIIAKEAAKPIRAARGEVDRTVQTYKFAAEEAKRIYGETLPLDAAPGADGRIAYTIRKPIGVIGAITPFNFPLNLVAHKVGPAIAAGNTVVLKPADQTPLSSYALIELFEEAGLPKGALNIISGPGSTVGEAIVTNDDVASITFTGSPKVGIGIKAKAGLKRVTLELGSNAAVIIDEDVELTDELIERVKWGAFVNNGQVCISVQRVFVHEERMDDFLSKLRKAMETVVVGDPLIEETDVSALISKKDVERIDNWVQEAVKEGANVLYGGNKRDERVFEPTVLTNVPEHVSVQCQEVFGPLMTVNTFKEFDEAIEQVNNSRYGLQAGVFTNNLFKAMRAIDELEVGGVMINDIPTFRVDHMPYGGVKESGTGREGIKYAIEEMTEMKLVCIKK

SEQ ID NO: 12532 - DNA, 1548 bp, Picrophilus torridus
  CDS (1)..(1548)
atgttctataatgaaaacacatacataaaaatgaaggcctctgggaaagaggatgaatttgataaaaagtatgaggaggcacttgaatctgtaaagggctattttggaaaggagtacccaaatataataataaatgacgtaaatgaggagaaaaaaataaaggacatatcaccaatagatgagagcgagcttgcagagtttcagcttgcatcaaaggagagcattgaaagggccatagatattttaagttctggttataaaaaatggtttcaggtaccgtatgatgcaagggtgaatataatagaaaaagctttgaggatgctccaggaaagaaaatttgaatttgccgcattgcttacatatgaaaacggaaaaaacagatacgaggccatgggtgatgttgatgaggcaatagactttatgaaatattattctatgagcatgatagagaaccacgggttcataaaatttacaggaaaggcatatgaaaacgaagaatcaatgagttttatgaaaccatatggtctttttgcagttatatccccatttaatttcttttccataggtgttggcatgaccaccggacccttgataacaggcaatgccgtgctgttaaaaccaagcagcgatataccattatcgctttatctgtttgtaagattattaatcgaggcgggcgttaataaagatgcaatagcctttgtctctggaacaggaagcctcataggcgatataataacagaaaataaaaaggtctccggtgtggtttttacaggctcaagggatgttggcctcagaatatttaaaaatgccacaaagtatggcccaaagcctgttataacagaaatgggaggcaaggacgccgttataatatcagataaggctgatttaaaaaaggccgttgagggctgtgtaagatcatccttcggctttgcaggccagaaatgcagcgcgtcatcattaatatatgtccatgaaaagatctacgatgagttcattgaaaaatttgttgagagaacaaagagtataaaggttggtgacccaagggagaaatcaacgtttatgaaccctgttgttaacaaagatgcatatgaaaaatacaagaagatgtgtgatacatacttcaaggaggggaaaatattaacaggcgcaagaatcatggatagaaagggttactacgttgagcccacagtaatcacagatttaaaaccggattcttacatagtaaggaatgagatatttttacctgcagttgcaattataaaggtaaaatccatagatgacgcgataaatgatataaattctatggactatgggcttacaggtggaattttcacagaggatccagaggagtaccagcattactttgaaagtgtggatgttggcgttgtatacgcaaacagggcagcaggtgcatcaaccggtgcaatggtgggctcacagccattcgtcggctggaagctaagtggaagcactggcaagggaactggatcattttattatctaacgcagtttttaagggagcagtccattaccatagcccactaa

SEQ ID NO: 12533 - protein, 515 aa, Picrophilus torridus
MFYNENTYIKMKASGKEDEFDKKYEEALESVKGYFGKEYPNIIINDVNEEKKIKDISPIDESELAEFQLASKESIERAIDILSSGYKKWFQVPYDARVNIIEKALRMLQERKFEFAALLTYENGKNRYEAMGDVDEAIDFMKYYSMSMIENHGFIKFTGKAYENEESMSFMKPYGLFAVISPFNFFSIGVGMTTGPLITGNAVLLKPSSDIPLSLYLFVRLLIEAGVNKDAIAFVSGTGSLIGDIITENKKVSGVVFTGSRDVGLRIFKNATKYGPKPVITEMGGKDAVIISDKADLKKAVEGCVRSSFGFAGQKCSASSLIYVHEKIYDEFIEKFVERTKSIKVGDPREKSTFMNPVVNKDAYEKYKKMCDTYFKEGKILTGARIMDRKGYYVEPTVITDLKPDSYIVRNEIFLPAVAIIKVKSIDDAINDINSMDYGLTGGIFTEDPEEYQHYFESVDVGVVYANRAAGASTGAMVGSQPFVGWKLSGSTGKGTGSFYYLTQFLREQSITIAH

SEQ ID NO: 12534 - DNA, 1482 bp, Picrophilus torridus
  CDS (1)..(1482)
atgaaaatttacatagatggtgagtggagggattcatccagcggcgagaccataaaaaagtacaatccaagcacaggcgaggttcttgatacgtttccggcggcaacaaggaatgatgttgatgctgcaattgactctgcagaggatgcattcaaaagatggagcgacatgacgtcaatggaaaggtcaaaaatactttacaaagcccttgaattaatatcaaaggataaagatcagctaacggatcttttaattaaagagaacggaaaggtgaaaagggaggccatggatgaaaccgagggcgttatagaccagttacagtattacacggaattcgagagaaagctaaccggtgacatcgttgaaggcacaagcaataaaagaaagatatttcaatacaaggttccatatggaatagtaatagcaataacgccatggaacttccctgcagcaatggtgataagaaagcttgcgcctgcacttttaactggaaacaccgtaatattaaagccaagctcagacacaccattaactgcggaatggctcgtgaaaaaatttgttgatgccggaataccaaagggcgttttaaatctaataacaggcaagggctctgaaataggtgattacatcgttgagcataaaaaggtatcattgataacaatgaccggatcgacatccacgggccagaggatcatggaaaaggcatcaaagaacatggcaaaattgatacttgagctcggcggaaaggcaccgttcatggtctggaaggacgcaaacattgaaagggcattaaagtccctggtctgggcaaagtatttaaacgttggccagtcatgcatagccgctgaaagattatacatacacgaggatatatacgatgaatttatgaaaaagttcattgaggtaagcaaaagaataaaacttggagacccggagagctctgacatgggcccattgataaataaaagcgcggttgaaacaacggaaaaatacgttgatattgcaaggagctcgggatataaaatactccttggcggcaaaaaaccggagctatcaggaaaatacaaaaatggatacttctatgaaccgacgataatagaaaacgttccacaggattcgccattattccaggaggagatctttggcccggtcataggcgcagagagtgtatccagtgtcgatgaattatacgaaaaggcaaatgattcaaagtacggacttgcctcttatttattcacagaggatcctgagttaatatttgaggcatccgagaagataaggttcggtgagttgtacgtcaacatgccagggcctgaggcatcacaggggtatcatacaggattcagattgacaggacaggccggcgagggaagcaagtacggaatctcagaatacctaaagttaaagaacgtctacgttgattactcaagggggaatctaagcataagcactgtaaacgacgacctattcaaaaatctttaa

SEQ ID NO: 12535 - protein, 493 aa, Picrophilus torridus
MKIYIDGEWRDSSSGETIKKYNPSTGEVLDTFPAATRNDVDAAIDSAEDAFKRWSDMTSMERSKILYKALELISKDKDQLTDLLIKENGKVKREAMDETEGVIDQLQYYTEFERKLTGDIVEGTSNKRKIFQYKVPYGIVIAITPWNFPAAMVIRKLAPALLTGNTVILKPSSDTPLTAEWLVKKFVDAGIPKGVLNLITGKGSEIGDYIVEHKKVSLITMTGSTSTGQRIMEKASKNMAKLILELGGKAPFMVWKDANIERALKSLVWAKYLNVGQSCIAAERLYIHEDIYDEFMKKFIEVSKRIKLGDPESSDMGPLINKSAVETTEKYVDIARSSGYKILLGGKKPELSGKYKNGYFYEPTIIENVPQDSPLFQEEIFGPVIGAESVSSVDELYEKANDSKYGLASYLFTEDPELIFEASEKIRFGELYVNMPGPEASQGYHTGFRLTGQAGEGSKYGISEYLKLKNVYVDYSRGNLSISTVNDDLFKNL

SEQ ID NO: 12536 - DNA, 3126 bp, Photobacterium profundum
  CDS (1)..(3126)
atgttcaatgcggcagatgtacttcagccatcctttattgagcgtccgttaaacgaaatctggacactgatttcgccgctctattctgttgatgagtcgttatggctagagcagctattacctttggctgagccgtcagatatagaacgtaaacacacgacagataaagctgctgaacttattcagcgcgtgcgtgccgataaaaatgcgattcaaatgattgatgcattgttattggagtacagcctagataccaaagaaggtattttgctgatgtgtttagcagaagccttgatgcgtattcctgatgccgcaacggctgatgcccttattcgcgacaaactcagtgttgctgattggaagtctcaccttaaaaattctgattctctgtttgtgaatgcctctacttggggtctgatgctgacgggaaaagtggtcacaatggatgccaaagaagacggtaagccatctcatgtgattaatcgcttagtgaataagatgtctgagcctgtgattcgtcaagcgatgaatcaggcgatgaagatcatgggtcaccagtttgtgctggggcgtacgatttcagaagcaatgaaaaatggtaagagtaaccgtgacaaaggcttcacttattcatttgatatgctgggcgaagcggcattaacggcgcaagatgctcaaaagtattttaaagattacatcatggcggttgaatctgttggtcgtgatgagtatgcaagccaaaaaggcagcaatcaacaatcgccggatccaacggtgtctataaagctatctgctttgcacccccgttacgatgtagcgaatgaagcccgcgtattagatgaaatgtatgaatcagtactgacattgctttcacgtgcgcgtgaattgaatgtgggtattacgattgatgctgaagaagccgatcgtcttgagttgtcattaaagttatttgaaaagctatatcgttcagatgcagtaaaaggctggggtcgatttggtatcgttgttcagtcttactctaagcgtgcactacctgtattggcatggttagcggcgttaagtaaagcgcagggcgatattattcctttacgcttggtgaaaggtgcctattgggacagtgaattaaagctttctcagcaaagcggttttagtgactacccagtctttacccgtaaagagtcaacagatagcgcatatcttgcgtgtgctcgtttcttattgtctgagcatttacgtggtgtgatttatccgcagtttgctagccataacgcacatacaatttcagctattgtggcgatgactgatcaccgcgattttgaattccaacgtctgcatggcatgggtgatgcgctttataatcatgcaatggacatgtaccaagcgaatgtacgtatttatgcgcctgttggcagccataaagatttgctgccgtaccttgtacgtcgtttacttgagaacggtgctaacagctcgtttgttcaccgtttggttgatgccaattgcccgattgaatcattaacagagcatccggtagataccttacgctcgcgtccttcgttaaataacagccttattccactgccaccccagatctttggtgagagccgtaaaaactctgccagcattaatattgatattgaatctgagtggacaccgttcaatgctgctattcaggcatttagtcagcatcaatggcaggctggtcctatcgtaaatggcgtaacgcttgatggcgaacaacacgccattacagctccttataatcgttctgaaagtgtcgggcaggttgcattttctagtgcgagccaagttgctcaagccattgatgttgcaagtgaagcatatcctgcatggtcacaagttgctgcttctgagcgtggtgagtgcttacagcgtttagctgatttacttgaacttcacactggtgagctggtcgccctttgtcatcgtgaagcgggcaaaacaattcaagacagcattgatgaaattcgtgaggccgtggatttctgtcgtttctatggtgaacaggcatcgtctgaactcgccagtgcgaaatcaattaaaagctttgatggttcaaccaagcagctgacctatcaaggccgcggtgtgtttgcatgtattagcccatggaatttccctctggcgattttcttagggcaagtatctgcggcattggctgcgggtaatactgttgttgccaagcctgctgaacaaacctcgttgattgcttaccgtgcgattgaattaatgctagaagcgggtattcctgctggcgcgattcaattattaccgggtacgggtgctgaagtgggtgcaacactcacaacagatgtgcgtattgcgggtgtcgcgtttaccgggtcaactgaaacagcccaacgcattaaccgttctttagtcgcacgtgattgtgaagcggttccgtttattgcagaaaccggcgggcagaatgcgatgatcgttgatagtaccgcgttgccagagcaagtagtgcgtgatgtggttcgttctgcctttgcatcagctgggcagcgttgttctgcgttacgggtgttatttgttcaagccgatattgccgatcgcataattacgcttatcaaaggtgcgatggctgagctatctgtcggacgccctgagttacacagtaccgatgttggccctgttattgatatcgcggcaaaagaaaagctgttaactcacattgagtcgttaaagaatcaatcgacactagtggctcaaactcagctgagtgatgaatgtaagttgggtgactttgttgcaccaacagcatttgaaattaacagtattgatattttgaaaaatgaaaacttcggcccaattcttcacatcgttcgttttaaagcgaatgaaatcgatcaggttgtcgatcagattaatcacacagggtttggtctaacgctgggtgttcacagccgtaacgagcgtacttattgccgtatcgagcaacgcgctcgggtgggtaactgctacatcaatcgtgatcaagtcggtgctgtggtgggtgttcagccgtttggcggacaaggcctatcgggcacaggtccaaaagcgggtggcccacactacctataccgcttcactaaagatgtactgagtgcgtaa

SEQ ID NO: 12537 - protein, 1041 aa, Photobacterium profundum
MFNAADVLQPSFIERPLNEIWTLISPLYSVDESLWLEQLLPLAEPSDIERKHTTDKAAELIQRVRADKNAIQMIDALLLEYSLDTKEGILLMCLAEALMRIPDAATADALIRDKLSVADWKSHLKNSDSLFVNASTWGLMLTGKVVTMDAKEDGKPSHVINRLVNKMSEPVIRQAMNQAMKIMGHQFVLGRTISEAMKNGKSNRDKGFTYSFDMLGEAALTAQDAQKYFKDYIMAVESVGRDEYASQKGSNQQSPDPTVSIKLSALHPRYDVANEARVLDEMYESVLTLLSRARELNVGITIDAEEADRLELSLKLFEKLYRSDAVKGWGRFGIVVQSYSKRALPVLAWLAALSKAQGDIIPLRLVKGAYWDSELKLSQQSGFSDYPVFTRKESTDSAYLACARFLLSEHLRGVIYPQFASHNAHTISAIVAMTDHRDFEFQRLHGMGDALYNHAMDMYQANVRIYAPVGSHKDLLPYLVRRLLENGANSSFVHRLVDANCPIESLTEHPVDTLRSRPSLNNSLIPLPPQIFGESRKNSASINIDIESEWTPFNAAIQAFSQHQWQAGPIVNGVTLDGEQHAITAPYNRSESVGQVAFSSASQVAQAIDVASEAYPAWSQVAASERGECLQRLADLLELHTGELVALCHREAGKTIQDSIDEIREAVDFCRFYGEQASSELASAKSIKSFDGSTKQLTYQGRGVFACISPWNFPLAIFLGQVSAALAAGNTVVAKPAEQTSLIAYRAIELMLEAGIPAGAIQLLPGTGAEVGATLTTDVRIAGVAFTGSTETAQRINRSLVARDCEAVPFIAETGGQNAMIVDSTALPEQVVRDVVRSAFASAGQRCSALRVLFVQADIADRIITLIKGAMAELSVGRPELHSTDVGPVIDIAAKEKLLTHIESLKNQSTLVAQTQLSDECKLGDFVAPTAFEINSIDILKNENFGPILHIVRFKANEIDQVVDQINHTGFGLTLGVHSRNERTYCRIEQRARVGNCYINRDQVGAVVGVQPFGGQGLSGTGPKAGGPHYLYRFTKDVLSA

SEQ ID NO: 12538 - DNA, 3648 bp, Parachlamydia sp
  CDS (1)..(3648)
atgattgaaaatgccttatttcaaattcattcagtcaaaggaaaaaaactttcattacaagaaaggcaagatctggcgatttcgttagcagctaaaatgttaaaagaggcgcaatatattcaaacaaaagttgaaaaaaggcaacaagcagaacttgctggaatgatgaacgattccgttggtaagatttttacaaccgtcttaacagaccagtgttttagaagtcttcaaaatagtagagtggctgatcagcttgcgcaagtcattcacaaatatggaatccccatctacttatcggataaaaaacgactagccttaaaagcttttagcctagttggtaaaattctctcttctttagcagttcctattactattcgactgattcagaaagaaacaaggcatattattttaccaggagagcctcaagcgtttgctaaacacatgaaaaagaggtgtcaagagggagtaagaattaatcttaatcatctaggtgaagcaattttaggagaagatgaagccaggcgtcgtttgcaaatttatctggatgatttagcaaatcctttgatcgagtatatttctattaaaatttctactatttatagccaaatccatttactggcttgggaagaaacgttagaaattttatctgaaagacttcgcttattgtatcgagcagcaattaaaaataaatatagacgagcaacgggtgaagtcatatcgaaatttgttaatttagatatggaagaatatcgagacttaaacctaacagtcgcactttttaaaaaagttttagatgagcctgagttttttcaatatcaaggcggaattgttttgcaaagctatttacccgattcctttttaattcaacaagagctaacgcagtgggcgatgcaaagagttaatcggatgggagctcctatcaaaatccgccttgtaaaaggtgctaatttagcgatggagcaatttgaatccgctgttcgtttatggccacaggctccttacacaactaaagcagatgtagatgcaaattataaacgaatggtcacgtatggatgcgagtttcaacgtgctcaggcagctcatttagggattgctagtcataatttatttgatatcgcttatgctttattactccgttctgaaaatcacgttgaaaaagaagtctgctttgaaatgctggagggaatggctgatcatattcgacgagttgttcaaactttagcagatgacatgcttctttactgcccaactgccactaaagaagaatttcaaagcgccgttgcttatcttgtcagacgtttagatgaaaatacagctcctgaaaacttcttacgacatgcttttgatttaaggcctggcactgatgattggaataatcaagttcatttgtttaaacaagcttgtcaaaattacgaacaagtttccgatcaacctaggcgtttacaaaatagattgcataaagatcgtttgctcaatcaacgaaaatgtttccaaaatgtggcagatactgactggtcattatctcacaatcgccaatgggcgaaaataattattgatcaatggaaaaataaaaaacatccagatgttcctttagtcattaatggcttccactatacttcagaaaatcgctggggaattggagaagatccctcttttcctggaaaaattttgtatcgctatgcgttagcttccaaagaacaagttgatgaagctttagacgctgcccaaaatgcttatttaaaatggtctgcgacaacttctcaagaacgggccaatttattaataaaaatagcgcaaggtttagagctgcatcgtgctgatttgattggagctatgattgctgatacggctaaaacattgattgaagcagatatagaagtttccgaagcgatcgattttgctaattattatcgcttcaatttattagaatggatgtatttggaagatgtcaagtggagtgctaaaggtgttgttgtcattgctcctccttggaattttccatgttcgatagcggctggcggtattttagcagcattagttactggcaatacggtaattttaaaacctgcttttgagtctgttttagtttgttggcatttagctcaaattttttgggaggcgggaattagccagcaagtgttacaatttgttgtttgcgaagatgaacctgtgggaagcgccttaattcaagattctcgagtgaatgcagttgtcttaactggtgcgacagaaactgcaaaactttttttacgcttaagggcagatttggatttaatggccgaaacgggtggtaaaaacacaatgattataacctctatggctgatcgtgatttagcgattaaagatttggttcaatcggcgtttagtcatgcaggacaaaaatgtagcgcatgtagtttggctattgtagaagcagagacttatgataatcttcactttcgtcagcaattaaaagattctgtagaaagtttatcaatcggttccccgtggaaattaaaatctaaagttaatcctttaattcgtgaagctaaccccaatctgttacgtggtttaacgcagttagaggaaggggaagaatggcttgtacaacctaagcaagatcctcaaaatccttatctgtggagtccgggaattaagcttggtgtaaaaccagggaattttacctataatacagagttatttggacctgttttggggcttgtaagagcagaaaatttcgatgaagccttacacatgatgaatcaaacaggctacggtttaacagcaggtattcataccctagatgaaagagagcagaagcaatggtttcaaaaaatagaggcagggaattgttatattaataggactatgacaggagctattgttgaaagacaaccatttggagggtgtaaagaaagcagttttggaaaaggatcgaaagctggaggtcctaattatctagtgcagtttatgcaaacttctcaaaaaaacttacctacagagcaaaaagagttaaaagaaatgcctctggcatttctaaaaaatgttcagagactaaagtatttgagttccgaagaatatgaaatttttagtttaagtatgaaaaattatgctttctattatgatttatatttttctcgatctcatgatcctagtttagttagagggcaagataatttacaaacttatcgcccgcataatcaaatttcggttagggtacaatcacctgatcgtttagtagacttattacgtttgatagcagcctctattatttgttctacccctttaatgttgagtacagataatcaagagacttaccaaaaattccagtctttacgtttacctcctttcatttcttttaaattggaggctgaatcgacctttatcgaaagattagagcgaggtgagatcaaaagaatgcgtgtgttaagccctttctctaaatctttagaaaatactttagcgaatgcagcttgtcatttaaatagaggggaagtaatggccaatggacgattagaacttcttcattttttaagagaagtaagtttaagttttgattatcacaggtatggaaaccttgccgagcgagaaaaagaatatagacatccattacccggtcataaaggaaaaacctgtttaccttgtggagcttgttgttgtgatggataa

SEQ ID NO: 12539 - protein, 1215 aa, Parachlamydia sp
MIENALFQIHSVKGKKLSLQERQDLAISLAAKMLKEAQYIQTKVEKRQQAELAGMMNDSVGKIFTTVLTDQCFRSLQNSRVADQLAQVIHKYGIPIYLSDKKRLALKAFSLVGKILSSLAVPITIRLIQKETRHIILPGEPQAFAKHMKKRCQEGVRINLNHLGEAILGEDEARRRLQIYLDDLANPLIEYISIKISTIYSQIHLLAWEETLEILSERLRLLYRAAIKNKYRRATGEVISKFVNLDMEEYRDLNLTVALFKKVLDEPEFFQYQGGIVLQSYLPDSFLIQQELTQWAMQRVNRMGAPIKIRLVKGANLAMEQFESAVRLWPQAPYTTKADVDANYKRMVTYGCEFQRAQAAHLGIASHNLFDIAYALLLRSENHVEKEVCFEMLEGMADHIRRVVQTLADDMLLYCPTATKEEFQSAVAYLVRRLDENTAPENFLRHAFDLRPGTDDWNNQVHLFKQACQNYEQVSDQPRRLQNRLHKDRLLNQRKCFQNVADTDWSLSHNRQWAKIIIDQWKNKKHPDVPLVINGFHYTSENRWGIGEDPSFPGKILYRYALASKEQVDEALDAAQNAYLKWSATTSQERANLLIKIAQGLELHRADLIGAMIADTAKTLIEADIEVSEAIDFANYYRFNLLEWMYLEDVKWSAKGVVVIAPPWNFPCSIAAGGILAALVTGNTVILKPAFESVLVCWHLAQIFWEAGISQQVLQFVVCEDEPVGSALIQDSRVNAVVLTGATETAKLFLRLRADLDLMAETGGKNTMIITSMADRDLAIKDLVQSAFSHAGQKCSACSLAIVEAETYDNLHFRQQLKDSVESLSIGSPWKLKSKVNPLIREANPNLLRGLTQLEEGEEWLVQPKQDPQNPYLWSPGIKLGVKPGNFTYNTELFGPVLGLVRAENFDEALHMMNQTGYGLTAGIHTLDEREQKQWFQKIEAGNCYINRTMTGAIVERQPFGGCKESSFGKGSKAGGPNYLVQFMQTSQKNLPTEQKELKEMPLAFLKNVQRLKYLSSEEYEIFSLSMKNYAFYYDLYFSRSHDPSLVRGQDNLQTYRPHNQISVRVQSPDRLVDLLRLIAASIICSTPLMLSTDNQETYQKFQSLRLPPFISFKLEAESTFIERLERGEIKRMRVLSPFSKSLENTLANAACHLNRGEVMANGRLELLHFLREVSLSFDYHRYGNLAEREKEYRHPLPGHKGKTCLPCGACCCDG

SEQ ID NO: 12540 - DNA, 2949 bp, Bdellovibrio bacteriovorus
  CDS (1)..(2949)
atgaacgacattcagtcgcaaattgtctcccgtggtgaagagattctgaaacgcatggaaagccagtccaaggcttccattttctccaaagacttctggtatggctccatcatggaatggagcatgaaaaacgaaaaattcaaaaccaacatgttccgtttcgtggacgtgcttccctccatcaactcgggtgatgaagtcgcgcgccacttgaaagaatacttctctgaagacggcggcaccctgcctccggtgttcaatgtgggacttggtttgggttctttggctccgggcctgatggcgggtgcgatcaaaaagaacgttatgggtatggcaaagatgttcatcactggcgaaagcccggatgaagcattgccggttttgaaaaaagcccgcaaaaacaaaatgaccttcactgtcgacattttgggtgaagcgacactttctgaaaaagaagcgcaagactacagcaacaagtacatggagcttgtgacctggctggcgaaagatgctgaaaaatgggacgaagttccgcagatcgaccgcgaccatgaaggtgctttgccgaaagtaaacgtgtccgtgaaaatgacggcgctttattcccagatcaaagatgcagcctgggatgaatccaaaaaaatcctgaaagaccgtctgcgcccggtgttccgtctgggcatggaaaaaggcgtgttcgtgaatctggatatggaacagtactctgtcaaacacctgacactggaagtattcacagagctgatcaacgaacctgagttcaaaaattacaagttttttggtatcgtgattcaggcttacctgcgcgattccttcgaagacgtcaaatccctgacagagttcgcgcaaaaacgcggcactccgttctgggttcgtctggtgaaaggtgcctactgggattacgaaaccatcgaagcggaacagcgtggatggccggtgccggtttacaccaacaaggccgaatccgacgccaactacgagttgtgcgcgaagtaccttctggaaaacatcaaattcatccgccctgcttttgcatcccacaacgtcagaactttggcggcgtgcatgctttacgcagaaaaactgaacatcccgaaagaggctttggaattccaaatgctttacggcatggcagaacccatcaaaaaaacaatcgtggacatgggctaccgcatgcgtgaatacgctccggtgggcgaactgatcccgggcatggcttacctggtacgccgtcttctggaaaacacgtccaacgaatcctggctgcgtggcaagttcgccgacaacaaatccatggcggagcttttgaaagatccggctcaaggtttgactccgacgtctccggttattccgaaaaaaccaggcaagttctataatgaaccacttttggatttcgccgtaaaagccgaccgtgagaaaatgctgaaagcactggctgaagccaaggcttctttgccggtgaacgtaaacattgtgatcaacaacaaggaacttcagtccggcaagatctttgaccgtgtgaatccgtcccagtccgatcagatcgtgggcaagatccagatggcaacaaccgagcaggctgaacaggcgatgcaagcggcgcaaactgcttacaaaacctggaagaacgttccttgcgaacagcgcgctgccctggtggacaagcttgctgacatcatgacccgtgaccgcttcaaactgattgccacgcaagtgcttgaagtaggtaaaccatgggctgaagctgacggtgacatcggtgaagccatcgacttctgccgttactatgcccgccatatgcgtgagttgcaaaaaccacttcgtgtgggtggcttgccaggtgagctgtctcactacatctacaaatcccgtggtgtgacggcggtgattgctccttggaacttccctctggcgattttggccggcatggtgactgcggcggctgttgcagggaacaccgtggtgatgaaacctgcagagcaatccacagtggttgcctggggcttgatgaaaatgatccaggaagctggattcccacaaggtgtgatcaacttcctgccgggttacggtgaagaagttggcgaatacatcgtgaaccacaagtacacgaccacgatcgccttcacaggttccaaagccgtgggcctgcacatcatgaaccgcgcagcggtggttcaaccaggacagcagcacgtcaaacgttgtatcattgaaatgggcggtaagaacgccgtgatcatcgacaacgatgcggatctggatgaagcagttgatggcgtgatctattctgcgttcggtttcagcggtcagaaatgttctgctgccagccgtgtgatcgtgcttgatgaagtttacgaccgtttcgtggaccgtctggttgaaacagcgaaatccatcgagatccacccggctgaaaatccaaaagcttacatgggtccggttgtcgacaaagaagcttacgaccgtatccttggaacgatcgcagaagctgaaaagaaccacaagctgctgttcaagggctctgtaccgggcggcgggttctttgcgcctccgacgatctttggagacgttccaggtgatgcgaagctggctcaggctgaaatcttcggcccggttgtggctgtgatccgcgcgaaaaacctggatcaggcgttggatatcgccaacagcacagagtacgcgttgacgggtggcgtgttctccagaagccctgcgaacatcaaccgtgtgaaagaggaactggaagtcggaaatctttatgtaaatcgtggtatcacgggcgcaatggtcgaccgtcatccattcggtgggttcaagatgtccggtatcggttctaaaaccggtggaccggattacttaaaacagtacatggaaccagcgtgcgtgactgagaacacacttcgtcgcggctttgctccggcggaagaatag

SEQ ID NO: 12541 - protein, 982 aa, Bdellovibrio bacteriovorus
MNDIQSQIVSRGEEILKRMESQSKASIFSKDFWYGSIMEWSMKNEKFKTNMFRFVDVLPSINSGDEVARHLKEYFSEDGGTLPPVFNVGLGLGSLAPGLMAGAIKKNVMGMAKMFITGESPDEALPVLKKARKNKMTFTVDILGEATLSEKEAQDYSNKYMELVTWLAKDAEKWDEVPQIDRDHEGALPKVNVSVKMTALYSQIKDAAWDESKKILKDRLRPVFRLGMEKGVFVNLDMEQYSVKHLTLEVFTELINEPEFKNYKFFGIVIQAYLRDSFEDVKSLTEFAQKRGTPFWVRLVKGAYWDYETIEAEQRGWPVPVYTNKAESDANYELCAKYLLENIKFIRPAFASHNVRTLAACMLYAEKLNIPKEALEFQMLYGMAEPIKKTIVDMGYRMREYAPVGELIPGMAYLVRRLLENTSNESWLRGKFADNKSMAELLKDPAQGLTPTSPVIPKKPGKFYNEPLLDFAVKADREKMLKALAEAKASLPVNVNIVINNKELQSGKIFDRVNPSQSDQIVGKIQMATTEQAEQAMQAAQTAYKTWKNVPCEQRAALVDKLADIMTRDRFKLIATQVLEVGKPWAEADGDIGEAIDFCRYYARHMRELQKPLRVGGLPGELSHYIYKSRGVTAVIAPWNFPLAILAGMVTAAAVAGNTVVMKPAEQSTVVAWGLMKMIQEAGFPQGVINFLPGYGEEVGEYIVNHKYTTTIAFTGSKAVGLHIMNRAAVVQPGQQHVKRCIIEMGGKNAVIIDNDADLDEAVDGVIYSAFGFSGQKCSAASRVIVLDEVYDRFVDRLVETAKSIEIHPAENPKAYMGPVVDKEAYDRILGTIAEAEKNHKLLFKGSVPGGGFFAPPTIFGDVPGDAKLAQAEIFGPVVAVIRAKNLDQALDIANSTEYALTGGVFSRSPANINRVKEELEVGNLYVNRGITGAMVDRHPFGGFKMSGIGSKTGGPDYLKQYMEPACVTENTLRRGFAPAEE

SEQ ID NO: 12542 - DNA, 3009 bp, Rhodopseudomonas palustris
  CDS (1)..(3009)
atgccgtcagacccgccgcttgccgaattcaccgcggcttacgcgccggacgatgctgcgctggctgcggagctgctgacgaccgccacgctgacgcccgaccgtgaagcccagatcgacgccatcgcgaccgacctgatcaccgcgatccgcggttccgaacacggcctgaggggcgtcgaagccatgctgcgcgaattcgcgctgtcgaccaaagaaggcctggccctgatggtgctggccgaggcgctgctgcgggtaccggatgctgcgactgcggacgccttcatcgaggacaagctcggccagggcgacttcgcgcatcaccgtatcaagtccgatgccgtgctggtgaacgcctctgcctgggccctcggactatcggcacgcctcgtccatgccggcgagacgccgcaaggcacgcttgcggccttaacgcggcggatcggcgcgcccgcggtgcgcgccgcgacacgtcaggcgatgcggctgatcggcaatcacttcgtgctcggcgaaacgatcgacgcggcgctcgcccgcgcacagccgtatgcgcgtgagggctctcgctattcttacgacatgctcggcgaaggcgcccgcactgccgcggatgccgaacgttattaccaatcctacgccgatgcgatcaccgcgatcggccgccgcgccggcaacgcggcgctgccggcgaggcctggcatctcggtgaagctgtcggcgctgcacccacggttcgaggcgatcagccgcgaccgcgtgatgcgggaactgacgccgcggctgctcgaactggcgcagctcgccaagagccacgacctcgctttcacggtcgatgccgaagaagccgaccggctcgaactgtcgctcgaggtgttcgccgcctgctttgccgatccatcgctcaaaggctgggacggttacggtctcgcggtgcaggcgtatcagaagcgtgccgccacggtgatcgaccacgtcgccgagctcgcgcgcgcgttcgaccgccgcatgatgctgcggctggtgaagggcgcctattgggacaccgaaatcaagcgcactcaggagcgcgggcttgccgactatccggtgttcaccaggaaggcgatgaccgacctcaactacctgcactgcgcgcgcaagctgctggcgctgcgcccgctcctgttcccgcagttcgccagccacaacgcgctgacggtcgccaccatcctggccgaggccggtgatggcgacggctacgaattccagcggctgcacggcatgggcgaggcactgtatggccggctgctcgccgaccacccgcaggcggtgtgccggatctacgcgccggtcggcgggcatcgcgacctgctggcctatctggtgcggcgcctcttggagaacggcgccaattcatccttcgtggcccaagccggcgacgacagcgtgccgatcaccgaactgcttgcgcgtcccgcgacgttgatcggccatcccgagaatgcgcgcaattcggcgatcccgttgccgcgcgatctgtaccagccgcagcggatcaattcgcgcggcatcgaattcggcgaccgcagcgcgctcgcggcactgctcggcgacatcgaaggcgcacgccggccgctgccgacggtcgcgtccacctcgccggaacaagccgcggccacggtcactgccgcacgcaaaggcttcgagtcctggagccggacgtccggcgatcatcgcgccgcgatcctgcagcgcgccggcgatctgctggagcaacgccgtggcgagctgatcgcgctcctgcaggacgaaggcggcaagacgctcgatgatggcgtggcggaagtgcgcgaagcagtcgactactgccgctactacgccagcgagggtcgccggctgttcggcgagccgcaggccctccctggcccgaccggcgagcgcaacacgctggccttgcgcggccgcggcgtgttcgtcgcgatcagcccgtggaacttcccgctggcgatcttcctcggccagatcacggcggggctgatggctggcaacgcggtggtcgcaaagccggccgagcagacgccggtgattgccgaggtcgcggtgcgcctattgcacgaagccggcgtgccgccggctgcgctgcatctggtgcaaggcgacggccgcatcggcgcggcactggtcgaacagcgcgacatcgccggcgtcgtattcaccggatcgaccgaggtcgcgcgcgcgatcaaccggacgctggccgccaaggacggtccgatcgtgccgctgatcgccgagaccggcggcatcaacgcgatgatcgtcgatgccactgcgctgcccgagcaggtcgccgacgacgtcattgcctctgcattccgctccgctggtcagcgctgttcggcgctgcggctcctgtgcgtgcaggacgacgttgccgaccgagtgatcgcgatgatcgccggcgcggcgcgcgagctaacaataggcgatccgcgcgatccggcgacgcatgtcggaccggtgatcgacgccgaggcgaagaccaggctcgacacgcatatcgccacgatgaaacgccaggcgcagcttcacttcgccggcaccgcgcccgcgagcggcaactttgtggcgccgcacatctttgaactcaaccgtgcctcagagctcaccgaggaagtgttcggcccgatcctgcacgtggtgcgctacaaggcggcgcagttcgacgatctcctcgatgacatcgccacgaccggctatgcgctcacgctcggcgtgcagtcgcggattgacgacacgatcgcgcgtgtgatcgcgcggcttcccaccggcaatgtctatgtgaaccgcaacatcatcggcgccgtggtcggcgtccagccgttcggtggctccggcctgtcgggcaccggccccaaagccggcggccctcattatctgccgcggttcgcactggaacagacggtgtcgatcaacactgcggccgccggcggcaatgccgctctgctgacaggcagcgaataa

SEQ ID NO: 12543 - protein, 1002 aa, Rhodopseudomonas palustris
MPSDPPLAEFTAAYAPDDAALAAELLTTATLTPDREAQIDAIATDLITAIRGSEHGLRGVEAMLREFALSTKEGLALMVLAEALLRVPDAATADAFIEDKLGQGDFAHHRIKSDAVLVNASAWALGLSARLVHAGETPQGTLAALTRRIGAPAVRAATRQAMRLIGNHFVLGETIDAALARAQPYAREGSRYSYDMLGEGARTAADAERYYQSYADAITAIGRRAGNAALPARPGISVKLSALHPRFEAISRDRVMRELTPRLLELAQLAKSHDLAFTVDAEEADRLELSLEVFAACFADPSLKGWDGYGLAVQAYQKRAATVIDHVAELARAFDRRMMLRLVKGAYWDTEIKRTQERGLADYPVFTRKAMTDLNYLHCARKLLALRPLLFPQFASHNALTVATILAEAGDGDGYEFQRLHGMGEALYGRLLADHPQAVCRIYAPVGGHRDLLAYLVRRLLENGANSSFVAQAGDDSVPITELLARPATLIGHPENARNSAIPLPRDLYQPQRINSRGIEFGDRSALAALLGDIEGARRPLPTVASTSPEQAAATVTAARKGFESWSRTSGDHRAAILQRAGDLLEQRRGELIALLQDEGGKTLDDGVAEVREAVDYCRYYASEGRRLFGEPQALPGPTGERNTLALRGRGVFVAISPWNFPLAIFLGQITAGLMAGNAVVAKPAEQTPVIAEVAVRLLHEAGVPPAALHLVQGDGRIGAALVEQRDIAGVVFTGSTEVARAINRTLAAKDGPIVPLIAETGGINAMIVDATALPEQVADDVIASAFRSAGQRCSALRLLCVQDDVADRVIAMIAGAARELTIGDPRDPATHVGPVIDAEAKTRLDTHIATMKRQAQLHFAGTAPASGNFVAPHIFELNRASELTEEVFGPILHVVRYKAAQFDDLLDDIATTGYALTLGVQSRIDDTIARVIARLPTGNVYVNRNIIGAVVGVQPFGGSGLSGTGPKAGGPHYLPRFALEQTVSINTAAAGGNAALLTGSE

SEQ ID NO: 12544 - DNA, 3603 bp, Pseudomonas paucimobilis
  CDS (1)..(3603)
atgacgaacccgccccccttcaccgatttcgcccctgtcatccggcctcagtcgccgctccgccaggcgatcaccgccgcctatcgccgcgacgaagcggagtgcatggcgcccctgctggaagccgccgcgctgcccgacgccatgcggcgtggagtgcgggacatggcgcgcaggctggtgacgacgctgcgcgccaatggcaagggcagcggggtcgaggcgctggtgcaggaatattcgctctccagccaggagggcgtggcgctgatgtgcctggccgaagcgctgctgcgcattcccgacgatgcgacccgcgatgcgctgatccgcgacaagatcgccgacggcgactggggcgggcatctgggcggcggcaggtcgctgttcgtcaatgcggcgacctgggggctggtggtgacgggcaagctggtcggcagcgtcgatgaccggggcctcggcgcggcgctgacgcggctggtggcgcggctgggcgagccggtgatccggcgcggcgtcgacctcgccatgcggatgatgggcgagcagttcgtgaccggcgagaccatcggcgaagcgctgaagcgggcgcgggcgcaggaggccaagggcttccagtacagctatgacatgctgggcgaagcggcggcgacggcggcggacgcggcgcgctacctggaggattaccggcaggcgatccatgccatcggccgggcgtcggccgggcgcggcgtctatgcggggccgggcatttcgatcaagctgtcggcgctgcatccgcgttattcccgcgcacaggcggagcgggtcatgggggaattgctgccgcgggtgaaggagctggcgttgctcgcccgcggctatgacatcggactcaacatcgatgcggaggaggcggatcggctcgaattgtcgctcgacctgctggagagtctggcgctggacccggagcttgcggggtggaacgggctgggcttcgtggtgcaggcctatggcaagcgctgccccttcgtgatcgactggatcgtcgatctggccgggcgggccgggcggcggatcatggtgcggctggtcaagggcgcctattgggacgcggagatcaagcgggcgcaggtcgacgggctggccgatttcccggtctatacgcgcaaagtccataccgacgtcgcctatatcgcctgcgcgaggaagctgctggcggcgcgggaccgggtgtttccgcaattcgcgacgcataacgcgcagacgctggcgacggtccatcatctggcggggcatgatttcacgctgggcgattatgaatatcagtgcctgcacggcatgggcgagccgctgtacgagcaggtggtggggaagggcgatctcgaccggccctgccgcatctacgcgccggtcggcacgcatgagacgctgctggcctatctggtgcggcggctgctggaaaatggcgcgaacagctccttcgtgcaccgcatcgccgatccggcggtgccggtggaggagatgatcgccgacccggtcgagcaggtgcgggcgatgccgcatccgggggcgcggcatgcggacatcgccctgccgtccgggctttatcccgaccggcgcaattccgacgggatcgacctcagcgatgaaaatgcgctggccatgctgacgcgggcgctggcggaaagcgcgcagatcggctggacggcccggccggagggcggggagggcgcggcgcggcccgtgctcaaccccgccgaccggcgcgatgtcgtggggacggtgttcgaggcgtcgacggattttgcgcgggcggcggtcgcgcgggcggacggaagcggctgggcgagggcgcccgtgacggaacgcgccgcgatattggagcgggcggccgacgcgatgcaggcgcgcatgccgatcctgctgggcctgatcgtgcgggaggcgggcaagtcgctgcccaacgccattgccgaagtgcgggaggcgatcgatttcctgcgctattatgcggcgcaggcgcggtcgaccttcggcccggcgcaggagcctttggggccggtggtgtgcatttcgccctggaatttcccgctggcgatcttcaccggccaggtggcggcggcgctggtcgcgggcaatgcggtgctggccaagcccgccgaggaaaccccgctgatcgcggcggaggcggttcgcctgctgcacgaggctggggtgccgggcgatgcgttgcagcttgtgcccggcgcgggggagatcggcgcggcgctggtggcggcgccgcaaaccgcaggagtgctgttcaccggatcgaccgaggtggcgcggctgatccagcggcaactggcctcgcgcctctccgcttcgggcaggcccattccgctggtcgcggagacgggcgggcagaatgcgatgatcgtcgacagctccgcgctggcggaacaggtggtggcggatgtcatcgcctccgccttcgacagcgcggggcagcgctgttcggcgctgcgcatcctctgcctgcaggaggatgtggcggaccggacgctggcgatgctgaagggggcgctcagggaattgcgcatcgggcggaccgaccggctggcggtcgacatcgggccggtcatcaccgacgaggcgcaggaaggaatcgggcggcacatagaggcgatgcgcgccctgcgctgcgcggtggagcagcagccattgccggaggaaagcgcgcatggcagcttcgtgccgccgacgatcatcgagatcgacgacatcgcgcagttgcggcgggaggtgttcgggccggtgctgcacgtcatccgcttcccccgcgcagggctggacgcgctggtggatgcgatcaacgcgaccggctatggcctgaccttcggcctgcatacgcggctggacgataccgtcgcccaggtgacggggcgggtgaaggcgggcaatctctatgtgaaccgcaatgtgatcggcgccatcgtgggggtgcagccctttggcgggcgcgggctgtcgggaaccggacccaaggcgggcgggccgctctatctggggcggcttgtgcgcgtgccgccggcctttgccgggcgggccggttcgttcccgtcggcgctcgccgatttcgccgactggctggcggcggagggcgaggcggaggcttcggccatggcgcggcgctgcggcgatgcctcggcgctgggggtggagatggcgctgccggggccggtgggggagcgcaacctctatgcgttgcatccccgcggatggatcgggatgcggcccgcgacgcggcagggccttttggggcagatggcggcggtgctggcgacgggcaatcgcggggtgctgcaggacatggcgctgccgcggggattgcccccgcatatcgccgcgcatttcgcgtctcggccggaagggccgctgggggcggtgctggtagagggcgatgccgggcggatcggcgcggcggttcgggacgtggccggcctgccggggccggtcgtcagcgtccatgcggcgggggcggatgggatgtatccgctccactggctgctggaggaggtgtcgacctccatcaacacgacggccgccggtgggaatgcgagcctgatgatgatcggatga

SEQ ID NO: 12545 - protein, 1200 aa, Pseudomonas paucimobilis
MTNPPPFTDFAPVIRPQSPLRQAITAAYRRDEAECMAPLLEAAALPDAMRRGVRDMARRLVTTLRANGKGSGVEALVQEYSLSSQEGVALMCLAEALLRIPDDATRDALIRDKIADGDWGGHLGGGRSLFVNAATWGLVVTGKLVGSVDDRGLGAALTRLVARLGEPVIRRGVDLAMRMMGEQFVTGETIGEALKRARAQEAKGFQYSYDMLGEAAATAADAARYLEDYRQAIHAIGRASAGRGVYAGPGISIKLSALHPRYSRAQAERVMGELLPRVKELALLARGYDIGLNIDAEEADRLELSLDLLESLALDPELAGWNGLGFVVQAYGKRCPFVIDWIVDLAGRAGRRIMVRLVKGAYWDAEIKRAQVDGLADFPVYTRKVHTDVAYIACARKLLAARDRVFPQFATHNAQTLATVHHLAGHDFTLGDYEYQCLHGMGEPLYEQVVGKGDLDRPCRIYAPVGTHETLLAYLVRRLLENGANSSFVHRIADPAVPVEEMIADPVEQVRAMPHPGARHADIALPSGLYPDRRNSDGIDLSDENALAMLTRALAESAQIGWTARPEGGEGAARPVLNPADRRDVVGTVFEASTDFARAAVARADGSGWARAPVTERAAILERAADAMQARMPILLGLIVREAGKSLPNAIAEVREAIDFLRYYAAQARSTFGPAQEPLGPVVCISPWNFPLAIFTGQVAAALVAGNAVLAKPAEETPLIAAEAVRLLHEAGVPGDALQLVPGAGEIGAALVAAPQTAGVLFTGSTEVARLIQRQLASRLSASGRPIPLVAETGGQNAMIVDSSALAEQVVADVIASAFDSAGQRCSALRILCLQEDVADRTLAMLKGALRELRIGRTDRLAVDIGPVITDEAQEGIGRHIEAMRALRCAVEQQPLPEESAHGSFVPPTIIEIDDIAQLRREVFGPVLHVIRFPRAGLDALVDAINATGYGLTFGLHTRLDDTVAQVTGRVKAGNLYVNRNVIGAIVGVQPFGGRGLSGTGPKAGGPLYLGRLVRVPPAFAGRAGSFPSALADFADWLAAEGEAEASAMARRCGDASALGVEMALPGPVGERNLYALHPRGWIGMRPATRQGLLGQMAAVLATGNRGVLQDMALPRGLPPHIAAHFASRPEGPLGAVLVEGDAGRIGAAVRDVAGLPGPVVSVHAAGADGMYPLHWLLEEVSTSINTTAAGGNASLMMIG

SEQ ID NO: 12546 - DNA, 1587 bp, Thermoproteus tenax
  CDS (1)..(1587)
atgggaattagattatctatgtctggcaaagttacctacgtctctgtgttggccgatgagtctatacaccctgcgtatgagaaggctctttccgaagtctgggagcttctgggaagggagtggccgatttacatcggcggaaaggaggtatataccagcggcaagtttgaaaagaggagcccctttgacacctctataaaaattggcacgttccagaggggaactcccgaggagttcaaagccgctctttcaaaagccgtggaggcgtttcccgagtggtctaggctagactggagagagagggcacggatcctcgccaagcttgccgacttgatagagagggatagattcaagttggccgcggctatcacgtatgaggtggggaagaacaggtttgaggccttggcggagatccacgaggctattgacgttttgcggtactacgtagagcttatacacaagatggatggctacgtgctgcagatgaggtctccgattcccaacgagaggcctctcagcgtgttgaggccgtacggcgcgtggtttgtaatttcgccattcaacttccccatagccctcgccaagggaatgctcaccggggtcctcttgatggggaacaccgctgtttggaagcccaccagcgaggcgccgttcacagccgccttggtgtaccagctggcggtggaggcgggagtgccgcctggggttttaaacttcgtcaccggccccggcgacgctgtcgaggaggtggctactggcgatccgagggtcgccggcatagccttcaccgggtcacgcgacgtcggcatgaggctgtaccgcctcttcacccagagacagccctggcctaagccaattgtgctggagatgggctcgaaaaaccccaccgtagtcaccgccaaggctgatttagagaaggcggctgagggcgttgtgagggccgccttcggcttcggaggccagaagtgctccgcgacgagcaggctctacgtgcagagggaggtctacgacaggtttgtggagcggcttgtggagaagactagggagattgtaaagataggcgacccgcggaggcgggaggttttcctcggccccgtgattaacaagtcggcgcgggagaactacaggcgctatgtggccgacgccgtggcggccggcggcaggttgagatacggcgggagggtgctggaagagggcgaattctcaaaaggcttctacgtagagccggccatcatagaaggcgtagcccccgacagctacctctggaagacagagctgttcctccccatactcctagtcgataagttcgacacgctggaggaggccgtgaggaaggcaaacgacacggaatacggcttaaccgccggcatattctccgaggacccgaaggaagtggagtatttctttgagcatatcgagttcggcgtggtgtacgccaacagaagaggcggcgcaaccaccggcgcgtggcccggcgctcagccattcacaggctggaaagcctcgggagcaactggcagaggcgtaaatggggtatattacctccttaacttcgcacgggagcaagccaggacggtggtctattag

SEQ ID NO: 12547 - protein, 528 aa, Thermoproteus tenax
MGIRLSMSGKVTYVSVLADESIHPAYEKALSEVWELLGREWPIYIGGKEVYTSGKFEKRSPFDTSIKIGTFQRGTPEEFKAALSKAVEAFPEWSRLDWRERARILAKLADLIERDRFKLAAAITYEVGKNRFEALAEIHEAIDVLRYYVELIHKMDGYVLQMRSPIPNERPLSVLRPYGAWFVISPFNFPIALAKGMLTGVLLMGNTAVWKPTSEAPFTAALVYQLAVEAGVPPGVLNFVTGPGDAVEEVATGDPRVAGIAFTGSRDVGMRLYRLFTQRQPWPKPIVLEMGSKNPTVVTAKADLEKAAEGVVRAAFGFGGQKCSATSRLYVQREVYDRFVERLVEKTREIVKIGDPRRREVFLGPVINKSARENYRRYVADAVAAGGRLRYGGRVLEEGEFSKGFYVEPAIIEGVAPDSYLWKTELFLPILLVDKFDTLEEAVRKANDTEYGLTAGIFSEDPKEVEYFFEHIEFGVVYANRRGGATTGAWPGAQPFTGWKASGATGRGVNGVYYLLNFAREQARTVVY

SEQ ID NO: 12548 - DNA, 1467 bp, Listeria monocytogenes
  CDS (1)..(1467)
atgagtattaaagaaacagccttaccaaaagttcaaacaaaattatttattaatggaaaatggacggatggagataataaagaaacaaaagatattgtaaacccagcaaatggagaagttattgccaaaatcgctcaagctggaccaaacgaaaccaaaaaagccattaaagctgcaaaagaagcatttcctgattgggcaaaaatggaactagctgatcgcgtcaaattattacacaaaattgccgatttaatggaagaaaaagcagatacactagcaaaaattatgacgcttgaacaaggtaaaccgctaaaagaatcaaaaggagaagtcctaactggcgcagaaaacttccgattcgctgcagaagaagcaagaagattatatggggaaactatcccagcgccaaacaatcacgcgtttatcgtcaaaaaacaaccaattggtgtagttgcggccattactccgtggaatttcccaggtggtatggtgacacgaaaacttgctccagcgcttgcaaccggaaatacaatcgtattaaaaccttccggagatacgccgctttcggccctagctatctttgaaatttttgaagaagccggcttgccaaaaggtgttgccaatatcgttatgggtagctccaaagaaatcggtgaaacattaactgacagtgatgatgttcgtaaactaactttcaccggctccacgaaagtcggtcaaacactattcaaacaatcagccgaaacactgaaaaaaatctcgctcgaacttggtggacatgcgccatttatcgtatttgatgatgcaaacctggatgctgctgtaaatgatttagttgccgcaaaattccgcaataacggtcaagtatgtgtatcgccaaaccgaatttttgttgccaaagaaattaaagaaaaattcactaaggcgctagttgctaaagtagaacaactaaaagtaggtaacggtttagatgatgtgaatgttggtccacttatccgcgaagatgcgattgacaaaatcgacaaacaacttaaaaatgccacagataaaggtgccaaagtcctaactggcggcggtcgtttaacaggttccgactatgacaaaggcaacttctacaaaccaactgtcttagataacgttacccgtgaaatggacattttttatgaggaaacatttggtccagtaatcccgcttatcacatttgaaacggaagacgaagcaatcgaaatggcgaatgacagtgaattcggtcttgcttcttacttctacactaaagatttagcacgcgtagaaaaagtgggagcagcactagaatacggaatggtcggagcaaatgaaattgccatctctaatccggaaactccatttggcggcgttaaacattctggtttcggtcgcgaaaatggccactacggaatggaagaatacatccaagtgaaattcattaacttaaaatatcgtgactaa

SEQ ID NO: 12549 - protein, 488 aa, Listeria monocytogenes
MSIKETALPKVQTKLFINGKWTDGDNKETKDIVNPANGEVIAKIAQAGPNETKKAIKAAKEAFPDWAKMELADRVKLLHKIADLMEEKADTLAKIMTLEQGKPLKESKGEVLTGAENFRFAAEEARRLYGETIPAPNNHAFIVKKQPIGVVAAITPWNFPGGMVTRKLAPALATGNTIVLKPSGDTPLSALAIFEIFEEAGLPKGVANIVMGSSKEIGETLTDSDDVRKLTFTGSTKVGQTLFKQSAETLKKISLELGGHAPFIVFDDANLDAAVNDLVAAKFRNNGQVCVSPNRIFVAKEIKEKFTKALVAKVEQLKVGNGLDDVNVGPLIREDAIDKIDKQLKNATDKGAKVLTGGGRLTGSDYDKGNFYKPTVLDNVTREMDIFYEETFGPVIPLITFETEDEAIEMANDSEFGLASYFYTKDLARVEKVGAALEYGMVGANEIAISNPETPFGGVKHSGFGRENGHYGMEEYIQVKFINLKYRD

SEQ ID NO: 12550 - DNA, 3021 bp, Desulfovibrio vulgaris
  CDS (1)..(3021)
atggatcagcaacatctcgacggcaaggtcgtcgagcgcggcaaagagttcttcagaagcatcagcggcgaggccccctccatcttcaacaagggatggtggaccggtaaggtcatggactgggccatgcagaacgaggacttcaaggtgcagctgttccgcttcgtggacgtgctgccctacctcaacacctccgaatcactcctgcggcacatccgcgagtacttcgccacagaagacgccgacatcccccccgtactcaagtggggcgcgggcaaggcgggcatcggcggggcactcaccgccaagctcatgggcatgaccatccgctccaacatcgagggcatggcgcgccagttcatcatcggcgacaacagcaaggaagccgtgaagggccttgcgaagcttcgcaaggacggcttcaccttcactgtcgaccttctcggtgaagccaccgtcagcgaagaggaatcagaagcctacgcgcagggctaccacgaagtggtcgacgccatcgcccgtgagcaggagaaatggaaggcgctgcccggcaacggcccggtggagggcttcgactggggtgccacacccaaggtcaacgtctccatcaagccttcggccctctactcgcaggccaagcccgtcgacgtggaaggctcggtgcgcggcatcctctcgcgccttgtgcccatctaccgcaaggtggtggccatgggcggcttcctgtgcatcgacatggagcagctcaaatacaaggagatgacgctggagcttttcaagcgcctgcgttccgaccccgaattccgtcactacccgcatctttccatcgtgttgcaggcctacctgcgcgataccgagaaggaccttgatgacctgctgcactgggcacgcagcgagaagctgcccatcggcatccgcctcgtgaagggcgcgtactgggactacgagaccgtcatcgccaagcagaacggctgggagattccggtctggaccgacaagcccgagtcggacatcgcctacgagaagctggcgcaccgcatcctcgagaacagcgacatcgtgtacttcgcctgcgcgtcgcacaacgtgcgcaccatcgccgccgtcatggagacggccctcgcgctgaacgtgcccgaacaccgctacgagtttcaggtgctctacggcatggcagaacccgtgcgcaagggcctcaagaacgtggcggggcgcgtgcgcctgtactgcccctacggtgaactcatccccggcatggcctacctcgtgcgccgtctgctggagaacaccgccaacgagtcgttcctgcggcaaagcttcgccgaaggggccgccctcgagcgtcttctggagaacccgcagaagaccctgcaccgcctgcttgccgcacggcccgaaccccgcgccgtcgaaccggggcccggcggtctgccgcccttcaccaacgacgccatgatcgacttcaccgtgcccgacaaccgcaaggccttcgtcgaggcattggccgacgtgcgctcgcgcttcgggcagacggtgccgctgtacatcggcgggcgcgacgtgaccaccgcagacctcatccccaccaccaacccggcgaagcccgcagaggtggtcgcctccatatgtcaggccggacggccggaaatcgacgacgccatcgccgccgcgaagaaggcggcactcacatggcgcgacacgtcgcccgccgacagggccgcctacctgcgtcgtgccgccgacatctgccgcaagcgcatctgggaactttcggcatggcaggtcgtcgaggtgggcaagcagtgggaccaggcctaccatgacgtgaccgaaggcatcgacttcctcgaatactatgcgcgtgagatgctgcgccttggcgcaccccggcgcatggggcgcgcgcccggcgagcacaaccacctgttctatcagcccaagggcatcgcggcggtcatcgccccgtggaacttcccgttcgccatcgccatcggcatggcttcggcagccatcgtcacgggcaaccccgtcatcttcaagccctcgtccatctcgtcgcgcatcggttacaaccttgccgaggtcttccgcgaggcggggcttcccgagggcgtgttcaactactgccccggccgcagttccatcatgggcgactacctcgtcgaacaccccgacatcagcctcatctgcttcacgggctccatggaagtgggcctgcgcattcaggagaaggccgcgaaggtgcagcccgggcagcggcagtgcaaacgcgtcatcgccgagatgggcggcaagaacgccaccatcatcgacgacgacgccgacctcgacgaggccgtgttgcaggtgctgtactccgccttcggctttcaggggcagaagtgctcggcctgctcacgggtcatcgttctcgacgccatctacgaccgcttcatcgaacggctggtgaaggccgcctcgtccatccacatcggcccatccgaagacccgtccaactacatgggccctgtggctgacgccaccttgcagaagaacgtcagcgactacatccgcatcgccgaagaagagggcagggtgctgctcaagcgcaccgaccttcccgcggaaggctgctacgtgccacttaccatcgtcggcgacatccggcccgaacatcgcatcgcgcaggaggagattttcggccctgtgcttgccgtcatgcgcgccgcgaccttcgatgaggccctctccatcgccaacggtacgcgcttcgccctgacgggtgccgtcttctcgcgcagccccgaacacctcgacaaggcacgccgcgaattccgcgtgggcaacctctacctcaacaagggctccaccggggcgcttgtcgagcgtcagcccttcggcggcttcgccatgtccggcgtgggctccaagacgggcgggcccgactacctgttgcagttcatggacccgcgcgtggtgacggagaacaccatgcgtcgcggtttcacccccatcgacgaggacgacgactggatcgtctag

SEQ ID NO: 12551 - protein, 1006 aa, Desulfovibrio vulgaris
MDQQHLDGKVVERGKEFFRSISGEAPSIFNKGWWTGKVMDWAMQNEDFKVQLFRFVDVLPYLNTSESLLRHIREYFATEDADIPPVLKWGAGKAGIGGALTAKLMGMTIRSNIEGMARQFIIGDNSKEAVKGLAKLRKDGFTFTVDLLGEATVSEEESEAYAQGYHEVVDAIAREQEKWKALPGNGPVEGFDWGATPKVNVSIKPSALYSQAKPVDVEGSVRGILSRLVPIYRKVVAMGGFLCIDMEQLKYKEMTLELFKRLRSDPEFRHYPHLSIVLQAYLRDTEKDLDDLLHWARSEKLPIGIRLVKGAYWDYETVIAKQNGWEIPVWTDKPESDIAYEKLAHRILENSDIVYFACASHNVRTIAAVMETALALNVPEHRYEFQVLYGMAEPVRKGLKNVAGRVRLYCPYGELIPGMAYLVRRLLENTANESFLRQSFAEGAALERLLENPQKTLHRLLAARPEPRAVEPGPGGLPPFTNDAMIDFTVPDNRKAFVEALADVRSRFGQTVPLYIGGRDVTTADLIPTTNPAKPAEVVASICQAGRPEIDDAIAAAKKAALTWRDTSPADRAAYLRRAADICRKRIWELSAWQVVEVGKQWDQAYHDVTEGIDFLEYYAREMLRLGAPRRMGRAPGEHNHLFYQPKGIAAVIAPWNFPFAIAIGMASAAIVTGNPVIFKPSSISSRIGYNLAEVFREAGLPEGVFNYCPGRSSIMGDYLVEHPDISLICFTGSMEVGLRIQEKAAKVQPGQRQCKRVIAEMGGKNATIIDDDADLDEAVLQVLYSAFGFQGQKCSACSRVIVLDAIYDRFIERLVKAASSIHIGPSEDPSNYMGPVADATLQKNVSDYIRIAEEEGRVLLKRTDLPAEGCYVPLTIVGDIRPEHRIAQEEIFGPVLAVMRAATFDEALSIANGTRFALTGAVFSRSPEHLDKARREFRVGNLYLNKGSTGALVERQPFGGFAMSGVGSKTGGPDYLLQFMDPRVVTENTMRRGFTPIDEDDDWIV

SEQ ID NO: 12552 - DNA, 1551 bp, Thermus thermophilus
  CDS (1)..(1551)
atgacggtggaacctttccggaacgagcccattgagaccttccagacggaggaggcccggcgcgccatgcgcgaggccctgaggcgggtgcgggaggagttcggccgccactaccccctctacatcgggggggagtgggtggacacgaaggagcgcatggtctccctcaacccctcggcgccaagcgaggtggtgggcaccaccgccaaggcggggaaggcggaggcggaggccgccctcgaggccgcctggaaggccttcaagacctggaaggactggccccaggaggaccggagccgcctcctcctcaaggcggcggccctcatgcggcggcggaagcgggagctggaggccaccttggtctacgaggtgggcaagaactgggtggaggcctccgcggacgtggccgaggccattgacttcattgagtactacgcccgggccgccctgcgctaccgctaccccgccgtggaggtggtgccctaccccggggaggacaacgagagcttctacgtgcccctgggggccggggtggtcatcgccccctggaacttccccgtggccatcttcaccgggatgatcatgggccccgtggccgtggggaacaccgtgatcgccaagcccgccgaggacgccgtggtggtgggggccaaggtctttgagatcttccacgaggcgggcttcccccccggggtggtcaacttcctgcccggggtgggggaggaggtgggggcgtacctggtggagcaccccaggacccgcttcatcaacttcacggggagcctggaggtgggcctgaagatctacgaggccgccgggcgcctggccccgggccagacctggttcaagcgggcctacgtggagaccgggggcaaggacgccatcatcgtggacgagacggcggactttgacctggccgccgagggggtggtggtctccgcctacggcttccaggggcagaagtgctccgcggcgagccgcctcatcctcacccagggggcctacgagcccgtgctggagagggtcctgaagcgggcggaaaggctttccgtaggccccgccgaggagaaccccgacctcggccccgtggtgagcgccgagcaggagaggaaggtcctctcctacattgagatcgggaagaacgagggccagctcgtcctgggggggaaacgcctcgagggggaggggtacttcatcgcccccacggtcttcaccgaggtgccgcccaaggccaggatcgcccaggaggagatcttcggcccggtgctttccgtgatccgggtcaaggacttcgccgaggccctggaggtggcgaacgacacgccctacggcctcacgggcggggtctactccaggaagcgggagcacctggagtgggccaggcgggagttccacgtgggcaacctctacttcaaccgcaagatcaccggggccctggtgggggtccagcccttcggcggctttaagctttccggcaccaacgccaagaccggggccttggactaccttaggctcttcctggagatgaaggcggtggccgagcgcttctag

SEQ ID NO: 12553 - protein, 516 aa, Thermus thermophilus
MTVEPFRNEPIETFQTEEARRAMREALRRVREEFGRHYPLYIGGEWVDTKERMVSLNPSAPSEVVGTTAKAGKAEAEAALEAAWKAFKTWKDWPQEDRSRLLLKAAALMRRRKRELEATLVYEVGKNWVEASADVAEAIDFIEYYARAALRYRYPAVEVVPYPGEDNESFYVPLGAGVVIAPWNFPVAIFTGMIMGPVAVGNTVIAKPAEDAVVVGAKVFEIFHEAGFPPGVVNFLPGVGEEVGAYLVEHPRTRFINFTGSLEVGLKIYEAAGRLAPGQTWFKRAYVETGGKDAIIVDETADFDLAAEGVVVSAYGFQGQKCSAASRLILTQGAYEPVLERVLKRAERLSVGPAEENPDLGPVVSAEQERKVLSYIEIGKNEGQLVLGGKRLEGEGYFIAPTVFTEVPPKARIAQEEIFGPVLSVIRVKDFAEALEVANDTPYGLTGGVYSRKREHLEWARREFHVGNLYFNRKITGALVGVQPFGGFKLSGTNAKTGALDYLRLFLEMKAVAERF

SEQ ID NO: 12554 - DNA, 1485 bp, Bacillus cereus
  CDS (1)..(1485)
atgttaacgaaaaacattgaactaaaaccaaaagtgaaagcgtttttaaatgaagaaattaaaatgtttattaatggtgaatttgttccttccattagcgggaagacatttgagacatacaatccagcaactgaagatgttttagctgttgtatgcgaagcacaagaagaggatattaatgtcgcagtaaaagcggcaagatctgcatttgaatcaggaccttgggcagaaatgactactgctgaaagagcacatcttatttataaattagcagacttaattgaagagcatggagaagaattggcgcagttagaagctttagataacgggaaaccatatcaagtagcactggatgatgatattgcagcgactgtagaaaattaccgctattatgcgggatgggctacgaaaattatcgggcaaacaattccgatttcaaaagattacttaaattatacacgccatgaacctgttggggttgtaggacaaattattccttggaattttccgctcgttatgtcttcttggaaaatgggagctgcactagcgacaggttgtacgatcgtattaaaaccagcagaacaaacgcctttatcgttattatatacagcgaaactttttaaagaagcaggttttccaaaaggtgttgtaaactttgtgccaggtttcggccctgaagcgggagctgcaattgtaaaccatcatgatattgataaggtagccttcacaggttcaacagttacaggaaaatatattatgcgtcaatctgcagaaactattaaacatgtaacgttagaacttggtggtaaatcaccaaatatcattttagaagacgctgatttagaagaagcgattaacggcgcattccaaggtattatgtataatcacggccaaaattgtagtgctggatctcgcgtgttcgttcaccgaaaacattacgaaacagtcgtaaatgaactagtaaaaatggcgaataacgtgaaacttggagcaggtatggagaaggaaacagaaatgggtccactcgtatctaaaaagcaacaagagcgtgtactacattacattgaacaaggaaaagcagaaggcgctactgttgctgctggtggtgaacgtgcatttgaaaaaggttattttgtacagccaacggtattcacaaatgttactgatgatatgacaattgtgaaagaagaaatttttggaccagttgtcgttgtacttccatttgattcaacagaagaggtaatcgaaagagcaaatcgctcgtcatacggactcgctgcaggcgtatggacacaaaatattaaaactggacatcaagttgccaataaattaaaggcaggaacagtatggattaatgattataacttagaaaatgcagctgcaccatttggtgggtttaaacaatctggaatcggtcgtgagttaggttcatatgcgcttgataattacacagaagtgaagagtgtttgggtaaatataaagtaa

SEQ ID NO: 12555 - protein, 494 aa, Bacillus cereus
MLTKNIELKPKVKAFLNEEIKMFINGEFVPSISGKTFETYNPATEDVLAVVCEAQEEDINVAVKAARSAFESGPWAEMTTAERAHLIYKLADLIEEHGEELAQLEALDNGKPYQVALDDDIAATVENYRYYAGWATKIIGQTIPISKDYLNYTRHEPVGVVGQIIPWNFPLVMSSWKMGAALATGCTIVLKPAEQTPLSLLYTAKLFKEAGFPKGVVNFVPGFGPEAGAAIVNHHDIDKVAFTGSTVTGKYIMRQSAETIKHVTLELGGKSPNIILEDADLEEAINGAFQGIMYNHGQNCSAGSRVFVHRKHYETVVNELVKMANNVKLGAGMEKETEMGPLVSKKQQERVLHYIEQGKAEGATVAAGGERAFEKGYFVQPTVFTNVTDDMTIVKEEIFGPVVVVLPFDSTEEVIERANRSSYGLAAGVWTQNIKTGHQVANKLKAGTVWINDYNLENAAAPFGGFKQSGIGRELGSYALDNYTEVKSVWVNIK

SEQ ID NO: 12556 - DNA, 3141 bp, Wolbachia pipientis wMel
  CDS (1)..(3141)
atgataagctctatacaagaacctaatgaactcagaaaacgtttacaaggattttatcgtactgatgaaaagagttatatacgttatcttgtagaaaaagcagagctttcggctgattcaaaaaatagaatttataatattgcaaaacaagttattgaaaaaatcaaacacaataaattaagtattgtagattcctttatgcagcaatactcgctttccaatgatgaaggaatagcattgatgtgccttgctgaatcactacttagaataccagatgattatacaatagacgaaataatcaaagataaaattgccaatcaggaatggaataaatatttagggcactcttcttcgttgtttgtcaatgcttccacatggagcttgatgataggtagcagtatattgagagataatgaaggcgattcgaagttctattacgcaatttctaagttacttaagaatttaggagaaccgatcattcgcaaagcagtaaaacaagcaatgtctatgcttggtaatcattttgttgttggagaaaccatagaagaagctttaaggtatgcaaaactagatgacaatagtaagtttttatactcttttgatatgcttggcgaaactgctcacacagctgaagatgcagaagagtattttaattcatacatgcactcaataaaagctataggtgaatccactgaaataaatgattgttttaaatcgcatggagtttcaatcaaattgtctgcgttacatccacgttatgaatttggtcaattcgataatatagctgaagagttgagagctaaactgctagagctttgtcatgaagcaaaaaaatacaacatttcattatgcatagatgcagaagaaacagaaaggcttgaaatgtccttaatcttgtttgaacaattacggcttgatgaatcactttctgagtgggaagggcttggcttggctgtgcaagcatatcaaaagcgcgctttatctgttcttgactttgttgaagatgttgctatccgatcaaagcacaaaattatggtgaggcttgtaaaaggtgcatattgggattcagaaatcaagcgtacgcaagaattgggattaaatgattactcagtatttacaagaaaaagctatactgacgtatcttacttcgtgtgcgcacagaaacttttgagtaaaccaaacagcttttacccatgctttggaactcataacgtctatacttttgcttctatcatggaacttgctgataaaaaccaccctggatttgaatttcaacgcttacatggaatggcaaaagacttatatgattatgcaatgtcagagcttgcaacaaatgttagctgtcgtgtctacgcacccgttggggaacatagtgacttgttgccttatcttataagacgccttcttgaaaatggagctaatagttcgtttgttaatcaaataagtgatcctaacgttaaaatcgatgagttaatttcagatccactggaaaaagctataaattttaattatgaacctcatccaggcattccattaccacaagatattttgggaccagaaagaaaaaattccttggggatggatattagtgattctgtgatagtctcacaatttgcagatgatataaagggttttagtgaaaaaaagtggcaaattggaccaataattgatggaaaagcactatttgataatgctgaatttatcgaagtagtgaatcctgcacatttggaaaatgtaattggagaagtgtcaagtgcaacaagcgatcaagctttaaacgctcttgaaatagcacacagtgcttttgctaagtggcagaatgtttcagcagaagagcgcgctaaatgccttgaaaaagctgcagatttgcttgaggaaaggatgaaagagttaatttacattctgattgtggaagcaggaaaaattttatccgatgcaatagcagaagtaagagaggcaatcgactttctgcgttattatgcaatgatagcaaaaaatgaactgagcgactggaaaaaattgccgggcccaacaggtgaagataacttcatcttttttgaaggcagaggagttttcttatgcatatcaccgtggaattttccgctcgctatcttcattgggcaggtctcagctgcacttgcagcaggtaatgcagtgctggcaaaaccggcagagcaaacgccgattattgcctacgaagctgttaagatactacatgaagctgggataccaaagaatgtgttacacctcattcctggggatggtggatatttaggcaaaatattagttccagacaatagaattgccggagtagcttttactggctcaacacaaactgctcaaataatcaataaaatgcttgcaaatagggatggtcctattgtgccacttattgctgaaacaggagggctcaatgctatgatagttgatagctctgctcttttagagcaagtggctatggatgctttgctttctgcgtttcgtagcagtggtcaacgctgttctgcacttagagtgctgtttattcaagaggacatagcagagaagcagataaaaatgatatgcggtgcagcgcaagaactcaagattggtgacccaatacaacttagtactgatattggtccaataattgacaaagcatctatcgatatgctaactcaacatacgcaaaaaatgtcagaggacgaagattcaaatctgttatttaaagtacccatggatacaaattctcataatggttatttctttcctccatatatttatgagatacaaaaaatttcgcaattaaagcaagaagtatttggtcctattttacatatcatacgttttaacaagtcacaattaaatgaagttataagtgatataaatagtactggatatgggcttacgttttctttgcagagtcgtatacaaagtcaaattgaaactataagtaaaaaaatatcagttggaaatgtctacatcaaccgtaaccagataggtgcagcagttgggatacaaccatttggtggtagaggactatctggcactgggccaaaagctggtggtcctcattatttacagcgtttttctacagaaaaagttgtaagtgttaacactacagcatttggtggtaacactacacttatgtgtttggattaa

SEQ ID NO: 12557 - protein, 1046 aa, Wolbachia pipientis wMel
MISSIQEPNELRKRLQGFYRTDEKSYIRYLVEKAELSADSKNRIYNIAKQVIEKIKHNKLSIVDSFMQQYSLSNDEGIALMCLAESLLRIPDDYTIDEIIKDKIANQEWNKYLGHSSSLFVNASTWSLMIGSSILRDNEGDSKFYYAISKLLKNLGEPIIRKAVKQAMSMLGNHFVVGETIEEALRYAKLDDNSKFLYSFDMLGETAHTAEDAEEYFNSYMHSIKAIGESTEINDCFKSHGVSIKLSALHPRYEFGQFDNIAEELRAKLLELCHEAKKYNISLCIDAEETERLEMSLILFEQLRLDESLSEWEGLGLAVQAYQKRALSVLDFVEDVAIRSKHKIMVRLVKGAYWDSEIKRTQELGLNDYSVFTRKSYTDVSYFVCAQKLLSKPNSFYPCFGTHNVYTFASIMELADKNHPGFEFQRLHGMAKDLYDYAMSELATNVSCRVYAPVGEHSDLLPYLIRRLLENGANSSFVNQISDPNVKIDELISDPLEKAINFNYEPHPGIPLPQDILGPERKNSLGMDISDSVIVSQFADDIKGFSEKKWQIGPIIDGKALFDNAEFIEVVNPAHLENVIGEVSSATSDQALNALEIAHSAFAKWQNVSAEERAKCLEKAADLLEERMKELIYILIVEAGKILSDAIAEVREAIDFLRYYAMIAKNELSDWKKLPGPTGEDNFIFFEGRGVFLCISPWNFPLAIFIGQVSAALAAGNAVLAKPAEQTPIIAYEAVKILHEAGIPKNVLHLIPGDGGYLGKILVPDNRIAGVAFTGSTQTAQIINKMLANRDGPIVPLIAETGGLNAMIVDSSALLEQVAMDALLSAFRSSGQRCSALRVLFIQEDIAEKQIKMICGAAQELKIGDPIQLSTDIGPIIDKASIDMLTQHTQKMSEDEDSNLLFKVPMDTNSHNGYFFPPYIYEIQKISQLKQEVFGPILHIIRFNKSQLNEVISDINSTGYGLTFSLQSRIQSQIETISKKISVGNVYINRNQIGAAVGIQPFGGRGLSGTGPKAGGPHYLQRFSTEKVVSVNTTAFGGNTTLMCLD

SEQ ID NO: 12558 - DNA, 1641 bp, Mycobacterium paratuberculosis
  CDS (1)..(1641)
atggatgcgatcactggaatttccgaggtgccggtgccggctaacgagccggtccacgattacgcgccgcgctccgcggagcgcgcccggttacgcgccgagttggccgcgctggccggccacccgatcgacctgccgcacgtcatcggcggccgccaccggatgggcgacggtgaacgcatcgacgtcgtccagccgcaccggcacgccgccaagctgggcaccctgaccaacgccgtgcacgccgacgcgaccgcggccgtcgacgccgcgatggccgcgaaaagcgattgggcggcaatgcctttcgatgagcgggcggcggtgtttttgcgggccgctgatctgctggccgggccgtggcgggagaagatcgccgcagcgacgatgctgggccaatccaagtcggcctatcaggccgagatcgactcgccctgcgagcagatcgacttctggcggttcaacgtggcgtttgcccggcagatcctggcgcagcagccgatcagcgggccgggggagtggaatcgcagcgactaccgcccgctggacggctttgtctacgcgatcactccgttcaatttcacctccattgccggcaacctgccgaccgcgccggcgctgatgggaaacaccgtggtgtggaagccgtcgatcacccagaccctgtcggcgtatctgaccatgcagttgctcgaggcggccgggttgccgcccggggtgatcaacctggtgaccggcgacgggttcgcggtttccgatgtggcactggcggatcggcggctggcgggcattcacttcaccgggtcgacggcgaccttccagcggctgtggtaccaggtgggcaccaatatcggtcactaccactgctatccgaggctggtgggcgagaccggcggcaaggacttcatcgtcgcgcacgcctccgcacgcccggatgtgttgcgcaccgcgctgattcgcggggccttcgactaccaggggcagaagtgctcggcggcgtcgcgggcgttcatcgcgcagtcggtctggcggcggatgggcgacgagtttctggccgagaccgccgcattgcgctacggcgacgtcaccgatctgaccaacttcggcggcgcgctgatcgaccggcgggcctttgtcaagaacgtcgacgccatcgaacgcgcgaagggcgcgccgcacgtcaccctcgcggtgggcggcgaatacgacgacagcgaaggctatttcgtgcggccgacggtgttgctgtccgacgacccggccgacgagtcgttcgcgaccgaatacttcggcccgctgctgtcggtgcacgtgtatcccgacgacgactaccagcgaatcctcgacgtggtcgacaccggatcgcggtacgcgctgaccggtgcggtcatcgccgacgaccgggcggcggtgctggccgcgcaggaccggctgcgctttgccgccgggaacttctacgtcaacgacaagccgaccggggcggtggtggggcgccagccgttcggcggttcgcgcggctcgggaaccaacgacaaggccggctctccgttgaacctgctgcgctggacgtcggcccgcaccatcaaggagacgttcgtcccggccaccgaccacacctatccgcacatggcggccgactga

SEQ ID NO: 12559 - protein, 546 aa, Mycobacterium paratuberculosis
MDAITGISEVPVPANEPVHDYAPRSAERARLRAELAALAGHPIDLPHVIGGRHRMGDGERIDVVQPHRHAAKLGTLTNAVHADATAAVDAAMAAKSDWAAMPFDERAAVFLRAADLLAGPWREKIAAATMLGQSKSAYQAEIDSPCEQIDFWRFNVAFARQILAQQPISGPGEWNRSDYRPLDGFVYAITPFNFTSIAGNLPTAPALMGNTVVWKPSITQTLSAYLTMQLLEAAGLPPGVINLVTGDGFAVSDVALADRRLAGIHFTGSTATFQRLWYQVGTNIGHYHCYPRLVGETGGKDFIVAHASARPDVLRTALIRGAFDYQGQKCSAASRAFIAQSVWRRMGDEFLAETAALRYGDVTDLTNFGGALIDRRAFVKNVDAIERAKGAPHVTLAVGGEYDDSEGYFVRPTVLLSDDPADESFATEYFGPLLSVHVYPDDDYQRILDVVDTGSRYALTGAVIADDRAAVLAAQDRLRFAAGNFYVNDKPTGAVVGRQPFGGSRGSGTNDKAGSPLNLLRWTSARTIKETFVPATDHTYPHMAAD

SEQ ID NO: 12560 - DNA, 3015 bp, Geobacter sulfurreducens
  CDS (1)..(3015)
atgctaaacagtgagctgaacacgaagatcgttaaccgcggcaaggagtttttcggcagcatttccggcgagaagccctccctcttcaacaagggggcctggatgggcaaggccatggactggagcatgcagaacgagcagttcaagatccagatgttccggtttgtggacgtgttcccctcgctgaccaccagtaagctcctgacggagcatattcgcgaatatttcggcaacgagcaggatatgcccgcgttcatgtccacgggggccaaggtggcggggatgctcggttccttcggcggggccgtgctgaacaaggtgctcacctccaatatcgaggagatggcccgccagttcatcgtgggcgagaccaccaaggaggcggtgaaaaacctggagaagctccgcaaggacggcttcgccgcggtggttgacgtgctcggcgaggcgaccctttccgaagaggaagcagaagtctacacgaacacctacctggagctgctggaggccctgaagaaagagcaggggagctggaaaggcctgcccggcaagggaggcgaccctggcttggactgggggcatgcccccaaggtgaacattgcggtgaagcccacggccctcttctgcctggccaatccccaggacttcgaggggtcggtggtggccatccttgaccggatgcgccgcatcttcaagaaggtaatggagctgaatggcttcctctgcatcgatatggaatcgtaccgccacaaggagatcatcctggaggtcttccggcgcctgaaactggagtaccgcgactatccccacctgggaatcgtgctccaggcttacctgaaggataacgacaaggacctggatgaccttctggcctgggcgaaggagcacaaggttcagatatccgtccgtctcgtgaagggtgcctactgggactacgaaacggtcaaggcgaagcagaacgattgggaagtcccggtctggaccatcaaggcggagagcgacgcggcctacgagcgccaggcgcggaagatcctggaaaaccaccagatctgccactttgcctgcgcctcccacaatatccggaccatatcggcggtcatggagatggcgcgggaactgaatgtgccggaggatcgttatgaattccaggttctctacggcatggccgaaccggtgcgcaaggggattctgaaggtggcgggacgcatccgcctctatgcaccctacggcaacatggttccggggatggggtacctggtgcgtcggctcctggagaacaccgccaatgaatcgttcctgcgccagagctttgccgaggacgcccagatcgagcgcctgctggaagacccggctgtcacggtcgagcgggaacgggccgcccgcgccgcaaagccgaagaaggagcggaaaggcctcggcgggcttcccccgttcaacaacgaggccatggtggacttcacccgggctgatcaccgggctgccttcccgaagcacatcgcccaggtgcggacccagttgggcaagacctatcccctgttcataaacgggaaagaggtccggaccaacgacctcatccccaccgtgaaccccaacaagccctctgaggtcctgggccagatctgccaggcaggcaccacggaggtgggcgacgccatcgctgccgccaaggcagccttcccggcatggcgcgacaccgatccccggaccagggccgaatatctcctgaaggcggcccaggccgcccgcaagcgactcttcgaactctcggcctggcaggtcctggagatcggcaagcagtgggatcaggcctatgccgacgtgaccgaggccatcgacttcctggaatactatgcccgtgagatgatccggctgggccagccccagcgggtgggccacgccccgggcgaactgaaccattacttctacgagcccaaaggggtggccgcggtcatcgcaccctggaacttccccctggccatcagcatgggcatggcgtcggcagccatcgtcaccggcaactgcgtggtcttcaagccgtcggggatcacctcgatcatcggctggcacttggtggagctgttccgcgaggcgggcctccccgaaggggtctttaacttcacgccgggtcgcggctcggtcatgggcgactacctggtggatcacccggacatcagcctgatcgccttcaccggctccatggagaccggcctgcggatcatcgagcgtgccgccaaggtccatccgggccaggccaacgtgaagaagatcatctccgagatgggcggcaagaacgccattatcatcgacgacgacgccgacctcgacgaggcggtgccccatgtcctctactcggccttcggcttccaggggcagaaatgctccgcctgttcccgggtcatcgtgctggatgcagtttatgataaattcatcgagcggctcgtttccatggccaaggccaccaaggtgggcccctccgaggatccggccaactacatgggtgccgtggccgacgacaaggccatgaagagcatcaaggagtacgcggagatcggcaagcgggaagggcatgttctctatgagagcccggtgccggccggtgaggggtatttcgtccccatgaccatcattggcggcataaagcccgagcaccgtatcgcccaggaggagatcttcggaccggttcttgcggttatgcgggccaaggacttcgaccaggccatcgaatgggccaactccacgcagtttgccctcaccggcggtatcttcagccgcagccccgaacacctggccaaggcccgccgggagttccgggtggggaacctctacatcaaccggaacaacaccggtgccttggtggagcggcagcccttcggcggcgcccgcatgtccggggtcggcaccaaggccggcggtcccgactacctcctccacttcatggacccgcgggtggtcactgagaacaccatgcggcgcggtttcgctcctatcgaggaggacgacgactgggtcgattag

SEQ ID NO: 12561 - protein, 1004 aa, Geobacter sulfurreducens
MLNSELNTKIVNRGKEFFGSISGEKPSLFNKGAWMGKAMDWSMQNEQFKIQMFRFVDVFPSLTTSKLLTEHIREYFGNEQDMPAFMSTGAKVAGMLGSFGGAVLNKVLTSNIEEMARQFIVGETTKEAVKNLEKLRKDGFAAVVDVLGEATLSEEEAEVYTNTYLELLEALKKEQGSWKGLPGKGGDPGLDWGHAPKVNIAVKPTALFCLANPQDFEGSVVAILDRMRRIFKKVMELNGFLCIDMESYRHKEIILEVFRRLKLEYRDYPHLGIVLQAYLKDNDKDLDDLLAWAKEHKVQISVRLVKGAYWDYETVKAKQNDWEVPVWTIKAESDAAYERQARKILENHQICHFACASHNIRTISAVMEMARELNVPEDRYEFQVLYGMAEPVRKGILKVAGRIRLYAPYGNMVPGMGYLVRRLLENTANESFLRQSFAEDAQIERLLEDPAVTVERERAARAAKPKKERKGLGGLPPFNNEAMVDFTRADHRAAFPKHIAQVRTQLGKTYPLFINGKEVRTNDLIPTVNPNKPSEVLGQICQAGTTEVGDAIAAAKAAFPAWRDTDPRTRAEYLLKAAQAARKRLFELSAWQVLEIGKQWDQAYADVTEAIDFLEYYAREMIRLGQPQRVGHAPGELNHYFYEPKGVAAVIAPWNFPLAISMGMASAAIVTGNCVVFKPSGITSIIGWHLVELFREAGLPEGVFNFTPGRGSVMGDYLVDHPDISLIAFTGSMETGLRIIERAAKVHPGQANVKKIISEMGGKNAIIIDDDADLDEAVPHVLYSAFGFQGQKCSACSRVIVLDAVYDKFIERLVSMAKATKVGPSEDPANYMGAVADDKAMKSIKEYAEIGKREGHVLYESPVPAGEGYFVPMTIIGGIKPEHRIAQEEIFGPVLAVMRAKDFDQAIEWANSTQFALTGGIFSRSPEHLAKARREFRVGNLYINRNNTGALVERQPFGGARMSGVGTKAGGPDYLLHFMDPRVVTENTMRRGFAPIEEDDDWVD

SEQ ID NO: 12562 - DNA, 1722 bp, Ashbya gossypii
  CDS (1)..(1722)
atgctgtctagatcgaggctattaggctactcggccaggaccatcgcgcagttgtcgcggccaggatgcccccggataagcaacgaggccgtcaagccgttcagcaagcgggacacgctggactgggacctgttgcgggcgtcgctgtccaagttcaacaactcgtcgctcgacgtgccgctcgtgataaacggcgaacggatatacttcaacgacgccggcaagcgtgagctgtttaagcaggtgaacccggcgcggcacacgcaggtgctggcgcacgtgacgcaggcctcgagggaggacgtgcgcgcggccgtgcgggccgcgcaagacgccaagcagaagtggtacgagacgccgttctacgaccgcgcagcggtgttcctcaaggccgcggacctggtggccacgaagtaccggtacgacatgctcgcggcaaccatgctcggtcaggggaaaaacgtgcagcaagcggagatcgactgcatcacggagctggcggacttcttccgcttcaacgtcaagtacgcggaggagctgtaccagcagcagcccgcagaatcgagcccgggcgtgtggaaccgctccgagtaccggccactggagggctttgtgtatgcggtatcgccgttcaacttcaccgcaatcgcaggcaacctggtgggtgcccccgccctcatggggaacacggtggtgtggaagccgtcgcagaacgccgcgctctcgaactacctgctgctcacggtgctggaggaggccggcctgccccgcggcgtgatcaacttcgtccccggcaaccccgtcgacgtcaccgaggaggtgctcgcggataaggccctcggcgggctgcacttcaccggctccacggccgtcttcaagcagctctacggcaagatccagcaaggcgtcgtcagcgggctgtaccgcgactacccccgcatcgtcggcgagaccggcggcaagaacttccacctcgtgcatccgagcgcaaacctgccccacgccgtgctctcgacgctgcgcggcgccttcgagttccagggccagaagtgctccgccgcgtcgcgcctgtacctcccccagtcgaaggccgacgcgttcctcgcagacctcgccggcacgctcgccgccatcaagcccgccaacacctccgcgtccagcatcaacggcggggacctccacgccttcatgggccccgtgatccacgagcagagcttcgacaagctcgccgccgccatcgagcgcgcgcgcaccgaccccgagctcgagatcctctacggcggcgaccacagcaagagccagggctacttcgtcggccccaccgtcgtccgcacctccaacccccgccacgacttcatgaccgccgagttcttcggccccatcctgaccgtctacgagtacccggacgcccagttcgaccaggtctgcgacctcatcgactccacctccgcctacggcctcacgggcgccgtcttcgcgcgcgaccgagacgccatcgccgccgccgaccgccgcctcaagtacgccgcaggcaacttctacatcaacgacaaggccaccggcgccgtcgtcgcccagcagtggttcggcggcgcccgcatgagcggcaccaacgacaaggccggctccccgaacgtgctctcgcgcttcgtcagcgtccgcagcgtcaaggagaacttctacgagctcaccgactttaagtatccctccaactacgagtag

SEQ ID NO: 12563 - protein, 573 aa, Ashbya gossypii
MLSRSRLLGYSARTIAQLSRPGCPRISNEAVKPFSKRDTLDWDLLRASLSKFNNSSLDVPLVINGERIYFNDAGKRELFKQVNPARHTQVLAHVTQASREDVRAAVRAAQDAKQKWYETPFYDRAAVFLKAADLVATKYRYDMLAATMLGQGKNVQQAEIDCITELADFFRFNVKYAEELYQQQPAESSPGVWNRSEYRPLEGFVYAVSPFNFTAIAGNLVGAPALMGNTVVWKPSQNAALSNYLLLTVLEEAGLPRGVINFVPGNPVDVTEEVLADKALGGLHFTGSTAVFKQLYGKIQQGVVSGLYRDYPRIVGETGGKNFHLVHPSANLPHAVLSTLRGAFEFQGQKCSAASRLYLPQSKADAFLADLAGTLAAIKPANTSASSINGGDLHAFMGPVIHEQSFDKLAAAIERARTDPELEILYGGDHSKSQGYFVGPTVVRTSNPRHDFMTAEFFGPILTVYEYPDAQFDQVCDLIDSTSAYGLTGAVFARDRDAIAAADRRLKYAAGNFYINDKATGAVVAQQWFGGARMSGTNDKAGSPNVLSRFVSVRSVKENFYELTDFKYPSNYE

SEQ ID NO: 12564 - DNA, 1632 bp, Porphyromonas gingivalis
  CDS (1)..(1632)
atgaataattcgcattttgcttttgccaagccggtcaatgagccggtttatggctatgccccgggttcgccggaaagaaaaaaactgaaagaggagcttcaacgacaattgtctacgcctatagagattcctattatcataggaggcaaagaaatccgaacgggcgataccggcactgtggtgatgccccataaccatgctgttcgactggccacctatcatcgggtaggggagaaagaagtgctgcaagctatcgaagctgccgaaaaggctcgtcaggattggagccgtctgccatggactgagcgtgcttccgtaatgttgcgcatcggagagttgatctctaccaaatatcgctatcagctggcagcttctgtaatgctcggacagagcaagaatccgatgcaggcagagatcgatgctccctgcgagttgatcgatttcttgcgtttcggtgcctactatgcgggccagatctatgccgatcaacccatcagtgagaaaggcattctcaatcgggtggagtaccgttcgctcgaaggtttcgttttggccgttactcctttcaatttcaccagtattgcttccaacctgaatctggcaccggccatgatggggaatactactatctggaagccttccactacagctcttcatagcaactacctccttatgaaaatcttccaagaggccggtttgcccgatggtgtggtcaatttccttcccggacagggtagcttgatcggtcgggtagccacggcgaacgaacacttggccggtttccattttaccggttctactgctacgttcaacacgctgtggaagagcatcgccggcaatatagatcgctatcgtggctatccccgtatagtgggcgaaacgggaggaaagaacttcgtgatggttcatccctcggctgaagcatgcgaagtggctacggctcttgtgcgcggagctttcgagtatcagggacaaaagtgttcggctgcaagtcgcgcatatatccctcgttctttgtggccgagcgtgaaagaggtgatgggcgatatgctcgacagtatcaaaatgggtgacgtaatggaattcgacaactttgtcaacgccgttatcgacgaagcctctttcgataatatcatgaactatttggctgccgccaagcgagattcagatgccaagatcatattcggtggtgaaggagataagagcgtgggttactttatacggcctaccgttattgaaacgacaaatccgcattacgcaacgatgacggatgagcttttcggccccgtcctgaccgtatatgtctatgaggacaaagactttgccgatacgctacgcctttgcgacagtaccggccgttacgggctgaccggctccatcttctctcgcgaccgctatgccatcgaacaggctttggatgctctgcgcttctccgccggtaacttctacatcaatgacaagccgacgggtgccgttgtaggacagcaaccttttggcggtgcgcgtgccagtggaactaacgacaaggcaggcgggccacttaatctgatgcgttggtgcaatccacgtaccgtgaaagaaaccttcgtgccaccgacggattatccctatccgtttttggcaaaggattga

SEQ ID NO: 12565 - protein, 543 aa, Porphyromonas gingivalis
MNNSHFAFAKPVNEPVYGYAPGSPERKKLKEELQRQLSTPIEIPIIIGGKEIRTGDTGTVVMPHNHAVRLATYHRVGEKEVLQAIEAAEKARQDWSRLPWTERASVMLRIGELISTKYRYQLAASVMLGQSKNPMQAEIDAPCELIDFLRFGAYYAGQIYADQPISEKGILNRVEYRSLEGFVLAVTPFNFTSIASNLNLAPAMMGNTTIWKPSTTALHSNYLLMKIFQEAGLPDGVVNFLPGQGSLIGRVATANEHLAGFHFTGSTATFNTLWKSIAGNIDRYRGYPRIVGETGGKNFVMVHPSAEACEVATALVRGAFEYQGQKCSAASRAYIPRSLWPSVKEVMGDMLDSIKMGDVMEFDNFVNAVIDEASFDNIMNYLAAAKRDSDAKIIFGGEGDKSVGYFIRPTVIETTNPHYATMTDELFGPVLTVYVYEDKDFADTLRLCDSTGRYGLTGSIFSRDRYAIEQALDALRFSAGNFYINDKPTGAVVGQQPFGGARASGTNDKAGGPLNLMRWCNPRTVKETFVPPTDYPYPFLAKD

SEQ ID NO: 12566 - DNA, 3981 bp, Photorhabdus luminescens
  CDS (1)..(3981)
atgggtagtacaacaatgggcgtgaagcttgatgaagcaacgcgtgatcgcattaaagctgcggcacaacggattgaccgcactccacattggctaattaaacaagctatttttaattatcttgaacgtcttgaaaatgatgaacagatcgctgaactctcgtccaatcaagatgttaaagaggagaagataatcgcagaagaaacggtaacagattctgctcatcaacctttcctcgacttcgctgagcatatcctgcctcaatcagtaaaacgttccgcaattactgcggcctatcgcctgccagaaacacaagccattcccatgctgttacaacaggcacaattgccggaagatcaggcacaagcaactcataagctggcttacagcattgcagaaaaattacgtaaccagaaaaacagcatgggtcgttcaggtctggttcaagggttattgcaagaattctcgctttcatctcaggaaggcgttgcactaatgtgtcttgcggaagctttactccgtatccctgataaagccactcgcgacgcgctgatccgcgacaaaatcagtaacggcaattggcattcccatctgggccaaagttcatccatgtttgtcaatgcagcaacctgggggctgctgtttaccggcaaactggtttctacccataacgaagctaaactttccaattcactgaatcgcattatcagtaagagtggcgaaccattagtgcgtaaaggcgtagatatggcaatgcgcctgatgggtgaacagtttgtgaccggagaaaccatcgctcaagcgctggcaagtgcacgtaagctggaagaaaaagggttccgttactcctacgacatgctaggtgaagccgctttaactgaggaagatgctcagaattatatggtttcctaccaacaagcaattcatgctatcgggaaagcatccaacggccgcggcatttatgaagggcccggaatttccattaagctttctgccctgcacccgcgttatagccgtgctcaatatgaacgcgtcatgaatgagctatatccacgcctgctttccctgacattacaagcacgccaatatgatgttggtatcaatattgatgccgaagaagcagatcgtctggaaatttctctcgatctgttggaaaagctctgttttgaaccgcaactggctggctggaatggcattggtttcgttattcaagcttatcagaagcgctgcccctttgttatcgatacagttattgacttagcacagcgcagccgccgccgactgatggtgcgactggtaaaaggcgcttactgggatagcgaaattaaacgtgctcaaatcgacgggctggaaggttatcccgtttacacccgcaaagtttatactgacgtttcttatctggcttgtgcccgcaaactattgtcagtacctaatctgatttatcctcagtttgctacccataacgcccatactttagctgctgtttatcatatggcgggccaaaactattatcctggccaatatgaatttcagtgtttgcatggcatgggagaaccattgtatgaacaagtggtcgggaaaatcgctgatggtaaattaaaccgcccatgccgtatttatgcaccagtaggcactcacgaaacactgttggcttatctggtccgtcgtctgttggagaacggcgctaacacctcttttgtcaaccgtatcgccgataccacattaccactggatgaactggttgccgatccagtgacaaaggtcaagaagctggccgaaaccgacggccaaatcggtcttccacatcctaaaatccctctgcctcacaatttgtatggcaaagatcgcgcaaactcagccggtttggatcttgccaacgaacatcgcctggcttctctttccagtgcactattaagttctgctaccgaagagcagtatagcgagccgcgactgggcggcaattatcaccatcaaggtgagttaccggccgccaaaccagttattaacccggcaaccccttcggatattgtcggctatgttcgtgaagcaactgaacaggaagtcagtcatgcgttggatgtcgcaacagaagctggcgcaatctggtttgcaacaccaccatcagaacgggctgccattctggttcgtgcggcggaattgatggaaaaccagatgcagccgttattaggcattttggttcgggaagccggcaaaacctttaataatgcgattgctgaagtacgtgaagcggtcgatttcctccattattacgcgggacagattcgccatgatttcgctaacgatactcatcgcccactggggccggttgtctgtatcagcccgtggaatttcccattagccatttttaccgggcagatagcggctgcattggctgccggtaacagcgtattagcaaaacctgcggaacagaccccattaattgcggcaacagcggtcaaaatactgcatcaagcaggtattccccttgatgcattgcaattattacccggccaaggtgaaaccatcggtgctcttctggtgggtgatgagagagtgcgaggtgtgatgtttactggctccactcaagtggcgagtctattacaacgtaacattgccggacgacttgatgcacaagggcgaccaacccctctggttgccgaaaccggtggcctaaatgccatgattgtcgactcttccgcgctgacagaacaagttgttatggatgtggtcgcttctgcttttgacagtgcaggtcaacgttgttctgccttgcgtatcctttgcattcaagatgatgtggcagaacgcaccatgactatgttgaaaggtgccatgtctgaatgccggatgggtaatcctgaacgcctgtctaccgatatcggcccggtcattgatgcggaagccaaagccggcattgatcgccatattcaagcaatgcgtaccaaagggcgcacgatttatcaggcagcacaagataatgtggtcgacaatcaagagtgggatcaaggcactttcgttaaaccgacactgattgaactggaaagctttgatgaattgaaacaggagattttcggcccggttctgcatgttgtccgttttaaacgtcatgaactggataaattactggatcagattaataactctaactatggtttgacccttggtgtccatacccgtattgatgaaacaattgcacaagttaccgctaaagcgaaagtcggcaatctgtatgttaaccgcaacatggtaggcgctgttgttggcgtgcaaccattcggtggtgaaggcttgtccggtaccggaccaaaagccggcggcccactctatctgtatcgtctgctctcttgccgtcctcaaaatgcgatcaaccaaacgttggaacgtcaggatgcggaatatccactggatgctaatgttcgttcagcgctaatggctccctttgatgcgctgacagaatgggcagccaatcagcacaacgaagagctaaatcagttagttcaacaatataaattgctggcacaaggtggtaccacccgtctgttgccggggccgaccggcgaacgtaatacttacaccctattacctcgtggtcaggtgctgtgtctggcggataatcaacaagatacattgatccaactggcagcaacactgtctgtaggctgtcagttgctatggcaaaatgatgaattacatcagcaactgtttcgtcaattgccagatagcgtccgtaaatcaatccatttggttcaggactggcagagtgaagatacggcattcgaagcggttatttaccacggcgactctgatcaactgcgtcaagtttgcggacaagtcgctcaacgtaaaggcattatcatttccgtacaaggttttgcccgtggagaaactaatctgctgttagaacgtctgctacatgaacgttcactgagcattaacaccgcggcagcggggggtaatgccagcctgatgactatcggttaa

SEQ ID NO: 12567 - protein, 1326 aa, Photorhabdus luminescens
MGSTTMGVKLDEATRDRIKAAAQRIDRTPHWLIKQAIFNYLERLENDEQIAELSSNQDVKEEKIIAEETVTDSAHQPFLDFAEHILPQSVKRSAITAAYRLPETQAIPMLLQQAQLPEDQAQATHKLAYSIAEKLRNQKNSMGRSGLVQGLLQEFSLSSQEGVALMCLAEALLRIPDKATRDALIRDKISNGNWHSHLGQSSSMFVNAATWGLLFTGKLVSTHNEAKLSNSLNRIISKSGEPLVRKGVDMAMRLMGEQFVTGETIAQALASARKLEEKGFRYSYDMLGEAALTEEDAQNYMVSYQQAIHAIGKASNGRGIYEGPGISIKLSALHPRYSRAQYERVMNELYPRLLSLTLQARQYDVGINIDAEEADRLEISLDLLEKLCFEPQLAGWNGIGFVIQAYQKRCPFVIDTVIDLAQRSRRRLMVRLVKGAYWDSEIKRAQIDGLEGYPVYTRKVYTDVSYLACARKLLSVPNLIYPQFATHNAHTLAAVYHMAGQNYYPGQYEFQCLHGMGEPLYEQVVGKIADGKLNRPCRIYAPVGTHETLLAYLVRRLLENGANTSFVNRIADTTLPLDELVADPVTKVKKLAETDGQIGLPHPKIPLPHNLYGKDRANSAGLDLANEHRLASLSSALLSSATEEQYSEPRLGGNYHHQGELPAAKPVINPATPSDIVGYVREATEQEVSHALDVATEAGAIWFATPPSERAAILVRAAELMENQMQPLLGILVREAGKTFNNAIAEVREAVDFLHYYAGQIRHDFANDTHRPLGPVVCISPWNFPLAIFTGQIAAALAAGNSVLAKPAEQTPLIAATAVKILHQAGIPLDALQLLPGQGETIGALLVGDERVRGVMFTGSTQVASLLQRNIAGRLDAQGRPTPLVAETGGLNAMIVDSSALTEQVVMDVVASAFDSAGQRCSALRILCIQDDVAERTMTMLKGAMSECRMGNPERLSTDIGPVIDAEAKAGIDRHIQAMRTKGRTIYQAAQDNVVDNQEWDQGTFVKPTLIELESFDELKQEIFGPVLHVVRFKRHELDKLLDQINNSNYGLTLGVHTRIDETIAQVTAKAKVGNLYVNRNMVGAVVGVQPFGGEGLSGTGPKAGGPLYLYRLLSCRPQNAINQTLERQDAEYPLDANVRSALMAPFDALTEWAANQHNEELNQLVQQYKLLAQGGTTRLLPGPTGERNTYTLLPRGQVLCLADNQQDTLIQLAATLSVGCQLLWQNDELHQQLFRQLPDSVRKSIHLVQDWQSEDTAFEAVIYHGDSDQLRQVCGQVAQRKGIIISVQGFARGETNLLLERLLHERSLSINTAAAGGNASLMTIG

SEQ ID NO: 12568 - DNA, 2991 bp, Gloeobacter violaceus
  CDS (1)..(2991)
atggaattgccgccattccaggaaactcgcgtgctcaccgtcgatccgatcgaatccgaaacccagcgcatcggccaatcgctgctcgctgccccccagcagagtcgtttttcattttttgagcgttctttttgggacgagaagctgctggagtgggcgatggcggacgacgagctgcgcgtgcagctgtttcgctttatcgactgcctgcctgccctcaagaccaatcgcgaggtggcttcccacctgcaggagtacctggggtcggtgaagctgcccgggccgctggccaaggcgctcgattttgccgacccgggttctccggcggcggcggtggcgacgttgggcttgcgccagggcatcagccagatggcccgccgctttatctgcggcgagaatctcaaaaccgccgtcaagacgatcgagaagttgcgttctcagaacatggccgtctcgctggacttgctcggtgaggcggtggtctcggaggcggaagccgaggtgtatcagcggcgctacttggagttgctgagcgatctgcacgccgcccaatcgcgctggccggtgatcgaccaaatcgaccgggcggacggacaattgctgccccgggtgcatttcgccctcaaactcacctcgctctacagccagttcgacgctatcgaccccgccactacaggccgcaacgtcaaggcgcgcctgcggccgattttgcggaaggcgcgggagttgggcgccttcgtgcacatcgacatggagcaatcccaacacaaagacctgatcttgcagatttttaaagaggtcatggtcgaagcggattttcgcgattggatcgacaccggtatctgtctgcaggcgtacctgcgctccgccgaactcgatgcggccaatgtcatcgcctggtcaaaagaacgcggctatccggtcactgtgcgcctggtcaaaggtgcctactgggacggcgaagtcatccgcgcagcccagcagcgctggcctgtgccggtctttacccgcaaggccgataccgacgcgcagtacgaaaaagtcctgcacctgctgatggagaatcatcggagtgtgcacatcgcggtgggcagccacaacgcccgcacggtggctttggcgattgccctggctcgccggaaccgggtaccgcgccgggcctttgaagtgcagatgctctacgggatggcggaccacctcaaggcgggagtggcgcagcagggagagcgattgcgggtgtacgcgccctacggagagctgttgcccgggatggcgtatctgattcgccggttgttggagaacacggcgaacacgtcgtttttgcgccagagtgtgcgtccgggcagcgatgtggtgcggttactggccccccccgctgcgagcggcgaggcggcgccgagcctgatgggcagcgaatttgtcaatgcaccggatcgagattttgcggtggcggcggagcgcgagaagctggcggctgggctggccgaggtgcgcacctgttttggacagacgtactggccggtggtgggaggtaaagcgcgcagaggtttgcccacgctctcggtccccaacccggctgaacctgggaccgtcctgggagcgctcggtcttgccgacgctgaattggccgacgaagcggtcaaagttgcccacaccgcctggcttagttggagcaaaaccacccccgaagcgcgcgcccgactgcttgggcgcctcgccgaactgatggaacaacagcgttccgccctcaccgcctggatcgtctacgagaccggcaaaccctggcgcgaatccgacgccgacgtctcagaagcgatcgacttctgccgctactacggccggcaaatcctcaagctcaccgcccaggcccagcaccgcgacgtgccgggcgaaaccaacggctaccactaccgctcgcggggggtggcggcggtgatcgctccgtggaattttccgctcgccatcctcaccggcatgaccaccgcggcgcttgccacaggcaataccgtgatcatgaaaccggccgagcagtcatcgattgtggccgctcaactgatgcggctgtgcgagcaagccggttttgcggccggggtggtcaactacctgccgggcaggggcgaggtggtcggagcgaagctggtggcgcacccgcaggtgcatttgattgctttcaccggttcgcttgcggtcggtcagcggattttggccgaggcgagcatggtgcgtccgggtcagcgccacctcaagcgggtgattgcggagttgggaggtaagaacgcgatcatcgtcgacagcgacgcggatctcgaccaggcggtcgtgggggtggtgcaatcggcgttcggctacagcggccagaagtgctcggcctgttcgcggctgattgtgctcgaagggatttacgacgtctttatcgaacggctcgtccaggccacccgctcgctcatcgtgggcaatcccgcacagcccgccacctacaccggcccggtgattgcccgcgacgcctgcgagcgcatccgtggcgtcatcgaagatgccaagggtcgccatcgcctggtgttggaggtagatgtctctcacctgggcgaggggtactttatcgggccgaccatcttcgcggacgtcgatccgcaatcgtcactggcccaggaagaaatcttcggcccggtgctcgccgtcatcaaagcccgcgacttcgagcacgccatcgagattgccaacggcaccagctttgctttgaccggcggcctcttctcgcgcagcccgaggcacattgccgaagcgcgcgagcgctttgaagtgggcaatctgtacatcaaccgcaagatcaccgcagctttggtggaccggcagcccttcgggggcttccgcctttcgggcgtcggctcgaaggcggggggaccggactacctgctgcaatttgtcgagccggtgacggtgacggaaaacatccagcgccagggcttcgcacctctgccgggcgagctgtag

SEQ ID NO: 12569 - protein, 996 aa, Gloeobacter violaceus
MELPPFQETRVLTVDPIESETQRIGQSLLAAPQQSRFSFFERSFWDEKLLEWAMADDELRVQLFRFIDCLPALKTNREVASHLQEYLGSVKLPGPLAKALDFADPGSPAAAVATLGLRQGISQMARRFICGENLKTAVKTIEKLRSQNMAVSLDLLGEAVVSEAEAEVYQRRYLELLSDLHAAQSRWPVIDQIDRADGQLLPRVHFALKLTSLYSQFDAIDPATTGRNVKARLRPILRKARELGAFVHIDMEQSQHKDLILQIFKEVMVEADFRDWIDTGICLQAYLRSAELDAANVIAWSKERGYPVTVRLVKGAYWDGEVIRAAQQRWPVPVFTRKADTDAQYEKVLHLLMENHRSVHIAVGSHNARTVALAIALARRNRVPRRAFEVQMLYGMADHLKAGVAQQGERLRVYAPYGELLPGMAYLIRRLLENTANTSFLRQSVRPGSDVVRLLAPPAASGEAAPSLMGSEFVNAPDRDFAVAAEREKLAAGLAEVRTCFGQTYWPVVGGKARRGLPTLSVPNPAEPGTVLGALGLADAELADEAVKVAHTAWLSWSKTTPEARARLLGRLAELMEQQRSALTAWIVYETGKPWRESDADVSEAIDFCRYYGRQILKLTAQAQHRDVPGETNGYHYRSRGVAAVIAPWNFPLAILTGMTTAALATGNTVIMKPAEQSSIVAAQLMRLCEQAGFAAGVVNYLPGRGEVVGAKLVAHPQVHLIAFTGSLAVGQRILAEASMVRPGQRHLKRVIAELGGKNAIIVDSDADLDQAVVGVVQSAFGYSGQKCSACSRLIVLEGIYDVFIERLVQATRSLIVGNPAQPATYTGPVIARDACERIRGVIEDAKGRHRLVLEVDVSHLGEGYFIGPTIFADVDPQSSLAQEEIFGPVLAVIKARDFEHAIEIANGTSFALTGGLFSRSPRHIAEARERFEVGNLYINRKITAALVDRQPFGGFRLSGVGSKAGGPDYLLQFVEPVTVTENIQRQGFAPLPGEL

SEQ ID NO: 12570 - DNA, 3594 bp, Chromobacterium violaceum
  CDS (1)..(3594)
atgcaattcgaatcctttgctcatcagcagtccgctctgcgcgatgcgatcaccgccgcttaccggcgcgatgaacgcgagtgcgtgcaggctttgttgcctcaggcggcgatgagtcccgagcaagtcgcatcagtgcaagaccttgcccgtcggctggtgaccgaggtgcgccgcgagcgcacccgttccagcggcgtggacgcgctgatgcacgagttctcgttggacagcagcgaagggatcgccctgatgtgtctggcggaggcgctgctgcgcatccccgaccgcgagacggccgacaagctgatccgcgacaagatttcccgcggcgactggaaggcccatttgggcaacagttcgtcgctgttcgtcaacgcggccgcttggggcctgctggtgaccggcaagctggtttcctctcatagcgccaacggcctgtcggcggcgatgacgcgcctgatcgccaaaggcggcgagccgctgatccgcaagggcgtcgacatggcgatgcgcatgctgggcaagcagttcgtcaccggcgagacgatcgaggaagcgctggccaacggccgcgaacgcgaagcgcgcggttaccgcttcagctacgacatgctgggcgaagcggcgatgaccgaagccgacgcccaacgctacctgaaggactacgtcaccgccatccatgcgatcggcaaggagtcgaacggccgcggcatctatgacggccccggcatctcggtgaagctgtccgcgatccacccgcgctatgcccgcctgaagcatgaacgcatgatgaccgagctgctgcctcgactgaaggcgctgttcctgttggccaagcaatacaatatcggcctgaacatcgacgccgaggaggccgaccgcctggagatctcgatggacctggtcgaagcgctggccaacgatgcggacctgaacggcttcgaaggcatcggcatcgtggtgcaggcctaccagaagcgctgtcccttcgtgatcgatttcctgatcgacctggcgcgccgcaccggccaccgcttcatggtgcggctggtgaagggcgcctactgggacgccgagatcaagcgcgcccaggtggacggcctgcctggctatccggtgtatacgcgcaaggtgtacaccgatgtgtcctaccttgcctgcgccaagaagctgctggccgcccaggacgcgatctacccgcagttcgccacgcacaacgcctacagcctgtcggcgatttacaacctggccgccggcaaggattacgagttccagtgcctgcacggcatgggcgagaccctgtacgaccaggtagtgggcaaggacaagctgggcaaggcttgccgcatctacgcgccggtcggctcgcatgagacgctgctagcctacctggtgcgccgcctgctggaaaacggcgccaactcctccttcgtcaaccgcatcgtcgacgaaaacgtgtccatcgacgaactggtgaccgatccggtggccgaggccgccggcttttccggcatgccgcacagcaagattccgctgcctgaggcgctgtacggcgaaggccgccgcaattccaaaggcctggacctgtccagcgagcacgtgctggccacgttgcagctgggcctgcaggcgtccgagcagcagcgttgggccgccttccccatgctgggagatggcgatgtcaccgacggcgagctgcaggaagtgcgcaatccggccgaccacagcgatgtggtgggcaaggtgatagaggccagcgccgccgacgtcgagcgcgcgctggccctatcggccggcatcgccgccgcctgggccgcgacgccggtagccgagcgcgcggccagcatccgccgcatggccgacctgatggaggcgcacatgccggcgctgatgggcctggcggtgcgcgaggcgggcaagacgctgaacaacgccatcgccgaagtgcgcgaggcggtggatttctgccgctactacgccgcgcagatcgtgtctgagttcgacaacgccagccaccggccgctgggtcctgtggtgtgcatcagcccgtggaacttcccgctggccattttcatcggcgaagtcgtcgcgtctttggccgccggcaatactgtactggccaagccggccgagcagaccagcctgatcgccgcctacgcggtgcgcctgctgcacgaggcgggcatcccgcgcgcggcgctgcagttcctgccgggccgcggcgaggtggtcggcgccgcgctgaccggcgacgcgcgcatccagggcgtgatcttcaccggttccaccgaggtggcgcagatcatcaaccgcacgctggcaaaacgccaagacgatccggtgctggtggcggaaaccggcggcatgaacgcgatgatcgtcgacagctcggcgctgccggaacaggtggtcaccgatgtgctgagctctgccttcgattccgccggccagcgttgctcggcgctgcgggtgctgtacctgcagaacgacatcgccgacaaggtgatcgcgatgatcaagggggcgatggatgagctgaccatcggcaatccggccaagctgaccaccgacgtcggtccggtgatcgacgccgaggcccaggccggcctgctcgcccacatcgccaggatgaagaactccgcccgcgcgatgcaccagaccaagctgtccgcggcgtgcgagcagggcactttcgtcgcgccgacgctgttcgagatcgacaatctgtcggagctcaagcgcgaagtgttcggcccggtgctgcacgtgctgcgctatgccgcgtcggatctggacaaggtggtggccgagatcaacgccaccggctatggcctgacccacggcatccacagccgcatcgacgaaaccatcgccgacatctgcggcaagatcaaagtgggcaatatctacgtcaaccgcaacatcgtcggcgcggtggtcggggtgcagcccttcggcggcgagggcaagtccggcaccggtcccaaggcaggcggtccgtactacctgtaccgcctgacccgtgccgcctggcagccgaagctggccgccgtgccggcggcggccgatttgtccgcgctggacgcgctggcggccgcggccaaggcgcagagcctggcgctggacggcgcgatcgccgccgcgcgcaaggaaagcccgctgacgcatagcgtggcgttgccggggccgaccggagaaaacaacttgctgtccttcgccggccgcggccgcataggctgcgtcgccgacgacgcgcaggcgctggccgaacagctggccgcggccttcgccgccggcaaccgcgcggtgctggccgataacgagctgggacgcaagttcgcgtccgccttgaacggccatgtgtcgctggctgccgacgtgctggaagcggatgtcgatgcggtgttgtacgccggcgccaaggccgaggaggcacggcgcgagctggccgcccgcgacggcgcgctggttccgctgatcctgcgcggcgaaaatggctacaatgtgcatcggctggtggtcgagcgcgcgcttagcgtcaataccacggcggccggcggaaacgccagcctgatgagcatgaccgaatga

SEQ ID NO: 12571 - protein, 1197 aa, Chromobacterium violaceum
MQFESFAHQQSALRDAITAAYRRDERECVQALLPQAAMSPEQVASVQDLARRLVTEVRRERTRSSGVDALMHEFSLDSSEGIALMCLAEALLRIPDRETADKLIRDKISRGDWKAHLGNSSSLFVNAAAWGLLVTGKLVSSHSANGLSAAMTRLIAKGGEPLIRKGVDMAMRMLGKQFVTGETIEEALANGREREARGYRFSYDMLGEAAMTEADAQRYLKDYVTAIHAIGKESNGRGIYDGPGISVKLSAIHPRYARLKHERMMTELLPRLKALFLLAKQYNIGLNIDAEEADRLEISMDLVEALANDADLNGFEGIGIVVQAYQKRCPFVIDFLIDLARRTGHRFMVRLVKGAYWDAEIKRAQVDGLPGYPVYTRKVYTDVSYLACAKKLLAAQDAIYPQFATHNAYSLSAIYNLAAGKDYEFQCLHGMGETLYDQVVGKDKLGKACRIYAPVGSHETLLAYLVRRLLENGANSSFVNRIVDENVSIDELVTDPVAEAAGFSGMPHSKIPLPEALYGEGRRNSKGLDLSSEHVLATLQLGLQASEQQRWAAFPMLGDGDVTDGELQEVRNPADHSDVVGKVIEASAADVERALALSAGIAAAWAATPVAERAASIRRMADLMEAHMPALMGLAVREAGKTLNNAIAEVREAVDFCRYYAAQIVSEFDNASHRPLGPVVCISPWNFPLAIFIGEVVASLAAGNTVLAKPAEQTSLIAAYAVRLLHEAGIPRAALQFLPGRGEVVGAALTGDARIQGVIFTGSTEVAQIINRTLAKRQDDPVLVAETGGMNAMIVDSSALPEQVVTDVLSSAFDSAGQRCSALRVLYLQNDIADKVIAMIKGAMDELTIGNPAKLTTDVGPVIDAEAQAGLLAHIARMKNSARAMHQTKLSAACEQGTFVAPTLFEIDNLSELKREVFGPVLHVLRYAASDLDKVVAEINATGYGLTHGIHSRIDETIADICGKIKVGNIYVNRNIVGAVVGVQPFGGEGKSGTGPKAGGPYYLYRLTRAAWQPKLAAVPAAADLSALDALAAAAKAQSLALDGAIAAARKESPLTHSVALPGPTGENNLLSFAGRGRIGCVADDAQALAEQLAAAFAAGNRAVLADNELGRKFASALNGHVSLAADVLEADVDAVLYAGAKAEEARRELAARDGALVPLILRGENGYNVHRLVVERALSVNTTAAGGNASLMSMTE

SEQ ID NO: 12572 - DNA, 1806 bp, Neurospora crassa
  CDS (1)..(1806)
atgtcggcacggaggcttcagaggctgtctcttaccacttcgagtggtctgagatcagctcgcacatcctcgactaccatcaactctgcattgctaaggccgcagctatataaccagagatccaggacagccatacccagcatcgtcaggacgaactctaccctcgcaaccttcaaagtccctacagtggccaacgagcccaatcaacactatgccaaaggctcagaatcacgacacaagctcacggaagcttatacggcgctttcaaagaatcttcctgtcgacgttcccattaacatccgcggaaggacgcttagcaaagcagacaccaagtaccaggtgaaccccgccgatcaccaacagaaaatagccaattatgccgtggcaacccccgaaatggtcaacctggctatcaatgccgccctgaacgcaaagccggcatgggaaagcttgcccttcgctgacagagcggcagtcttcctcaaggccgccgatctgattagcaccaagtatcgctacgagttgatggccgcaacaatgttgggccaaggcaagaacgcctggcaggccgaaatcgatgccgctgctgagctctgtgactttctccgcttcaacgtccaatatgcggagcaactatacgctcagcaaccggcacataactcccccggtgtctggaaccgtgtcgagtacaggccacttgagggctttgtctatgccgtcaccccgttcaacttcactgccattgcgggcaaccttccaggcgtggcagcactgctgggcaatgttgtggtctggaagccgagcgattccgcgatcctcagcaactaccttctgtacaaggtccttctcgaagcgggactcccgcccgatgtcattcagttcatccccggcgatcctgagttggtgacaaaggaagtgctcgcgcacaaggactttgcggctctacactacacaggcagcactgccgtcttccgtaagctctatggccagattggcgctggcgttgctgagggtaggtatcgatcatatcctcgcattgttggcgaaaccggtggcaagaacttccacctggttcacaagtctgccgatctacgaaacgctgttgtccagacggtccgcggtgcattcgaataccagggccagaagtgcagcgccacttcccgactgtacgttgccaagtcgatttggccagatttccaggagcttctcgtccaagaaacggagaagttgaaagttggcccacctcatgatcatggaaacttcatgggcccggtcattcatgccgcctctttcaagaagctgagcacggctattgacgagggcaaaaaagacccagacctccagctaattgcaggaggagaatacgacagctcggttggttactacgtcaagccaaccatctttgtgtccaagacgccagaccataaactcttttcgacggagctgttcggacccgtcttgacggtctacgtctatgatgactacgtagacagcactacctctatctacgacatcatcgacggagctacggaatatgggctgacgggctcaatctttgcaagtgaccggagcgttatccggttcgcagaggagaaactccgcaactcggcaggaaacttctacattaactgcaagagtacgggtgctgttgtaggccagcagccatttggtggcagccgagcgagcgggaccaatgacaaggccggcagcatcaacctcctgagtcggtttgttagcatgagaagcatcaaggaggaatttaactcgacgaccacggtgacatatcccagcaatgaggtcgagtag

SEQ ID NO: 12573 - protein, 601 aa, Neurospora crassa
MSARRLQRLSLTTSSGLRSARTSSTTINSALLRPQLYNQRSRTAIPSIVRTNSTLATFKVPTVANEPNQHYAKGSESRHKLTEAYTALSKNLPVDVPINIRGRTLSKADTKYQVNPADHQQKIANYAVATPEMVNLAINAALNAKPAWESLPFADRAAVFLKAADLISTKYRYELMAATMLGQGKNAWQAEIDAAAELCDFLRFNVQYAEQLYAQQPAHNSPGVWNRVEYRPLEGFVYAVTPFNFTAIAGNLPGVAALLGNVVVWKPSDSAILSNYLLYKVLLEAGLPPDVIQFIPGDPELVTKEVLAHKDFAALHYTGSTAVFRKLYGQIGAGVAEGRYRSYPRIVGETGGKNFHLVHKSADLRNAVVQTVRGAFEYQGQKCSATSRLYVAKSIWPDFQELLVQETEKLKVGPPHDHGNFMGPVIHAASFKKLSTAIDEGKKDPDLQLIAGGEYDSSVGYYVKPTIFVSKTPDHKLFSTELFGPVLTVYVYDDYVDSTTSIYDIIDGATEYGLTGSIFASDRSVIRFAEEKLRNSAGNFYINCKSTGAVVGQQPFGGSRASGTNDKAGSINLLSRFVSMRSIKEEFNSTTTVTYPSNEVE

SEQ ID NO: 12574 - DNA, 1985 bp, Brachydanio rerio
  CDS (108)..(1778)
agtatcaaaattccacctcagcgccgtggttcctcaacaggaggatatttctgaattgtatatatataaataatatctctgtgcttccctgtacggccaaatcaacgatgctgcgagcgaggtctgccgtcagtcagtcgtggaaagggttcaagactttctcgtgtgtagcggtggaggtgaagaatgagcccgttctggagtttaaagagggcagtaaagagagagcagaactggaggaggcgttacgaaacctgaagggaaaaacagaagaaattccatgtgtgatcggaaatgaagaagtgtggaccaaagacatccgattccagctgtctcccttcaaccattctcaccaagttgcaaagttctgctatgctgacaaggatcttctaaataaagccattgaggcttcagtcgctgctcggagggaatgggatcttaaaccggtctcagatcgagcccagatcttcttcaaagctgccgacatcatcagtgggcccaagagagcagaagtactggccaagactatgatcggacagggtaagactgtggttcaggcggagatcgacgcagctccagaactcattgacttcttcaggtttaatgccaaacatgcaattgagcttgaagaccagcagccgctggacagtgacggcagcacaaacaccatgctgtaccgcggcctagagggatttgttgctgctgttgctccatttaacttcacagcgattggcggaaacctggccggcactcctgctcttatgggtaacgttgtgctgtggaaacccagtgataccgccatgtctgccagttatgcagtctataagatcctgagagagtctggattgccaccgaacatcattcagtttgtcccggcagatgggccagtgtttggagacacagttacgtcctctgagcacctcgccggcatcaacttcaccggcagcgtcccaacgtttaagcggttgtggaagcaggtcgcccagaatctggacatctacaagaatttccctcgcgttgctggagagtgtggtgggaagaacttccactttgtgcacaagtctgcagacgtccgcagtgtggtgaccggcaccatccgctccgcgtttgagtacggaggacagaaatgttctgcctgctctcgtatgtacgtcccagactctctctggcctcagatcagacagggcctcctggacgtctacaaacagatcaaagttggagacccagtggaagatttcagcactttcttctcagcggtgattgatgacaagtctttctccaggattaaaggctggcttgaacacgccagatcttctccacatctgaagatcatcgctggaggaaactgcgacgacaagaagggctatttcgtggagcccacaataatcgagaccaccgacccacaggagaagatcatgaatgaggagatcttcggacccgtcctgacagtctacgtttaccctgaaaacgactacaagaaagtcctgcacttaatagacaacacttctccatacgccctaacaggagccatcttcccccaagacaaatctgttatagaggaggccggaaaagctttaagaaatgctgcaggaaactattatatcaatgataaatcgacaggatcaatcgtggcccagcagccttttggtggcgccagagcgtcaggcaccaacgacaaacccggcggcccccattacgtcctacgctggacatcccctcaggtggtcaagcagacacacgtcccactcacagaatggaaatatccttacatgagctaaaagaccgcttcatttctctaaaatccttcctaaaagactcttcttaccgtcccaaaaccgcagacaaagtgtggtaatgatgaagagcaacagtaaaaagcagaccagactgaatgtatccccgaagatttctctgcaaacatcactggattattaatacaagctattaattcagcaaagaaaaaaaaaaaaaaaaaaaaaaaaaaa

SEQ ID NO: 12575 - protein, 556 aa, Brachydanio rerio
MLRARSAVSQSWKGFKTFSCVAVEVKNEPVLEFKEGSKERAELEEALRNLKGKTEEIPCVIGNEEVWTKDIRFQLSPFNHSHQVAKFCYADKDLLNKAIEASVAARREWDLKPVSDRAQIFFKAADIISGPKRAEVLAKTMIGQGKTVVQAEIDAAPELIDFFRFNAKHAIELEDQQPLDSDGSTNTMLYRGLEGFVAAVAPFNFTAIGGNLAGTPALMGNVVLWKPSDTAMSASYAVYKILRESGLPPNIIQFVPADGPVFGDTVTSSEHLAGINFTGSVPTFKRLWKQVAQNLDIYKNFPRVAGECGGKNFHFVHKSADVRSVVTGTIRSAFEYGGQKCSACSRMYVPDSLWPQIRQGLLDVYKQIKVGDPVEDFSTFFSAVIDDKSFSRIKGWLEHARSSPHLKIIAGGNCDDKKGYFVEPTIIETTDPQEKIMNEEIFGPVLTVYVYPENDYKKVLHLIDNTSPYALTGAIFPQDKSVIEEAGKALRNAAGNYYINDKSTGSIVAQQPFGGARASGTNDKPGGPHYVLRWTSPQVVKQTHVPLTEWKYPYMS

SEQ ID NO: 12576 - DNA, 3822 bp, Bordetella bronchiseptica
  CDS (1)..(3822)
atggctagcacgactctgggcgtcaaggtcgacgacgcattgcgcgatcgcctcaaagccgccgcgcagaaactgaactgcaccccgcactggctgcacaagcaggccattctttcctatctcgacagaatcgaacgcggccatctgccggcggagatggcccatctggggcgcgacgagcgcggcgaggacgaggacgcaggcgcgtcggccgatgccatgccgcctttcttcgagttcggccaggacgtgcaaccgcaatccgtgctgcgcgccgccatcaccgcagcctatcgccggcccgagccggaatgcgtgccgttgctgctggggcaggcccgcgtggccggccccgagaaggtgcacgccatggccagcaagctggtccacgcgctgcgggccaagcgcagcggcggcggcgtcgaaggactgatccaggagttctcgctgtccagccaggaaggcgtggcgctgatgtgcctggccgaggcgctgttgcgcattcccgaccgcgccacccgcgatgccctgatccgcgacaagatcgcgcacggcgactggcgctctcacatgggcggatcgcagtcgctgtttgtcaacgccgcgacctggggcctgatgatcaccggcaagctggtcgccgtcagcagcgagcagtcgctgtccaaggcgctgacgcgcctgatcggcaagggcggcgagccgctggtgcgcaagggcgtgaacatggccatgcgcatgatgggcgagcagttcgtctcgggccagacgatctccgaagccctggccaacaaccgcaagatggaggcgcggggctttcgctactcgtacgacatgctgggcgaggccgccaccacggccgccgacgccgaacgctattacgcggcgtacgagcaggccatccatgccatcggcaaggcggccgccggacgcggcatctacgaaggcccgggcatctcgatcaagctgtcggcgctgcatccgcgttatgcgcgcgcccagcgcgaccgggtcatggccgagctgctgccgcgcgtcaaggcgctgacgctgctggcgcgccaatacgatatcggcctgaacatagacgccgaggaagccgaccggctcgagatttcgctggacctgctggaagccttgtgtttcgtccccgagctggacggctggaatggcatcggcttcgtcatccaggcctatcagaagcgcgcgccgttcgtgatcgattacgtgatcgacctggccaagcgcagccgtcaccgcctgatggtgcgcctggtcaagggggcgtattgggacacggagatcaagcgcgcccaggtcgacggcctggaggggtatccggtctacacgcgcaaggtgtacaccgacgtcgcctacctggcctgcgcgcgcaggctgctggcggcgcccgaggccacatacccgcagttcgccacccataacgcctataccctgtcggccatctaccagatggcgggacagaactactacccggggcagtacgagttccagtgcctgcacggcatgggcgaaccgctgtacgaggaggtggtcgggccgctggcgcaaggcaagctgaaccgcccgtgccgcatctatgccccggtgggcacgcacgaaaccctgctggcgtacctggtgcgccgcctgctggaaaatggcgccaacacttccttcgtcaacctgatcggcgacgacagcatcacggtcgagcaactggtggccgatccggtcgaggcggcgtcccgcatcgtgccgctgggcgcgccgcacgagaaaatccccctgccgcgcgagctgtacggcagcgtgcagcagggcgcgcgggccaactcggccggcctggacctgaccaacgagcatcgcctgggctcgctgtcggcggccctgctggccagcgccgcgatcgactggcgcgcctggcccatgctgggcgagggagatcccggctgggatccggccggcgcggtcgaagtggccaacccggccaacctgcgcgacatcgtcggccacgtcatgcaggccacgccgcaacatgtggaacaggccctgcgcgacgccgccaacgcggcgcccatctggcagtccacgccggtgcccgagcgcgcgcagtgcctgcggcgggcggcccagctgctggaagagcagatgcagacgctgcttggcctgatcgtgcgcgaggccggcaagtcgttgcccaacgccatcgccgaggtgcgcgaagcggtggacttcctgcgctattacgccgaccaggccgagcgcgaattcgacaacgatacccatcgtccgctgggccaggtactgtgcatcagcccatggaacttcccgctggccattttcaccggccaggtcgccgccgcgctggccgccggtaacaccgtgctggccaagccggccgagcagacgtcgctgatcgccggccaggcggtggccatcctgcgcgccgcgggcgtgcccgccggcgcggtgcaactgctgccgggccgtggcgaaaccgtgggggcccagctggtggccagtccgcaggtgcgcggcgtgatgttcaccggctcgaccgaggtggcgcgcatcatcgccggcgcgctggccgaacgcctggacgatcagggccacaccattccgctgatcgccgagaccggcggccagaacgccatggtgatcgattcgtcggcgctggccgagcaggtcgtgttcgatgtgctgacctcggcgttcgactccgccggccagcgctgctccgcgctgcgcgtgctgtgcctgcaggaggacagtgcggatcacgtgctggccatgctgcgcggcgcgatgcgcgagctgcgcgtgggcaatcccgaccgcctgtcggtcgacgtggggcccgtgatcgacgccgaggcgcgcaacggcatccagggccatatcgaggccatgcgctcgtccggacgcccggtcgaccaggtcgagctggcgggcgaatgccgctacggcacgttcgtgccgccgacgctgatcgagatcgaccatatcggcgagctcacgcgcgaagtgttcggcccggtgctgcacgtattgcgctaccggcgcgacgacctggacgggctgatcgagcagatcaacgccaccggttatgggctgaccttcggcgtgcatacccgcatcgacgaaaccatcgcccgcgtcaccgaacaggtgcacgctggcaacctgtatgtcaaccgcaacatcgtgggcgccgtggtcggggtgcaacccttcggaggcgaaggcctctcgggcaccggcccgaaggcgggggggccgctgtacatgtaccggctgctggccacgcgcccggccggcctgccgcccgccctcgacccggcggcgccgatgccgcaggcgcttgccttgccgggcccgaccggcgagaccaatacctaccgggtcgagccgcgcggcgcggtctattgcgtggccgccaccgaggccggcgcccgggcgcaatgggccgtcgtgagccagaccggcaaccatgcctggttcgccgatacgccggcggcgcgcgcctggatcgccggcctggacgccaggctgcgcgagcaggctgccttgctggaagattccgaacttgatgaggccgatttccaggcggtgctgttcgagggggacggcgacgccttgcgcgcgctgaacatgcgcatcgcccaacgtcccggccccctggtgtccgtgcatggcctgagcgccgatgccctggccgccggggccagctacgcgcccgaccgcctgctggccgagcgttcgatcagcgtcaatacggcggccgctggcggcaacgccagcctgatgacgataggttga

SEQ ID NO: 12577 - protein, 1273 aa, Bordetella bronchiseptica
MASTTLGVKVDDALRDRLKAAAQKLNCTPHWLHKQAILSYLDRIERGHLPAEMAHLGRDERGEDEDAGASADAMPPFFEFGQDVQPQSVLRAAITAAYRRPEPECVPLLLGQARVAGPEKVHAMASKLVHALRAKRSGGGVEGLIQEFSLSSQEGVALMCLAEALLRIPDRATRDALIRDKIAHGDWRSHMGGSQSLFVNAATWGLMITGKLVAVSSEQSLSKALTRLIGKGGEPLVRKGVNMAMRMMGEQFVSGQTISEALANNRKMEARGFRYSYDMLGEAATTAADAERYYAAYEQAIHAIGKAAAGRGIYEGPGISIKLSALHPRYARAQRDRVMAELLPRVKALTLLARQYDIGLNIDAEEADRLEISLDLLEALCFVPELDGWNGIGFVIQAYQKRAPFVIDYVIDLAKRSRHRLMVRLVKGAYWDTEIKRAQVDGLEGYPVYTRKVYTDVAYLACARRLLAAPEATYPQFATHNAYTLSAIYQMAGQNYYPGQYEFQCLHGMGEPLYEEVVGPLAQGKLNRPCRIYAPVGTHETLLAYLVRRLLENGANTSFVNLIGDDSITVEQLVADPVEAASRIVPLGAPHEKIPLPRELYGSVQQGARANSAGLDLTNEHRLGSLSAALLASAAIDWRAWPMLGEGDPGWDPAGAVEVANPANLRDIVGHVMQATPQHVEQALRDAANAAPIWQSTPVPERAQCLRRAAQLLEEQMQTLLGLIVREAGKSLPNAIAEVREAVDFLRYYADQAEREFDNDTHRPLGQVLCISPWNFPLAIFTGQVAAALAAGNTVLAKPAEQTSLIAGQAVAILRAAGVPAGAVQLLPGRGETVGAQLVASPQVRGVMFTGSTEVARIIAGALAERLDDQGHTIPLIAETGGQNAMVIDSSALAEQVVFDVLTSAFDSAGQRCSALRVLCLQEDSADHVLAMLRGAMRELRVGNPDRLSVDVGPVIDAEARNGIQGHIEAMRSSGRPVDQVELAGECRYGTFVPPTLIEIDHIGELTREVFGPVLHVLRYRRDDLDGLIEQINATGYGLTFGVHTRIDETIARVTEQVHAGNLYVNRNIVGAVVGVQPFGGEGLSGTGPKAGGPLYMYRLLATRPAGLPPALDPAAPMPQALALPGPTGETNTYRVEPRGAVYCVAATEAGARAQWAVVSQTGNHAWFADTPAARAWIAGLDARLREQAALLEDSELDEADFQAVLFEGDGDALRALNMRIAQRPGPLVSVHGLSADALAAGASYAPDRLLAERSISVNTAAAGGNASLMTIG

SEQ ID NO: 12578 - DNA, 1731 bp, Kluyveromyces lactis
  CDS (1)..(1731)
atgctatcatctcgtattcagctattgcgctcttcaaaacgatgcgttgcgcagctatcccatattcaaccacctaaacaaattggcaatgagccagttaaagcgttcggtagtaaggatttggttgattgggatttactaagggcttctttatctaagttcaaaaactcctctttggacgttcctttagtcattaacggcgaacgtatttattataacgacgacggtggtaagagaggcattttccagcaattgaacccagccaaccactctgaagttttagctaacgttactcaggctactaatgaagatgttaaagctgcaatccaagcttctaaacaagctaaggacaaatggtacaaattgccatattacgagcgtgcctccgttttcatgaaggcagctgatttgatttgtaccaaataccgttatgacatgctcgctgccactatgttgggtcaaggtaagaatgtataccaagcagaaatcgattgcatcactgaattggctgatttcttcagattcaacgtgaagtatgctaatgaattgtacgcccaacaacccattgaatcttctcccggtgtatggaacagggctgaatacagacctttagaaggctttgtgtatgcagtaactccgttcaatttcactgccattgctggtaatttgatcggtgcgcctgcgttgatgggtaacactgttgtgtggaaaccttctcaaaacgccaatttgtccaactacttgttattaactgttttggaagaagcaggtttgccaaatggtgttgtgaattttgtcccaggtaacgcagtggaagtcaccaaggaagttttgagcgactcggaattcgctgctttacatttcactggttctactgctgttttcaagcaactatatggagatatccagaagggtgttgtgaatggtttgtacagagactatccgcgtattgtcggtgagactggtggtaagaatttccacttgatccatccaagtgctaacattcctcattctgttctatccactttgagaggtgcatttgagttccaaggtcaaaaatgttctgctacttccagagtatacttgcccgaaagtaagagcgaggaattttttcgtgatttaggaggtgtcttatctgaagttcaaccagtgaacacatcggcatctaagattaacggtggtgatttacacggttttattggcccggtgatccatgaaggtagttttgataaattggccaaagtgattgacgatgccaagaacgatccagaattggaaattgttttcggaggcttccatgataaatctaagggttattacatccaaccaacaatcataaagactacaaatccaagacatccttatttaagccaagaattctttggtccaatattgactgtatacgaatatccagacgcaaaattcgaagacgtgtgtgaactggttgattccaccagccaatatggtttaacgggatccatattcgcccgtgaccgtgaggctattaagatcgctgatgaaaaattgaaatacagtgcaggaaacttctacatcaacgataaatctaccggggctgttgtcgctcaacaatggtttggtggtgccagaatgagcggtactaatgacaaggccgggtctggaaatatcttgaacagatttgttagcgtcaggaacatcaaagaaaactattatgaattgacagactacagatatccatccaattacgaataa

SEQ ID NO: 12579 - protein, 576 aa, Kluyveromyces lactis
MLSSRIQLLRSSKRCVAQLSHIQPPKQIGNEPVKAFGSKDLVDWDLLRASLSKFKNSSLDVPLVINGERIYYNDDGGKRGIFQQLNPANHSEVLANVTQATNEDVKAAIQASKQAKDKWYKLPYYERASVFMKAADLICTKYRYDMLAATMLGQGKNVYQAEIDCITELADFFRFNVKYANELYAQQPIESSPGVWNRAEYRPLEGFVYAVTPFNFTAIAGNLIGAPALMGNTVVWKPSQNANLSNYLLLTVLEEAGLPNGVVNFVPGNAVEVTKEVLSDSEFAALHFTGSTAVFKQLYGDIQKGVVNGLYRDYPRIVGETGGKNFHLIHPSANIPHSVLSTLRGAFEFQGQKCSATSRVYLPESKSEEFFRDLGGVLSEVQPVNTSASKINGGDLHGFIGPVIHEGSFDKLAKVIDDAKNDPELEIVFGGFHDKSKGYYIQPTIIKTTNPRHPYLSQEFFGPILTVYEYPDAKFEDVCELVDSTSQYGLTGSIFARDREAIKIADEKLKYSAGNFYINDKSTGAVVAQQWFGGARMSGTNDKAGSGNILNRFVSVRNIKENYYELTDYRYPSNYE

SEQ ID NO: 12580 - DNA, 1485 bp, Bacillus cereus
  CDS (1)..(1485)
atgagtcaactagctgtaaatcttcatgaaaaggtagagaaatttcttcaaggtacaaaaaagttatatgtgaatggatctttcattgaaagcgcttccggtaaaacatttaaaacacctaacccagcaactggtgaaacacttgccgtcgtttctgaagctggtcgcgaagatattcataaagctgtagtcgcagctcgtatggcttttgacgaaggtccttggtctcgtatgagcaccgctgagcgaagccgtctcatgtacaagttagctgatttaatggaagaacataaagaagagcttgcacagctcgaaacattagataacggaaagccaatccgtgaaacaatggcagcagacataccacttgcaattgagcatatgcgctattacgctggatgggctacgaaaatcgttggtcaaacaattcctgtttccggtgattactttaactatacacgccatgaagctgttggtgtcgttggtcaaattatcccttggaacttcccgcttcttatggcaatgtggaaaatgggagcagcgcttgctacaggatgtacaatcgttttaaaacctgcagaacaaactccactatctgctctatacttagctgaattaattgaagaagctggattcccgaaaggtgttattaatatcgtacctggattcggtgaatcagctggacaagctctcgttaatcatccactcgttgataaaattgcatttaccggttctactcctgtcggtaaacaaattatgcgacaagcatccgaaacattaaaacgcgttacacttgaattaggcggtaaatcaccaaatatcatattgccagatgctgatttatctcgcgcgattcctggtgcactttctggtgttatgtttaaccaaggacaagtatgctctgctggatcacgcttatttgttccgaagaaaatgtatgataatgtcatggctgatctcgtcctctattctaaaaaactaaatcaaggtgtcggtcttaaccctgaaacaacaattggccctctcgtttccgaagaacaacaaaaacgtgtaatgggctacattgaaaaagggattgaagaaggcgctgaagtactttgcggaggaagtaatccattcgatcaaggctacttcgtttctcctacagtattcgctgacgtaaatgatgaaatgacgatcgcaaaagaagaaattttcggtccagttatttctgcaataccgtttaacgatattgacgaagtaattgaacgtgcaaataaatcacaattcggcttagcggctggtgtgtggacagaaaatgttaaaacagcacactatgttgcaagtaaagtacgtgcaggtacagtatgggtaaactgttataacgtctttgatgcagcatctccatttggaggatttaaacaatctggtcttggccgtgaaatgggatcttacgcattaaataactatacagaagtaaagagcgtttggcttaacttaaattaa

SEQ ID NO: 12581 - protein, 494 aa, Bacillus cereus
MSQLAVNLHEKVEKFLQGTKKLYVNGSFIESASGKTFKTPNPATGETLAVVSEAGREDIHKAVVAARMAFDEGPWSRMSTAERSRLMYKLADLMEEHKEELAQLETLDNGKPIRETMAADIPLAIEHMRYYAGWATKIVGQTIPVSGDYFNYTRHEAVGVVGQIIPWNFPLLMAMWKMGAALATGCTIVLKPAEQTPLSALYLAELIEEAGFPKGVINIVPGFGESAGQALVNHPLVDKIAFTGSTPVGKQIMRQASETLKRVTLELGGKSPNIILPDADLSRAIPGALSGVMFNQGQVCSAGSRLFVPKKMYDNVMADLVLYSKKLNQGVGLNPETTIGPLVSEEQQKRVMGYIEKGIEEGAEVLCGGSNPFDQGYFVSPTVFADVNDEMTIAKEEIFGPVISAIPFNDIDEVIERANKSQFGLAAGVWTENVKTAHYVASKVRAGTVWVNCYNVFDAASPFGGFKQSGLGREMGSYALNNYTEVKSVWLNLN

SEQ ID NO: 12582 - DNA, 1485 bp, Bacillus cereus
  CDS (1)..(1485)
atgttaaagacaaatattgagctgaaaccaaaagtggaagcgttcttaaatgaagaaattaaaatgtttattaatggcgaatttgttgctgctattgggggaaagacgtttgaaacgtataatccggctacagaagatgttctagctgtcgtatgtgaagcgcaagaagaggatattgatgctgcagtaaaagcggcaagatctgcatttgaatccggtccgtgggcagaaatgactactgctgaaagagcgcatcttatttataaattagcagatttaattgaagaacatagagaagaattagcgcaactagaagctttagataatggaaagccatatcaagtagcacttgatgatgatatttcagcaactgtagaaaattatcgttattacgcaggatgggctacaaaaattattgggcaaacaatcccaatttcaaaagattacttaaattacacgagacatgaacctgtaggtgttgtaggtcagattattccgtggaattttccgctcgttatgtcttcttggaaaatgggagctgcactggcgacaggttgtacgatcgtattaaagccagcagagcaaacgcctttatctttactatatacagcaaaactttttaaagaggctggatttccaaacggtgttgtaaactttgtaccaggctttggtcctgaagcaggagcagcaattgtaaatcatcatgacattgataaagttgcttttacaggatctactgttacaggaaagtatattatgcgtcagtctgcagaaatgattaagcatgtaacgttagagcttggcggcaaatcaccaaatatcattttagaagatgcggacttggaagaagcaattaatggtgcattccaaggtattatgtataatcacggtcaaaattgtagcgcaggatcacgtgtatttgttcatcgtaaacattatgaaactgtagtagatgcacttgtgaaaatggcgaacaacgtaaaacttggagcaggtatggagaaaggaacggaaatgggtccactcgtatctaagaaacaacaagagcgtgtgttacattacattgagcaagggaagaaagaaggcgctacagttgcggctggtggtgaacgtgcacttgaaaagggttatttcgttaagccaactgtattcacagatgttacagacgatatgacaatcgttaaggaagaaatatttggaccagttgttgttgttctgccatttgattcgacagaagaagtaattgaacgagcgaacaactcatcctatggccttgctgcgggtgtatggacgcaaaatatcaaaacgggtcatcaagtggcaaataaattaaaagcaggaacagtgtggattaatgattataacttagaaaatgcagctgcaccatttggtggatacaaacaatctggtattggccgcgaattaggttcatatgcgcttgataattatacagaagtgaaaagtgtttgggtaaatataaagtaa

SEQ ID NO: 12583 - protein, 494 aa, Bacillus cereus
MLKTNIELKPKVEAFLNEEIKMFINGEFVAAIGGKTFETYNPATEDVLAVVCEAQEEDIDAAVKAARSAFESGPWAEMTTAERAHLIYKLADLIEEHREELAQLEALDNGKPYQVALDDDISATVENYRYYAGWATKIIGQTIPISKDYLNYTRHEPVGVVGQIIPWNFPLVMSSWKMGAALATGCTIVLKPAEQTPLSLLYTAKLFKEAGFPNGVVNFVPGFGPEAGAAIVNHHDIDKVAFTGSTVTGKYIMRQSAEMIKHVTLELGGKSPNIILEDADLEEAINGAFQGIMYNHGQNCSAGSRVFVHRKHYETVVDALVKMANNVKLGAGMEKGTEMGPLVSKKQQERVLHYIEQGKKEGATVAAGGERALEKGYFVKPTVFTDVTDDMTIVKEEIFGPVVVVLPFDSTEEVIERANNSSYGLAAGVWTQNIKTGHQVANKLKAGTVWINDYNLENAAAPFGGYKQSGIGRELGSYALDNYTEVKSVWVNIK

SEQ ID NO: 12584 - DNA, 1425 bp, Bacillus cereus
  CDS (1)..(1425)
atgaaaaagcatttatatataaacggaagttggaaatctgtaaacacgtataaaccattatacgcaccatattctgaagaaacattagcggaaattgcacaaggaacggaagaagatgtaaaagaggctgttactgctgcaaaaaatgcaatgacaaaaatgaataaattatctgcatatgatcgtgcgactattttagagaaagttgcacaaaaaatggatgaaagaagagaagaatttgcagagattattgcaaaagaagctgcaaaaccaatacgtgctgcaaggggagaagtagatcgtactgttcaaacgtacaaatttgcagctgaagaagcgaagcgtatatatggtgagacattgccattagacgccgcacctggtgcagatgggcgtattgcatatacaatccgaaagccgattggggttataggggctattacaccatttaatttcccattaaatttagtagcgcataaagttggaccagcaatcgctgccggaaatacagttgtattaaagccagctgatcaaacgccattatcatcttatgcattagttgagttatttgaagaggcaggattgccaaatggagctttaaatatcatttctggccctggccccacggttggtgaggcaatcgtcaaaaatgattacgttgcttctattacttttaccggaagtccaaaagttggaatcggaataaaacaaaaggctgggctaaaacgagttacgttagaactaggctcaaatgctgctgttattattgatgaagatgtagagttaacagatgaaataattgaacgtgtaaaatggggagcatttgttaataatgggcaagtttgtatttcagtacaacgtgtttttgtacatgaaacgaaaatacatgaatttctctcaaagctaaagaaagcgatggaatcagttgttgttggtgatccatcgcttgaggaaacggatgtatcagctttaatttcaaaaaaagatgtagagcgaattgatatgtgggttcaagaagcaattaaggaaggagcaactgttttatgtggtggtaagaagcaggatgcaagaatttttgaaccgactgtattaacaaatgttccagatcatgtatctgtgcagtgccaagaagtattcggtccactcatgacagtaaatacatttaaagaatttgatgaagcgattgagcaagtaaataattcgcgttacggcttacaggcgggagtatttacaaataatttatttaaagcaatgcgtgcaattgatgagctagaggttggtggtgtcatgattaatgatattccaacgttcagagtagatcatatgccttatggtggtgtgaaagaaagtggcacgggacgcgaaggaattaaatatgcaatagaagaaatgacagaaatgaaattagtatgtattaaaaaataa

SEQ ID NO: 12585 - protein, 474 aa, Bacillus cereus
MKKHLYINGSWKSVNTYKPLYAPYSEETLAEIAQGTEEDVKEAVTAAKNAMTKMNKLSAYDRATILEKVAQKMDERREEFAEIIAKEAAKPIRAARGEVDRTVQTYKFAAEEAKRIYGETLPLDAAPGADGRIAYTIRKPIGVIGAITPFNFPLNLVAHKVGPAIAAGNTVVLKPADQTPLSSYALVELFEEAGLPNGALNIISGPGPTVGEAIVKNDYVASITFTGSPKVGIGIKQKAGLKRVTLELGSNAAVIIDEDVELTDEIIERVKWGAFVNNGQVCISVQRVFVHETKIHEFLSKLKKAMESVVVGDPSLEETDVSALISKKDVERIDMWVQEAIKEGATVLCGGKKQDARIFEPTVLTNVPDHVSVQCQEVFGPLMTVNTFKEFDEAIEQVNNSRYGLQAGVFTNNLFKAMRAIDELEVGGVMINDIPTFRVDHMPYGGVKESGTGREGIKYAIEEMTEMKLVCIKK

SEQ ID NO: 12586 - DNA, 1632 bp, Streptomyces avermitilis
  CDS (1)..(1632)
atggatgctgtgacccaggtccccacccccgtcaatgagccggtgcacggctatgcccccggctcgcccgagcgcgcccgtctggaggccaagctcaaggagctggccgagaacccgatcgagctgccgatgaccatcggcggcgagaagcggctcggcggcggtgagcgcttcgaggtggtgcagccgcacaaccacaaggccgtcatcggcaccggcgcgcacgccacgcagcaggacgcgcaggacgcgatcgacgccgcgctggccgccgccccggcctggcgcgcgatgtccttcgacgaccgcgccgcgatcatcctgcgcgccgccgagctgctgtccggcccgtggcgcgagaccctcgccgcctccaccatgctcggccagtcgaagaccgcccagcaggccgagatcgactgtccgtgcgaactggtcgacttctggcgcttcaacgtcaagtacgcccgcgacctgctcgccgagcagcccccggccaactcgccgggcgtctggaaccgcctcgaccaccgcccgctcgagggcttcgtctacgcgatcaccccgttcaacttctcggcgatcgcgggcaacctgccgacggctccggcgctcatgggcaacgtggtcgtgtggaagccgtccccgacgcagacccacgccgccgtgctgctgatgcggctcctggaggaggcgggcctgcccaagggcgtcatcaacctcgtcaccggtgacggcatcgaggtctccaaggtcgccctggagcaccgcgatctcgcgggcatccacttcacgggttcgaccaagaccttccagtacctgtggaagacggtcggcaacaacatcgagaagtaccgctcgtacccgcgcctggtcggcgagaccggcggcaaggacttcctggtcgcgcacccgagcgccgaccgcgcggtcctgaagaccgccctgacccgcggtgccttcgagtaccagggccagaagtgctccgcgacctcccgcgcctaccttccggcctccatctggaactccggcttcaaggaggagttcgcggccgaggtcgactacctgaccatgggtgacgtcaccgacctgtcgaacttcgtcggcgcggtcatcgacgagcgctcgttcgccaagaacaaggcggccatcgaccgcgccaagtcggacccgacctgcacgatcgtggcgggcggcgagtacgacgactcggtcggctacttcgtgcgcccgacggtcgtcgagtgctcggacccggagaacgaggtcttcaagaccgagtacttcggcccgttcctcgccgtgcacgtctacgaggacgacgcgtacgacgagatgctgacccagatggagtcggcctcggactacgcgctgacgggtgcggtcgtctccaacgaccgtgcggcggccgcgtacacgatggacaagctccgctacgccgcgggcaacttctacatcaacgacaagtcgaccggcgccgtcgtcggccagcagcccttcggcggcggccgtgcctcgggcacgaacgacaaggcgggcgccccgcagaacctgatgcgctggacgctgacccgcgccatcaaggagacgctggtcccgccgaccgactacacgtacccgcacatgggctga

SEQ ID NO: 12587 - protein, 543 aa, Streptomyces avermitilis
MDAVTQVPTPVNEPVHGYAPGSPERARLEAKLKELAENPIELPMTIGGEKRLGGGERFEVVQPHNHKAVIGTGAHATQQDAQDAIDAALAAAPAWRAMSFDDRAAIILRAAELLSGPWRETLAASTMLGQSKTAQQAEIDCPCELVDFWRFNVKYARDLLAEQPPANSPGVWNRLDHRPLEGFVYAITPFNFSAIAGNLPTAPALMGNVVVWKPSPTQTHAAVLLMRLLEEAGLPKGVINLVTGDGIEVSKVALEHRDLAGIHFTGSTKTFQYLWKTVGNNIEKYRSYPRLVGETGGKDFLVAHPSADRAVLKTALTRGAFEYQGQKCSATSRAYLPASIWNSGFKEEFAAEVDYLTMGDVTDLSNFVGAVIDERSFAKNKAAIDRAKSDPTCTIVAGGEYDDSVGYFVRPTVVECSDPENEVFKTEYFGPFLAVHVYEDDAYDEMLTQMESASDYALTGAVVSNDRAAAAYTMDKLRYAAGNFYINDKSTGAVVGQQPFGGGRASGTNDKAGAPQNLMRWTLTRAIKETLVPPTDYTYPHMG

SEQ ID NO: 12588 - DNA, 3141 bp, Coxiella burnetii
  CDS (1)..(3141)
atgacagatactcacttgcttttttttgaaaaagcgatagcgcaaaatgcgatccgaccatcgttaaataaaacctatcgaatggatgaaaccacatgcgttaaccaccttctgaaaacaatcgcttttactccccggctggaagcagctgtcagtcgtttggccaaagagctggtaacggcggtgcgggaacaagagagtgagaagggcggtatcgaaggtttcatgatgcaatacgatttatccactgaagaaggcattttattaatgtgcttagcagaagctttgctgcgcgtgccggataaagaaaccgaaaaccttttaattcgagataaattaacgagtgcagaatggaataaatacgtaggcgctagcgaatcttcgtttgtgaatttcgcgacatggggacttgcattatcgggaaaaattttaaagaaagaaaaagatgggcaattcaagaatgtttggcgcaatctcgttcgcagaagtggcgaaccggtcatccgcaaagcagttcgtgaagcgatgaaattaatgagcgaacattttgttttggggcggaccattgaagaagctgtcaaacgttcacaaagcgctataaaagaaggctttcgtcattcttacgacatgttaggtgaagtggcgcgcacccaagaggacgccgatcgttattatgattcctatcatcgtgccattagtgttttaggaaaaagtcatcccacaaaatccgttcatgaggcgccaggcatttccgttaaattatccgctttataccctcgatacgattttaaaaaacgagaattagcggtgccttttttgattgagcgcgtaaaagaattggcattgcatgctaaagaacaaaaaatcggcatgaccattgacgcggaagaagcggatcgcttggatatttctctcgatatttttgaagcgctttttacggatgaagcgtttgaaaattggcaaggtttagggcttgctgtgcaagcttatcaaaaacgagccttttatttaatcgattggttaattgatttagctcaacgacaaaaacgtcgcattcctgttcgtttagtaaaaggagcttattgggataccgaaataaaattagcgcaaatggaaggacttagtggctatccggtttttacccgaaaagtaaatacagatatatcttacattgcgtgcgctcagaaaatgttgaacgcgcaagacgccatttatccgcaatttgcaacgcataatgcctactccgttgcagcgatattaaatcttatggatcaccattacgataattacgaatttgaatttcagcaattgcagggtatgggtaaagcgctccatcattacattgtcactaaacttaaattaccgtgtcgagtttacgcgcctgtcggctatcacgaagatttattaccttatttagtccgacgattactggaaaatggtgcgaacagttcgtttgttaatcgcattgctgacaaaaccgtgcccgttgaccagcttatcgaaagtcccgtcaaaaaaatcgaagcttttggggatattcccaatccgaaaattcctttacctaaaggtattttcaaaacgcggactaattcaagtggcattgatttaagtaatttcgctgaattaatgcctttaaatgaggaaattcatcatgccttggaaaaagaatgggaggcagcgccgtttttacaagaaattaaaaatggtaaacctgtttttgatccaacggataatcgtcgccaaataggggtaattgaacttgcgaatgaatccgatgtagagaaagcgatacaagcgggtcattcagcattcccaaactgggatcaaaaagggatttccgcacgggcgactattttaagaaaaatggcggatttattagaaaaacataaagcggaattaatggcagtggtggttcgcgaagggggaaggacgctgcaaaatgcactgtcagaagtgcgagaagcgacagatttttgtcgttactatgctgagcaggcggaacagcatttaagtgataaggctttgccaggctacacgggtgaaagtaataccctgcggatgaatggacgtggaattattttgtgtatcagcccttggaattttcccattgctatttttacagggcaaattgccgccgctttggtgactggtaatgccgttatcgcaaaaccctcgggacagacgcctttaactggcgcgttggtgacgcggttgtttcatgaagcgggtgtgccgaaagaaattttgcagttaatgccgggttcgggcaaaacggtgggacaggcgcttatcgaggataccaaaatcagtggcgtgattttcacgggttcagatgctaccgcgcggcatattcaaaaaacgttggccgcccgcccgggcccgatcgtgccctttgtagcagaaacctccggtattaatgccatgatcgcagattcgaccgctttacccgaacagttagttaatgacgtcattgtttctgcctttgatagcgctggacagcgctgttcagcacttcgaattttgtatattcaagaggatatcgcggatgacgttattaagatgctaaagggcgcaatggccgaaattaaaatgggcgaccccctgctcttatccacggatgtcggtcctgttattgacgctaatgcgcaaaaaacgctgcaaaaacaccaagcattgatgcaaaaagaagcgaaattaatttataaagtggatttgcctcgcgaaaccgattttgggactttcgttgcgccacaagcctacgaattgcctaatttgggactgattactgaggaagtatttggacctattttgcatgttattcgttataagcgagaaaatttgaataaagttatcgaagaaatcaacgggctgggttacggtttaaccttcggcatccaaagccgcatagatgaaacagtcgattatatccagcagcgtattaacgcaggaaatatttacgttaatcgcaatacggttggcgccgtggtaggcgtgcagccttttgggggcagttggttgtccggtaccggccccaaagcgggtggtcctcattatcttccccgtttttgcatagaaagcacactgactatcaacacgacggcagccggcggaaatgcttcgcttatggcgatggaggattag

SEQ ID NO: 12589 - protein, 1046 aa, Coxiella burnetii
MTDTHLLFFEKAIAQNAIRPSLNKTYRMDETTCVNHLLKTIAFTPRLEAAVSRLAKELVTAVREQESEKGGIEGFMMQYDLSTEEGILLMCLAEALLRVPDKETENLLIRDKLTSAEWNKYVGASESSFVNFATWGLALSGKILKKEKDGQFKNVWRNLVRRSGEPVIRKAVREAMKLMSEHFVLGRTIEEAVKRSQSAIKEGFRHSYDMLGEVARTQEDADRYYDSYHRAISVLGKSHPTKSVHEAPGISVKLSALYPRYDFKKRELAVPFLIERVKELALHAKEQKIGMTIDAEEADRLDISLDIFEALFTDEAFENWQGLGLAVQAYQKRAFYLIDWLIDLAQRQKRRIPVRLVKGAYWDTEIKLAQMEGLSGYPVFTRKVNTDISYIACAQKMLNAQDAIYPQFATHNAYSVAAILNLMDHHYDNYEFEFQQLQGMGKALHHYIVTKLKLPCRVYAPVGYHEDLLPYLVRRLLENGANSSFVNRIADKTVPVDQLIESPVKKIEAFGDIPNPKIPLPKGIFKTRTNSSGIDLSNFAELMPLNEEIHHALEKEWEAAPFLQEIKNGKPVFDPTDNRRQIGVIELANESDVEKAIQAGHSAFPNWDQKGISARATILRKMADLLEKHKAELMAVVVREGGRTLQNALSEVREATDFCRYYAEQAEQHLSDKALPGYTGESNTLRMNGRGIILCISPWNFPIAIFTGQIAAALVTGNAVIAKPSGQTPLTGALVTRLFHEAGVPKEILQLMPGSGKTVGQALIEDTKISGVIFTGSDATARHIQKTLAARPGPIVPFVAETSGINAMIADSTALPEQLVNDVIVSAFDSAGQRCSALRILYIQEDIADDVIKMLKGAMAEIKMGDPLLLSTDVGPVIDANAQKTLQKHQALMQKEAKLIYKVDLPRETDFGTFVAPQAYELPNLGLITEEVFGPILHVIRYKRENLNKVIEEINGLGYGLTFGIQSRIDETVDYIQQRINAGNIYVNRNTVGAVVGVQPFGGSWLSGTGPKAGGPHYLPRFCIESTLTINTTAAGGNASLMAMED

SEQ ID NO: 12590 - DNA, 1539 bp, Caenorhabditis elegans
  CDS (1)..(1539)
atgctctcattcgcagctcgacgctccttaatcacacaaaaatgcgccgccagcacgtacagcggtctaacatcggcggattttctcaaaaagaagacaaatgagccgattttagagtatcgaaaaggaagcaaagaacgacaggatttggaggcagcgttggcgttctacagcaagaacatcacagaagttccattgagaattggcgacaagaaaatcacgaataaattggagcagaagcaagttattccctctgaccatcgttcaacacttgccaagtacacttatgccaccggagagcaaattcaagaagccatcgatgtggctcttcaggcgagaggcgcctgggagagaaaaccgcttaaagaacgagctgaaattttgctccgcgccgccgatttggccgctggaaagtaccgaatgaagctgaacgcctccacgatgctcggccagggaaagaatattattcaggctgaaattgacgccgcctgtgagctcatcgatttcttccgattcaacgcggttttcgctatggagctggagcattatgagccgatttccacgaaaatcaccaaaaatacgatgcagttccgtggaatggagggattcgtcgccgcaatcgcaccgttcaattttacggcgatcggaggaaatttgccgactgctccggcgcttatgggtaacgtctccctctggaagccatcgaacaccgccgtgctctccaattatataatctacgaactcctcgaggaagctggtatgccacctggaattctctcattcttgccatcagatggccccgttttcggtgacgtcatcaccgcatctccacacttgagcgctgtcaatttcactggctccgtgccaactttcaagacgatttggagaaaagtcgccgagaatttggataactatgtgacttttccgaaactcatcggagaatgcggcggaaaaaacttccactttgtgcatccatccgcccacgtggacgctgtcgccgctggaaccgcccgttccgcctgggaatattcgggacaaaagtgctcggcgtgctccaggatgtacgcgccaaaatcgatttggccaaagattctcgagaaaatctcggcgattcacaaagagatcaagcttggagatgttcgcgatggatccgtctttctgtcggctgtgatcgatgataaggcgtttgccaggctcaaggcctacattgactttgcgaaaaccggagccgacggagcaaatgtggtgctcggcggaaaatgtgacgacaaaacgggatacttcatcgagccgaccctgatcactgtgacggatccgaagagcaagcttctcactgaggaaatgttcggaccggtggtgacggtactggtctacgaggattcgaaggttgatgaggtgctcgcgactgtgaaagacgcgacaccttatgggctgactggcgccgttttttcgcaggataaggagttcctttataggttggcaactacaaaaaatacaagtttttgcacaggttttcagggactcaaaaattttatctaa

SEQ ID NO: 12591 - protein, 512 aa, Caenorhabditis elegans
MLSFAARRSLITQKCAASTYSGLTSADFLKKKTNEPILEYRKGSKERQDLEAALAFYSKNITEVPLRIGDKKITNKLEQKQVIPSDHRSTLAKYTYATGEQIQEAIDVALQARGAWERKPLKERAEILLRAADLAAGKYRMKLNASTMLGQGKNIIQAEIDAACELIDFFRFNAVFAMELEHYEPISTKITKNTMQFRGMEGFVAAIAPFNFTAIGGNLPTAPALMGNVSLWKPSNTAVLSNYIIYELLEEAGMPPGILSFLPSDGPVFGDVITASPHLSAVNFTGSVPTFKTIWRKVAENLDNYVTFPKLIGECGGKNFHFVHPSAHVDAVAAGTARSAWEYSGQKCSACSRMYAPKSIWPKILEKISAIHKEIKLGDVRDGSVFLSAVIDDKAFARLKAYIDFAKTGADGANVVLGGKCDDKTGYFIEPTLITVTDPKSKLLTEEMFGPVVTVLVYEDSKVDEVLATVKDATPYGLTGAVFSQDKEFLYRLATTKNTSFCTGFQGLKNFI

SEQ ID NO: 12592 - DNA, 3132 bp, Vibrio parahaemolyticus
  CDS (1)..(3132)
atgtttacagctacgaacgtgttgacaccggaatttatcgggcagccgcttgataagttgtggtcactgatctcgccattgtatatggtggacgagtctcaatggctagagcaattattgccactagcgacgccgacaacggaagaaaaatcggcgatcactaaccaaacgaccaaacttattgaagccattcgtgccgataagaagtcaatccagatgattgatgcacttttgctggaatacagtctcgatactcaagaaggtatcttgctgatgtgtcttgcagaagcgttaatgcgaatcccggatgcggcaaccgcagacgcgctgattaaagacaagttaagcgttgcggactggaaatctcacctgaaaaactcggactctgttttcgttaacgcgtcaacatggggtctaatgctgacaggtaaagtggtcggtcttggtgagcaaggcacccagagcccaagtcaggctgtaaaccgtctggttaacaaattctctgaacctgtgattcgtaaagccatgtatcaggcaatgaagatcatgggtcaccagtttgtccgcggccgcacgattgaagaagcgcagaaaaatggtcgcccgatgcgcgacaaaggtttcacttactcatttgatatgttgggtgaagcggcgctaacaactgcggatgcaaacaaatacttcaaagattacctaatggcgatcgaagcggtgggtcgcgagacttacggtaacgacaccagccctgcgccttcggtttctatcaagctttcagcattgcaccctcgctacgaagtggcgaacgaagagcgtgttatgactgagctgtacgaaacgctcatgcaactactaaaacgcgcgattgaagtcgacgttgcgatcacgattgatgcagaagaagctgatcgccttgagctgtctctaaagctgttcgagaagatttaccgcagtgacctcgtgaaaggttggggcaagtttggtcttgttgtgcaagcgtactcgaagcgtgctctaccagtattggtttggctcaatgcccttgcgaaagagcaaggtgacttgatcccacttcgcttggtaaaaggcgcgtactgggatagcgaaatcaaatggtcacaacaagcgggctacgaaaactacccggtgtacacacgcaaagaagcgaccgatgttgcttaccttgcatgtgcgcgtttcttattaagcgaaggcgtacgtggcaatatcttcccgcaatttgccagccacaatgcgcacacagttactgcgattgcagtgatggcgcagcataaggattttgaattccaacgcctacacggcatgggagattcactctacaaccacgtgatggagaaatacggccaacctgttcgtatttacgctccagttggtagccacgcggatctactgccttaccttgttcgtcgtttgctagaaaatggcgcaaacagctcgtttgtacaccgtttggttgacgcgcgttgcccaatttctgaactgacacatcaccctgtggatgcgctaaccagttttgcgacgctgaataacgataagatcccaatgccttcaggtattttccctgagcgtaaaaactcttacggcgtcaacattgatatcgaaagcgaagcaaaaccatttgaagcgcaagttgaaagcttcctaaacaataagtgggttgcgggccctgtgatcaacggtgaacgttttgccgaaagcatgatcaaggaaaacctcgctgagatcattaccgcgccttacgatcgtcgtgttgaagtgggtcaagtcgcttttgcaactcttgatcatgtttccgctgcgattgaagcggcgcaagcggcattcccagaatggaaaggcactgcgattgagcaaaaagcgaagtgtttagaaacacttgctgacctgatggaagcaaacttggcggagttggtggcgatttgtcatcaagaagcgggtaaaaccattcacgacagcattgatgaagttcgtgaagcggttgatttctgtcgttactacgcaaaacaagcgcaaaacctacaaccatttgaactggaaggttttgatggtgtgaaacgcatttcaagccgtgaaggtcttggtgtgttcgtttgtattagcccttggaacttccctctggcgattttccttggtcaagtaaccgcggcgcttgttgcgggtaacactgtagttgctaaaccggctgaacaaaccagcttgattgctgctcgcgcgattgatttgatgctggaagctggcttcccagctggcgtaattcaattacttcctggtcgcggtggtgagattggtcatgcactaacctctcacgacgccatcgcaggtgtcgcatttacgggctctacggcaacggcacagcgcatcaacgtaacgttggcagagcgtaccgcgaagccagtaccgtttatcgcggaaactggcggccaaaacgccatgatcgtcgacagtactgcactgccagagcaggtggttcgtgatgtgattcgctctgcgtttgcatcggcgggtcaacgctgttctgcgcttcgtgtgctgtttgttcaagaagacgttgcggaccgcatcatcacccttatccaaggcgcgatgaaagagctacatgttggcttgccttacttgcacaaaaccgatgtgggtccggttattgaccgcaatgcgaagcaaaaactccttgctcacctagaacagatgagcagcacgcagaagaaagttgcgcagctgcaactggaagaagcgtgtcaatacggcgattttgttgcgccaagtgcgtttgaaatctcaggcattgatgttctgaaagaagagcaatttggtcctatcttgcacattgttcgctttaaagcgtctgaactgccaaacgtggtagagcagatcaaccaaacaggttttggtctaacaatgggcattcacagccgcaacgaaaccacttatcgctggattgaaaaacacgctcgcgtgggtaactgctacatcaaccgagatcaagttggtgcggttgttggcgttcagccatttggtgggcaaggcttgtctggtacaggtccaaaagctggtggtcctcactacttgtaccgctttactcaacatcttcttgctcaagcagagaacgcataa

SEQ ID NO: 12593 - protein, 1043 aa, Vibrio parahaemolyticus
MFTATNVLTPEFIGQPLDKLWSLISPLYMVDESQWLEQLLPLATPTTEEKSAITNQTTKLIEAIRADKKSIQMIDALLLEYSLDTQEGILLMCLAEALMRIPDAATADALIKDKLSVADWKSHLKNSDSVFVNASTWGLMLTGKVVGLGEQGTQSPSQAVNRLVNKFSEPVIRKAMYQAMKIMGHQFVRGRTIEEAQKNGRPMRDKGFTYSFDMLGEAALTTADANKYFKDYLMAIEAVGRETYGNDTSPAPSVSIKLSALHPRYEVANEERVMTELYETLMQLLKRAIEVDVAITIDAEEADRLELSLKLFEKIYRSDLVKGWGKFGLVVQAYSKRALPVLVWLNALAKEQGDLIPLRLVKGAYWDSEIKWSQQAGYENYPVYTRKEATDVAYLACARFLLSEGVRGNIFPQFASHNAHTVTAIAVMAQHKDFEFQRLHGMGDSLYNHVMEKYGQPVRIYAPVGSHADLLPYLVRRLLENGANSSFVHRLVDARCPISELTHHPVDALTSFATLNNDKIPMPSGIFPERKNSYGVNIDIESEAKPFEAQVESFLNNKWVAGPVINGERFAESMIKENLAEIITAPYDRRVEVGQVAFATLDHVSAAIEAAQAAFPEWKGTAIEQKAKCLETLADLMEANLAELVAICHQEAGKTIHDSIDEVREAVDFCRYYAKQAQNLQPFELEGFDGVKRISSREGLGVFVCISPWNFPLAIFLGQVTAALVAGNTVVAKPAEQTSLIAARAIDLMLEAGFPAGVIQLLPGRGGEIGHALTSHDAIAGVAFTGSTATAQRINVTLAERTAKPVPFIAETGGQNAMIVDSTALPEQVVRDVIRSAFASAGQRCSALRVLFVQEDVADRIITLIQGAMKELHVGLPYLHKTDVGPVIDRNAKQKLLAHLEQMSSTQKKVAQLQLEEACQYGDFVAPSAFEISGIDVLKEEQFGPILHIVRFKASELPNVVEQINQTGFGLTMGIHSRNETTYRWIEKHARVGNCYINRDQVGAVVGVQPFGGQGLSGTGPKAGGPHYLYRFTQHLLAQAENA

SEQ ID NO: 12594 - DNA, 3954 bp, Pseudomonas syringae
  CDS (1)..(3954)
atggccaccaccactttgggcgtcaagctcgacgaccctacccgcgagcgattgaaagccgccgcccattcgatcgaccgcacgccgcactggttgatcaagcaggcgattttcaattacctggaaaagctggaaagtggtgcaaccttgcttgagctgaacggcgcgacaggcaaagacagcgaagaccgtggtgagctggcagaagatgcaggcctgcaatgctttctggattttgccgaaagcattcagccgcagtcagtgctgcgtgcggcgatcacttccgcctaccgtcgcccggagcaggaagtggtgcctatgctgctggaacaggcacgcctgacagcgcctgtcgccgaagcgaccaacaagctcgccgcgtcgattgccgaaaaactgcgcaatcaaaaaagcgcgggcgggcgcgcaggcatcgttcaaggcctgctgcaggagttttcgctgtcctcccaggaaggcgttgccctgatgtgtctggctgaagcactgctgcgtattcccgacaaaggcactcgcgatgccttgattcgcgacaagatcagcaacggcaactggcagccgcacctgggcaacagcccgtcgctgttcgtcaacgcagccacctggggcctgctgctgaccggcaagctggtcgccacgcacaacgaagcaggcctgacctcctcgctgagccggatcatcggcaagcgcggcgaaccgatgatccgcaagggcgtcgacatggccatgcgcctgatgggtgagcagttcgtcaccggcgaaaccattggcgaggctctggccaatgccagtcgtttcgaagccaagggcttccgctactcctacgacatgctgggtgaagcagcgttgaccgaacacgacgcgcagaaatatctggcgtcctacgagcaggccattcattccatcggcaaagcctcccacggtcgcggcatctacgaaggcccgggtatttccatcaagctgtcggcgctgcatccgcgctacagccgcgctcagtacgagcgcgtcatggacgagctctacccgcgcctgctgtcgctgaccctgctggccaaacagtacgacatcggcctgaacatcgacgccgaagaagccgaccgcctggagctgtcgcttgatctgcttgagcgcctgtgcttcgagccgcaactgaccggctggaacggtatcggtttcgtgattcaggcttaccagaagcgctgcccttatgtgatcgactacgtgatcgatctggctcggcgcagtcgtcatcgcctgatgatccgcctggtaaaaggcgcgtactgggacagcgaaatcaagcgtgcgcaggttgaaggtctggaaggctatccggtctacacccgcaaggtgtacaccgacgtttcctatatcgcctgcgcccgcaaactgctggccgcaccggaagtcatctatccgcagttcgccacccacaacgcccacaccctggcggccatctaccagattgccggtcagaattattaccccggccagtacgagttccagtgcctgcacggcatgggcgagccactctacgagcaggttgttggcaaagtcgccgacggcaagctgaaccgtccgtgccgcgtgtacgcgccggttggcactcacgaaacgctgctggcctatctggtccggcgcctgctggagaacggcgccaacacctcgttcgtcaaccggattgccgaccattcgatctcgattcaggaactcgtcgccgatccggtcaaccagatcgaacgcatggcaacgcaggaaggcgggttcggcttgccacacccgcgtattccgctgccgcgcgacctgtatggcaccgagcgcgccaactccagcggcatcgatatggccaacgaacatcgtctggcgtcgctgtcctcagccctgctgtcgaccgcgcacaacgactggaaagctgcgccaatgctcggctgcccggccagtgaaggcacacttgctgcggcgttgaacccgtcggatctgcgtgacgtggtcggccatgtgcaggaagcctccttgcaggatgtcgataatgccatccagtgcgccttgagcgccggcccgatctggcaggccacgccgcccgccgaacgcgccgcgattctggagcgcgccgccgacctgatggaaggcgagattcagccgctgatgggcctgctggtccgtgaagcaggcaagacgttcgcgaacgccatcgccgaagtgcgtgaagcggtggacttcctgcgctactacgcagtgcaggcgcgcaacgacttcaccaatgatgcgcaccgtcctttgggcccggtggtctgcatcagcccatggaacttcccgctggcaatcttcagtggtcaggtggcggctgcattggctgcaggtaacccggtactggccaaacccgccgagcagacgccgctgattgcagctcaggcggtacgcctgctgcttgaagccgggatcccggaaggcgtggtgcaattgctgcccggtcgcggtgaaaccgtcggggccgggctggtgggcgatgagcgcgtcaagggcgtgatgttcaccggctccaccgaagtcgcccgcctgctgcaacgcaatgtcgccgatcgcctcgactctcagggtcgccctatcccactaatcgccgaaaccggcggccagaacgcaatgatcgtggactcctcggcgctgaccgaacaagtggtcatcgacgtagtgtcctcggcgttcgacagcgccgggcaacgttgctcggcactgcgcgtgctgtgcctgcaggaagattcggccgatcgcgtcattgaaatgctcaagggcgcgatggccgaaagccgtctgggcaacccggaacgcctgtccgtggacatcgggccggtgatcgatgccgaggccaaggccggcatcgagaaacacatccaggcgatgcgcgacaagggccgcacggtttatcaggttgccatcgccgaaagcgccgaactcaagcgcggcacctacgtgatgccaaccttgatcgagctggaaagcttcgatgaactgcaacgcgaaatcttcggcccggtgctgcacgtggtgcgctacaagcgcaaggagctcggccttttgatcgaccagatcaatgcatccggctacggcctgacgctcggcgttcacacgcgcatcgacgaaaccatcgccaaggtcatcgataacgtcaacgccggtaacgtctacgtcaaccgcaacatcgtcggtgccgtggtcggggttcagccgtttggcggcgaaggcctgtctggcaccggccctaaagccggtggcccgctgtacctgtatcgcctgttgtcgacacgaccgctggatgccatcgaaaaatcgtttgtgcgtggcgatgcattggttgcacctgatacacgtctgcgcgaagtgatgagcaaaccgctgcaagccttgaaggcctgggcagcgagcagccagcacgccgaactggatgtgctgtgcggccagtacgccgagcaatcgcaaagcggcatcacccgccaactggccggcccgaccggcgagcgcaacagctacgccattctgccacgcgaacacgtgctgtgcctggctgacgacgagaacgacctgctgacccaactggcagccgtactggctgtcggcagctcagccgtatggccggaaaccgacatcagcaaaccgctcttcgctcgcctgccaaaagaagttcaggctcgcatcaagctggtgcctgactgggccaaggacgaagtcgctatcgacgctgttctgcaccacggcgactccgaccaattgcgcgccatctgccaacagatcgcccagcgcagcggcgcaatcgtcggcgtcaacggtctgtcccacggcgaaaccaacgtccctctggaacgcctggtgatcgaacgggcactgagcgtcaacacggcggctgcggggggcaatgcgagcttgatgacgataggatga

SEQ ID NO: 12595 - protein, 1317 aa, Pseudomonas syringae
MATTTLGVKLDDPTRERLKAAAHSIDRTPHWLIKQAIFNYLEKLESGATLLELNGATGKDSEDRGELAEDAGLQCFLDFAESIQPQSVLRAAITSAYRRPEQEVVPMLLEQARLTAPVAEATNKLAASIAEKLRNQKSAGGRAGIVQGLLQEFSLSSQEGVALMCLAEALLRIPDKGTRDALIRDKISNGNWQPHLGNSPSLFVNAATWGLLLTGKLVATHNEAGLTSSLSRIIGKRGEPMIRKGVDMAMRLMGEQFVTGETIGEALANASRFEAKGFRYSYDMLGEAALTEHDAQKYLASYEQAIHSIGKASHGRGIYEGPGISIKLSALHPRYSRAQYERVMDELYPRLLSLTLLAKQYDIGLNIDAEEADRLELSLDLLERLCFEPQLTGWNGIGFVIQAYQKRCPYVIDYVIDLARRSRHRLMIRLVKGAYWDSEIKRAQVEGLEGYPVYTRKVYTDVSYIACARKLLAAPEVIYPQFATHNAHTLAAIYQIAGQNYYPGQYEFQCLHGMGEPLYEQVVGKVADGKLNRPCRVYAPVGTHETLLAYLVRRLLENGANTSFVNRIADHSISIQELVADPVNQIERMATQEGGFGLPHPRIPLPRDLYGTERANSSGIDMANEHRLASLSSALLSTAHNDWKAAPMLGCPASEGTLAAALNPSDLRDVVGHVQEASLQDVDNAIQCALSAGPIWQATPPAERAAILERAADLMEGEIQPLMGLLVREAGKTFANAIAEVREAVDFLRYYAVQARNDFTNDAHRPLGPVVCISPWNFPLAIFSGQVAAALAAGNPVLAKPAEQTPLIAAQAVRLLLEAGIPEGVVQLLPGRGETVGAGLVGDERVKGVMFTGSTEVARLLQRNVADRLDSQGRPIPLIAETGGQNAMIVDSSALTEQVVIDVVSSAFDSAGQRCSALRVLCLQEDSADRVIEMLKGAMAESRLGNPERLSVDIGPVIDAEAKAGIEKHIQAMRDKGRTVYQVAIAESAELKRGTYVMPTLIELESFDELQREIFGPVLHVVRYKRKELGLLIDQINASGYGLTLGVHTRIDETIAKVIDNVNAGNVYVNRNIVGAVVGVQPFGGEGLSGTGPKAGGPLYLYRLLSTRPLDAIEKSFVRGDALVAPDTRLREVMSKPLQALKAWAASSQHAELDVLCGQYAEQSQSGITRQLAGPTGERNSYAILPREHVLCLADDENDLLTQLAAVLAVGSSAVWPETDISKPLFARLPKEVQARIKLVPDWAKDEVAIDAVLHHGDSDQLRAICQQIAQRSGAIVGVNGLSHGETNVPLERLVIERALSVNTAAAGGNASLMTIG

SEQ ID NO: 12596 - DNA, 3954 bp, Pseudomonas putida
  CDS (1)..(3954)
atggcgactaccacccttggggtcaaactcgacgacccgacccgtgagcgactcaaagcagctgcgcagtccatcgaccgcacgcctcactggttgatcaagcaagcgatcttcaattacctggagaagctcgagggtggtgccaccctgaccgaactcaacggtcatgccagcaacccggccgacgatgccggtgaagtccaggccgaccacagccaccagtgcttcctcgaatttgccgagagcatcttgccgcagtcggtactgcgctcggcgatcaccgccgcctaccgccgccccgagcaggaagtggtgccgatgctgctggagcaggcgcgcctgagcgcgccgctggccgacgccaccaacaagctggccgcaagcattgccgaaaaactgcgcaaccagaaaagcgtcggcggccgtgccggtatcgtccagggcctgctgcaggaattctcgctgtcgtctcaggaaggcgtggcgctgatgtgcctggccgaagccctgctgcgtatccccgacaaaggtacccgtgatgcgctgatccgcgacaagatcagtaccggcaactggcagccgcacctgggcaacagcccgtcactgttcgtcaacgccgccacctgggggctgctgctgaccggcaagctggtcagcacccataacgaaaccggcctcacctcctcgctcacccgcatcatcggcaagagcggcgagccgatgatccgcaagggcgtcgacatggccatgcgcctgatgggtgagcagttcgtcaccggcgagaccattgccgaagccctggccaacgccagccgtttcgaggccaaaggcttccgttactcctacgacatgcttggcgaagccgcactgaccgagcacgacgcgcagaagtacctggcgtcctacgagcaggccatccactcgatcggcaaggcctcgcatggccgtggcatctatgaaggcccaggcatctcgatcaagctgtcggcactgcacccgcgctacagccgggcccagtacgagcgcgtgatggaagagctgtacccgcgcctgctgtcgctgaccctgctggccaagcagtacgacatcggccttaacatcgacgccgaagaagccgaccgcctggagctttcgctggacctgctcgaacgcctgtgcttcgagccatccctggctggctggaacggcatcggcttcgttatccaggcctaccagaagcgctgcccgtacgtgatcgactacgtcatcgatctggccaagcgcagccgccaccgcctgatgatccgcctggtaaaaggcgcctactgggacagcgagatcaagcgtgcccaggtcgaaggcctggaaggctacccggtctatacccgcaaggtgtacaccgacgtgtcctacgtcgcctgcgcccgcaagctgctggccgtgccagaagccatctacccgcagttcgccacccacaacgcccacaccctgtcggccatctaccacattgccgggcagaactattacccgggccagtacgagttccagtgcctgcacggcatgggcgaaccgctgtacgagcaagtggtcggcaagattgccgatggcaagctgaaccgcccgtgccgcgtgtatgcaccggtcggcacccatgaaacgctgctggcctacctggtgcgccgcctgctggaaaacggcgcgaacacctcgttcgtcaaccgcattgccgaccactcgatttccatccaggaactggtcgccgacccggtggccagcatcgagcgcatgggtacccaggaaggcagtatcggcctgccgcacccacgcattcccctgccgcgcgacctgtatggcaccgaacgggccaactcggccggcatcgacatggccaatgaacaccgcctggcgtcgctgtcctgcgccatgctggccaccgctcacaacgactggaaggctgccccgctgctggcctgcgccgccagcgagagcgctgccgcaccggtgctgaacccggctgaccaccgcgacgtcgtcggccatgtgcaggaggccaccgttgccgacgttgacaacgccatccagtgcgcactgaacgccgcgccgatctggcaggccaccccaccagccgagcgtgctgccattctggagcgcaccgccgacctgatggaggccgagatccagccgctgatgggcctgctcatccgcgaggccggcaagaccttcgccaacgccattgccgaagtgcgtgaagccgtggacttcctgcgctactacgcggtgcaggcacgtaacgacttcagcaacgacgcccaccgcccactgggtcctgtggtgtgcatcagcccatggaacttcccgctggcgatcttcaccggccaggtggccgcagccctggctgccggcaacccggtactggccaagcctgccgagcaaaccccactgatcgccgcccaggccgtgcgcctgctgctggaagctggcatcccagaaggcgtgctgcagctgctgccgggccgcggtgaaactgtcggtgccggcctggtcggagacgagcgcgtcaaaggcgtgatgttcaccggctccactgaagtggcccgcctgctgcagcgcaacgtcgctggccgtctggacaaccagggccgcccgatcccgctgatcgccgaaaccggcggccagaacgcgatgatcgtcgactcctcggcactgaccgaacaggtcgtgatcgacgtggtgtcctcggccttcgacagtgccggccagcgttgctcggccctgcgcgtactgtgcttgcaggaagactccgccgaccgcgtaatcgagatgctcaagggcgccatggctgaaagccgcctgggctgcccggaccgcctggccgtggacatcggcccggtgatcgatgccgaagccaaagccggcatcgagaagcacatccagggcatgcgcgagaaaggccgcccggtctaccaagtcgccattgccgatgctgccgagatcaagcgcggcaccttcgtcatgccaaccctgatcgagctggacagcttcgacgagctgaagcgcgaaatcttcggccccgtgctgcacgtggtgcgctacaaccgccgcaatctggaccagctgatcgagcagatcaacaactccggctacggcctgaccctcggcgtgcacacccgtatcgacgagaccatcgccaaagtggtggaaaccgccaacgccggcaacatgtacgtcaaccgcaacattgtgggtgcagtggtgggcgtgcagccgttcggtggtgaaggcctgtctggcaccggcccgaaagccggcggcccgctgtacctctaccgcctgctgtcgacccgcccggccgacgccattggccgccacttccagcagcaggacggcgaaggcacgccggaccgcaccctgcacgaacagctggtaaagccgctgcacggcctgaaggcctgggccgagaacaaccagctggccgacctggccgcgctgtgcagccagttcgccagccagtcgcagagcggcatcgcccgcctgctgccaggcccgaccggcgagcgcaacagctacaccattctgccgcgtgagcacgtgctgtgcctggccgacaacgaaaccgacctgctggcgcagttcgccgcggtactggccgttggcagctcggcggtgtgggttgacggtgaaccgggcaaggccctgcgcgcccgcctgccgcgtgagctgcaggccaaggtgaagctggtcgcggactggaacaaggatgaagtggcgttcgacgccgtgatccaccatggcgactcggaccagctgcgcggcgtatgccagcaggtggccaagcgtgccggggcgatcgttggggtgcacgggctgtccagcggggatcaccagattgcgctggagcgcctggtcatcgagcgcgcggtgagcgtgaacactgcagcggcgggtggtaacgccagcctgatgaccattggctaa

SEQ ID NO: 12597 - protein, 1317 aa, Pseudomonas putida
MATTTLGVKLDDPTRERLKAAAQSIDRTPHWLIKQAIFNYLEKLEGGATLTELNGHASNPADDAGEVQADHSHQCFLEFAESILPQSVLRSAITAAYRRPEQEVVPMLLEQARLSAPLADATNKLAASIAEKLRNQKSVGGRAGIVQGLLQEFSLSSQEGVALMCLAEALLRIPDKGTRDALIRDKISTGNWQPHLGNSPSLFVNAATWGLLLTGKLVSTHNETGLTSSLTRIIGKSGEPMIRKGVDMAMRLMGEQFVTGETIAEALANASRFEAKGFRYSYDMLGEAALTEHDAQKYLASYEQAIHSIGKASHGRGIYEGPGISIKLSALHPRYSRAQYERVMEELYPRLLSLTLLAKQYDIGLNIDAEEADRLELSLDLLERLCFEPSLAGWNGIGFVIQAYQKRCPYVIDYVIDLAKRSRHRLMIRLVKGAYWDSEIKRAQVEGLEGYPVYTRKVYTDVSYVACARKLLAVPEAIYPQFATHNAHTLSAIYHIAGQNYYPGQYEFQCLHGMGEPLYEQVVGKIADGKLNRPCRVYAPVGTHETLLAYLVRRLLENGANTSFVNRIADHSISIQELVADPVASIERMGTQEGSIGLPHPRIPLPRDLYGTERANSAGIDMANEHRLASLSCAMLATAHNDWKAAPLLACAASESAAAPVLNPADHRDVVGHVQEATVADVDNAIQCALNAAPIWQATPPAERAAILERTADLMEAEIQPLMGLLIREAGKTFANAIAEVREAVDFLRYYAVQARNDFSNDAHRPLGPVVCISPWNFPLAIFTGQVAAALAAGNPVLAKPAEQTPLIAAQAVRLLLEAGIPEGVLQLLPGRGETVGAGLVGDERVKGVMFTGSTEVARLLQRNVAGRLDNQGRPIPLIAETGGQNAMIVDSSALTEQVVIDVVSSAFDSAGQRCSALRVLCLQEDSADRVIEMLKGAMAESRLGCPDRLAVDIGPVIDAEAKAGIEKHIQGMREKGRPVYQVAIADAAEIKRGTFVMPTLIELDSFDELKREIFGPVLHVVRYNRRNLDQLIEQINNSGYGLTLGVHTRIDETIAKVVETANAGNMYVNRNIVGAVVGVQPFGGEGLSGTGPKAGGPLYLYRLLSTRPADAIGRHFQQQDGEGTPDRTLHEQLVKPLHGLKAWAENNQLADLAALCSQFASQSQSGIARLLPGPTGERNSYTILPREHVLCLADNETDLLAQFAAVLAVGSSAVWVDGEPGKALRARLPRELQAKVKLVADWNKDEVAFDAVIHHGDSDQLRGVCQQVAKRAGAIVGVHGLSSGDHQIALERLVIERAVSVNTAAAGGNASLMTIG

SEQ ID NO: 12598 - DNA, 3321 bp, Bacteroides thetaiotaomicron
  CDS (1)..(3321)
atggtacaacgtccgcaggacaagaaattcctcgtgaagatgctggatgaatcttcgcaaatccgtgaccgaaggatacttgccaaacgtatcaaaacccttctcgaccaatacggcgttcccgaatttctgaacaagcgggacagcttcctgttcaaaatgtatcaggcattcggccatcatttcgactttatcgccatccccatcatcaagaagcgcctgcgcatgaacacctcgcaggtcatcatcaacgaagcgcgtccgcaactcacgaagcatctggccatccgtgcaaaggagaaaatcgggcagaacgtcaacctgctgggcgaagtggtgctcggcaacggagaagccgaccatcgttaccaccattatctgaaagcgctcgaatcacccgacatcaactacatatcagtgaaaatatcgggaatctatgcgcagacacacgccttgaattatgaagaaagttttccggaactcatttcgcgaatgtccgcgctttatcagaaagcgattgatttcccctatacggacgaagaaggagtcagacgatccaagtttatcaatctggatatggaggagtacaaagatacccatttcacattacgcctcttcaagacagtgctcagcctgccgcagttcaagaactattccgccggaatcgtcgttcaggcatatctgccggacgcatacgactttcagaccgaactgatcgaatttgccaaagcacgtgtggcagaaggcggtgctccgatcaagatgcgtctggtgaaaggctgcaacctggaaatggaaaccgtcatctcttcgctgagaggctggcccaatccgatccgcccttccaaagaagaagtagacgccaactacctgcatctgctggaacgggcactgatgcccgaaaacgcaagggtattgcatcttggagtagcttcccataacctgttctccatcgcctacgcctatctgctggctcagaaatatggtacagccgaatacatgaccttcgaaatgctggaagggatggcgaaccacctatggagagcccaatccatgctcggcaaccgggtgattctttatactcccgtagtgaaaaacgaacattttctgaatgccgtctcatatctcgtccgccggatggatgagaatacggcacctgataacttcctgactcactctttcaatctgagaccgaacacaaaagagtgggatttcctggctaagcagttcgaagatgcctacgccatgaaagatcaactgagtcatgtgtccccacgcacacagaatcgcaatcttccttacacgcccgtcccaccggcagacgtcctgaagaatgaaccggacacggacttcgacctgccacagaatcaggaatgggtgcgttctatcttctccaaatggaagaaagacggaacggaacagccggaaatcattccgctgcaaataggtgcggaaacggtggtatgcgaaagccgctacccatatacagaccgttgtcaggacgatgaagtctgtatctgtgaaatgtcgcaggcggacagcgcacaagtggagaaaatcatcgaaattgcagaggcagaccctgccggatggagaaagaccacactcgaagaacgccaccggatcatgtacgaagcagccaaccggctcgccgatatgcggggcgatctgataggctgtatgtgtgccgtgacgggtaaaaccgtcattgaaggtgatgtagaagtatcggaagcggtagactatgcccgtttctatacgacagcgatgaagaagtttgccgcgctggatgacgtagaaatgaaaccgaaaggcaccatactggtcatctccccgtggaacttcccctgtgccatccctgtgggcggcatagtagccggactggcgggaggaaataccgttatactgaaacctgccaccgtagccgcccctgttgcgtggatgtttgccaaggcattctgggatgccggtgtgccgaaggaagcgctgcaagtcatcatcacccgccgggaagcactgaaagtactgactaccgcccccgccatcaaacatatcattctgacaggaggaacggacaccgcacagaatatcgcaaaagccaatccgaccactccgttatcggcagaaacgggaggtaaaaacgttattatcctcacagcgtcgggcgaccgtgaccacgccatcatgaacatcgtcacttctgccttcggcaatgccggacagaagtgttccgcctgttcgctgttgttagtcgaacgttccgtatacgaagacgaaaacttccgtagcaagctgaaagatgcggcgacaagcctgaaaaccggcagtgtgtggaatgccggaaatatcgtcggtccgatgattaccaacaagaacgataagttactgcaagccttcaacctcgaaccgggtgagtcatggctggttcccccgcgtttcatcgaccgcagagagtacatccttgcaccaactgtcaaatggggagtaaaaccggaaagtttctcattccgcaccgaattgttcggtcccctgctgagcgtggcctgtatcgagaaccttgaagaaggaatcaggctggtgaacgggttggattacggattgacctccggcctgcaaagtctggatgaaaaggagcagaagctgtggaagaactccgtaatggcaggaaacctgtatatcaaccggggaattaccggagccatcgtcaaccggcaaccattcggaggaatgaaactatccgccttcggtggtggtatcaaagcaggtggccccaactactgtacctgtttcctcgaaatcaccgacaaaccggacagccggaccgactaccgacagagttatgccaaagcctatcaggaagagttctcaaaaccgagagacgtcaaccggctatatggagaacaaaacctcttccgctatctgcctttgaagaacatgattctacgcctcttcccgaaagatacagacgaagaagcgacgatgattgcacacgccgcccgtatatgcagaactccgctcaccatcagttttggcccgacagatgatcgtagcagcagacttgccggactcggctgcacactccggaaagaatcattagaggacttcctgaaagaattgcccgaatatgaaagagtacgtacctgttcgccggatatacccgatgtcatgtacgaacgggcagcggaaaccaataaatacattgcgacagcaccgcctgtgaagcaagggcgcatcgagctgatacactatatcaaggagcaaagcatcgcctttgagtatcaccggtatggcagtatttcggaagtaccgccttgcgaataa

SEQ ID NO: 12599 - protein, 1106 aa, Bacteroides thetaiotaomicron
MVQRPQDKKFLVKMLDESSQIRDRRILAKRIKTLLDQYGVPEFLNKRDSFLFKMYQAFGHHFDFIAIPIIKKRLRMNTSQVIINEARPQLTKHLAIRAKEKIGQNVNLLGEVVLGNGEADHRYHHYLKALESPDINYISVKISGIYAQTHALNYEESFPELISRMSALYQKAIDFPYTDEEGVRRSKFINLDMEEYKDTHFTLRLFKTVLSLPQFKNYSAGIVVQAYLPDAYDFQTELIEFAKARVAEGGAPIKMRLVKGCNLEMETVISSLRGWPNPIRPSKEEVDANYLHLLERALMPENARVLHLGVASHNLFSIAYAYLLAQKYGTAEYMTFEMLEGMANHLWRAQSMLGNRVILYTPVVKNEHFLNAVSYLVRRMDENTAPDNFLTHSFNLRPNTKEWDFLAKQFEDAYAMKDQLSHVSPRTQNRNLPYTPVPPADVLKNEPDTDFDLPQNQEWVRSIFSKWKKDGTEQPEIIPLQIGAETVVCESRYPYTDRCQDDEVCICEMSQADSAQVEKIIEIAEADPAGWRKTTLEERHRIMYEAANRLADMRGDLIGCMCAVTGKTVIEGDVEVSEAVDYARFYTTAMKKFAALDDVEMKPKGTILVISPWNFPCAIPVGGIVAGLAGGNTVILKPATVAAPVAWMFAKAFWDAGVPKEALQVIITRREALKVLTTAPAIKHIILTGGTDTAQNIAKANPTTPLSAETGGKNVIILTASGDRDHAIMNIVTSAFGNAGQKCSACSLLLVERSVYEDENFRSKLKDAATSLKTGSVWNAGNIVGPMITNKNDKLLQAFNLEPGESWLVPPRFIDRREYILAPTVKWGVKPESFSFRTELFGPLLSVACIENLEEGIRLVNGLDYGLTSGLQSLDEKEQKLWKNSVMAGNLYINRGITGAIVNRQPFGGMKLSAFGGGIKAGGPNYCTCFLEITDKPDSRTDYRQSYAKAYQEEFSKPRDVNRLYGEQNLFRYLPLKNMILRLFPKDTDEEATMIAHAARICRTPLTISFGPTDDRSSRLAGLGCTLRKESLEDFLKELPEYERVRTCSPDIPDVMYERAAETNKYIATAPPVKQGRIELIHYIKEQSIAFEYHRYGSISEVPPCE

SEQ ID NO: 12600 - DNA, 3281 bp, Mus musculus
  CDS (130)..(1818)
ccgaaggaggtggaccgggcgatgctgcgcctcccgcagaggtagtgcgctccgggcttgtctagtccagccctgcggggctgactcttagcttcccacagctgcgcaagactgttaagagtctccgcgatgctgccgctgccgtcgctccgccgatccctgctgtcccacgcctggaggagcgctgggctgcgatggaagcacacctcttctctaaaggtggccaatgagcccatcttagcattctctcagggaagccccgagcgggatgcactgcagaaggctctgaaggacctgaagggccagacggaagccatcccctgcgttgtcggggacgaggaggtgtggacctccgatatacagtaccagttgtcgccctttaaccatgcacacaaggtggccaagttctgctatgctgataaggccttgctcaacagagccatcgatgctgccttggctgccaggaaagagtgggacctgaagcccatggcagaccgggcccaggtcttcctgaaggcggcagatatgctgagtgggccccgaagggcggaagtccttgccaagaccatggtgggacagggcaagaccgtgatccaagcagagatcgatgctgcagccgaactcatcgacttcttcaggttcaacgcaaagttcgccgtggaactggagggggaacagcccatcagcgtgccacccagcaccaaccacacggtgtaccgggggctggagggcttcgtggcggccatctctcccttcaacttcaccgcgattggaggcaacctggcaggcgctccggccttaatgggcaacgtggttctgtggaagcccagtgacactgccatgctggctagctacgccgtctaccgcatcctccgggaggccggcttgccccccaacataatccagtttgtgccagccgacgggccaaccttcggggacacagtcaccagctcagagcacctttgtggcatcaattttacaggcagtgtccccaccttcaaacacctgtggaggcaggtggcccagaacctggaccggttccgtaccttcccacgcttggctggagagtgtggcgggaagaatttccatttcgtgcacagctcggccgacgtggacagcgtggtgagcgggacgctgcgctcggcattcgagtacggcggccagaagtgctcagcctgctcgcgcctctacgtgccgaagtcgctgtggccgcagatcaaagggcgactgctggaggaacacagcaggatcaaagtgggggatcctgcagaggactttgggaccttcttctccgcagtgattgatgccaaggcctttgctcgcattaagaagtggttggagcatgcacgttcctcgcccagcctcagcatcctggcagggggccagtgtaacgagtcagtgggttactacgtggaaccatgtatcattgagagcaaggacccacaggaacccatcatgaaggaggagatcttcggtcctgtgttgacagtatatgtgtacccagatgataaatacagagagacgctgaagctggtcgacagcactaccagctatggcctcacgggggcagtgttcgcccaggataaagcgattgtccaggaggccacgaggatgctgaggaacgctgctggcaacttctacatcaacgataagtctactgggtctgtggtgggccagcagccctttgggggcgcccgggcctcaggaaccaatgacaagccaggaggtccccactacatcttacgctggacatcaccccaggtcatcaaggagactcataagcccctgggggactggcgatactcctacatgcagtgagcccaggccagcacctctgttgtcaagcagatgtccatccagatgactgacatctctgcactgaccccctgctccccaccagctcctcctggactctctacagctgagctggaccctgtcctggccactgggtgcctgtcctcggagtcaggtgcccaggcttcgggtcatattggggaggatcagcccaatccacccagaattctcatctgctgcagaacgccctggtacctggcaggttccccgcctgtctgcttttctctcttcatcctgggcctggtgactcagagggcctcagaacctaaagggatattctcaggaccctgtcagggaaggagacagctctggtgtctcacttcaccactcagagactcctgactttggccttgtcccctacacatgtccagtgagataggacctcagccagatgactgcaggggcaccagctggctttgccccttggtctgtgctagctcctcctgcagggacttgtatccagccatatgcctttagtcccatgtgccttcctccagggtgcttgtgcatccctgagccttcatccctcctggacacctgctgggagtgaccagtggtggtcgtcccatacaggctgagtctgggaaacctcgaggtgggcctccattccatactcttgtgggatggatgcagccagcccagtggtagccagggagagctcctgcttgggtcctggataatcaaatgtttctagtggcttaagagcacacatgactttttaaggacatttgcctggggtccacatggaactggtatagctgtcaccaagggctacactgaagggtggggtaccagtatcagggccagctctgccttctgcttcctttcagggtccatgttgcttcccagggagcaggactcggctacaaatgtcccagttgtgcagttgtacactgtgagggggtggggctactgccacccgagaaaaaaaaatgccagatatctactcaaagtggccatggagggaggggaagggcagactggcttctcattcctaatctaatgaactgccagcgtcttgtcacgtggttctgtgcggtgtcatgggagggaggagtgactccggagcccaatggctaggtttagaaatggctttctgtcccaccccccccaaagtggtcatcaaaaaaatcatgtaatttctccaaccttccatgtctaaaatggtgatgattccgtcatatgcacggaggatcaatgggctaattcctgtggatttcagacaaatgatcagaaatgtcacccgttcgtttgttctcctaccagtatgtgctgtggtggctgatcttatgtgtcacctttgcctggccacggttcccagagacctggtcagccactgtggaagtttttatgatggtgcaataaatacgtgggcaaaataaaaaaaaaaaaaaaaaaaaaaaaaaaaaaaaaaaaaaaaaaaaaaa

SEQ ID NO: 12601 - protein, 562 aa, Mus musculus
MLPLPSLRRSLLSHAWRSAGLRWKHTSSLKVANEPILAFSQGSPERDALQKALKDLKGQTEAIPCVVGDEEVWTSDIQYQLSPFNHAHKVAKFCYADKALLNRAIDAALAARKEWDLKPMADRAQVFLKAADMLSGPRRAEVLAKTMVGQGKTVIQAEIDAAAELIDFFRFNAKFAVELEGEQPISVPPSTNHTVYRGLEGFVAAISPFNFTAIGGNLAGAPALMGNVVLWKPSDTAMLASYAVYRILREAGLPPNIIQFVPADGPTFGDTVTSSEHLCGINFTGSVPTFKHLWRQVAQNLDRFRTFPRLAGECGGKNFHFVHSSADVDSVVSGTLRSAFEYGGQKCSACSRLYVPKSLWPQIKGRLLEEHSRIKVGDPAEDFGTFFSAVIDAKAFARIKKWLEHARSSPSLSILAGGQCNESVGYYVEPCIIESKDPQEPIMKEEIFGPVLTVYVYPDDKYRETLKLVDSTTSYGLTGAVFAQDKAIVQEATRMLRNAAGNFYINDKSTGSVVGQQPFGGARASGTNDKPGGPHYILRWTSPQVIKETHKPLGDWRYSYMQ

SEQ ID NO: 12602 - DNA, 1641 bp, Streptomyces coelicolor
  CDS (1)..(1641)
atggacgctgtgacccaggtccccacccccgtcaacgagccggtgcacggctacgcgcccggttcgcccgagcgcgcccgtctggaggccaagctcaaggagctggccgacaacccgatcgacctgccttgcaccatcggtggcgagaagcggatgggcggcggcgagcgcttcgacgtcgtgcagccgcacaaccacaagtcccgcctgggcacgtacgccaacgccacgcaagcggacgcccaggacgcgatcgacgccgccctggccgccgcccccgcgtggcgcgcgatgtccttcgacgaccgcgcggcgatcatcctgcgcgccgccgagctgctgtccggcccgtggcgcgagaccatcgccgcctccaccatgctcggccagtccaagaccgcccagcaggccgagatcgacagcccctgcgagctgatcgacttctggcgcttcaacgtgcactacgcgcggaacatcctcgccgagcagcccccggccaactcccagggcgtgtggaaccgtatggaccaccgcccgctggagggcttcgtctacgcgatcacgccgttcaacttcagcgcgatcgcggccaacctgcccaccgccccggccctgatgggcaacgtcgtggtgtggaagccgtccccgacgcagacccacgccgccgtgctgctcatgcagctgctggaggaggccggactgcccaagggcgtcatcaacctggtcaccggcgacggcatcgcggtctccgaggtcgccctggagcaccgggacctcgcgggcatccacttcaccggttcgaccaagaccttccagcacctgtggaagacggtcggcaacaacatcgagaagtaccgcacctacccgcgcctggtcggcgagaccggcggcaaggacttcctggtcgcccacccgagcgccgaccgcgccgtcctcaagacggccctgacccgcggtgccttcgagtaccagggccagaagtgcagcgccacctcccgcgcgtacatcccggcgtcgatctggaacgacgggttcaaggaggagttcgccgccgaggtcgactacctcaccatgggtgacgtcaccgacctgtcgaacttcatcggcgcggtcatcgacgagcggtccttcgccaagaacaaggccgccatcgaccgggccaaggaggacgagacctgcacgatcgtcgcgggcggctcctacgacgactcggtcggctacttcgtccgcccgaccgtcgtcgagtgcaccgacccggagaacgaggtcttccgcaccgagtacttcggccccttcctcgccgtgcacgtgtacgacgacagcgccgacgacgcgtacgacgcgatgctgacccagatggagtcggtctcggactacgcgctcaccggctcggtgatctccaacgaccgcgcggcggccgcgtacacgatggagaagctgcgctacgcggcgggcaacttctacatcaacgacaagtcgaccggtgccgtggtcggccagcagcccttcggcggcggccgcgcctccggcaccaacgacaaggccggcgccccgcagaacctgatgcgctggacgctgacccgcgccatcaaggagacgctggtcgcaccgaccgactacacgtacccgcacatgggctga

SEQ ID NO: 12603 - protein, 546 aa, Streptomyces coelicolor
MDAVTQVPTPVNEPVHGYAPGSPERARLEAKLKELADNPIDLPCTIGGEKRMGGGERFDVVQPHNHKSRLGTYANATQADAQDAIDAALAAAPAWRAMSFDDRAAIILRAAELLSGPWRETIAASTMLGQSKTAQQAEIDSPCELIDFWRFNVHYARNILAEQPPANSQGVWNRMDHRPLEGFVYAITPFNFSAIAANLPTAPALMGNVVVWKPSPTQTHAAVLLMQLLEEAGLPKGVINLVTGDGIAVSEVALEHRDLAGIHFTGSTKTFQHLWKTVGNNIEKYRTYPRLVGETGGKDFLVAHPSADRAVLKTALTRGAFEYQGQKCSATSRAYIPASIWNDGFKEEFAAEVDYLTMGDVTDLSNFIGAVIDERSFAKNKAAIDRAKEDETCTIVAGGSYDDSVGYFVRPTVVECTDPENEVFRTEYFGPFLAVHVYDDSADDAYDAMLTQMESVSDYALTGSVISNDRAAAAYTMEKLRYAAGNFYINDKSTGAVVGQQPFGGGRASGTNDKAGAPQNLMRWTLTRAIKETLVAPTDYTYPHMG

SEQ ID NO: 12604 - DNA, 1494 bp, Oceanobacillus iheyensis
  CDS (1)..(1494)
atgacagcgcttacattagagacggatgtattaaaaaattttattgatggtaaatgggtagatgtgaataataccactgccgttacaaatcctgcaaatggtgaacgtatcgtgcaagtaccattgtctgatcaatctcatgttgaggaggctgttcaggctgcgataaaggctcaaaaggaatgggcacttgttcctgcacctcaacgtgcagaagtattgtaccgtgttggaatgattatgaaggataaaaaagaacgactatctcgtctgttgaccatggagaatggaaaggtactagaagaagcaagaggagaagtacaagaaggaatcgatatggctttttatatggctggggaaggtcgacgattgtttggccaaactacaccagcggaattaaaagataaattcgcgatgagtcagcgggttcctgtaggtgtcgtcggtatcattacaccatggaacttcccgattgcaattgctacttggaagtcattcccagcgattgtagctggaaatgcggtggtttggaaaccagcaacggaaactcccattatggcatatgagttagctaaaatatttgaagaagcaggattaccaagtggtgtcatcaatgttgtttttggtaaaggatcagaagtgggagattcgatggttcagcataaagatatcagagttatatcgtttacgggatcgaatgacacagggagaaatattgcatcagattgtgggaagcagttaaagaaggtatcacttgaaatgggcggaaagaatgcagtgattgttatggatgatgcagatttagacttagcggtagaaggaattctctggagtgcgtttggaacgagtgggcagcgttgtacagcttgcagtcgtgtgattgttcatcataaagtaaaaaagacgttggaagagagacttttagctgcaatggatcatttaacgattggtaatggattggaagacggaattaaagtaggaccaattatcaatgaagcaggattaaataaaatcaagaaatatatcgaagtgggcaagcaggagggtgctactttattagcaggaggaactgaatgggaaaccaataatccagggtattattttactccgaccttattcaccgatgctaagcctgacatgcggattgcacaagaggagatttttgggcctgttgtttcattaattgaagtaagtagttttgaagaagccattgaagtaaataatcaagttacgtttggcttatccagttctatttttacaaaggatgtaaatcgtgtttttaaagcacaacgtgatttagatacgggcattgtttatgtgaatgctggaacaacaggtgctgagattcatttaccttttggtggaacgaaaggaactggaaatggacatcgtgactctggcgtccaggcgttagatgtattcactgaatggaaggcgatttatgttgactatagcggaaaattacaacgtgcccagatagacacagaggaataa

SEQ ID NO: 12605 - protein, 497 aa, Oceanobacillus iheyensis
MTALTLETDVLKNFIDGKWVDVNNTTAVTNPANGERIVQVPLSDQSHVEEAVQAAIKAQKEWALVPAPQRAEVLYRVGMIMKDKKERLSRLLTMENGKVLEEARGEVQEGIDMAFYMAGEGRRLFGQTTPAELKDKFAMSQRVPVGVVGIITPWNFPIAIATWKSFPAIVAGNAVVWKPATETPIMAYELAKIFEEAGLPSGVINVVFGKGSEVGDSMVQHKDIRVISFTGSNDTGRNIASDCGKQLKKVSLEMGGKNAVIVMDDADLDLAVEGILWSAFGTSGQRCTACSRVIVHHKVKKTLEERLLAAMDHLTIGNGLEDGIKVGPIINEAGLNKIKKYIEVGKQEGATLLAGGTEWETNNPGYYFTPTLFTDAKPDMRIAQEEIFGPVVSLIEVSSFEEAIEVNNQVTFGLSSSIFTKDVNRVFKAQRDLDTGIVYVNAGTTGAEIHLPFGGTKGTGNGHRDSGVQALDVFTEWKAIYVDYSGKLQRAQIDTEE

SEQ ID NO: 12606 - DNA, 3951 bp, Wigglesworthia glossinidia brevipalpis
  CDS (1)..(3951)
atggataccagaatattaggaataaaattagacaacaaattatcccatcgtatcgaaaatatatcaagtagattaaatcgtactccacattggataattaagcaggccatttttcttcacctagatgatttagagaaaaaatcaaaatctagcgaaaaattaatagaaaataaaaatgaaattcaagattatcaagacaaaataaatgaaaaaattatttttaaacctttctttgaatttgcacaacaaatattacctcaatcttatttaagatttaatacaacaaacgcttggagtactcctgaaaaagaaattgttccaaagttattagaactatctaaatgcgaagaagaaactgaaaaaaaaattcatgagctatcaaagtatctagcaaaaggattaagagaaaaatcaaaaaagtacaatagagaacaaatggttcaagatttactacgagaatttcctttatcttctaaagaaggtatagctttaatgtgtttagcagaagccttgctaagaataccagatgtaaatacaagaaattctttaataaaagacaaaataaaaaataaagattggaaaagccattttggatccaataaaggtttatttataaattcagcagtatggggtttatgtataactaataatttaatcaaaagacataaagaaaaaaatttaagttcatatttaaataaagttattcaaaaaataggagagccaatcgtaggaaaagctataaacgtagctatgaaattaatgggaaaacaatttgttgtaggagaaaatatacaacaagctctaaaaaatacaaacattttagaaaaaaaaggtttttcatattcatatgatatgcttggagaagcagctttaacagaagaagatgcacaaaaatacatgacttcttatgaaaacgcaattcattgtataggaaaatcatctttgggaaaaggaatatataaaggaccaggtatatctattaaattatcagctattcatcctcgttattctagaaataaatatgaaaaagttatgtctgaattatatcctagattaagatcgttaactttattagctagacattatgacataggtatgaatatagatgctgaagaggcaaacagattagaaatttctatagatttattagataaattatgttgtgaaccatctttatttggatggagtggtattgggtttgtagtacaagcttatcaaaaaagatgtatgtatgtaatagaagaactaattgatatagcaaaacgtacgaaaagaagattaatggtaaggttagtaaaaggagcttattgggatagtgaaataaaaaatgcacaaattgaaggaatagaagactatccagtatttacgagaaaagcatatacagacatatcttatttagcatgtgctaaaaaacttctatcagaaagtaatcatatatatccacaatttgctactcacaatgctcatactgtatcatctatatatcattttgctggagagaattattattcaggacaatatgaatttcaatgtttacacggtatgggagaacaattatacgaaaaagtagtaggtaatgccattgataaaaaattagatcgtccatgtagaatttatgctcctgtaggtacacataaaactttacttgcttatttagtaagaagaattttagaaaacggagctaataattcatttattaatcgcatatcagataataatgtttctattgaaaaattagttttaagtccgataaaagagtctataagtatatcaaaaaaagaaaatgttgaaattggaacttctcatccaaatattcctttgccaaaaaatttatatggaaataatagagaaaattctcatggatttaatttttctaatgaaaatgttttagcaaaattatcatctgacttgttaaaaaattcagataaattttggaaagttactccaataattcattcaaaattagataaaggatctattagtaaaattataaatccagctaataaaaaagatataataggagagtgtcaaagttctactttaaaagacgttgaatctgctcttgaaagctcggtaaaaggaattgaattatggtcttcaaaagaaccattagagagatctaaaattttatatgatatttctaacaagatagaaaaaaatactaatatttttattaatttactcgttagagagtcaggaaaaacttttcctaatgccgtttccgaaataagagaagcagttgattttttaagatattactcaaatcaaataaaaccttttaataataaaacacatattcctttagggtgtgtgttatgcataagtccatggaattttcctttagctatttttttaggacaaatttcagctgctttagcttctggaaatgcagtaatagctaaacctgcagaacaaacgcctatagttgcatatgaagctattaaattaatgatagattctggaataccaagtgagtctttacagtttttacctggaagtggaaaaataataggaaattctctatctaaagatcatcgtatacacggagttatgtttacaggatctactcaagttgctcgtttattgcaattgaatttatctgatcgtttaagcaaaggaagacctgttcctctaattgctgaaactggcggtctaaatgccatgattgtagattcttcagcattaacagagcaagtagtatctgatattattgtttctgcttttgatagcgctggacagcgttgttctgctttaagactattatgtatacaagaagatgtatcagaaaaaactttaaatatgattaaaggagctattgattcttatactgtaggaaatccagaatatttttcaacagatattggtcctgtgatagataaaaatgcaaaaatcaatattgatcaacatattttgaatatgaaaaaaagcaaccattctgtatggcagagtgaaatgtcttatgacacaaaacaagatctaggaaattttgttttaccaacattgatagaattagacgatatagatcaaataaaagaagaagtatttggtccagttttacatattgttaaatttaaatatgaagaaatgaataatatatttgaaaaaataaattcttctggatatggattgactatcggtattcattctagaatagaagaaaatatagaaaaagtcacaacatcaacaaaagttggaaattattatgtaaatagaaacatagtaggagcagtagttggggttcagccttttggtggagaaggtttatctggtactgggccaaaagcaggaggtccattatatctatacagattgctttctgatagaaaagaaaaaaatattttatcttcattagaagaactagataaaaataaaaaagtagatttgactagatgcgaaaaaatacaagaatcttgtgtcagtttaatagaatggatttctgtaaactatccagatttagaaaaatattgtaattattttatttcacaatctcaatcaggaagctcaagagtgctacaaggacctactggagagaagaatacctatttgttgcttccaagagaaagaatattatgtttatcaaatgatgaaaatgatttactaattcaattagcagctgttaccagtattggagggaaagcaattttatctcataatccaattacacaaaaaatattttctattcttccacaatctgttttaaaaaatgtaattcttatcccaaattggaaaagagaagattcaatgtttgatatagttttatttcacggcgatgaattacaattaaaagaagtgttggaaattttatctaaaaaaagaggtccagtaataaatgttcatagccataaaaatggagataaaaaaatatttttagaaaaacttttaatagaacgtacaataagtttaaacactactgctgcaggtggaaatactactttattgagtatggtttaa

SEQ ID NO: 12607 - protein, 1316 aa, Wigglesworthia glossinidia brevipalpis
MDTRILGIKLDNKLSHRIENISSRLNRTPHWIIKQAIFLHLDDLEKKSKSSEKLIENKNEIQDYQDKINEKIIFKPFFEFAQQILPQSYLRFNTTNAWSTPEKEIVPKLLELSKCEEETEKKIHELSKYLAKGLREKSKKYNREQMVQDLLREFPLSSKEGIALMCLAEALLRIPDVNTRNSLIKDKIKNKDWKSHFGSNKGLFINSAVWGLCITNNLIKRHKEKNLSSYLNKVIQKIGEPIVGKAINVAMKLMGKQFVVGENIQQALKNTNILEKKGFSYSYDMLGEAALTEEDAQKYMTSYENAIHCIGKSSLGKGIYKGPGISIKLSAIHPRYSRNKYEKVMSELYPRLRSLTLLARHYDIGMNIDAEEANRLEISIDLLDKLCCEPSLFGWSGIGFVVQAYQKRCMYVIEELIDIAKRTKRRLMVRLVKGAYWDSEIKNAQIEGIEDYPVFTRKAYTDISYLACAKKLLSESNHIYPQFATHNAHTVSSIYHFAGENYYSGQYEFQCLHGMGEQLYEKVVGNAIDKKLDRPCRIYAPVGTHKTLLAYLVRRILENGANNSFINRISDNNVSIEKLVLSPIKESISISKKENVEIGTSHPNIPLPKNLYGNNRENSHGFNFSNENVLAKLSSDLLKNSDKFWKVTPIIHSKLDKGSISKIINPANKKDIIGECQSSTLKDVESALESSVKGIELWSSKEPLERSKILYDISNKIEKNTNIFINLLVRESGKTFPNAVSEIREAVDFLRYYSNQIKPFNNKTHIPLGCVLCISPWNFPLAIFLGQISAALASGNAVIAKPAEQTPIVAYEAIKLMIDSGIPSESLQFLPGSGKIIGNSLSKDHRIHGVMFTGSTQVARLLQLNLSDRLSKGRPVPLIAETGGLNAMIVDSSALTEQVVSDIIVSAFDSAGQRCSALRLLCIQEDVSEKTLNMIKGAIDSYTVGNPEYFSTDIGPVIDKNAKINIDQHILNMKKSNHSVWQSEMSYDTKQDLGNFVLPTLIELDDIDQIKEEVFGPVLHIVKFKYEEMNNIFEKINSSGYGLTIGIHSRIEENIEKVTTSTKVGNYYVNRNIVGAVVGVQPFGGEGLSGTGPKAGGPLYLYRLLSDRKEKNILSSLEELDKNKKVDLTRCEKIQESCVSLIEWISVNYPDLEKYCNYFISQSQSGSSRVLQGPTGEKNTYLLLPRERILCLSNDENDLLIQLAAVTSIGGKAILSHNPITQKIFSILPQSVLKNVILIPNWKREDSMFDIVLFHGDELQLKEVLEILSKKRGPVINVHSHKNGDKKIFLEKLLIERTISLNTTAAGGNTTLLSMV

SEQ ID NO: 12608 - DNA, 2943 bp, Synechococcus elongatus
  CDS (1)..(2943)
atgaccggtctttacgaagcagaaacgatcgcgatcgcccggcaactgtgggcggccagccaagagtcccgcaacttttttagccaactgcgggagcaaatgcgcattgaagataagctcctcggctgggccatggaacatccgggtctacgggtacaactctttcgcctcattgactgtctgcccagtctgcgcagtcaaaccgaggtggcacgccacctgcaggagtacctcagtgatcccagtgtggagttgccgcccgggctgaaaaaactcttgaactttgcccagccggattccctgccggcccaagcagcggcaaccaccttcacaacagcagtgcaagccctggcccacaagtacattgccggtgaaaccaccgagcaggtgctaaaaaccattggccgtctgcgcaagcagggcatgctggtgacgatggatattcttggggaagcggtgattacggaggcagaggcacagcagtattgcgatcgctaccttgacttgatggagcacctcagtcccttgggccaacgggagggcgtgaatccagtccaggtctccgtaaagctgacggccttttactcccagtttgatcctttggatgtttctggctgccgtgccaaggtgggagagccgattcgccggctgttgcatcgtgcccaagaattgggggtggcagtgcactttgatatggagcagtatgcctacaaagacattaccttggcgatcctcaaggatattttgctagagccagagtttcgcgatcgcgccgatattgggctaacactgcaggcctatttgcgggatagctaccaagatgcccaagacctcattacttgggtacaacagcggggcacccccatcactgtgcgggtggtcaagggcgcctactgggatcaggaactcattaaggcagtgcaacatcattggccgttgcccgtctatcaacacaaacagaacacggatgccaactttgagcgcatcattgaactgctcctgagtcaccatacggtgttgcgcacagcgatcgcgagccataatgtgcgttcccaagcgcgggcgatcgcaattgctcaacggcagcacattccgcccacggccatggaatgccaagttctctacggcatggccgataaactggccaaggcattggtggaggcagggcaaacggtgcgggtctattgtccctatggcgatctcattccggggatggcctacctgattcggcgactcctggaaaataccgccaatagttcctttttacgccaacagttgggggctgtggccatcgaggaattactggccccaccggaaccaacggcggactttgaagccgtgaacgttcatctgaccacgggcaagacttcaacctttgtcaatgctgccaatagtgactatgcccgagccagccagcgggaagccattcaagcggccttaatccatgtccatcgccaactggggcaaacctatactcccatcatcaatggcgatcgcgtcaatccccgcgaatacagtgagtccctgaacccttcgcagccggaggaaatcgtcggtcgggttggcttggccaccattgaggatgccgagcatgcgatccgggctgccaaagccgctcaagcccaatggcaacagacctccgtggctgaacgggcaaccctgctccggcgggcagcagacctcctagaggcacagcgccatgaactggtggcttggatgtgctacgaagtgggcaaggtggtggcagaaggggatgccgaagtctccgaagccgttgatttttgccgctactacgccgatgaaatggagcgcctcagcagcggctatgaccgcaactttcccggtgaaaccaaccattaccactaccaagggcggggccttgcggttgtgatttctccttggaactttcccttggcgattcccaccggtatgaccgcggccgccctagtgacaggtaactgcacgattctcaaacctgcggatcccgccgccgtcgttgctgccaaactagcggagatcctgatggccgccggttttccgccgggggtgtttcagtttctccccggacgtggctccgtgattggcccctatttaacccaacatcccgatgtacatctcatcgcctttactggctcccaagaggtgggttgccgcattattgctgaggcagcagtgttacagcggggacaaagccacatcaagcgggtgattgccgagatggggggcaaaaacgccatcatcattgacgaaagtgccgacttagatcaggcagtggcgggggttgtgcagtccgcctttggctacagcggccaaaaatgctccgcctgttcgcgggtgattgtccttgagtccatctacaaaccctttgtggagcgcttagtggcggccacccagtccctgaatattgggccagcccacttgcccagtacccgtgtcggaccggtggtgacagccgctgcccgcgatcgcattcaggaatacattgccaaaggacagcaagaggcggaactcctcttgagcgtaccggtaccggagatgggctattttgtctcgcccacgatctttaccaacgtgccccccacggccacgatcgcccaagaggaaatttttggcccggtgctggccgtcctacgggcagaaaccttcacccaagcccttgcaattgccaatgccaccgcctatgccctgacaggggggctgtattcgcggacgccctcccatattcagcaggccaaagcccaatttgctgtagggaacctgtacatcaatcgggggattacaggggcgatcgtggatcggcagccctttggcggctttaagctgtcggggattggctccaaagccggtggacgcgattacctgctgcaattccttgaaccgcgggtcattaccgagaatgtccaacgtcaagggtttgcccccattgccggagtcgatgattga

SEQ ID NO: 12609 - protein, 980 aa, Synechococcus elongatus
MTGLYEAETIAIARQLWAASQESRNFFSQLREQMRIEDKLLGWAMEHPGLRVQLFRLIDCLPSLRSQTEVARHLQEYLSDPSVELPPGLKKLLNFAQPDSLPAQAAATTFTTAVQALAHKYIAGETTEQVLKTIGRLRKQGMLVTMDILGEAVITEAEAQQYCDRYLDLMEHLSPLGQREGVNPVQVSVKLTAFYSQFDPLDVSGCRAKVGEPIRRLLHRAQELGVAVHFDMEQYAYKDITLAILKDILLEPEFRDRADIGLTLQAYLRDSYQDAQDLITWVQQRGTPITVRVVKGAYWDQELIKAVQHHWPLPVYQHKQNTDANFERIIELLLSHHTVLRTAIASHNVRSQARAIAIAQRQHIPPTAMECQVLYGMADKLAKALVEAGQTVRVYCPYGDLIPGMAYLIRRLLENTANSSFLRQQLGAVAIEELLAPPEPTADFEAVNVHLTTGKTSTFVNAANSDYARASQREAIQAALIHVHRQLGQTYTPIINGDRVNPREYSESLNPSQPEEIVGRVGLATIEDAEHAIRAAKAAQAQWQQTSVAERATLLRRAADLLEAQRHELVAWMCYEVGKVVAEGDAEVSEAVDFCRYYADEMERLSSGYDRNFPGETNHYHYQGRGLAVVISPWNFPLAIPTGMTAAALVTGNCTILKPADPAAVVAAKLAEILMAAGFPPGVFQFLPGRGSVIGPYLTQHPDVHLIAFTGSQEVGCRIIAEAAVLQRGQSHIKRVIAEMGGKNAIIIDESADLDQAVAGVVQSAFGYSGQKCSACSRVIVLESIYKPFVERLVAATQSLNIGPAHLPSTRVGPVVTAAARDRIQEYIAKGQQEAELLLSVPVPEMGYFVSPTIFTNVPPTATIAQEEIFGPVLAVLRAETFTQALAIANATAYALTGGLYSRTPSHIQQAKAQFAVGNLYINRGITGAIVDRQPFGGFKLSGIGSKAGGRDYLLQFLEPRVITENVQRQGFAPIAGVDD

SEQ ID NO: 12610 - DNA, 3180 bp, Shewanella oneidensis
  CDS (1)..(3180)
atgttcaaagcgagtgaagtgctggcaggccgctacgattctgccaatctcgacgaactgttcaaagctgtcaccgacaactacattgtcgatgaagaacaatacttgtcagagctaatcaaactagtcccctccagtgatgaagcgattgagcgcgtcactcgtcgtgcccacgaactggtgaacaaagttcgtcaatttgagaaaaaaggcttaatggttggcatcgatgccttcctacagcaatacagcttagagactcaggaaggtatcatcctgatgtgtttagccgaagccctactgcgtattcccgatgcggccaccgctgacgccttgattgaagataaactttcaggtgcaaaatgggatgaacacttaagcaagagcgattcggtactggttaacgcctccacttggggcctgatgctcaccggtaaaattgtcagcttagataaaaaaatcgacggcagctcaagtaacctattaggccgtttagtcaatcgtttaggtgaacccgtgatccgccaagccatgatggccgcgatgaaaatcatgggtaaacagttcgttcttggccgcaccatgaaagaagcgcttaagaacagcgaagacaagcgtaaattaggttacacccactcctacgatatgctgggcgaagccgcgctgacgcgtaaagatgccgaaaaatactttaccgattatgccaatgcgattaccgagttaggcgcgcaaagctataacgaaagtgaatctccacgcccaacgatttcaattaagttgtcggcattgcacccacgttacgaagtcgctaacgaagaccgtgtactaaccgagctgtatgacaccgtcattcgcctaattaaactcgcgcgcgggttaaatatcggtatttctatcgacgccgaagaagttgaccgtctcgaactgtcattaaagctgttccaaaaactgtttaattctgaagccactaaaggctggggattactgggtatcgttgttcaagcttactctaagcgcgcgctacctgtactggtatggttaacccgcctagcgaaagagcaaggcgatgaaatcccggttcgcttagtcaaaggcgcttactgggatagcgagcttaaatgggcgcagcaggcaggcgaagccgcttacccactttacacccgcaaagcagggacagacgtatcttacttagcctgtgcgcgttacctgttatccgacgccacccgcggcgcgatttaccctcaatttgccagccacaacgcgcaaaccgttgcggcaatttccgatatggcgggcgatcgtaaccacgaattccaacgtctacacggtatgggacaagagctgtacgacaccattctgtcggaagcgggcgcgaaagcagtacgtatctacgcccccatcggtgcccataaggatctgctgccctacttagtacgtcgcctactggaaaacggtgcgaacacctcgttcgtgcacaaactggtcgatccgaaaacgcctattgagtctttagtggttcatccgttaaagacattgaccagctacaaaaccctggctaacaacaaaatcgttttacctatcgatattttcggtagcgatcgcaaaaattccaagggactcaatatgaacattatttcagaagcagagccattcttcgcggccttagacaaattcaaatcaacacagtggcaagcgggtcctctggttaatggtcaacccttaactggcgagcacaaaaccattgttagcccattcgataccactcaaactgtgggtcaagtggcctttgccgacaaagcagctatcgaacaagccgtgtcttctgctcatgcggctttcggctcttggacccgtacacctgttgaagtgcgcgcctcggcactgcaaaagctagcggatctgttagaagaaaaccgcgaagaactgattgccctctgtacccgtgaagcaggtaagagcattcaagacggtatcgacgaagtgcgtgaagccgtcgacttctgccgttactacgcagtacaagccaagaagctgatgtcaaaacctgaactgctcccaggcccaacaggcgagttaaacgaactcttcctccaaggtcgcggtgtatttgtgtgtatcagcccatggaacttcccattagcgatcttcttaggccaagtctcagcggccctagcagcgggtaacactgtggtcgcaaaacctgcggaacagacgtcaatcattggttaccgcgcagtgcagttagcacaccaagcgggtattccaacggacgtgctgcaatatctgccaggtacaggcgccaccgttggtaacgcactgacggctgatgagcgcattggcggcgtatgctttaccggttcaacgggcacagccaaactgattaaccgcacgctggcaaaccgtgaaggcgcgatcattccgttaatcgccgaaaccggtggccaaaacgccatggtggttgattctacttctcaaccagaacaagtggttaacgatgtagtgtcttcatccttcaccagcgcgggtcaacgctgctcggcgctgcgcgtactcttcctgcaggaagatattgctgaccgcgttattgatgttctgcaaggtgcgatggatgagctagtgattggcaatccaagttcaatcaaaactgacgtaggtccagtgattgatgcaacagccaaagccaaccttgatgcccatatcgaccacattaagcaagttggcaagctgatcaagcaaatgtctctgccagcgggcactgagaatggtcactttgtagcgccaacagccgttgaaattgattcaatcaaagtgcttgaaaaagaacactttggcccaatcctgcacgtgatccgttacaaagcatcagaacttgcccatgtgatcgatgaaatcaacagcacaggctttggtttaaccttaggtatccacagccgtaacgaaggccatgccctcgaagtggcggataaagtgaatgtcggcaacgtgtacattaaccgtaaccaaatcggcgcggtggttggagtacagcctttcggcggtcaaggtctatctggcacaggtccaaaagccggtggtccacactacttaacccgtttcgtgactgaaaaaacccgcactaacaacatcaccgctatcggtggtaatgcgaccctgctgtcactcggtgatagcgacgcctaa

SEQ ID NO: 12611 - protein, 1059 aa, Shewanella oneidensis
MFKASEVLAGRYDSANLDELFKAVTDNYIVDEEQYLSELIKLVPSSDEAIERVTRRAHELVNKVRQFEKKGLMVGIDAFLQQYSLETQEGIILMCLAEALLRIPDAATADALIEDKLSGAKWDEHLSKSDSVLVNASTWGLMLTGKIVSLDKKIDGSSSNLLGRLVNRLGEPVIRQAMMAAMKIMGKQFVLGRTMKEALKNSEDKRKLGYTHSYDMLGEAALTRKDAEKYFTDYANAITELGAQSYNESESPRPTISIKLSALHPRYEVANEDRVLTELYDTVIRLIKLARGLNIGISIDAEEVDRLELSLKLFQKLFNSEATKGWGLLGIVVQAYSKRALPVLVWLTRLAKEQGDEIPVRLVKGAYWDSELKWAQQAGEAAYPLYTRKAGTDVSYLACARYLLSDATRGAIYPQFASHNAQTVAAISDMAGDRNHEFQRLHGMGQELYDTILSEAGAKAVRIYAPIGAHKDLLPYLVRRLLENGANTSFVHKLVDPKTPIESLVVHPLKTLTSYKTLANNKIVLPIDIFGSDRKNSKGLNMNIISEAEPFFAALDKFKSTQWQAGPLVNGQPLTGEHKTIVSPFDTTQTVGQVAFADKAAIEQAVSSAHAAFGSWTRTPVEVRASALQKLADLLEENREELIALCTREAGKSIQDGIDEVREAVDFCRYYAVQAKKLMSKPELLPGPTGELNELFLQGRGVFVCISPWNFPLAIFLGQVSAALAAGNTVVAKPAEQTSIIGYRAVQLAHQAGIPTDVLQYLPGTGATVGNALTADERIGGVCFTGSTGTAKLINRTLANREGAIIPLIAETGGQNAMVVDSTSQPEQVVNDVVSSSFTSAGQRCSALRVLFLQEDIADRVIDVLQGAMDELVIGNPSSIKTDVGPVIDATAKANLDAHIDHIKQVGKLIKQMSLPAGTENGHFVAPTAVEIDSIKVLEKEHFGPILHVIRYKASELAHVIDEINSTGFGLTLGIHSRNEGHALEVADKVNVGNVYINRNQIGAVVGVQPFGGQGLSGTGPKAGGPHYLTRFVTEKTRTNNITAIGGNATLLSLGDSDA

SEQ ID NO: 12612 - DNA, 1455 bp, Oceanobacillus iheyensis
  CDS (1)..(1455)
atggctgaattgaaagcgataacaacatatcaaatgtacattaacggagagtttgtcaatgctagtaacaatgaaacacttgaggttacaaatcctgcaacagaggaaatagtttcaacagttccaaaagctagcttagaagatactagaagagcaatcgatggttctgcaaaagcgcaaaaagactgggcaaaccttccttcaagtaaacgagcatcttatctattcgcaataagtaaagagattcgatcaaacattgatgaatatgcaaagattatttctgaggaaatgggaaaaccgcttgatcaagctgttgtagaagttagtgttactgctgactactttgaatatattgctggttgggcaagaaaatatgaaggtgaaatcgtaccaagtgacagagaaaaagaaaacatccttgtattcaaacaaccaattggtgttgtagccggtatattaccttggaattttccgttcttcttaattgcacgaaaagctgcacctgctatattaactggaaatactatagtgctcaaaccaagtagtgtttctcctaataatgcgttagcttttgctaagattttagataaagtcggattaccaaaaggtgttattaatatagttactggtgcaggtagcattgttggtgaagaattatctaaaaacgaaaaaatcggaatgatcagcttaacaggaagcacagaggctggatcaagagtaatggagaaagcatcgaaaaacatcacaaaagtgtctcttgagttaggaggcaaagcgccttcgattgtgatggaagatgcagatattgacttggctgtaaaatccgttcttgattctcgaatcatcaatacaggacaggtttgtaactgtacagaaagagtttatgtacatgaagatgtagctgatgaatttattgaaaaaatcacaaaagcaatgtccaatgttagttatggaaatcctcttggaaatgaacaaatcgatatgggaccactttcaaatgaagcaggtcttaaaaatgtagaagatatggttaagcgcgcagtagaaaatggagcaactgtattaacaggtggaaaccgagtgaacacagaggctggatactattatgaacctactgtactatcaaatgtcgataatagctttgaaattatgaaagaagaagtgttcgggcctgtattacctattgctacttttacttcattggatgaagcaatcgaattagcaaatgactgccaatatggattaacatctgctatttttacaaataacgtgaattacatgatgcgcgctagtaatgaattagaattcggagaaacctatgttaatagagaaagcttcgaagcaattcaaggattccatgctggttggaaaaaatcaggaattggcggagcagacggaaaacatgggttaggagaatttctacaaactcatgttgtctacattcaatataaataa

SEQ ID NO: 12613 - protein, 484 aa, Oceanobacillus iheyensis
MAELKAITTYQMYINGEFVNASNNETLEVTNPATEEIVSTVPKASLEDTRRAIDGSAKAQKDWANLPSSKRASYLFAISKEIRSNIDEYAKIISEEMGKPLDQAVVEVSVTADYFEYIAGWARKYEGEIVPSDREKENILVFKQPIGVVAGILPWNFPFFLIARKAAPAILTGNTIVLKPSSVSPNNALAFAKILDKVGLPKGVINIVTGAGSIVGEELSKNEKIGMISLTGSTEAGSRVMEKASKNITKVSLELGGKAPSIVMEDADIDLAVKSVLDSRIINTGQVCNCTERVYVHEDVADEFIEKITKAMSNVSYGNPLGNEQIDMGPLSNEAGLKNVEDMVKRAVENGATVLTGGNRVNTEAGYYYEPTVLSNVDNSFEIMKEEVFGPVLPIATFTSLDEAIELANDCQYGLTSAIFTNNVNYMMRASNELEFGETYVNRESFEAIQGFHAGWKKSGIGGADGKHGLGEFLQTHVVYIQYK

SEQ ID NO: 12614 - DNA, 4029 bp, Escherichia coli O6
  CDS (1)..(4029)
atgcaacatcatagatatttcacgataacgttaagttgcacctttcagaacaacaggagtaatggcatgggaaccaccaccatgggggttaagctggacgacgcgacgcgtgagcgtattaagtctgccgcgacacgtatcgatcgcacaccacactggttaattaaacaggcgattttttcttatcttgaacaactggaaaacagcgatactctcccggagctaccagcgctgctttctggcgcggccaatgagagcgatgaagcaccgactccggcagaggaaccacaccagcctttcctcgactttgccgagcaaatattgccccagtcggtttcccgcgccgccatcaccgccgcctatcgccgcccggaaaccgaagcggtttctatgctgctggaacaagctcgcctgccgcagccagtagctgaacaggcgcacaaactggcgtatcaactggccgataaactgcgtaatcaaaaaaacgccagtggtcgcgcaggtatggttcaggggttattgcaggagttttcgttgtcatcgcaggaaggcgtggcgctgatgtgtctggcggaagcgttgttgcgtattcccgacaaagccacccgtgacgcgttaattcgcgacaaaatcagtaacggtaactggcagtcacacattggtcgtagcccgtccctgtttgttaatgccgctacctgggggctgctgtttaccggcaaactggtttccacccataacgaagccagcctctcccgctcgctgaaccgcattatcggtaagagcggtgaaccgctgatccgcaaaggtgtggatatggcgatgcgcctgatgggcgagcagttcgtcacgggcgaaaccatcgcggaagcgttagccaatgcccgcaaactggaagagaaaggtttccgttactcttacgatatgctgggcgaagccgcactgactgccgcagatgcacaagcgtatatggtttcctatcagcaggcgattcacgccattggtaaagcgtctaacggtcgtggcatctatgaaggtccgggcatttcaatcaagctgtcggcgctacatccgcgttatagccgcgcccagtatgaccgggtaatggaagagctttacccgcgtctgaaatcactcaccctgctggcgcgtcagtacgatattggtattaacatcgatgccgaagaggccgatcgtctggagatctccctcgatctgctggaaaaactctgtttcgagcctgaactggcaggctggaacggcatcggttttgttattcaggcttatcaaaaacgctgcccgttggtgatcgattacctgattgatctcgccacccgcagccgtcgccgtctgatgattcgcctggtgaaaggcgcgtactgggatagtgaaatcaagcgtgcacagatggacggccttgaaggttatccggtttatacccgcaaggtgtataccgacgtttcttatcttgcctgtgcgaaaaaactgctggcggtgccaaatctaatctacccgcagttcgcgacgcacaacgcccatacgctggcggcaatttatcaactggcgggtcaaaactactacccgggtcagtacgagttccagtgcctgcatggtatgggcgagccactgtatgagcaggtcaccgggaaagttgccgacggcaaacttaaccgtccgtgtcgtatttatgctccggtcggtacacatgaaacgctgctggcatatctggtgcgccgcctgctggaaaacggtgctaacacctcgtttgttaaccgtattgccgacacctctttgccactggatgaactggtcgccgatccagtcactgctgtagaaaaactggcgcaacaggaagggcaaactggattaccgcatccgaaaattcccctgccgcgcgatctttacggtcacgggcgcgacaactcggcagggctggatctcgctaacgaacaccgtctggcctcgctctcttcagccctgctcaatagtgcactgcaaaaatggcagtccttgccaatgctggaacaaccggtcgcggctggtgagatgtcgcccgttattaaccctgcggaaccgaaagatattgtgggctatgtgcgtgaagccacgccgcgtgaagtagaacaggcgctggaaagtgcggttaataacgcgccaatctggtttgccactcctccggctgaacgcgcggcgattttgcatcgcgctgccgtgctaatggaaagccagatgcagcaactgattggtattctggtgcgtgaagccggaaaaaccttcagtaacgccattgccgaagtgcgcgaagcggtcgattttctccactactatgccggacaggtgcgggatgatttcgctaacgaaacccaccgtccattagggcctgtggtatgtatcagtccgtggaacttcccgctggctattttcaccggacagatcgctgccgcactggcggcaggtaacagcgtgctggcaaaaccggcagaacaaacgccgctgattgccgcgcaagggatcgccattttgctggaagcgggtgtaccgccaggcgtggtgcaattgctgccaggtcggggtgaaaccgtgggcgcgcaactgacgggtgatgatcgcgtgcgcggggtgatgtttaccggttcaaccgaagtcgctacgttactgcagcgcaatatcgccagccgcctggacgctcagggtcgccctattccgctcatcgctgaaaccggcggcatgaacgcgatgattgtcgattcttcagcactgaccgaacaagtcgtaatagatgtgctggcctcggcgtttgacagtgcaggtcagcgttgttcggcactgcgcgtgctgtgcctgcaagatgagattgccgaccacacgctgaaaatgctgcgcggcgcaatggccgaatgccggatgggtaatccgggtcgcctgaccaccgatatcggtccggtgattgatagcgaagcgaaagccaatatcgagcgtcatattcagaccatgcgtagtaaaggccgtcaggtgttccaggcggtgcgggaaaacagcgaagatgcccgtgaatggcaaagcggcacctttgtcgctccgacgctgatcgaactggatgactttgccgaattacaaaaagaggtctttggtccggtgctgcatgtggtgcgttacaaccgtaaccagctcccagagctgatcgagcagattaacgcttccggctatggtctgacgcttggcgttcatacgcgtattgatgaaaccattgcccaggtcactggctcggcccaggtcggtaatctgtacgttaaccgtaatatggtgggcgcggtggttggggtgcaaccgttcggcggcgaagggttgtctggcaccgggccgaaagcaggcggtccgctctatctctaccgtctgctggcgaatcgcccggaaagtgcactggcagtgacgctcgcgcgtcaggatgcggagtatccggtcgatgcgcagttgaaagccgcattgactcagccgctaaatgcactgcgggaatgggcggcaaaccgtccagaattgcaggcgttatgtacgcaatatggcgagttggcgcaggcaggaacacaacgattgttgccagggccgacgggtgaacgcaacacctggacgctgctgccgcgtgagcgcgtgttgtgtattgcggatgatgaacaggatgcgctgactcagctcgccgccgtgctggcagtgggtagccagatgctgtggccggatgatgcgctacatcgtcagttagtgaaggcattgccatcggcagtcagcgaacgtattcaactggcgaaagcggaaaatataaccgctcaaccatttgatgcggtgatcttccacggtgattcggatcagcttcgcgcattgtgtgaagccgttgccgcgcgggatggtgcaattgtttcggtgcagggttttgcccgtggcgaaagcaatatccttctggaacggctgtatatcgagcgttcgctgagtgtgaataccgctgctgctggcggtaacgccagtttaatgacgatcggttaa

SEQ ID NO: 12615 - protein, 1342 aa, Escherichia coli O6
MQHHRYFTITLSCTFQNNRSNGMGTTTMGVKLDDATRERIKSAATRIDRTPHWLIKQAIFSYLEQLENSDTLPELPALLSGAANESDEAPTPAEEPHQPFLDFAEQILPQSVSRAAITAAYRRPETEAVSMLLEQARLPQPVAEQAHKLAYQLADKLRNQKNASGRAGMVQGLLQEFSLSSQEGVALMCLAEALLRIPDKATRDALIRDKISNGNWQSHIGRSPSLFVNAATWGLLFTGKLVSTHNEASLSRSLNRIIGKSGEPLIRKGVDMAMRLMGEQFVTGETIAEALANARKLEEKGFRYSYDMLGEAALTAADAQAYMVSYQQAIHAIGKASNGRGIYEGPGISIKLSALHPRYSRAQYDRVMEELYPRLKSLTLLARQYDIGINIDAEEADRLEISLDLLEKLCFEPELAGWNGIGFVIQAYQKRCPLVIDYLIDLATRSRRRLMIRLVKGAYWDSEIKRAQMDGLEGYPVYTRKVYTDVSYLACAKKLLAVPNLIYPQFATHNAHTLAAIYQLAGQNYYPGQYEFQCLHGMGEPLYEQVTGKVADGKLNRPCRIYAPVGTHETLLAYLVRRLLENGANTSFVNRIADTSLPLDELVADPVTAVEKLAQQEGQTGLPHPKIPLPRDLYGHGRDNSAGLDLANEHRLASLSSALLNSALQKWQSLPMLEQPVAAGEMSPVINPAEPKDIVGYVREATPREVEQALESAVNNAPIWFATPPAERAAILHRAAVLMESQMQQLIGILVREAGKTFSNAIAEVREAVDFLHYYAGQVRDDFANETHRPLGPVVCISPWNFPLAIFTGQIAAALAAGNSVLAKPAEQTPLIAAQGIAILLEAGVPPGVVQLLPGRGETVGAQLTGDDRVRGVMFTGSTEVATLLQRNIASRLDAQGRPIPLIAETGGMNAMIVDSSALTEQVVIDVLASAFDSAGQRCSALRVLCLQDEIADHTLKMLRGAMAECRMGNPGRLTTDIGPVIDSEAKANIERHIQTMRSKGRQVFQAVRENSEDAREWQSGTFVAPTLIELDDFAELQKEVFGPVLHVVRYNRNQLPELIEQINASGYGLTLGVHTRIDETIAQVTGSAQVGNLYVNRNMVGAVVGVQPFGGEGLSGTGPKAGGPLYLYRLLANRPESALAVTLARQDAEYPVDAQLKAALTQPLNALREWAANRPELQALCTQYGELAQAGTQRLLPGPTGERNTWTLLPRERVLCIADDEQDALTQLAAVLAVGSQMLWPDDALHRQLVKALPSAVSERIQLAKAENITAQPFDAVIFHGDSDQLRALCEAVAARDGAIVSVQGFARGESNILLERLYIERSLSVNTAAAGGNASLMTIG

SEQ ID NO: 12616 - DNA, 1623 bp, Corynebacterium efficiens
  CDS (1)..(1623)
atgggagtattccccgggggtttttgcatgcctgctggaattccgccaatctcccgctggcacccaaggactatcaaccccggcgcgcccgtgcccgtagcctggtggggacaatctcacctctctcggaaggacacacccatgactgatccgcttgatgtctctgcactcctgaccaaggtccccaccggtctgctcatcggcgacacctggcgggactcctccgacgggtccacctacaccgtggacaaccccgccaccggccagaccatcgccaccctcgcatcggccaccagcgacgatgccctcgccgcactcgatgccgcctgcgaggtccagtccagctgggccaggacccccgcccgggaacgctcggagatcctgcgccgcgccttcgacctgatcaatgaacgtgccgaggaattcgccaccctcatgaccctggagatgggcaaaccgatcgccgaggcccgtggtgaggttacctacggcaatgagttcatgcgctggttctccgaggaggccgtgcgcacctacggccgccacggccagacacccgagggcacccaccgcatgctcaccgtgcgcaaaccggtcggcccctgcctactgatcaccccgtggaacttccccctggccatggccacccgcaaggtcgcccccgcgatcgccgccggctgcaccatggtgctcaagcccgcacgcctgaccccgttgaccgcccagtactttgcgcagaccatgctcgatgccggccttcccgcaggtgtgctcaatgtggtgtccggggcatcggccagcgcgatctccaaccccatcatggaggacgatcgcctgcgcaaggtctccttcaccggttccaccccggtgggcaaacaactgctgaagaaggctgccgacaaggtcctgcgcacctccatggagctcggtggcaacgccccgttcatcatcttcgaggatgccgacctggatctggccgtcgagggtgccatgggggcgaagatgcgcaacatcggtgaggcctgcaccgccgccaaccgcttcctggtccacgactccatcgcccaggacttcagccgccgactggctgagcgtttcaaccaactcacactcggcaacggcctcgacgacggtgtcaccgtcggtcccctggtcgaggcgaaggcacgcgagaacgtcgcaaagcttgtcgacgacgccgtcaccgagggcgccaccgtgctcaccgggggcaccgccggcgagggggagggctacttctaccagcccaccgtgctggtcgatgtcgcgcccggcgcgcggatcctcaccgaggagatcttcgggccggtcgcaccgatcatcacgttcaccaccgaggaggaggccatccagctggccaatgacaccgaatacggactggcctcctacctgttcacccgtgattatgcccggatgttccggatctccgaccagttggagttcggtctgctcggtttcaactcaggggtgatctccaatgccgcggccccgttcggtggcgtcaagcagtccggcatcggccgggagggtggtaccgagggcatcgatgagtacacgcaactgcagtacatcggcatccgcgacccctacacggatcgctga

SEQ ID NO: 12617 - protein, 540 aa, Corynebacterium efficiens
MGVFPGGFCMPAGIPPISRWHPRTINPGAPVPVAWWGQSHLSRKDTPMTDPLDVSALLTKVPTGLLIGDTWRDSSDGSTYTVDNPATGQTIATLASATSDDALAALDAACEVQSSWARTPARERSEILRRAFDLINERAEEFATLMTLEMGKPIAEARGEVTYGNEFMRWFSEEAVRTYGRHGQTPEGTHRMLTVRKPVGPCLLITPWNFPLAMATRKVAPAIAAGCTMVLKPARLTPLTAQYFAQTMLDAGLPAGVLNVVSGASASAISNPIMEDDRLRKVSFTGSTPVGKQLLKKAADKVLRTSMELGGNAPFIIFEDADLDLAVEGAMGAKMRNIGEACTAANRFLVHDSIAQDFSRRLAERFNQLTLGNGLDDGVTVGPLVEAKARENVAKLVDDAVTEGATVLTGGTAGEGEGYFYQPTVLVDVAPGARILTEEIFGPVAPIITFTTEEEAIQLANDTEYGLASYLFTRDYARMFRISDQLEFGLLGFNSGVISNAAAPFGGVKQSGIGREGGTEGIDEYTQLQYIGIRDPYTDR

SEQ ID NO: 12618 - DNA, 2159 bp, Sorghum bicolor
  CDS (223)..(1866)
agagagagagaggcacccggcagccattactcgtcctcactcccacaccaacaacctccatccagtgcctgccgcagccgcttctgctgcagcggggacgcgtgcaagtacaggaggatatccgcttccattactgcgctgcgccgcggcggaaacagcagcagcagaggggttcttcgattcggggggttcggccggcgggcgcaataaattttgcccgggatggctcggagggccgcgtcctcgctcgtctcccgctgcctcttggccagggcctctgcccccgccgcgccacccgctgtcccctctgcgctgcgcaggccagatgggatgcgcggactgttgccaggcgtccttcagaggttcagcactgcagcagcagtagaggagcccatcacgccctcagtccaagtgaactatacaaagctcctcattaatggcaactttgttgatgctgcatccggcaagaccttcccaactctggaccctcgtacaggggaggtgattgctcatgtggctgagggtgatgcagaggacattaaccgtgcagtagctgctgcccgcaaggcttttgatgaagggccatggccgaagatgactgcctatgagaggtcccgtatcctactgcggtttgctgatttgattgagaagcacaatgatgagcttgctgctttggagacgtgggacaacggaaagccatatgagcaagcagcccatattgaagtaccaatggtggcccgtcttatgcgttactatgctggttgggctgataagatccatgggctcgttgtgccagctgatggcccacaccatgtacagatcttgcatgagccaatcggtgttgcaggtcagatcatcccatggaacttccctcttctgatgtttgcctggaaagttggccctgctttggcatgtggaaacactctcgtgctcaagactgctgagcaaactcctctatcggctttgtatatctccaagctgttgcatgaggctggactacctgagggtgttgtgaatgtcgtttctggttttggccctactgctggtgctgctcttgctagtcacatggatgttgataagcttgcatttacgggatctaccgataccggcaaagttgttcttgagttggctgcaaggagcaaccttaagacagtgacactggagttaggaggcaagtctccttttatcatcatggatgatgctgacattgaccatgctgttgagcttgcgcactttgccctgttctttaaccaggggcaatgctgttgtgctggatctcgcacatttgtacatgagcgtgtttatgatgagtttgtggagaaagccaaggctcgtgcattgaagcgcgtcgttggtgatccattcaggaaaggtgttgaacagggcccgcagattgacgacgagcaattcaacaagatcttgcgctacattaggtctggtgttgacagtggagctaaccttgtgacgggtggtgataggttgggtgagaaaggttactacatccagccaacgattttctcagatgtccaggatggcatgaagattgctcaggaggagatatttgggcctgttcagtcaatcctcaagttcaaggatctcaatgaggttattaagagggcaaatgcgagcccatatggattggccgctggtgtgttcaccaatagcttggacacagccaacaccctgacgcgtgcgctcagggctgggaccgtctggattaactgcttcgacatcttcgatgctgcaattccctttggtgggtacaagatgagcggcattgggagggagaagggcattgacagcctgaagaactacctgcaagtgaaggcagtcgtcacccctatcaagaacgccgcgtggttgtagatgctgcaagtatggccttctggataagaactacggatattcatttcctcatcacatcccgcacaataatatgaaggcgataatcagttagatgacgatgaagaacgaacagctataataagatttgccctttggttgtcagttatatctctaataagccttttggttggtgccatattgtgcaatttggctgcaccctttttcttttggataagactatattgtagcaacggattttgcagagttcattatgaaaaaacatttgttagaagagcaaaaaaaaaaaaaaaaaa

SEQ ID NO: 12619 - protein, 547 aa, Sorghum bicolor
MARRAASSLVSRCLLARASAPAAPPAVPSALRRPDGMRGLLPGVLQRFSTAAAVEEPITPSVQVNYTKLLINGNFVDAASGKTFPTLDPRTGEVIAHVAEGDAEDINRAVAAARKAFDEGPWPKMTAYERSRILLRFADLIEKHNDELAALETWDNGKPYEQAAHIEVPMVARLMRYYAGWADKIHGLVVPADGPHHVQILHEPIGVAGQIIPWNFPLLMFAWKVGPALACGNTLVLKTAEQTPLSALYISKLLHEAGLPEGVVNVVSGFGPTAGAALASHMDVDKLAFTGSTDTGKVVLELAARSNLKTVTLELGGKSPFIIMDDADIDHAVELAHFALFFNQGQCCCAGSRTFVHERVYDEFVEKAKARALKRVVGDPFRKGVEQGPQIDDEQFNKILRYIRSGVDSGANLVTGGDRLGEKGYYIQPTIFSDVQDGMKIAQEEIFGPVQSILKFKDLNEVIKRANASPYGLAAGVFTNSLDTANTLTRALRAGTVWINCFDIFDAAIPFGGYKMSGIGREKGIDSLKNYLQVKAVVTPIKNAAWL

SEQ ID NO: 12620 - DNA, 3201 bp, Xanthomonas campestris
  CDS (1)..(3201)
atgaacgcccagccagacacgtttgcttcttcccacctcgcgcgcccgctgttggcgcccgaactgcccgccgcgcccggcgccttgcgtgccgccatcaccgctgcctggctcaaggacgaaaccgagcacgtccgtgaattgctggagcaggcgcgcctgccggccgcagagcaggccaaggtgcaggcgctggccgccgacctggtcacccgggtgcgcgcacgtgcccaggatcagggcgcgatcgaagccttcatgcgccaatacgatctgggcagcgaagaaggcgtgctgctgatgtgcgtggccgaagccttgctgcgcattcccgaccaggacaccgccgacaagctgatccgcgacaagctgggcgaggcggactggaaaaagcacgtgggtggcagtgattcggtgctggtcaacgcatccacctggggcttgatgctcaccggcaagctggtgcagctcaacgaccttacccgcgccgatgtgccgggcgccttcaaacggctgatcggccgcgtcggcgagccggtgatccgtttggccgtgcgccaggcgatgaagatcatgggccaccagttcgtcatgggccgcaccatcggcgaggcgctggcgcgttcgcgcaagggtgacaacgccaattaccgctattcgttcgacatgctcggcgaaggcgcgctcaccatgaaggatgcgcagcgctatctgcaggcgtatcgcgatgccatccacgcgattggccgcagtggtagtttcgtgggcacagacgtgttcgccgcgcccagcatttcgatcaagttgtccgcgctgtatccgcgctacgaacacgccaagcgcgcacgcgtgatggccgagctggttcccggcgtgctggagctggcacaactggccaagtcctacggcatcggctacaccgtcgatgccgaagaggccgaccgcctggagctgtcgctggacatcatcgaagccacgttctccgatccatcgctggatggttgggagggctacgggctcgcagtgcaggcgtatcagaagcgcacgccctacacgatcgatttccttgccgatctggcgcgtcgcgttggccgccgcattccggtgcgtctggtcaagggcgcgtattgggacgctgagatcaagcgtgcgcagatcgacggccaccccgggtatccggtgtttacccgcaagcagaacaccgacgtgtcctatctggcctgcgcacgccgcatgttcgcgcacagcgacgcgctgtacccgatgttcgccacccacaacgcacagaccatcgctgcggtgcgcgcgatctcggcaggaaagacctacgagcaccagaaactgcacggcatgggcgatgacctgtatgccgaggtgattccggccgatcggctgggattgccgtgccgggtgtatgcgccggtcggctcgcacgaagacctgttgccgtacctggtccgtcgcttactggaaaacggcgccaactccagcttcgtcaatcgcatcaccgacgaagacgtcgccatcgaagacctgatccgcgatccggtcgaggcggtgtcctcgtttgcgtccatcccgcaccccaagatcccgctgccggccgacctgctgcgcagccagaaccagaacaggaagaattccatgggcgccaacctcgccaacgataacgatctgcggcagctggccgaccaactcaccgccgcaatcaagccgtggaaggccgcgccgctggtgccgggtgccgtgatcaccacgccaagcgaggccgtgttcaacccggccgaccgccgcgagacagtcggtcactggcagcccgcggacccagccaccgtgcagaaggcattggcgtctgccgccgccgctcagccagcctggaatcgcacgcccgccgccagccgcgccaccatcctcgaacacgccgcagacctgctcgaggcccgcatgccggagttcatggcgatctgcgtcaaggaagcaggcaagaccctgccggacgccgtggccgaggtacgcgaagccgtggacttcctgcgctattacgctgcccaggcgcgtgcgcagtttggtgcgcctgagcgcctgccgggccccaccggcgaatccaacgagctgcaactgcatggccgcggcgtgttcgtctgcatcagcccctggaacttcccgctggcgatcttcctgggccaagtggctgcggcgctggcggcaggcaataccgtcatcgccaagccggccgagcagaccaacctggtgggctttgcggcggtcaaactgttgcatgaagccggcgtgccggaagccgctgtgcagttcctgcccggcgatggcgccacggtcggcgccgcgttgaccaacgacccccgcgttgccggcgtcgccttcaccggctccaccgataccgcccgcatcatcaatcgcacgctcgccgcgcgtgacgccgcgattggcgtactgatcgccgagaccggcggccagaatgccttcatcgccgattcgtcctcgctcccggaagccgtagtcaaggacgccatctccagcgccttcatctctgctggtcagcgctgctcggccgcccgcgtgctgttcgtacaggacgacatcgccgacaaggtcatgaccatgctcgccggcgcgatgggcgagctgaaaatcggcgacccggccctgctctccaccgacgttggtcccgtaatcgacgccgatgccctgaagatcctggaagaacacgcgagccgcatggacagcgaagcacgcctgatcggcacgaccacgctggacagcgccacggcacatggcagcttctttgctccacgtgcctacgaattgaagtccctggcgcagctgcagcgtgagattttcggccccgtgctgcacatcattcgctggaaagccgaccagctggattcggtcatcgatcagatcaacgccaccggctatggcctcaccctgggcgtgcattcgcggatcgatgagaccatcgatcgcatcacctcgcgcgtggccgtaggcaatgtctacgtcaatcgcaaccagatcggcgctgtggtcggcgtgcagccgttcggtggccagggattgtcaggcaccggcccgaaggccggcggtcctcactacctgctgcgctttgccaccgaaaaggtcgtcaccgtgaacaccaccgcagccggcggcaatgcttcgctgctgaccttgggtgactga

SEQ ID NO: 12621 - protein, 1066 aa, Xanthomonas campestris
MNAQPDTFASSHLARPLLAPELPAAPGALRAAITAAWLKDETEHVRELLEQARLPAAEQAKVQALAADLVTRVRARAQDQGAIEAFMRQYDLGSEEGVLLMCVAEALLRIPDQDTADKLIRDKLGEADWKKHVGGSDSVLVNASTWGLMLTGKLVQLNDLTRADVPGAFKRLIGRVGEPVIRLAVRQAMKIMGHQFVMGRTIGEALARSRKGDNANYRYSFDMLGEGALTMKDAQRYLQAYRDAIHAIGRSGSFVGTDVFAAPSISIKLSALYPRYEHAKRARVMAELVPGVLELAQLAKSYGIGYTVDAEEADRLELSLDIIEATFSDPSLDGWEGYGLAVQAYQKRTPYTIDFLADLARRVGRRIPVRLVKGAYWDAEIKRAQIDGHPGYPVFTRKQNTDVSYLACARRMFAHSDALYPMFATHNAQTIAAVRAISAGKTYEHQKLHGMGDDLYAEVIPADRLGLPCRVYAPVGSHEDLLPYLVRRLLENGANSSFVNRITDEDVAIEDLIRDPVEAVSSFASIPHPKIPLPADLLRSQNQNRKNSMGANLANDNDLRQLADQLTAAIKPWKAAPLVPGAVITTPSEAVFNPADRRETVGHWQPADPATVQKALASAAAAQPAWNRTPAASRATILEHAADLLEARMPEFMAICVKEAGKTLPDAVAEVREAVDFLRYYAAQARAQFGAPERLPGPTGESNELQLHGRGVFVCISPWNFPLAIFLGQVAAALAAGNTVIAKPAEQTNLVGFAAVKLLHEAGVPEAAVQFLPGDGATVGAALTNDPRVAGVAFTGSTDTARIINRTLAARDAAIGVLIAETGGQNAFIADSSSLPEAVVKDAISSAFISAGQRCSAARVLFVQDDIADKVMTMLAGAMGELKIGDPALLSTDVGPVIDADALKILEEHASRMDSEARLIGTTTLDSATAHGSFFAPRAYELKSLAQLQREIFGPVLHIIRWKADQLDSVIDQINATGYGLTLGVHSRIDETIDRITSRVAVGNVYVNRNQIGAVVGVQPFGGQGLSGTGPKAGGPHYLLRFATEKVVTVNTTAAGGNASLLTLGD

SEQ ID NO: 12622 - DNA, 3201 bp, Xanthomonas axonopodis
  CDS (1)..(3201)
atgaacgctcagctcgacccgcttgcctccacctcagttgcgcgcccgctgctggcgcccgaactgcccgccgcacctggcgctttgcgtgccgccatcaccgcggcctggctcaaggacgaaaccgagcacgtgcgtgaattgctcgaccaggcacgcctgcctgtcgctgagcaagccaacgtgcaggcgatcgctgccgatctggttacccgtgtgcgggcgcgttcgcaggaccagggcgccatcgaagccttcatgcgccaatacgacctgggcagcgaagaaggcgtgctgctgatgtgcgtggccgaggcgctgttgcgcattcccgaccaggacactgccgacaagctgatccgcgacaagcttggcgatgcggattggaagaagcatatgggcggcagcgattcggtgctggtcaacgcttccacctggggcctgatgctgaccggtcagttggtgcagctcaacgacctcacccgcgccgatgtgccgggcgccttcaagcgcctgatcggccgcgtcggcgagccggtcattcgcctggccgtgcgccaggccatgaagatcatgggccatcagttcgtcatgggccgcaccatcggcgaggcgctgtcgcgttcgcgcaagggcgacaacgccaactaccgttattcgttcgacatgcttggcgaaggcgcgctcaccatgaaggatgcgcagcgctatctgcaggcgtatcgggatgcgattcatgcgatcggccgcagcggtagcttcgtcggtaccgatgtatttgccgcgcccagcatctcgatcaagttgtcggcgctgtatccgcgttacgagcatgccaagcgcgcccgcgtgatggcagagctggtgccgggcgtgctggaacttgcgcagttggccaagtcgtacggcatcggctacaccgtcgacgccgaagaagccgaccggctggaactgtcgctggacatcatcgaggccaccttctccgacccgtcattggatggctgggaaggctatggcctggccgtgcaggcctatcaaaaacgcacgccgtacacgatcgattttcttgccgatctggcgcgccgtgtcggacgacgtattccggtgcgcctggtcaaaggcgcgtactgggacgcagagatcaagcgcgcgcagatcgaagggcatcccggctacccggtgtttacgcgcaagcagaacaccgacgtgtcgtacctggcatgcgcacgtcgcatgttcgcgcacagcgacgcgctctacccgatgttcgccacgcacaacgcgcagaccattgcggcagtccgtgcgattgcggcaggcaagacctacgagcaccagaaactgcacggcatgggcgatgacctgtatgccgaagtgattcctgccgatcgtctcgatctgccatgccgcgtctatgcaccggtcggctcgcacgaagatctgctgccgtatctggtgcgccgtttgctcgaaaacggcgccaattccagcttcgtcaatcgcatcaccgacgaggatgtcgccatcgaagacctcatccgcgacccggtcgaggctgtgacgtcatttacttccatcccgcatcccaagattccactgccagccgatttgctgcgtagccagaaccagaacaggaaaaactccatgggcgccaatctcgccaacgacaacgatctgcgccagctggccgagcaactcaacgccgcgatcaaaccgtggaaggccacgcccctggtgcctggtgcgctgatcagcacgcccagccaagcggtgttgaatccggcagatcgccgcgagacggttggacagtggcacccggccgatccggacaccgtccagaagtcgctggccagcgctgtggccgcgcagccggcctggaaccgcacacctgcagcgagccgcgccactatcctggaacatgcagctgatctgctcgaaacgcgcatgtccgagttcatggcgatctgcgtcaaggaagccggcaagacgctgcccgacgcagtggccgaagtccgcgaggccgtcgatttcctgcgctattacgccggccaggcgcgtgcgcagttcggtgccccggagcgcctgcctggaccgaccggcgaatccaacgagctgcagctgcacgggcgtggcgtctttgtctgcatcagtccgtggaacttcccgttggcgatcttcctcggtcaggtcgccgcagcgctggcggccggcaacacggtcatcgccaaaccggccgagcagaccaacctgatcggctttgcagcggtcaagctgctgcacgaagccggcgtaccggaagcggctgtgcagttcctgccaggtgatggcgctaccgttggtgctgcgctgaccaacgacccgcgcgttgccggcgttgcattcaccggttctaccgaaaccgcacgcatcatcaaccgcaccctggccgcacgcgatgctgccatcggcgtcttgatcgccgaaaccggcggccagaacgccttcatcgctgactcgtcctcgctgcccgaagcggtggtcaaagacgccatttccagtgccttcatctcggccgggcagcgctgctccgcggcgcgcgtcctgttcgtccaggacgacatcgccgacaaggtcatgacgatgctggccggtgcgatgggtgagttgaagatcggcgatccgggcctgccatcgaccgacgttggccctgtcatcgatgccgatgccctcaagattctcgacgatcacgctgcacgcatggatcggcaagcgcgtctgatcggcagcaccgccctggacggtagcaccgcacacggcagctttttcgctccacgcgcctatgagctgacatcgctgtcccagctgcagcgtgaaatcttcgggccggtgctgcacgtgattcgctggaaagccgaccagctcgatgccgtcatcgagcagatcaacgcgaccggttacggcctcacgttgggtgtccattcgcgtatcgatgagacaatcgaccgcatcacctcgcgcgtggcggtaggcaacgtctacgtcaatcgcaaccagatcggcgccgtggtcggcgtacaaccgttcggcggccagggcctgtccggcaccggccccaaggccggcggcccgcattacctgctgcgtttcgcgaccgagaaggtcgtcaccgtcaacaccaccgcggcaggcggcaacgcctcgctattgaccttgggtgactaa

SEQ ID NO: 12623 - protein, 1066 aa, Xanthomonas axonopodis
MNAQLDPLASTSVARPLLAPELPAAPGALRAAITAAWLKDETEHVRELLDQARLPVAEQANVQAIAADLVTRVRARSQDQGAIEAFMRQYDLGSEEGVLLMCVAEALLRIPDQDTADKLIRDKLGDADWKKHMGGSDSVLVNASTWGLMLTGQLVQLNDLTRADVPGAFKRLIGRVGEPVIRLAVRQAMKIMGHQFVMGRTIGEALSRSRKGDNANYRYSFDMLGEGALTMKDAQRYLQAYRDAIHAIGRSGSFVGTDVFAAPSISIKLSALYPRYEHAKRARVMAELVPGVLELAQLAKSYGIGYTVDAEEADRLELSLDIIEATFSDPSLDGWEGYGLAVQAYQKRTPYTIDFLADLARRVGRRIPVRLVKGAYWDAEIKRAQIEGHPGYPVFTRKQNTDVSYLACARRMFAHSDALYPMFATHNAQTIAAVRAIAAGKTYEHQKLHGMGDDLYAEVIPADRLDLPCRVYAPVGSHEDLLPYLVRRLLENGANSSFVNRITDEDVAIEDLIRDPVEAVTSFTSIPHPKIPLPADLLRSQNQNRKNSMGANLANDNDLRQLAEQLNAAIKPWKATPLVPGALISTPSQAVLNPADRRETVGQWHPADPDTVQKSLASAVAAQPAWNRTPAASRATILEHAADLLETRMSEFMAICVKEAGKTLPDAVAEVREAVDFLRYYAGQARAQFGAPERLPGPTGESNELQLHGRGVFVCISPWNFPLAIFLGQVAAALAAGNTVIAKPAEQTNLIGFAAVKLLHEAGVPEAAVQFLPGDGATVGAALTNDPRVAGVAFTGSTETARIINRTLAARDAAIGVLIAETGGQNAFIADSSSLPEAVVKDAISSAFISAGQRCSAARVLFVQDDIADKVMTMLAGAMGELKIGDPGLPSTDVGPVIDADALKILDDHAARMDRQARLIGSTALDGSTAHGSFFAPRAYELTSLSQLQREIFGPVLHVIRWKADQLDAVIEQINATGYGLTLGVHSRIDETIDRITSRVAVGNVYVNRNQIGAVVGVQPFGGQGLSGTGPKAGGPHYLLRFATEKVVTVNTTAAGGNASLLTLGD

SEQ ID NO: 12624 - DNA, 1440 bp, Methanosarcina mazei
  CDS (1)..(1440)
atggtagccatgaaaatgcagattaatggaaaagcggcaggatcatgtggcggcgagtgctttgacgttagaaatcctgcaacatgcgaacttcttgagcaggtcccgagaggcacggaagaggatgttgcccttgcggtagaagccgctttatcagcttttgaaggctgggcttctatctctccacagcagagaggcatggttttttacagggctgccgggcttgtaaggcagaggaaggaggagcttgctgccctgctcacacaggaacaggggaagcctcttgcagaagccagaaacgaactggaaggcttctcgcatgtgcttgaatactactgcgggcttgcaggcagtttgaggggtgactttatccctgttacgggaaatggctattcttttaccgtaaaaaaacctctgggtgtctgtgcagccatcatcccctggaacatgcctgccctgattatggggtggaaaattgcacctgcccttatttcaggcaacacttttgtgctaaaacctgcaagcagcactcccctcacaaacctcaccctggcttctatcctgaatgaagccggtcttccagcaggagtcctgaacgttgtcacaggctctggagagattgcaggagaaagccttgtccgcagccctgatgtaagaaaaatttcttttacaggggaatccgggacaggaaaaaggatatccgagcttgcagccagcgggatgaaaagggttactcttgagctgggcggaagcgaccccatgattgtatgtgatgatgccaatctcgaaagtgcagttgcaggagccatcagggggagattttacaattgcggccagacctgtactgctgtcaaaaggctgtatgtttttgaatccgttgccagggagttcataagaaaactcgaagaaggagttaagagattaaaagtcggaaacggactggataaggatacggatatggggcctctcaataaccacagccagtttgaatacataaaagagctggtagcaggaattgaggagaagggtgaaggcagaataattgcagggggaaaagccccttcattcaaaggcatgggtaaaggatatttctttgagccgactctcgtttcagatgtccccggagattccaggctccttaaggaggaggtgttcggacctttgctgcccatagttacagtaaggaatctcgatgaggctatagaagaggcaaacaggagcatttatggtcttggagcatccatctggacaaaagacctggacaggataaggatgggatgcgagcagttgaatgcgggaattatatgggttaaccagcaccttaaggtagccccggaagttcctttcggaggagttaaagagagcgggtttggaagagaaaacgggcctgacatcctttccgaatacctcgaaaccaggaccataatgttaaaaacctga

SEQ ID NO: 12625 - protein, 479 aa, Methanosarcina mazei
MVAMKMQINGKAAGSCGGECFDVRNPATCELLEQVPRGTEEDVALAVEAALSAFEGWASISPQQRGMVFYRAAGLVRQRKEELAALLTQEQGKPLAEARNELEGFSHVLEYYCGLAGSLRGDFIPVTGNGYSFTVKKPLGVCAAIIPWNMPALIMGWKIAPALISGNTFVLKPASSTPLTNLTLASILNEAGLPAGVLNVVTGSGEIAGESLVRSPDVRKISFTGESGTGKRISELAASGMKRVTLELGGSDPMIVCDDANLESAVAGAIRGRFYNCGQTCTAVKRLYVFESVAREFIRKLEEGVKRLKVGNGLDKDTDMGPLNNHSQFEYIKELVAGIEEKGEGRIIAGGKAPSFKGMGKGYFFEPTLVSDVPGDSRLLKEEVFGPLLPIVTVRNLDEAIEEANRSIYGLGASIWTKDLDRIRMGCEQLNAGIIWVNQHLKVAPEVPFGGVKESGFGRENGPDILSEYLETRTIMLKT

SEQ ID NO: 12626 - DNA, 1479 bp, Methanosarcina mazei
  CDS (1)..(1479)
atgattcgggagtataagttactgataggtgggaagtcggtagactcatcaaccggagaaacttttgatgacatcaatccggctactcttgaaaaccttgccacgttacaggtcgcaggaatcgaagatgtggaccgggcagttgaggctgcagaggcagggttcagggtatggagtgaagttccggctcctggaagggctgaggtccttttcagggcagcgcgcataatgcaggagagaaaagaaggccttgccagactcatgacagaagagatgggaaaggtcctgcccgagaccaggggtgatgtacaggaagcaatagacattaccatttacgctgcaggggaaggcagaaggatgtttggggaaacaacgacctcagaactcagggacaagttctgcatgaccgtgctaaggcctgtaggagttgtgggcatgataacaccctggaactttcctattgcgattcccagctggaagatcatgccagcccttattgcagggaatgcgatcgtgttcaagcctgcaagcgatacgcccctgcttaccataaaacttgtagaaatcctgatggaggcgggcctgcctccaggagtcataaacatcgttcccggacctggaggaagtaccggaaaagcaatagtccagcacccccgaataagagcaatttcatttacaggaagccttgataccgggaaatggatcatggaagagtgtgcaaaatccatgaagcgggtctctttagagctgggtggaaaaaatcctgttattgtaatggatgatgcaaaccttgagcttgcccttgaaggcgtggtctggggagctttcgggacaacaggccagcgctgtacagctacgagcaggctgatccttcacgaaaaaataaaggatgaattcataaaaaggctgctcgcaaaaacaaagtctctcagggtgggaaacgggctcctgcctgaaacggacgtggggcctgtaattaataaagcccagcttgagaaaatagaaaagtacgtcaggataggaaaggaagaaggtgcagctatcctggttggagggaacaggatagatccgggtcttcccggttatttcttcgaaccgaccatatttacggatgtcagtcctgaaatgaggattgcacaggaagaaatcttcgggcccgtgctaagcataatcactgtttcggattttgacgaggctattgaggttgcaaataacatcaagtacggtctctcatctgcgatttatactgaaaatgttagaaccgctttcagggcaattgaaaaactggaagcaggaatcacatatgttaatgcccctactataggtgccgaagtccatcttcctttcgggggcataaaaggaaccgggaacggtttcagggaagctggaacagaggcgattaaagaattcaccgaggtaaaagccgtatatatagattacagcggcaggctacaaaaagcccagatagatacagaataa

SEQ ID NO: 12627 - protein, 492 aa, Methanosarcina mazei
MIREYKLLIGGKSVDSSTGETFDDINPATLENLATLQVAGIEDVDRAVEAAEAGFRVWSEVPAPGRAEVLFRAARIMQERKEGLARLMTEEMGKVLPETRGDVQEAIDITIYAAGEGRRMFGETTTSELRDKFCMTVLRPVGVVGMITPWNFPIAIPSWKIMPALIAGNAIVFKPASDTPLLTIKLVEILMEAGLPPGVINIVPGPGGSTGKAIVQHPRIRAISFTGSLDTGKWIMEECAKSMKRVSLELGGKNPVIVMDDANLELALEGVVWGAFGTTGQRCTATSRLILHEKIKDEFIKRLLAKTKSLRVGNGLLPETDVGPVINKAQLEKIEKYVRIGKEEGAAILVGGNRIDPGLPGYFFEPTIFTDVSPEMRIAQEEIFGPVLSIITVSDFDEAIEVANNIKYGLSSAIYTENVRTAFRAIEKLEAGITYVNAPTIGAEVHLPFGGIKGTGNGFREAGTEAIKEFTEVKAVYIDYSGRLQKAQIDTE

SEQ ID NO: 12628 - DNA, 1772 bp, Arabidopsis thaliana
  CDS (15)..(1619)
caaaaaagttagccatggcatcaagaagagtttcttcgctgctctctcgctctttcatgtcctcctcacgttctatcttctctcttagaggcatgaacagaggagctcaaagatacagtaacctcgctgctgctgtcgaaaacactattactccaccagtgaaagttgaacacacacagcttctaatcggtggaagattcgttgatgcagtgtcaggaaaaactttccctactttggatccaagaaatggagaagtgattgctcaagtgtctgaaggtgatgcagaagacgtgaaccgcgcggttgcagctgcacgaaaggcttttgatgaaggaccatggcctaaaatgacagcttatgagagatcaaagatactgtttcgtttcgctgatttaatcgagaaacataatgatgagattgctgctcttgagacttgggataatgggaaaccttatgaacaatctgctcaaattgaagtaccaatgcttgctagggtgttccggtactatgctggttgggcagacaagatacatggaatgacaatgccaggagatggtccacaccatgtgcagaccttacatgagcctataggagtcgctggacaaatcatcccatggaacttccctcttctcatgctttcttggaaacttggaccagctttagcttgcggtaacaccgttgttctcaaaactgctgagcaaactcctctatctgctcttcttgttgggaaactacttcatgaggctggacttcctgatggagttgtgaatatagtttctggatttggggctactgctggtgcagctatagctagtcacatggacgttgataaggttgctttcaccgggtctactgatgttgggaagattattcttgagttagcttcaaaaagcaaccttaaggcagtgactcttgagctggaggaaagtcaccattcatttgtatgtgaagatgctgatgtggatcaggccgttgagcttgcacatttcgctttgttctttaaccagggacaatgttgttgtgctggttcgcgtacatttgtacatgaacgtgtgtatgatgagtttgtagagaaagctaaagctcgtgcactcaagcgaaatgttggagatcccttcaagtcaggcattgagcaaggtccccaggtagactcagagcaattcaacaaaatcctgaagtacatcaaacatggagttgaggctggagccacattacaagctggaggtgacaggcttggttccaagggttactacattcaacctactgtcttctcagatgtgaaagatgacatgctcatagcaacagacgagattttcgggccggttcaaaccatactgaaattcaaggatcttgatgaggtgattgcaagggccaacaactcaaggtacggtttagctgctggagtgttcacacagaatcttgacacagcacaccggctgatgcgagcactcagagttgggactgtttggatcaactgttttgatgtacttgatgcatcaattccatttggagggtataagatgagtggcattggtagagagaaaggtatctacagtctcaacaattacttgcaagtcaaggctgttgttacttccctcaagaaccctgcctggctctaaaccataccaggtggttacacttatttctcgagtttggtttatgatttgcacttttgctttgaaaacctggagttgtactgtgtctctaggatttctagattttgagagtaatttatcttcaatacattttgcaataaagctacatgacaatgg

SEQ ID NO: 12629 - protein, 534 aa, Arabidopsis thaliana
MASRRVSSLLSRSFMSSSRSIFSLRGMNRGAQRYSNLAAAVENTITPPVKVEHTQLLIGGRFVDAVSGKTFPTLDPRNGEVIAQVSEGDAEDVNRAVAAARKAFDEGPWPKMTAYERSKILFRFADLIEKHNDEIAALETWDNGKPYEQSAQIEVPMLARVFRYYAGWADKIHGMTMPGDGPHHVQTLHEPIGVAGQIIPWNFPLLMLSWKLGPALACGNTVVLKTAEQTPLSALLVGKLLHEAGLPDGVVNIVSGFGATAGAAIASHMDVDKVAFTGSTDVGKIILELASKSNLKAVTLELEESHHSFVCEDADVDQAVELAHFALFFNQGQCCCAGSRTFVHERVYDEFVEKAKARALKRNVGDPFKSGIEQGPQVDSEQFNKILKYIKHGVEAGATLQAGGDRLGSKGYYIQPTVFSDVKDDMLIATDEIFGPVQTILKFKDLDEVIARANNSRYGLAAGVFTQNLDTAHRLMRALRVGTVWINCFDVLDASIPFGGYKMSGIGREKGIYSLNNYLQVKAVVTSLKNPAWL

SEQ ID NO: 12630 - DNA, 1901 bp, Zea mays
  CDS (111)..(1646)
gagacgagtcgagtgagggggcagaggccacaaaacagagagtacccaaacgatcgatctgtgcatctccccgtccgtcccgcaaccatctaattcagaagcagacatcaatggcgagcaacggctgcaacggcaacggcaacggcaacggcaacggcaaggcggctccggcgggtgtggtggtaccggagatcaagttcaccaagctcttcatcaacggcgagttcgtcgacgccgcctccggcaagacattcgataccagggacccacggaccggcgacgtgctggcccacgtagcagaggcagacaaagctgatgtggacctggcggtgaagtccgcccgggacgccttcgagcacggcaagtggccccgcatgtcaggctacgagcgcgggcggatcatgagcaagctggcggacctggtggagcagcacacggaggagctggcggcgctggacggtgccgacgccgggaagctgctgctgctgggcaagatcatcgacatccccgcggccacgcagatgctgcgctactacgccggcgccgccgacaagatccacggcgacgtcctgcgcgtctccggcaggtaccagggctacacgctcaaggagcctatcggcgtcgtgggcgtcatcatcccctggaacttccccaccatgatgttcttcctcaaggtcagcccggcgctcgccgcgggctgcaccgtcgtcgtcaagcccgccgagcagacgccgctttccgcgctctactacgcgcacctcgcaaagatggccggcgtccccgacggagtgatcaacgtcgtccccgggttcggccccaccgccggcgccgcgctcgcctcccacatggacgtcgacagcgtggccttcaccggctccacagaggtgggtcgcctcatcatggagtcggccgcgcggagcaacctcaagacggtctcgctggagctcggcggcaagtcgccgctcatcatcttcgacgacgccgacgtcgacatggccgttaacctgtcgaggcttgccgtcttcttcaacaagggagaggtttgcgtggcgggatcgcgcgtgtacgtgcaggaagggatctatgacgagttcgtcaagaaggccgtggaggccgcgcggagctggaaggttggagacccgttcgatgtcaccagcaacatgggccctcaggttgacaaggaccagtttgagagggtcctaaagtacattgagcatggcaagagcgagggagcgactctgctcaccggcggcaagcctgccgccgacaaagggtactacattgagcccaccatctttgtcgatgtcactgaggacatgaagatcgcgcaggaagagatcttcggccccgtcatgtccctcatgaagttcaagacggttgatgaggtgatcgagaaggccaactgcaccaggtacgggctcgccgccgggatcgtgaccaagagcctggacgtcgccaaccgggtgtcccggtcggtgcgcgccggcaccgtgtgggtgaactgctacttcgccttcgacccggacgcgcccttcggcgggtacaagatgagcggcttcggccgggaccaggggctggcagccatggacaagtacctgcaggtcaagagcgtcatcaccgcgctcccggactcgccatggtactgagttgagccagggaccgatggaaccccatcgatctcttcttgtgcagtgtacatgcgtcatgcgtgcgtgctcacacagctgggttgctgctttgtgcttgtgttcgtctctggtttgtggctcatgtgtgttagtctgcaccctatccttctgtacgtagctgccggacatgcaaatagtatgttaagtacaccatataaactcttgttttataaattcaagtttagcttggagccttcactcccttcagccttg

SEQ ID NO: 12631 - protein, 511 aa, Zea mays
MASNGCNGNGNGNGNGKAAPAGVVVPEIKFTKLFINGEFVDAASGKTFDTRDPRTGDVLAHVAEADKADVDLAVKSARDAFEHGKWPRMSGYERGRIMSKLADLVEQHTEELAALDGADAGKLLLLGKIIDIPAATQMLRYYAGAADKIHGDVLRVSGRYQGYTLKEPIGVVGVIIPWNFPTMMFFLKVSPALAAGCTVVVKPAEQTPLSALYYAHLAKMAGVPDGVINVVPGFGPTAGAALASHMDVDSVAFTGSTEVGRLIMESAARSNLKTVSLELGGKSPLIIFDDADVDMAVNLSRLAVFFNKGEVCVAGSRVYVQEGIYDEFVKKAVEAARSWKVGDPFDVTSNMGPQVDKDQFERVLKYIEHGKSEGATLLTGGKPAADKGYYIEPTIFVDVTEDMKIAQEEIFGPVMSLMKFKTVDEVIEKANCTRYGLAAGIVTKSLDVANRVSRSVRAGTVWVNCYFAFDPDAPFGGYKMSGFGRDQGLAAMDKYLQVKSVITALPDSPWY

SEQ ID NO: 12632 - DNA, 2372 bp, Drosophila melanogaster
  CDS (463)..(2307)
aggaaatcaaatcaaaagcttgagcccttgtcctcaggatatagaaagtatatgggaacttttaccgtctcgctgacatgaacgatctcggtgtgactaattagacggatggcagccagtccatagaagagcattgggcatacacctttttcgagttaccacggacctatgtagcataatccgtttactggacttacccaaattaatcaccttaaggaagcgaaagaacttgtcctccagccaaagatcctgcacctccctcttgctacagtggtacttcatatagggataacaggcggtgcgaagaatgtgatagttggttccgttttccagggtccaattaaagtgagacattcccctctgatcgttggccacatcgtgaaactagacttggagcatatttctcattagatctggtgaaaatattggggcggaaaaaggggagtcttaccttcacgaaatatgatgtccaaggtggctcatggcattgtttcaaatatgcggtcaatacttccgaggctcgaggcttcagtaaaaggcggcctcgtgtctgttagaagtaccagcaagagacccgagctatccgagcactttacgctggatgagatggtggccaacgagaagctgcttcagtatgacgagggctcaaaggaacgcacggaactggaaaccgccctgctgggcgttctcaatagggtagagcacgttcccatcgttattaacggccaggagttccaggccaaggaggacttccaacaggttctgccctacgacatccaacagcccattgcccattacggtcatgcccaccgcgtgctcatccaaatggccatcgataagagtgtggaggcgcaggtgaagtgggacaaggtcaggcttagtgatcgaattgatatttgggagcgggcagcgatgctaattgccggaagataccgctacaacatcattgcggccacgatgttgggccagggaaaaacgctgcgccaggcggagatggatgtagccgagctggtggactttatgcgcattaatcccgtcttcctgcgtgagctggccaactacgaacccattagagacatccaaaacaattgcaggaactccatgcggttgagaggactttcgggatttgtggctgccatcagtccgtttaactttacgggtatcgccgccaatctggcctatacgcctgccttaatgggcaactcggtgatctggaagccctctgactcggccatcctgtccaactatttcgttttcaaggccctgcgggaggctggagtgcccgatggtgtggtgaactttgtgcccgccgaggagacaacgtttgcatccgtagtgacgcaacatccgaaattggcggggattaacttcactggtacctcaacggtgctcaaggtgctctggcaactggtggcccagaatataaatttctatcagaactatccccgtttggtgggcgagggaggcggcaagaatttccacttcgtacactcctcggcggaaccggaaacggcggtggcctgcacgataagagctgcctttgagtacgccggccagaagtgctcctcctgttcgatgttgtacgttccggaatccctgtggcagaatcacatacgagaacctcttcttgagatcactgcatctctggtcgtgcgacaagatgccacgtattgcgatagtttttgctcggcggtgatcaaccgacgggcctacgatcgcatctacatgtggctaaggtacatcgaccagagtcccagttgccagatcctcgttggaggaagctgcgacaagcgacgtggctattacgtagatccaacggtggtactggtcaaggatctggacaatatcatatgtcgggaagagctactggcacccattctcggtgtctatgtctatccagaccataagctcaaggagactatggaaaaggtggcccagattaatcatggattgacaggttcggtgtttgcccaggatcagaacttcatcgaggaagcatacgatgccttcagagtcaatgtgggcaacttaaatgtgaatgacaagtccaccggattgatggtgggtcagcagccttttggtgcgggacacatgaccggcaccagtgataagttgggcactccccactccctgctgcgatggacatcgccccaggtgattaaagagtcctacaagacacacaggaatatcttttatccatatatgcaaataaatgatcaggagcagggcatagcacaaagtgatatggtctcccaggatgaatcctcctttgggcacttcaacagtgatggcaacaaggtggtgtaggacaagctgaaacctttgttttatgatcaaaatttctgtggcaataaatatgaaaattgtgtaat

SEQ ID NO: 12633 - protein, 614 aa, Drosophila melanogaster
MMSKVAHGIVSNMRSILPRLEASVKGGLVSVRSTSKRPELSEHFTLDEMVANEKLLQYDEGSKERTELETALLGVLNRVEHVPIVINGQEFQAKEDFQQVLPYDIQQPIAHYGHAHRVLIQMAIDKSVEAQVKWDKVRLSDRIDIWERAAMLIAGRYRYNIIAATMLGQGKTLRQAEMDVAELVDFMRINPVFLRELANYEPIRDIQNNCRNSMRLRGLSGFVAAISPFNFTGIAANLAYTPALMGNSVIWKPSDSAILSNYFVFKALREAGVPDGVVNFVPAEETTFASVVTQHPKLAGINFTGTSTVLKVLWQLVAQNINFYQNYPRLVGEGGGKNFHFVHSSAEPETAVACTIRAAFEYAGQKCSSCSMLYVPESLWQNHIREPLLEITASLVVRQDATYCDSFCSAVINRRAYDRIYMWLRYIDQSPSCQILVGGSCDKRRGYYVDPTVVLVKDLDNIICREELLAPILGVYVYPDHKLKETMEKVAQINHGLTGSVFAQDQNFIEEAYDAFRVNVGNLNVNDKSTGLMVGQQPFGAGHMTGTSDKLGTPHSLLRWTSPQVIKESYKTHRNIFYPYMQINDQEQGIAQSDMVSQDESSFGHFNSDGNKVV

SEQ ID NO: 12634 - DNA, 2705 bp, Drosophila melanogaster
  CDS (172)..(1896)
gaacgtgcttatcgataataaagtaaactgaaaataaatcagtcatccgctcggttgaccaactgcccaaatagcaaaattctaggtggtacgagccgacgacgacgaagaatctgagagaccgcttatataatccggcagcgaacgagacaggccccaaatcccgacaagatgttgcgaatgatgcgaagttcctcctccagatgctctagtcttcagcagagcttgttgaaaaattcgacacgctgtctgggttccgttataccggaccttaaactgaaggacttcccgatcgccaatgagccaatcctgggatatctcaaggactctaaggagcgtaaggccctcgagcaggctctaaagggcacggcctcgagttgcgaagacatccccatcgtgatcggcggcaaggagtacaagacgccggaggttcgataccaggtcatgccccatgaccaccaacacaagctggccagcttctactacgccgacaagaagcttatcgagaaggccatcaaaacggcggtggaaacacagcccaagtgggaccgtgtgtcgattgcagaccgtctgaagatctgggagaaggcagcggacctaatggcaacgacgtaccgccaggatctcaacgccgccaccatgctgggtcagtcaaagacggcgattcaggcggaaatcgattcagcagcggagcttatcgactttatacgaatgaatgcctattttctgaaggaggtcactaaataccagcccatcagcgagaacataaaggtcacgaagaactccttgcgctatcgtggcattgatggcttcatcgccgctgtcagcccctttaactttacggccatcggcggcaacttgtcctacacgccagctctgatgggaaacggcgtgctgtggaagccctcggacactgccatgctgtccaactggattattttcaagattatgcgcgaagcgggagtgcccgatggagtcgttaactttgtgcccgccgatgggcccgtgtttggagacacgattacggccagtccccacctggcaggcatcaatttcaccggctctgtgccaacctttaaccgcctgtggaagcaggtgggcaacaacattgacaactacgtgaactttcctcgcttgactggtgagtgtggcggcaagaatttccactttatacatgcatcagccgacgttgagtcagtggtgacctccacgatacgctcagcatttgagtactgcggccagaagtgttccgcctgctcgcgaatgtatgtgccggaatccctttggccacagatcaaggagggcctggtatgcgaggcagcaaagctgaagatcggtgacgttcaagacttcagcagcttcacgtcggctgtgattgatgacaaagcatttaaacgcattacgggctacattgagcatgccaaaaaatccccgaacctcgagattctcgccggaggcacttactcagacagcaagggctacttcgttaatccgaccattgtactcagcaaggatcccaaggaccggatcatgaccgaagagattttcggtcccgtgctatctatttatgtgtacaaggagtcggacctccttgagaccatgaaactggtgcacacctctaccaagtttgctttaaccggagcagtattcgggcaggacgaggatttcgtcaagtgcgctctgcaggagtttaaaatggccgctggaaacttctacatcaacgacaagtccactggatccgtggtgggccagcagccattcggaggcggccggatgtccggcaccaatgacaaggccggaggaccacattatattctgcgctggacctctccgcagtccatcaaggagacctttgtgccgctgcgggacgtcaactatccatacatgtgcgagtaagctggccgacagaagatgcgcaaggggaatgggatgagcaaaagtagtgaaaaccagacaggaatctcatataactactaactatataaacatacttaaatgtattttgttgaaatacttttaaacatctccaacacccaaagacctgccccgtaaccctacatacctagttcagatagcttcgatttgtatacacacacactctaagaatctcaaaacaacccatgagaatgcctcgaaagtttgtaaattgatatgctgataccttcgaactacaaacacaccatgacatggatattttaaatgaatactatgtaatatcattattttacgatttaaacgcaatgtgattatttaattatatatgatttataattaaatggcccgccttatgttttattcgttatcgaaattgcttgaattggttgaaccgttttcaattataaaatacttaatgtacacacctatgtatgtgaaatcaaacgacaatacattctgaatactaaatgtgaaagatcatgaagagataaagtgaaacctagttacatgtaacgtaagcatcaaattcatattaataaatataacaaagaattaaaaataattatttgggttccgttttcaacatttcgtttaacccaaaatgctatccgcatcgattggggcagttcctttacccgtagaatttaaacttcaaaacttgatggtctgaagagaacatgcaaaggtttagtttcatttgattcaaatttgtaatcaaactacaaacaattctgttattaaaaaatacatgtaaaaaaaaaaaaaaaaaa

SEQ ID NO: 12635 - protein, 574 aa, Drosophila melanogaster
MLRMMRSSSSRCSSLQQSLLKNSTRCLGSVIPDLKLKDFPIANEPILGYLKDSKERKALEQALKGTASSCEDIPIVIGGKEYKTPEVRYQVMPHDHQHKLASFYYADKKLIEKAIKTAVETQPKWDRVSIADRLKIWEKAADLMATTYRQDLNAATMLGQSKTAIQAEIDSAAELIDFIRMNAYFLKEVTKYQPISENIKVTKNSLRYRGIDGFIAAVSPFNFTAIGGNLSYTPALMGNGVLWKPSDTAMLSNWIIFKIMREAGVPDGVVNFVPADGPVFGDTITASPHLAGINFTGSVPTFNRLWKQVGNNIDNYVNFPRLTGECGGKNFHFIHASADVESVVTSTIRSAFEYCGQKCSACSRMYVPESLWPQIKEGLVCEAAKLKIGDVQDFSSFTSAVIDDKAFKRITGYIEHAKKSPNLEILAGGTYSDSKGYFVNPTIVLSKDPKDRIMTEEIFGPVLSIYVYKESDLLETMKLVHTSTKFALTGAVFGQDEDFVKCALQEFKMAAGNFYINDKSTGSVVGQQPFGGGRMSGTNDKAGGPHYILRWTSPQSIKETFVPLRDVNYPYMCE

SEQ ID NO: 12636 - DNA, 3132 bp, Vibrio vulnificus
  CDS (1)..(3132)
atgtttacagcaacagatgtgttaaagccggagtttgtcgcgcagccgctcgataagctatgggcattgatctccccattgtatatggtggacgaatctcaatggctggagcagctcctgccactggcaaccccttcagcggaagagaagcaagcgatcgccagccgaacgactcagttaattgaagcgattcgcgccgacaagaagtcgattcaattgatcgatgcactgttgttggaatacagcctagacacgcacgaaggcatcttgctgatgtgtttggcagaagcgctgatgcgtattccggatgcggccacggctgacgctctgatcaaagataaaatgagcgtggcagattggaaatcgcatcttaaaaattccgaatctgtgtttgtcaacgcctcgacatggggcctcatgctgacaggtaaagtggtgggcttgggtgatgatgaaacgcaaagtgccagccaagcgctcaatcgcttagtgaacaagctttctgagccggtgatccgcaaagccatgtatcaggcgatgaagatcatgggccatcagttcgttcgtggccgcaccatcgaagaggcgcagaaaaatggccgcccaatgcgcgataaaggcttcacttactcttttgacatgctgggtgaagcggcgctgaccaccgcggatgccaataaatacttcaaagattatttgatggcgattgaggctgtgggccgtgaaacgtatggtaatgacaccagccctgcgccatcggtatcgatcaaactctctgccttgcatcctcgctatgaagtggccaatgaacaccgcgtgatgagcgagctgtttgacaccttggcacaactgctgaaacgcgctgtcgagctagacgttgcgattaccattgatgcggaagaagccgaccgcctagagctctctctcaaactgtttgaaaaactctaccgcagtgaaacggtcaaaggctggggtaagtttggcctggtggtgcaagcgtattccaaacgcgctctgccggtgttggtgtggctcaatgctctcgctaaagagcaaggcgatttgatcccgctgcgtttggtgaaaggcgcgtattgggacagcgaagtgaagtggtctcagcagcgtggttacgataactacccggtttacactcgcaaagaagccaccgatgtggcgtacttagcgtgtgctcgcttcctattaagcgatgacgtgcgcggcaacattttcccgcaatttgctagccataacgcgcaaaccgtttcctcgatcgccaccatggcgactcacagcgactatgagttccaacgtctgcatggcatgggcgattcactttataaccatgtgatggagcagtatcgtcagccagtacgaatttacgcgccagtgggcagccacaaagatttgctgccatacctagtgcgtcgtctgctggaaaacggtgccaacagctcgtttgtccaccgtttggtcgatgcgcgctgcccagtggcagagcttaccaaacacccagtagaagcgctgacctcatttgaaaccctgaacaataccaagatcccattgccagcggcgattttccctgagcgtaaaaactcctatggcgttaacgtggatatcgaaagtgaagccaagccgtttgaagcacaggtcgagtccttcttgagcaagcagtggttagctggcccgatcatcaacggcgcatcgctggccgaaagcatgatcaaggacggtcaagcggaaagtgtcacagcgccgtatgatcgtcgtatccaagtggggcaaattgcgtttgctaaccttgatcatgtttcccaagcgatcgatatcgcacaagcggcttttgctgattggaatcgcacaccgttggtggagaaagcgcgttgcctagacaacctcgctgacttgatggaagccaacttggctgagctggtggcactttgtcaccaagaagcgggcaagacactgcatgacagtattgatgaagtgcgtgaagcggtcgatttctgtcgttactacgccaaacaagcgcaaaatctgcaaccttttgagttagaaggctttgatggcgtgaaacgcattgccagccgtgaaggtttgggggtgttcgtctgtattagcccgtggaacttcccactggcgattttccttggtcaagtgaccgcagcgctcgtggcgggcaacacggtcgtagcgaaaccagcggaacaaaccagtttgatcgcggtacgtgcggtagaactcatgctacaagcgggtttcccagcgagtgttgttcaactgattcctggtcgtggtgcggatattggctcggcgctcacctctcacccatccattgcgggtgtggcgtttacgggctccaccgccacggcgcaacgcatcaacgtaactttggcacaacgtgaagccaaaccggtgccgtttatcgccgaaaccggtggtcaaaacgcgatgatcgtggacagtactgcgctgccagagcaggtggtgcgtgatgtgattcgttctgcctttgcttctgcaggtcaacgctgttcagcactgcgtgtgctgtttgttcagcaagacattgccgatcgagtgattggcttgatccaaggggcaatgaatgaactgagtgttggtgtgccgtatctacacaaaaccgatgtggggccagtgatcgacgctcgcgcgaaagaaaagctgctgcagcatatcgagcagatgaaccaaactcagaagccgattgcgcaactgacactggcggacgattgtcagcatggtgattttgtcacaccaacggcgtttgaaatctcaggtatcgatgtgcttaaagaagagcagtttggcccgatcctgcacattgtgcgtttcaaagcgtctgaactgactcgcgtggtggaacacatcaaccaaacgggtttcggtttgaccatgggtattcacagtcgtaacgaaaccacctaccgctggatcgaaaaacacgctcgagtagggaactgctacatcaaccgtgaccaagtgggtgcggtggttggcgtgcagccattcggtggtcagggcttatcggggactgggccaaaagcaggtggtccacactacttgtaccgctttacccaagtgcaatttaaccagactgagaacgcataa

SEQ ID NO: 12637 - protein, 1043 aa, Vibrio vulnificus
MFTATDVLKPEFVAQPLDKLWALISPLYMVDESQWLEQLLPLATPSAEEKQAIASRTTQLIEAIRADKKSIQLIDALLLEYSLDTHEGILLMCLAEALMRIPDAATADALIKDKMSVADWKSHLKNSESVFVNASTWGLMLTGKVVGLGDDETQSASQALNRLVNKLSEPVIRKAMYQAMKIMGHQFVRGRTIEEAQKNGRPMRDKGFTYSFDMLGEAALTTADANKYFKDYLMAIEAVGRETYGNDTSPAPSVSIKLSALHPRYEVANEHRVMSELFDTLAQLLKRAVELDVAITIDAEEADRLELSLKLFEKLYRSETVKGWGKFGLVVQAYSKRALPVLVWLNALAKEQGDLIPLRLVKGAYWDSEVKWSQQRGYDNYPVYTRKEATDVAYLACARFLLSDDVRGNIFPQFASHNAQTVSSIATMATHSDYEFQRLHGMGDSLYNHVMEQYRQPVRIYAPVGSHKDLLPYLVRRLLENGANSSFVHRLVDARCPVAELTKHPVEALTSFETLNNTKIPLPAAIFPERKNSYGVNVDIESEAKPFEAQVESFLSKQWLAGPIINGASLAESMIKDGQAESVTAPYDRRIQVGQIAFANLDHVSQAIDIAQAAFADWNRTPLVEKARCLDNLADLMEANLAELVALCHQEAGKTLHDSIDEVREAVDFCRYYAKQAQNLQPFELEGFDGVKRIASREGLGVFVCISPWNFPLAIFLGQVTAALVAGNTVVAKPAEQTSLIAVRAVELMLQAGFPASVVQLIPGRGADIGSALTSHPSIAGVAFTGSTATAQRINVTLAQREAKPVPFIAETGGQNAMIVDSTALPEQVVRDVIRSAFASAGQRCSALRVLFVQQDIADRVIGLIQGAMNELSVGVPYLHKTDVGPVIDARAKEKLLQHIEQMNQTQKPIAQLTLADDCQHGDFVTPTAFEISGIDVLKEEQFGPILHIVRFKASELTRVVEHINQTGFGLTMGIHSRNETTYRWIEKHARVGNCYINRDQVGAVVGVQPFGGQGLSGTGPKAGGPHYLYRFTQVQFNQTENA

SEQ ID NO: 12638 - DNA, 3978 bp, Ralstonia solanacearum
  CDS (1)..(3978)
atggctacgaccaccctcggggtcaagctggacgatgcttcgcgcgaacgcctcaagcgcgcagcccagtccattgaccgcacaccgcactggctgatcaagcaggcgatcttcacctatctggaccaagtggagcgggggcagctgccgaatgatgcgggcggtccggcggcggatggcctcccgtccgccgccgcagccgtcgcggacatggccgatgccgatggcaccgaggccgtggtgcaacccttcctcgaattcgcgcagagcgtgcagccgcagtcggtgctgcgcgccgccatcacggccgcctaccgccggccggaaaccgaggcgattccgatgctgctggagcaggcccgcctgccgggcgcgctggcctccgaggccaagcagctcgcccgcgaccttgccggcaagctccgtacgcaaaaggtcggcaccggccgcgaaggtctggtgcaaggtctgattcaagagttctccctgtcgagccaggagggcgtggcgctgatgtgcctggccgaggcactgctgcgcattcccgacaaggccacgcgcgatgcgctgatccgcgacaagatcagcagcggcaactggcagtcgcatctgggccagagcccgtcgttgttcgtcaacgccgccacctggggcctgctgctgacgggcaagctggtggccacgcacaacgaggccggactgtcgaaggcgctcacgcgcatcatcggcaagcgcggcgagccgctgatccgcaagggcgtcgacatggcgatgcgcctgatgggcgagcagttcgtcaccggcgagaccatttccgaagcgctggccaacgcccgcaagtacgaggccgaaggcttccgctactcctacgacatgctcggcgaagccgccatgacggaagaggatgcccagcgctacctcgcgtcgtacgagcaggccatccgcgcgatcggccaggcttcgggcgggcgcggcatctatgaggggccgggcatctcgatcaagctgtcggcgctgcacccgcgctacagccgcgcccagtacgaccgcgccatcaatgagctgtatccgcgcgtgaagggcctggccatgctggcccgcgagtacgacatcggcatcaacatcgatgcggaagaagccgaccgcctggagctgtcgctcgatctgctcgagcgcttgtgcttcgcgcccgagctggccggctggaacggcatcggcttcgtggtgcagggctaccagaagcgctgcccgttcgtgctcgactacctcatcgacctggcgcgccgcagcaagcaccgcctgatgattcgcctggtcaagggcgcctactgggacagcgagatcaagcgcgcccaggtcgacggcctggagggctatccggtctatacgcgcaaggtctacaccgacgtgtcgtacctggcctgcgcgcgcaagctgctggccgcgcccgatgtcgtgtttccgcagttcgccacgcacaacgcccatacgctggcggccatctatcacatggccgggcagaactattaccccggccagtacgaattccagtgcctgcacggcatgggcgagccgctgtacgagcaggtggtcggcaacaagccgggcaagctcaaccggccgtgccgcatctacgcgccggtcggcacgcacgagacgctgctggcctacctggtgcgccgcctgctggagaacggcgccaacacctcgttcgtcaaccgcatcgcggacgagtcgattccgctggacgaactcgtcgccgatccggtggcggtggtggagaacatgcacgccgaggaaggcgcgctcggcctgccgcatccgaaaattccgttgccgcgccatctctatggtgatgtgcgtgccaattcggcagggatcgacctggcgaacgagcatcggctggcgtcgttgtcgtctgcgctgctggccggtaccagctcggtctgggccgctgaaccgaccatcggcgatgcgccatacaccggtggcacgccgcaaccggtgcgcaacccgtcggacctgcgtgacgtggtcggccacgtgaccgaagccactgaagccgacgtcgatgccgcgctgtcggccgccgccgccgccgccccgatctggcaagccacgctgcccgaagcgcgtgccgcgctgctcgatcgcgccgccgacctgatggaaggcgagatgcagcacctgatgggcctgatcatccgcgaggcgggcaagacgctgtccaacgcgatcgccgaagtgcgcgaggcggtggacttcctgcgctactacgcggcgcaggtgcgtggcgggttctccaacgacacgcaccgcccgctgggcccggtggtctgcatcagcccgtggaacttcccgctggcgatcttcaccggccaggtgagcgcggcgctggccgccggcaacccggtgctggccaagcccgccgagcagaccccgctgatcgccgcacaggccgtgcgcatcctgcgcgaagccggcgtgccggccggcgcggtgcagctgctgccgggccgcggcgagaccgtcggggccgcactggtgaaggatgcgcgcaccaagggcgtgatgttcaccggctcgaccgaggtggcgcgcatcctgcagcgcacgctggccggccgcctggatgccaacggtgcaccgatcccgctgatcgccgagaccggcggccagaacgcgatgatcgtcgattcgtcggcgctggccgagcaggtggtggccgatgtgctgtcgtccgccttcgattccgccgggcagcgctgctcggccctgcgcgtgctgtgcctgcaggacgacgtggccgaccgcgtgctggcgatgctcaagggcggcatggccgagctggcgatgggcaatcccgatcgcctgtccaccgacgtcggcccggtgatcgacgccgaggcgcgcgacaacatcgtcggccatatcgaagggatgcgcgccaagggccggcgcgtgcaccaggcgcccgcgccggctgcctgcgcccacggcaccttcgtgccgccgacggtgatcgaactcgacagcctgtcggacctgacgcgcgagatcttcgggccggtgctgcacgtggtccgctggaagcgcacagccgacaacgccggcctcacccggctcatcgagcagatcaacggcacgggctacggcctgacgctgggcatccacacccgcatcgacgagaccattgcgcacatcgtcgagcgggcgcgggtgggcaacctgtacgtgaaccgcaatatcgtcggcgcggtggtcggcgtgcagccgttcggcggcgagggcctgtcgggcaccggcccgaaggcgggcggctcgctgtatctgctgcgcctgctgtcgacctgcccgcaggacgcgatgcgcacggcgctggagttgaccgcgggcgccggcaccgacgtcgagaccgaggagcgccgcgcgctgctggcgccgttcgacgcgctgcgtgactgggcgcgccggcagtcgcccgggctggccgcgctgtgcgaccgcctggcggcggccacggccaccggcgcggttctgacgctgccgggcccgaccggcgagcgcaacacctatatgctgctgccgcgcgacgcggtgctgtgcgtggcggccgatccggccgactggctgcgtcagctggcggccgtgctggcggtgggcagcgaggcggtcgtgcaggaaaaccctgccatcgccgaggtgctgcgtacgctgccgtcggcagtacaatcgcgcgtccggacggtggcgtcgctggaagacgcggcgttcgacgcggtgctgcaccacggcgattcggatcacctgcgcgccctgtgcgaagggctggcgcgccgtgccggtccgatcgtcggcgtgcagggcttgccgcacggcggacaggggctggcgctggagcgcctgctgatcgagcgttcgctgtcggtcaacacggccgcggcgggtggcaacgccagcctgatgaccatcggctga

SEQ ID NO: 12639 - protein, 1325 aa, Ralstonia solanacearum
MATTTLGVKLDDASRERLKRAAQSIDRTPHWLIKQAIFTYLDQVERGQLPNDAGGPAADGLPSAAAAVADMADADGTEAVVQPFLEFAQSVQPQSVLRAAITAAYRRPETEAIPMLLEQARLPGALASEAKQLARDLAGKLRTQKVGTGREGLVQGLIQEFSLSSQEGVALMCLAEALLRIPDKATRDALIRDKISSGNWQSHLGQSPSLFVNAATWGLLLTGKLVATHNEAGLSKALTRIIGKRGEPLIRKGVDMAMRLMGEQFVTGETISEALANARKYEAEGFRYSYDMLGEAAMTEEDAQRYLASYEQAIRAIGQASGGRGIYEGPGISIKLSALHPRYSRAQYDRAINELYPRVKGLAMLAREYDIGINIDAEEADRLELSLDLLERLCFAPELAGWNGIGFVVQGYQKRCPFVLDYLIDLARRSKHRLMIRLVKGAYWDSEIKRAQVDGLEGYPVYTRKVYTDVSYLACARKLLAAPDVVFPQFATHNAHTLAAIYHMAGQNYYPGQYEFQCLHGMGEPLYEQVVGNKPGKLNRPCRIYAPVGTHETLLAYLVRRLLENGANTSFVNRIADESIPLDELVADPVAVVENMHAEEGALGLPHPKIPLPRHLYGDVRANSAGIDLANEHRLASLSSALLAGTSSVWAAEPTIGDAPYTGGTPQPVRNPSDLRDVVGHVTEATEADVDAALSAAAAAAPIWQATLPEARAALLDRAADLMEGEMQHLMGLIIREAGKTLSNAIAEVREAVDFLRYYAAQVRGGFSNDTHRPLGPVVCISPWNFPLAIFTGQVSAALAAGNPVLAKPAEQTPLIAAQAVRILREAGVPAGAVQLLPGRGETVGAALVKDARTKGVMFTGSTEVARILQRTLAGRLDANGAPIPLIAETGGQNAMIVDSSALAEQVVADVLSSAFDSAGQRCSALRVLCLQDDVADRVLAMLKGGMAELAMGNPDRLSTDVGPVIDAEARDNIVGHIEGMRAKGRRVHQAPAPAACAHGTFVPPTVIELDSLSDLTREIFGPVLHVVRWKRTADNAGLTRLIEQINGTGYGLTLGIHTRIDETIAHIVERARVGNLYVNRNIVGAVVGVQPFGGEGLSGTGPKAGGSLYLLRLLSTCPQDAMRTALELTAGAGTDVETEERRALLAPFDALRDWARRQSPGLAALCDRLAAATATGAVLTLPGPTGERNTYMLLPRDAVLCVAADPADWLRQLAAVLAVGSEAVVQENPAIAEVLRTLPSAVQSRVRTVASLEDAAFDAVLHHGDSDHLRALCEGLARRAGPIVGVQGLPHGGQGLALERLLIERSLSVNTAAAGGNASLMTIG

SEQ ID NO: 12640 - DNA, 1653 bp, Ustilago maydis
  CDS (55)..(1548)
ccttctattcaccagagtatccacattcgcccacacccatacccacttttcagcatgccaactctcaacctcgatctgcctaacggcatcaagtcgaccatccaggctgacttgttcatcaacaacaagtttgtgcccgctcttgacggcaagacttttgcgaccatcaacccttccaccggtaaggagattggtcaggtcgccgaggcttccgccaaggacgttgatctcgctgtcaaggctgcgcgcgaggcattcgagactacttggggcgagaacacacccggtgacgctcgtggcagacttctgatcaagctcgccgagctggtcgaggccaacattgacgagcttgctgccatcgagtcgctcgacaacggcaaggccttctcgatcgctaaaagctttgacgtcgctgccgtcgctgccaacttgcgatactatggtggctgggccgacaagaaccacggcaaggtcatggaggtcgacaccaagcgcctcaactacacgcgccacgagcccatcggcgtgtgtggtcagatcatcccttggaacttccccttgctcatgttcgcctggaagctcggccctgcgctcgccacaggtaacacgatcgtcctcaaaaccgccgagcagacaccactgtcagccatcaagatgtgtgagcttatcgtcgaggccggcttcccgcctggtgtggtcaacgtcatttccggtttcggtcccgtcgccggtgccgccatctcacagcacatggacattgacaagatcgccttcaccggctcaacactggtgggccgcaacattatgaaggctgctgcttcgaccaacctgaagaaggtgacgctcgagctcggcggcaagtcgcccaacattatctttaaggacgccgacctggaccaggcggttcgatggtcggcgttcggtatcatgttcaatcacggacaatgctgctgtgcgggctcgcgtgtctatgtggaggaatcgatctatgacgctttcatggagaagatgactgcccactgcaaggcgctccaggtgggtgaccccttttccgccaacacgttccaaggtcctcaggtttcgcagctccagtacgaccgtatcatggagtacatcgagtccggcaagaaggacgctaaccttgcgctcggtggtgtgcgcaagggtaacgaaggctactttatcgagcctaccatcttcaccgacgttcctcacgatgccaagattgccaaggaggagatcttcggccctgtcgtggtcgtctccaagttcaaagatgaaaaggacctcattcgcatcgccaacgactcgatctacggcctcgctgccgctgtcttcagccgcgacatcagccgtgccatcgagactgcccacaagctcaaggccggcaccgtctgggtcaactgctacaaccagctcatccctcaggttccgttcggcggttacaaggcgtccggtatcggtcgagagctcggcgagtatgcgctcagcaactacacaaacatcaaggcggtgcatgtgaacctcagccagcctgcccctatctaaacgaaaggcacgcaagctaatgaaagcgaaatcacacgtctctacttctgtcctgtttcttgtacctttattcccggtgattcgaatatcatcgtgctgtttttg

SEQ ID NO: 12641 - protein, 497 aa, Ustilago maydis
MPTLNLDLPNGIKSTIQADLFINNKFVPALDGKTFATINPSTGKEIGQVAEASAKDVDLAVKAAREAFETTWGENTPGDARGRLLIKLAELVEANIDELAAIESLDNGKAFSIAKSFDVAAVAANLRYYGGWADKNHGKVMEVDTKRLNYTRHEPIGVCGQIIPWNFPLLMFAWKLGPALATGNTIVLKTAEQTPLSAIKMCELIVEAGFPPGVVNVISGFGPVAGAAISQHMDIDKIAFTGSTLVGRNIMKAAASTNLKKVTLELGGKSPNIIFKDADLDQAVRWSAFGIMFNHGQCCCAGSRVYVEESIYDAFMEKMTAHCKALQVGDPFSANTFQGPQVSQLQYDRIMEYIESGKKDANLALGGVRKGNEGYFIEPTIFTDVPHDAKIAKEEIFGPVVVVSKFKDEKDLIRIANDSIYGLAAAVFSRDISRAIETAHKLKAGTVWVNCYNQLIPQVPFGGYKASGIGRELGEYALSNYTNIKAVHVNLSQPAPI

SEQ ID NO: 12642 - DNA, 3702 bp, Rhizobium meliloti
  CDS (1)..(3702)
atgagcccgaacccgcttcagaaacccgcgatcgacgccgcacctgcgcccttcgccgacttcgcaccgccagtccggccgcaaagcacgctgcgccgggcgatcacggccgcttaccgccgcccggaaacggaatgcctgccgcctctcgtcgaggcggccacgcaatcgaaggaaatacgggacgccgccgcaagcaccgcccgcaagctgatcgaggcgctgcgcggcaagcatagtggttccggcgtcgagggactggtgcaggaatattcgctttcgagccaggaaggcgtggcactcatgtgccttgcggaagcgctgctgcgcattcccgatacggcgacgcgcgacgcgctgatccgcgacaagattgccgacggcaactggaaatcgcatctcggcggcagccgttcgctcttcgtcaatgccgcgacctggggacttgtggtcaccggcaagctgacctcgacggtcaacgaccgcagcctcgcggcggcgctcacgcgtctcatctcgcgttgcggcgagccggtgatccggcgcggcgtcgacatggccatgcggatgatgggcgaacagttcgtcaccggcgagacgatccgcgaagcgctgaaacgttctaaggagctcgaggagaaaggcttcagctactcctacgacatgctcggcgaagcggcgaccacggccgccgacgccgaacgctattacagggactatgagagcgccattcacgcaatcggcaaagcctccgccggccgcggcatctatgagggcccgggcatctccatcaagctctcggcgctgcatccccgctatagccgcgcgcaagccgcgcgcgtcatgggcgaattgttgccgagggtgaaggcgctcgctctcctcgccaagaattacgatatcggcctcaacatcgacgccgaggaagccgaccggctggaactgtcgctcgatctcctcgaggtgctctgcctcgacggcgatctctccggctggaacggcatgggcttcgtcgtgcaggcctatggcaaacgctgccccttcgttctcgacttcatcatcgatcttgcccggcgctccggccggcgcatcatggtgcggctggtgaagggtgcctattgggatgccgagatcaagcgggcgcagctcgacgggctcgcggatttcccggtcttcacgcgcaagatccacaccgacgtctcctatatcgcctgcgcagccaagctgcttgccgcgaccgatgtggtgttcccgcaattcgcgacacacaatgcccagacgctcgccgccatctaccacatggccggcaaggactttcacgtgggcaaatacgaattccagtgcctgcacggcatgggcgagccgctttatgaagaggtcgtcggccgcggcaagctcgatcgcccctgccgcatctatgcgcctgtcggcacccatgagacgctgcttgcctatctggtccggcgcctcctcgaaaacggcgccaactcctccttcgtgcatcgcatcaacgacccgaaggtttcgatcgacgaactgatcgccgaccccgtcgaagtcgtccgcgccatgccggtcgtcggcgccaagcacgacaggatcgccttgccggccgaactcttcggcgatgcgcggaccaattccgccgggctcgatctttccaacgaggaaacgcttgcgtcgcttacggaagcgctgagggaaagcgcggcaatgaagtggaccgccctgccgcagctcgcaaccggccccgctgccggcgagacgcggacggttctgaaccccggcgaccatcgtgacgtcgtcggctcggtgaccgagacctcggaagaggacgcacggcgcgccgtgcgccttgccgccgacgcggcgccggattgggcggccgtgccgccctccgagcgggccgcctgcctcgaccgcgccgccgagctgatgcaggcccgcatgcccacgcttctcgggctgatcatccgcgaggcgggcaaatcggcgctgaacgccattgccgaggtgcgcgaggcgatcgatttcctgcgctactatgccgaacagacgcgccgcacgctcggccccggccacgggccgctcggcccgatcgtctgcatcagcccatggaatttcccgctggcaatcttcaccgggcagatcgccgccgcactcgtcgccggcaatcccgtgctcgccaaacccgcggaagagacgccgctgatcgccgccgagggcgtgcgcatcctgcgtgaggccggcattccggcaagcgcgctgcagcttcttccgggcgacggacgcgtcggtgcggcgctggtcgccgcggccgagaccgcgggcgtgatgttcaccggatcgacggaagtcgcgcggctgatccaggcacagcttgccgaccgcctttcgcccgccggccggccgatcccgctgatcgccgaaaccggtggccagaatgcgatgatcgtcgactcctcggcgcttgccgagcaggtggtcggcgacgtgatcacctccgccttcgacagtgccggccagcgctgctcggcactgcgtgtgctgtgcctgcaggaggatgtggccgaccgcatcctgacgatgctgaagggcgcgctgcacgaactgcatatcggccgcaccgatcgtctttccgtggatgtcggcccggtcatcacatcagaggcgaaggacaacatcgagaagcacatagagcggatgcgcgggctcggccgcaaggtcgagcagatcgggctcgcctcggagaccggagtgggcaccttcgtgccgccgacgatcatcgaactcgagaagctttccgatcttcaacgcgaggtcttcgggccggtgctgcacgtcatccgctaccggcgcgacgatctcgaccggctggtggacgacgtcaacgccaccggctacggcctgaccttcgggctccacacgcgcctcgacgagacgatcgcgcatgtgacgagccgtatcaaggcgggcaacctctacatcaaccgcaacatcatcggcgcggtcgtcggcgtccagcccttcggcggccgcggtctttccggtaccggtcccaaggccggcggtccgctttatctcggccgcctggttacgaccgcaccggtgccgccgcagcacagctcggtgcacacggacccggtccttctcgacttcgccaaatggctcgacggcaaaggcgcgcgcgcggaggccgaagcggcccgcaacgccggcagcagctcggcacttggcctggatctggaactccccggccccgtcggcgaacgcaatctctatacgctccatgcgcgcggccgcatcctcctcgtgccggcgacggagagcggtctataccaccagctcgccgctgcgctcgcgaccggcaacagcgtcgcgatcgatgccgcctccggtctgcaggcttcgctgaagaacctgccgcagaccgtcggcctgcgtgtctcctggtccaaggactgggccgccgacggcccgttcgccggtgcgctggtcgaaggtgacgccgagcgcatccgcgcggtcaacaaggctatcgccgccctgcccggcccgctgctgctcgtgcaggccgcatcgagcggggagatcgcccgcaacccggacgcctattgcctgaactggctcgtggaagaggtttccgcctcgatcaacacggctgcagccggcggcaatgccagcctgatggcgatcggctga

SEQ ID NO: 12643 - protein, 1233 aa, Rhizobium meliloti
MSPNPLQKPAIDAAPAPFADFAPPVRPQSTLRRAITAAYRRPETECLPPLVEAATQSKEIRDAAASTARKLIEALRGKHSGSGVEGLVQEYSLSSQEGVALMCLAEALLRIPDTATRDALIRDKIADGNWKSHLGGSRSLFVNAATWGLVVTGKLTSTVNDRSLAAALTRLISRCGEPVIRRGVDMAMRMMGEQFVTGETIREALKRSKELEEKGFSYSYDMLGEAATTAADAERYYRDYESAIHAIGKASAGRGIYEGPGISIKLSALHPRYSRAQAARVMGELLPRVKALALLAKNYDIGLNIDAEEADRLELSLDLLEVLCLDGDLSGWNGMGFVVQAYGKRCPFVLDFIIDLARRSGRRIMVRLVKGAYWDAEIKRAQLDGLADFPVFTRKIHTDVSYIACAAKLLAATDVVFPQFATHNAQTLAAIYHMAGKDFHVGKYEFQCLHGMGEPLYEEVVGRGKLDRPCRIYAPVGTHETLLAYLVRRLLENGANSSFVHRINDPKVSIDELIADPVEVVRAMPVVGAKHDRIALPAELFGDARTNSAGLDLSNEETLASLTEALRESAAMKWTALPQLATGPAAGETRTVLNPGDHRDVVGSVTETSEEDARRAVRLAADAAPDWAAVPPSERAACLDRAAELMQARMPTLLGLIIREAGKSALNAIAEVREAIDFLRYYAEQTRRTLGPGHGPLGPIVCISPWNFPLAIFTGQIAAALVAGNPVLAKPAEETPLIAAEGVRILREAGIPASALQLLPGDGRVGAALVAAAETAGVMFTGSTEVARLIQAQLADRLSPAGRPIPLIAETGGQNAMIVDSSALAEQVVGDVITSAFDSAGQRCSALRVLCLQEDVADRILTMLKGALHELHIGRTDRLSVDVGPVITSEAKDNIEKHIERMRGLGRKVEQIGLASETGVGTFVPPTIIELEKLSDLQREVFGPVLHVIRYRRDDLDRLVDDVNATGYGLTFGLHTRLDETIAHVTSRIKAGNLYINRNIIGAVVGVQPFGGRGLSGTGPKAGGPLYLGRLVTTAPVPPQHSSVHTDPVLLDFAKWLDGKGARAEAEAARNAGSSSALGLDLELPGPVGERNLYTLHARGRILLVPATESGLYHQLAAALATGNSVAIDAASGLQASLKNLPQTVGLRVSWSKDWAADGPFAGALVEGDAERIRAVNKAIAALPGPLLLVQAASSGEIARNPDAYCLNWLVEEVSASINTAAAGGNASLMAIG

SEQ ID NO: 12644 - DNA, 3801 bp, Burkholderia cepacia
  CDS (1)..(3801)
atgcagatctcccagaaacactcgacagtcatggacattcactcaaagttcgatccggcatcgcgattccgcgggttcgccagcggacagccagccgcatccgagcttcgcgaacgcatcaccgcggcctgtcgaacggcggaacctgtagccgtctcagccttgcttgccatggcaaagatggagcctgaagtcgcgcgcaaggccaaccaactgtccatgcaaatagcgcagcgtctgcgtgagcgcaagaactccgcgggtcgtgcgggaatcgtgcagggcctgctgcaggagtacgcactctcttcacaggagggcgttgcgctgatgtgcctcgcggaagcactcttgcggattcccgacatggcgacgcgcgacgcgctgatcagggacaagatcgcgcgtggacattggcaggagcacgcaggccggagcccctcgttgttcatcaatgccgcaacgtgggggctgtttctgaccgggaaacttgtctccacctacagcgagtcgtcgctgtcgaccttgctcacgcggctcatcgccaagggcggcgaaccgctcattcgcaagggtgtcgacatggcgatgcggatgatgggcgagcagttcgtcaccggagaaaccatcaaggaggcgctggaccacgcgcgaggcctggaggcgcaaggtttccgctattcatacgacatgctcggcgaggcggcgatgacggccgaagacgcagaccgctaccgccagtcctacgagcgagccattcatgccatcggcgaggcatcgaacggccgaggcgtctacgagggacccggcatctcgatcaagctctcagcgctgcatccgcgttacagccgcgcgcagtacggccgagtcatggacgaactctatcccgtggtgcgcagtcttgcgctgctggctcgacgttacgacatcggtctcaacatcgacgccgaggaagccgatcgccttgaactgtcgctcgacttgctggagaagctttgcttcgaacccgccctcgcagggtggaatggcatcggcttggtgatccaggcttaccaaaagcgttgcctcttcgtgatcgaccatgtgattgaactcgcgcaacgcagccgtcatcggctgatgatccggctcgtcaagggagcctactgggacagcgagatcaagcgtgcccaggtggaggggcaggacggctttccagtttatacgcgcaaggtctacaccgacgtttcgtacctggcctgcgcgcgcaagctgctggttgctcccgcagagatctatccgcagttcgccacgcacaacgcgcacaccatggcagcgatctacaacctggcggagcccgcgacctaccagcctggtcagtatgaatttcaatgcctgcacggcatgggtgagccgctgtacgagcaggtggtcggaagcctggcggatggcaagctggggcgtccgtgccgcatctacgcacccgtgggtacacacgagacgctgttggcctacctggtgcgccggctgctcgagaacggggccaacacgtcgttcgtcaaccgcatcgccgacccgtcgattccacttgaagcgctggtggaggatcccgtcgcggccgtggagcgcatggcccaggaagagggcgaagcggggcggccgcatccttgcatcccgagcccgagcgcactctacggccaggcgcgacgcaattctcatgggctggatttgtccaacgagcagaccctgcgggggctggagccaatcctggtggacagcgcacgaacaggatggacggctgaaccgctgctcggagaatctgccgaagccgaacccacagcctggaagccggtactcaatccagccgaccatcgtgacgtggtcggaaaggtgcgcgcagccagcgagcaacaaatcgaagccgcgcttcgttcggcgacggggttcgcgccgcagtgggccgcgacgtccgccggcgatagggctttcgtactcgagcgcgccgccgacctgttgcaggaccagcttccgtatctgctggggttgctctgccgcgaagcgggaaaatcctatgccaacggtgtcgccgaagtgcgtgaggcgatcgactttctgcgcttctacgcagcacacgcacgcacggacttcgacgatccggcgcataagccgttgggacccgtggtttgcatcagcccctggaacttcccactggccatcttcgtgggccaagtctccgcggcgctggctgccggcaaccccgtcctggcgaagcccgcggagcagacatcgttgattgcggctgaggccacacggctgatgcacacggccggcgtcccgcgtgcggcgcttcaattgatcccgggccgcggctcggtcgttggggcacggatggtcgcggatgcccgggttcaaggcgtcatgttcacaggctcgacggcagtggctcgtcagctgcagcgaacgatggccgaacgactgggtccgacgggggcgccggttccgctcattgccgagacaggcgggcagaacgcaatgatcgtggactcctctgcattggtcgagcaggtcgtggcggatgtcatggcgtccgcgttcgacagtgcaggccagcgctgctccgcccttcgggttctatgtgtgcaggacgacgttgcggatcgcttgcttcatatgcttcgtggcgcgatggctgagtccaatgtcggcgacccgtcctccctgtgcaccgacgtgggacccgtgatcgaccttgcagcacgcacgacgatcgagtcccatatcgaactcatgcagagtcgcggccgtcgagtcaaccgcgcggggcgtgcagcgcacgaagtccttgaaggtggaacattcgtcctgccgacgatgattgaactggagagcatctccgagcttgagcgggaagtgttcgggcctgtactgcacgtcgtgcgatatgccaggcaggacctggacacgatgctggcgcagatcagcgcaaccggctatgggctgacgatgggcattcactcgcgcattgacgagaccatcggccgtgtggtctccagtgccaaggtcggcaacgtttatgtgaaccggaacatggtcggggcagtcgtgggtgtgcagcccttcggcggcgagggcctgtcgggcacggggccaaaggctggagggcccctctatatgtacaggcttctcgctgaaagtccgcacgatgtgctcgtgcgcgcagccgagcggggattgccaggctctgttgctgacggcagcgtgacgcaagcatcggagccgttcgaggcactgctctcctggattgagacgcatcgggaacgacctttgaccgcccgatgccggcttctcaagcggaccgccggatccgggcagatgcgcgtgctggtcgggcccaccggagagcgaaacacgtactccttgcagcctcgagttgctgcactgtgcctggctgaagacgaggactcattgttgtttcagttggctggcgcgctcgttgtgggctgccgtgccatctggccatcgaacaccgatacccaggcgctgcgagccaccttgccgttggacgttcaagcggagatcgctctcgcgcgggactgggcagcgccgaccgtggaattcgatgtcgcgctctatcaaggcagccgtgagggcctcctggcggcttcggcccggctggccgagcgccaggggccgataaccagcctgtggcggttcccgacggacagcggcaaggtgccgctggaagccctggttgtggagcaggccgtgagcacgaacacggctgccgcgggcggcaacgcaagcctgatgacgatttcttga

SEQ ID NO: 12645 - protein, 1266 aa, Burkholderia cepacia
MQISQKHSTVMDIHSKFDPASRFRGFASGQPAASELRERITAACRTAEPVAVSALLAMAKMEPEVARKANQLSMQIAQRLRERKNSAGRAGIVQGLLQEYALSSQEGVALMCLAEALLRIPDMATRDALIRDKIARGHWQEHAGRSPSLFINAATWGLFLTGKLVSTYSESSLSTLLTRLIAKGGEPLIRKGVDMAMRMMGEQFVTGETIKEALDHARGLEAQGFRYSYDMLGEAAMTAEDADRYRQSYERAIHAIGEASNGRGVYEGPGISIKLSALHPRYSRAQYGRVMDELYPVVRSLALLARRYDIGLNIDAEEADRLELSLDLLEKLCFEPALAGWNGIGLVIQAYQKRCLFVIDHVIELAQRSRHRLMIRLVKGAYWDSEIKRAQVEGQDGFPVYTRKVYTDVSYLACARKLLVAPAEIYPQFATHNAHTMAAIYNLAEPATYQPGQYEFQCLHGMGEPLYEQVVGSLADGKLGRPCRIYAPVGTHETLLAYLVRRLLENGANTSFVNRIADPSIPLEALVEDPVAAVERMAQEEGEAGRPHPCIPSPSALYGQARRNSHGLDLSNEQTLRGLEPILVDSARTGWTAEPLLGESAEAEPTAWKPVLNPADHRDVVGKVRAASEQQIEAALRSATGFAPQWAATSAGDRAFVLERAADLLQDQLPYLLGLLCREAGKSYANGVAEVREAIDFLRFYAAHARTDFDDPAHKPLGPVVCISPWNFPLAIFVGQVSAALAAGNPVLAKPAEQTSLIAAEATRLMHTAGVPRAALQLIPGRGSVVGARMVADARVQGVMFTGSTAVARQLQRTMAERLGPTGAPVPLIAETGGQNAMIVDSSALVEQVVADVMASAFDSAGQRCSALRVLCVQDDVADRLLHMLRGAMAESNVGDPSSLCTDVGPVIDLAARTTIESHIELMQSRGRRVNRAGRAAHEVLEGGTFVLPTMIELESISELEREVFGPVLHVVRYARQDLDTMLAQISATGYGLTMGIHSRIDETIGRVVSSAKVGNVYVNRNMVGAVVGVQPFGGEGLSGTGPKAGGPLYMYRLLAESPHDVLVRAAERGLPGSVADGSVTQASEPFEALLSWIETHRERPLTARCRLLKRTAGSGQMRVLVGPTGERNTYSLQPRVAALCLAEDEDSLLFQLAGALVVGCRAIWPSNTDTQALRATLPLDVQAEIALARDWAAPTVEFDVALYQGSREGLLAASARLAERQGPITSLWRFPTDSGKVPLEALVVEQAVSTNTAAAGGNASLMTIS

SEQ ID NO: 12646 - DNA, 1808 bp, Pisum sativum
  CDS (126)..(1637)
tagagaataacactttatcttagctcagttgagtgaacaatttcagcaactttcaaggtgagatctgatctatctatctccatatccatcaaatcaataatagattggagagagaaagtactagaatggatattccgatcccaactcgtcagttgttcattaacggcgactggaaagctcccgtccttaacaaacggattcccgtcatcaatcccgccacccaaaacatcatcggcgatatccctgccgctactaaggaagacgtcgacgtcgccgtcgccgccgctaaaactgctctcacgcgtaacaaaggcgctgattgggctaccgcttctggcgctgttcgtgcacgctatctacgcgccattgccgctaaggttactgagaaaaagcctgaactagcgaagcttgagtctattgattgtggaaaaccactcgatgaagccgcgtgggacattgatgatgttgctggttgctttgagtattatgctgatcttgctgaaaaattggatgcaagacaaaaggctccggtgtctcttccaatggatacattcaagagtcatgtgcttagggaacctattggtgttgttggattgataactccatggaattatcctatgttgatggctacgtggaaggttgctcctgctcttgctgcgggctgtgctgcaatattgaagccgtctgaattggcatctctaacctgcttggagttaggcgaaatatgcaaagaagttggtcttcctcgtagtgttttaaatattgtcaccggattaggccatgaagccggtgctcctttggcatctcatcctgatgtagataagatttcttttactggtagctctgcaactgggagcaagattatgacaactgcagctcagctcgttaagcctgtttcactggagcttggtggaaaaagcccattagttgtttttgaggatgttgaccttgataaggctgctgaatgggccatctttggctgcttctggacaaatggtcagatatgcagtgcaacttcccgtcttattttacatgaaagtatagcaacagagtttttgaataggattgtcaaatggatcaaaaacatcaaaatttcagatcccttggaagaaggttgcagactaggacctgttgttagtgaaggacagtatgaaaaaatattgaagtttgtctcaaatgctaagagcgagggtgcaaccattttgactggtgggtctcgaccagagcatctaaagaaaggattctttattgaaccaaccatcataaccgacgtgactactaacatgcaaatttggagagaagaagtatttggacctgtcctctgtgtaaaaacatttagcactgaagaagaagctattgatctagcaaatgacactgtctatggcttaggtgctgctgtaatatcaaatgatctagaaagatgtgaacgcgttactaaggcttttaaggccggaattgtatgggtcaattgctctcaaccatgcttcactcaagctccatggggaggcgtcaaacgtagtggttttggccgtgaactaggagaatggggacttgacaattacttgagcgtgaagcaagtgactcagtatatctctgaggaaccatggggctggtaccagcctcctgcaaaactgtgataggcatctaaaaattcacacgagaataagggttgggtcataccaaattatggccgatcttgaaatgagaaggcatataaagtcttgtaaaacagtgtaactggttgtactcaagtttatgcttgtagtgtttttatttgacttggttttaaaaaaaaaaaaaaaaaaaaa

SEQ ID NO: 12647 - protein, 503 aa, Pisum sativum
MDIPIPTRQLFINGDWKAPVLNKRIPVINPATQNIIGDIPAATKEDVDVAVAAAKTALTRNKGADWATASGAVRARYLRAIAAKVTEKKPELAKLESIDCGKPLDEAAWDIDDVAGCFEYYADLAEKLDARQKAPVSLPMDTFKSHVLREPIGVVGLITPWNYPMLMATWKVAPALAAGCAAILKPSELASLTCLELGEICKEVGLPRSVLNIVTGLGHEAGAPLASHPDVDKISFTGSSATGSKIMTTAAQLVKPVSLELGGKSPLVVFEDVDLDKAAEWAIFGCFWTNGQICSATSRLILHESIATEFLNRIVKWIKNIKISDPLEEGCRLGPVVSEGQYEKILKFVSNAKSEGATILTGGSRPEHLKKGFFIEPTIITDVTTNMQIWREEVFGPVLCVKTFSTEEEAIDLANDTVYGLGAAVISNDLERCERVTKAFKAGIVWVNCSQPCFTQAPWGGVKRSGFGRELGEWGLDNYLSVKQVTQYISEEPWGWYQPPAKL

SEQ ID NO: 12648 - DNA, 1866 bp, Arabidopsis thaliana
  CDS (76)..(1680)
ataaacagagttctcacaccaatacaaaagagaccatcaccgtgagaaagagaagaagaacaaaaaaagttagccatggcatcaagaagagtttcttcgctgctctctcgctctttcatgtcctcctcacgttctatcttctctcttagaggcatgaacagaggagctcaaagatacagtaacctcgctgctgctgtcgaaaacactattactccaccagtgaaagttgaacacacacagcttctaatcggtggaagattcgttgatgcagtgtcaggaaaaactttccctactttggatccaagaaatggagaagtgattgctcaagtgtctgaaggtgatgcagaagacgtgaaccgcgcggttgcagctgcacgaaaggcttttgatgaaggaccatggcctaaaatgacagcttatgagagatcaaagatactgtttcgtttcgctgatttaatcgagaaacataatgatgagattgctgctcttgagacttgggataatgggaaaccttatgaacaatctgctcaaattgaagtaccaatgcttgctagggtgttccggtactatgctggttgggcagacaagatacatggaatgacaatgccaggagatggtccacaccatgtgcagaccttacatgagcctataggagtcgctggacaaatcatcccatggaacttccctcttctcatgctttcttggaaacttggaccagctttagcttgcggtaacaccgttgttctcaaaactgctgagcaaactcctctatctgctcttcttgttgggaaactacttcatgaggctggacttcctgatggagttgtgaatatagtttctggatttggggctactgctggtgcagctatagctagtcacatggacgttgataaggttgctttcaccgggtctactgatgttgggaagattattcttgagttagcttcaaaaagcaaccttaaggcagtgactcttgagcttggaggaaagtcaccattcattgtatgtgaagatgctgatgtggatcaggccgttgagcttgcacatttcgctttgttctttaaccagggacaatgttgttgtgctggttcgcgtacatttgtacatgaacgtgtgtatgatgagtttgtagagaaagctaaagctcgtgcactcaagcgaaatgttggagatcccttcaagtcaggcattgagcaaggtccccaggtagactcagagcaattcaacaaaatcctgaagtacatcaaacatggagttgaggctggagccacattacaagctggaggtgacaggcttggttccaagggttactacattcaacctactgtcttctcagatgtgaaagatgacatgctcatagcaacagacgagattttcgggccggttcaaaccatactgaaattcaaggatcttgatgaggtgattgcaagggccaacaactcaaggtacggtttagctgctggagtgttcacacagaatcttgacacagcacaccggctgatgcgagcactcagagttgggactgtttggatcaactgttttgatgtacttgatgcatcaattccatttggagggtataagatgagtggcattggtagagagaaaggtatctacagtctcaacaattacttgcaagtcaaggctgttgttacttccctcaagaaccctgcctggctctaaaccataccaggtggttacacttatttctcgagtttggtttatgatttgcacttttgctttgaaaacctggagttgtactgtgtctctaggatttctagattttgagagtaatttatcttcaatacattttgcaaataaagctacatgacaatgtgtgattaataaacacaaactcttattagtttc

SEQ ID NO: 12649 - protein, 534 aa, Arabidopsis thaliana
MASRRVSSLLSRSFMSSSRSIFSLRGMNRGAQRYSNLAAAVENTITPPVKVEHTQLLIGGRFVDAVSGKTFPTLDPRNGEVIAQVSEGDAEDVNRAVAAARKAFDEGPWPKMTAYERSKILFRFADLIEKHNDEIAALETWDNGKPYEQSAQIEVPMLARVFRYYAGWADKIHGMTMPGDGPHHVQTLHEPIGVAGQIIPWNFPLLMLSWKLGPALACGNTVVLKTAEQTPLSALLVGKLLHEAGLPDGVVNIVSGFGATAGAAIASHMDVDKVAFTGSTDVGKIILELASKSNLKAVTLELGGKSPFIVCEDADVDQAVELAHFALFFNQGQCCCAGSRTFVHERVYDEFVEKAKARALKRNVGDPFKSGIEQGPQVDSEQFNKILKYIKHGVEAGATLQAGGDRLGSKGYYIQPTVFSDVKDDMLIATDEIFGPVQTILKFKDLDEVIARANNSRYGLAAGVFTQNLDTAHRLMRALRVGTVWINCFDVLDASIPFGGYKMSGIGREKGIYSLNNYLQVKAVVTSLKNPAWL

SEQ ID NO: 12650 - DNA, 1746 bp, Drosophila melanogaster
  CDS (1)..(1746)
atgcttaagctgggactcgcggtccccactcgatggtccttcagatgtcgtcgccttggtggaatggctatcattaaaggcgagacaaaaatctccgtggacaagcagaaagcagtccagccggaacaggatgaggaccaacaagaggtcgagccggattcccagccggcggaagaaaatccaagtattcacaggaaccagagagtattagttaatcatgccattcaggagattcagcacaggccgttggaggtgcccacaattatcggcgatgatacagtgtacaccatggacactcagcgtgtttgctgcccgcatcacctgcagacgaacttggctcacgtctactacgccaatcgcaagcaaatcgaggcggcaattaagtctgctctttcggcgcaaggaacttggagtctagttcccatcgcccagcgactggccatttggcgacgtgccgccaccattatcgaggaggacgagctgcggctgagagtgttcctcatgatgacgctgagcaaaaccgccgacgatgcgacgcgggacattcggcggctactcacatcgctgagggccaatgctgactatttggagcatctgtccgagctgcgctttgagatccagggtgatatgaatgtattccccagctttcatttgcgacccatggatggatttgtggccgcactggcaccatttgaatcggtggccttgtcatccagcttggccctctgtccggcgctcatgggcaacacggtgttgtggaatccctcattggaagtggcaccagtgagctatttaattttcagagccttccaggaggcgggtttgcccagcggcgttatcaactttgtgccggccaacgagcgtctgttcttggacaccatcacggatgccgtgcactttgccggactgaatactcaagcgagtgcagctttttacaggcatgtgcacaagctggtgagcgatcgaatggagcgatacatctgttttcctcgtctggtggccgagtgcccgggtcagaactttcattttgtccatgccagcgctaaggtggaatctgtcgtctcagccaccgtgcaggcggcctttggctttgccggacagtatgccaactcgctctcccggatgtatgtgccctcgtcaatgtggccacgcctcagggaggagttggtggaggccacggagcaactgaccatcggagaccccatcgaatcggaaacggatataggagcgatggtgcatataaatgacttccggcggatgcagaaactactgcagcgcaccaagaacatggagcagttgtgcggaggcagctgtgatgacagcactggtagattcgttgatccaacgattgtccgggtgtcggatccattggatccactgctgtgtgagccctgctgcggaccgttcttgccggtgttcgtctattcggacgattccttcagtgaggctctcaagcttgccgccaatcagtccagatacgcgctctccggctccatattcgcaagtcaggatgaggttatccttcactgcctgaaccaactgcgaatgtccgctagtaatctctacgtgaatgagcgatgcacgggtagcacgtacgggctgactccctttggtggaaatcggttgtccgggacaaacgataaatccggatctgcctacttcctaatgcgctggagctcgccgctgctcatcgaggagactgttgatggtccacctcccatgcgtggatcaaatacgtttccctga

SEQ ID NO: 12651 - protein, 581 aa, Drosophila melanogaster
MLKLGLAVPTRWSFRCRRLGGMAIIKGETKISVDKQKAVQPEQDEDQQEVEPDSQPAEENPSIHRNQRVLVNHAIQEIQHRPLEVPTIIGDDTVYTMDTQRVCCPHHLQTNLAHVYYANRKQIEAAIKSALSAQGTWSLVPIAQRLAIWRRAATIIEEDELRLRVFLMMTLSKTADDATRDIRRLLTSLRANADYLEHLSELRFEIQGDMNVFPSFHLRPMDGFVAALAPFESVALSSSLALCPALMGNTVLWNPSLEVAPVSYLIFRAFQEAGLPSGVINFVPANERLFLDTITDAVHFAGLNTQASAAFYRHVHKLVSDRMERYICFPRLVAECPGQNFHFVHASAKVESVVSATVQAAFGFAGQYANSLSRMYVPSSMWPRLREELVEATEQLTIGDPIESETDIGAMVHINDFRRMQKLLQRTKNMEQLCGGSCDDSTGRFVDPTIVRVSDPLDPLLCEPCCGPFLPVFVYSDDSFSEALKLAANQSRYALSGSIFASQDEVILHCLNQLRMSASNLYVNERCTGSTYGLTPFGGNRLSGTNDKSGSAYFLMRWSSPLLIEETVDGPPPMRGSNTFP

SEQ ID NO: 12652 - DNA, 1482 bp, Thermoplasma volcanium
  CDS (1)..(1482)
atggatggaaaactgtacatagatggacaatgggttgattcgtccaatggtgatactttaacgaaatacaacccggttactggcgaagtcattgggaaatttgcagcagcatcaagggatgatgttgatagagcatttgatgcagccgaggacgccttccaaaagtggatggatcttgggtcagtcgagcgttcaaaaatcatatacaaagcgaaggagctcatagaggaaaaccggaaggaacttgaaaatataataatacaagagaatggaaaacctgttaaagaagccgctgaagaagtcgatggtgtgctcgatcaaatgcaatactatgcggaatgggccagaaagctgaacggagaggtcgttgaagggactactaaccaccgcaagatattccaatataaagtcccgtacggtactgtagttgcccttactccgtggaatttcccagcaggtatggttgcgaggaagcttgctccggcactcctcacaggcaatacggtcatattgaagccaagcagtgatacaccaggaagcgctgaatggatagtgaaaaagtttatccaggctggcgttccaaagggcgctctcaattatataacaggcaggggttcggttatcggtgattatatagtagagcataagaaagttgcattaatcaccatgactggctctaccagcaccggccaaaggataatgcagaaagcttctgctaacatggcaaaacttatgctcgaattgggaggaaaggccccctttatggtttggaaggacgccgacataaacaatgcgcttaaaaccctgctctgggcaaagtactggaacgccggccagtcctgcatagcggcggaaaggctctacgtacacgaggatatatacgacacgttcattaacaagttcgtggaactgagcaagaagattgtagtcggcgacccgtcaagggcagacatgggcccgttgataaatactactgcattgaagggaacagaagaggtcgttgaagaggctaaagaaagcggtgcacgcatactatatggcggatccaaacccgatctttctggtccatacaagaatggatacttcttcctgcctacgataattgacaatgtcgatcagaaatcaaagatattccaggaggagatatttgcaccagtaataggcgcaagaaaggtgtctgacgtagaggaaatgtacagccttgccaatgattccaagtacgggcttgcatcgtacttgtttactaaagatccgaaccttatattcgaagccgcagaacgcataaggtttggcgaactctacataaacatgccaggcccagaggcatcgcaaggataccacacaggtttcaggcttactggtcaagcaggggaaggaagcagatacggcatacttgagtaccttaaaataaagaacatatacgtagactactcaggaaagccgttgcaaataaatactgtaagagatgatctatttcagtaa

SEQ ID NO: 12653 - protein, 493 aa, Thermoplasma volcanium
MDGKLYIDGQWVDSSNGDTLTKYNPVTGEVIGKFAAASRDDVDRAFDAAEDAFQKWMDLGSVERSKIIYKAKELIEENRKELENIIIQENGKPVKEAAEEVDGVLDQMQYYAEWARKLNGEVVEGTTNHRKIFQYKVPYGTVVALTPWNFPAGMVARKLAPALLTGNTVILKPSSDTPGSAEWIVKKFIQAGVPKGALNYITGRGSVIGDYIVEHKKVALITMTGSTSTGQRIMQKASANMAKLMLELGGKAPFMVWKDADINNALKTLLWAKYWNAGQSCIAAERLYVHEDIYDTFINKFVELSKKIVVGDPSRADMGPLINTTALKGTEEVVEEAKESGARILYGGSKPDLSGPYKNGYFFLPTIIDNVDQKSKIFQEEIFAPVIGARKVSDVEEMYSLANDSKYGLASYLFTKDPNLIFEAAERIRFGELYINMPGPEASQGYHTGFRLTGQAGEGSRYGILEYLKIKNIYVDYSGKPLQINTVRDDLFQ

SEQ ID NO: 12654 - DNA, 1548 bp, Thermoplasma volcanium
  CDS (1)..(1548)
atgccatttgaaaatgagaatacttatctccgtatgtcggaggcaggaaaagaggcggagtttcataggttatacgaagaaagcctgaaagaaatagaggcgtatttcaataaggagtatccaaacataatagatggcgatgttatagagtctaagaaaataaaggatataagcccaattgatgggaaggagatagccactttccaactagcatcggattcatccgtagataaagctgttgatatgctgtacaaatcttacaaggcatggtacagcctggggtatatgaaaagggccttgatattcctaaaggccgcagatatgctaagtgaacagaagtttaagtttgcagctatacttacttatgaaaacgggaagaacagatacgaagctattggagatgtggatgaagcaatagactttatgagatattatgccatgaatttgatagaaaaccagggtttcataaggttcacaggaaaagcctataggaatgaagaatccataagcattatgaagccgtacggggtatttggcgttatctctccattcaacttcttttccatcggagtaggcatgagctcagctcccttggtgaccggcaacgccgttatactgaaaccttcaagtgatatacctctctccctctatctctgggttagattgatgcatgaggcaggcgtcccgaagaatgtgttagcgtttgtatcaggttcaggcggcctagtaggaaggcatatagttgagaacaagaaggttgcaggcatcgtgtttactgggtcgagggatgtgggtctggacatccagaggaaatccatagacaacggcccgaaggtagtcataactgaaatggggggaaaagatgctataatagtttccaacaaagccgatatggacaaggctgtggaaggtgttgttagagccgcatttgggtttgctgggcaaaagtgcagtgcttgttcactactttacgtacataaggacatatatgatgaatttatgaagaggctcaaggcaaggacagaggccattaagccagacgatccaaggaagaaggatacattcctcaatcctataataaataaggaagcttacgataagttcataaaattaaagcctgaattcaacaagggcaagatacttacgggcggccacgaacttaacaaacctggcttctatgtagaaccaacaatagtgacggatctgccgaaggatgcatacatagcaaggaatgagatattccttcctgttctcagcgtgttcaagtgcaatagcatagaagaagctgtagatgatatcaacagcatggactacgggctcaccggaggtatattcacggaagacccgaaggagatacagtattacttcgacaatatagaggttggggtaatctacgctaacagaaagagtggcggttccactggatcaatggttggatcgcagccttttgttgggtggaaactgagtggcgtatccggcaaaggaacaggatcattctactatctacagcagttcctgagagaacagtcgcagactatagcccactga

SEQ ID NO: 12655 - protein, 515 aa, Thermoplasma volcanium
MPFENENTYLRMSEAGKEAEFHRLYEESLKEIEAYFNKEYPNIIDGDVIESKKIKDISPIDGKEIATFQLASDSSVDKAVDMLYKSYKAWYSLGYMKRALIFLKAADMLSEQKFKFAAILTYENGKNRYEAIGDVDEAIDFMRYYAMNLIENQGFIRFTGKAYRNEESISIMKPYGVFGVISPFNFFSIGVGMSSAPLVTGNAVILKPSSDIPLSLYLWVRLMHEAGVPKNVLAFVSGSGGLVGRHIVENKKVAGIVFTGSRDVGLDIQRKSIDNGPKVVITEMGGKDAIIVSNKADMDKAVEGVVRAAFGFAGQKCSACSLLYVHKDIYDEFMKRLKARTEAIKPDDPRKKDTFLNPIINKEAYDKFIKLKPEFNKGKILTGGHELNKPGFYVEPTIVTDLPKDAYIARNEIFLPVLSVFKCNSIEEAVDDINSMDYGLTGGIFTEDPKEIQYYFDNIEVGVIYANRKSGGSTGSMVGSQPFVGWKLSGVSGKGTGSFYYLQQFLREQSQTIAH

SEQ ID NO: 12656 - DNA, 3654 bp, Rhizobium loti
  CDS (1)..(3654)
atgaccgccggcccgctccctgacgctcgctccacgggacccgccatgccgctcgacaccatccgccagcagatccgcgccaactatctgcccgacgaagatgaggccgtgaaacgattggccgaggcgacagggctttcggctgcggatcgcgacgcgatctcggcgcgagccgccgatctggtgcgggcggtgcgcggctcgtccgatccccggctgatggaggttttcctctcggcctacggcctttccaccaaggagggcgtggcgctgatgtgcctggccgaggcgctgctgcgcgtgcccgacaccgagacgatggacgatctcatcgccgacaagatcgcgccgcatgactggtcggcgcattcgggtggttcgagctcgatcttcgtcaacgcctcgacctgggcgctgatgctgaccggccgcgtgctggacgagggcgagggcggtatcgaaggcacgttgcgctccatggtgcgcaggctgggcgagccggtcatccgcaaggcggtggccgccgccatgcgcgagatgggcgaacagttcgtgctcggccgcaccattgcagaagccgtcaagcgcggccggccgatgacacagaagggctacctctattccttcgacatgctgggcgaggcggcccgcaccgaggccgatgcactgcgctaccacaaggcctatgccgacgcgatttcgtcgctcgatgccggctccaatggtcccgacatcaggcaaaaccacggcatctcggtcaagctttcggcgctgcatccgcgctacgaagtggcgcagaaggaagagatgctgcctgtcatggccgagcggctgctgtcgctggcgcttgcggccagacattcgcgcatgggtctcaacatcgacgccgaggaggccgatcgcttggatctgtcgctcgacgtcatcgagcgcgtgctggccgagccggaactcgccggctggaacggctttggcgtggtcgtgcaagcgtatgggccgcgcgcggccttcgtcatcgactggctctatgctctggccaggaaatacgaccgcaccatcatggtgcggctggtcaagggcgcctattgggacaccgagatcaagcgggcgcagacgctcggacttgccggctatcccgtcttcacccgcaaggccaacaccgacgtttcctacatggcttgcgcgaagaaactgcttggcatgaccgaccgcatctatccgcaattcgccacccacaacgcccacaccgtcgcggccatcctgtcgatggccacgaaccgcgattccttcgaattccagcgcctgcatggcatgggcgaggcgttgcacgagacggtgcgccaggccgaaggcacgcgctgccgcatctatgcgccagtcggcgcgcattcggacctgctggcctatctggtccgccggctgctcgagaacggcgccaactcctccttcgtgcaccaactgaccgacgaggatgtcgagccggaagacatcgcgcgcgatccgctcgaaacggtcgaaagccaaggccctgccgccaatccggcgattgccaggccgtcgcagatttttggcgcaggccgccgcaattccagaggtttcgacatcaccgacacggtgacgctggcggccatcgacaaggccagggcggcgttcgccgggccggaccgctggcatgccaagccgatcacgcgggccgccggctatggcaagccgcacccggtcgtcaatccggccaagcccgatgaagtggtcgggacggttcacgaggccgccgccaagcaggtcgcgatcgccgtgcgcatcgcggtggaggcgcagccggcctgggcgaagcgtcccgttggcgaacgcgccgccatcctcaaccgcgccgccgatctctatgaagccaatgcggtcgagttcttcgcgctcgccacccgcgaggccggcaaatcgctggccgatggtgtggcggaagtgcgcgaggccgtcgacttcctgcgctactacgccgccgaggcggcaaacgccgagacgggcacgcaggcgcgcggcgcgatcgtctgtatttcgccgtggaatttcccgttggcgatcttcaccggccagatcgcggcagcactcgttaccggcaattcggtcatcgccaagccggccgaacagacaccgctgattgccttccgcgccgtcgagttgctgcgcgaggccggcgtgccggaagacatcatccaactgctgcccggcgacggcccatcggtcggcggaccgctgaccgccgacccacgcattgccggcgtctgcttcaccggctcgaccgaagtcgccaagctgatcgagaaacagctggccgagaccgcggcacccgacgccatgctgatcgccgagaccggtggtttgaacgccatgatcgtcgattccaccgcgctgcccgagcaggcggtgcgcgatatactggcctctgccttccagagtgccggccagcgctgctcggcgctgcgcgtgctctacgtgcagaaggacgtcgagaagaagatgctggacatgctgaagggcgccatggaggcgctcaacatcggggatccctggcggatttcgactgatgtcggtccggtcatcgatgatgaggcgcaggcctctatccgtgactattgcaccaggaaaggtctcgaggggcggctgatcgccaagctcgaggcgccgaaggacgggcgcttcgtcgcgccgcatgtcttccgggtcaagggcatcgaggagatggagcgcgaagtgttcgggccggtgctgcacgtcgccagcttcgacgccgatgagatcgatgctgtcatcgctgccatcaaccgcaagggctatggcctgaccttcggcctgcacacccgcatcgaaggtcgcgtccagcatttcgtcgacggcatccatgctggcaacatctacgtcaaccgcaaccagatcggcgccgtggtcggttcccagccctttggcggcgaggggctttccggcaccgggccgaaggctggcggcccgcattatctgcgccgcttccgcaaggggccggaagccggcacagaggttggcgagggccacaaggtgacggcgaccgaactggccgacaatctgcccgatccggccctcggcggctggtcgacgcgcccggaccggatcgccatcctgaggaagcatctgcgcggcaagggcgctgccgccatcggcgctgccgctgcaatcgatttcggccaggtcgacctgcccggcccgaccggcgaggccaatacgctgtcgctgtcgccgcgcgggcgggtgttgtgcctggggccggatgccgagacgctgctcgcccagaccatccaggcgctcgccgccggcaatgcagtgctggccgtggcccctggggcgccggccgccttgtcggcgctgaccggcaagggcttgccgctcgcggcgatagatggccgccccgatccggtcgaggcgcgcgcgctgcgcgtcgatgtcgtcgctttctcgggtacgccggaggccgcgcgcatcgtgcgccaggtgatcgccgacaggaccggcccgatcgtgccgctggtcagcgaggtgctcaatccggccgcctatgcgcatgagcgcgcggtctgtgtcgacaccacggccgcgggcggcaatgccagcctgcttgccgcggcctag

SEQ ID NO: 12657 - protein, 1217 aa, Rhizobium loti
MTAGPLPDARSTGPAMPLDTIRQQIRANYLPDEDEAVKRLAEATGLSAADRDAISARAADLVRAVRGSSDPRLMEVFLSAYGLSTKEGVALMCLAEALLRVPDTETMDDLIADKIAPHDWSAHSGGSSSIFVNASTWALMLTGRVLDEGEGGIEGTLRSMVRRLGEPVIRKAVAAAMREMGEQFVLGRTIAEAVKRGRPMTQKGYLYSFDMLGEAARTEADALRYHKAYADAISSLDAGSNGPDIRQNHGISVKLSALHPRYEVAQKEEMLPVMAERLLSLALAARHSRMGLNIDAEEADRLDLSLDVIERVLAEPELAGWNGFGVVVQAYGPRAAFVIDWLYALARKYDRTIMVRLVKGAYWDTEIKRAQTLGLAGYPVFTRKANTDVSYMACAKKLLGMTDRIYPQFATHNAHTVAAILSMATNRDSFEFQRLHGMGEALHETVRQAEGTRCRIYAPVGAHSDLLAYLVRRLLENGANSSFVHQLTDEDVEPEDIARDPLETVESQGPAANPAIARPSQIFGAGRRNSRGFDITDTVTLAAIDKARAAFAGPDRWHAKPITRAAGYGKPHPVVNPAKPDEVVGTVHEAAAKQVAIAVRIAVEAQPAWAKRPVGERAAILNRAADLYEANAVEFFALATREAGKSLADGVAEVREAVDFLRYYAAEAANAETGTQARGAIVCISPWNFPLAIFTGQIAAALVTGNSVIAKPAEQTPLIAFRAVELLREAGVPEDIIQLLPGDGPSVGGPLTADPRIAGVCFTGSTEVAKLIEKQLAETAAPDAMLIAETGGLNAMIVDSTALPEQAVRDILASAFQSAGQRCSALRVLYVQKDVEKKMLDMLKGAMEALNIGDPWRISTDVGPVIDDEAQASIRDYCTRKGLEGRLIAKLEAPKDGRFVAPHVFRVKGIEEMEREVFGPVLHVASFDADEIDAVIAAINRKGYGLTFGLHTRIEGRVQHFVDGIHAGNIYVNRNQIGAVVGSQPFGGEGLSGTGPKAGGPHYLRRFRKGPEAGTEVGEGHKVTATELADNLPDPALGGWSTRPDRIAILRKHLRGKGAAAIGAAAAIDFGQVDLPGPTGEANTLSLSPRGRVLCLGPDAETLLAQTIQALAAGNAVLAVAPGAPAALSALTGKGLPLAAIDGRPDPVEARALRVDVVAFSGTPEAARIVRQVIADRTGPIVPLVSEVLNPAAYAHERAVCVDTTAAGGNASLLAAA

SEQ ID NO: 12658 - DNA, 3597 bp, Pasteurella multocida
  CDS (1)..(3597)
atgacataccaattacttcccaaattaacttcattacgagaaccattaagccaacattatcgtattgacgaaaccacgttagtgcaaaaacttctctccgacgcagaaattccttccgatctccaaaccaaaattcaacagctagccagaaaattggtcgaaaatgtacgcaacgctcgccaaaatgcaagtggggtagatgccttaatgcatgagttttcattatcgagtcaagaaggtgtcgccttaatgtgcttagctgaagcattattgcgtattcctgataaagccactgcagataaattgattcgcgataaaatttcaaaagggaactggcgttcgcatatcggacagagtccgtctatgtttgtgaatgccgccgcttggggtttattgattaccggtaaattagtttcgacacacagtgaacaacagctttcatccagtttaaccaaattgattgcgaaaggcggagaaccattgattcgtaaaggtgtggaagtggcaatgcgcttattaggtaaacaatttgtcactggggaaacgatcgaacaagcgattaaaaacggtgaaaaacgtttccaacaaggttttcgttatagctatgatatgttgggcgaagctgccttaacggaagaagatgccgcacgttattatcaagactatgtggattccattcatgcggtggggcaacgttcttctgggcttggcgtttatgccgcctctggtgtctcgatcaaactctctgctattcatcctcgttacagtctatcacaacaccaacgtgtgatagacgaactgtatcccaaggtcaaacaactctttttattagcgaagcaatatgacattggtctgaatattgatgctgaagaagcggacagattagacatttctttggatttagtcgatcgtttattagctgatcctgatttagcacattttaacggtatcggtttggtggtacaggcataccaaaaacgttgtacttttgtcattgactatttaattgaacaagcccgcaaacatcaacataaaattatggtacgtttagtgaaaggggcttattgggacagcgaaattaaacgtgcgcaaaccgatggtgccgaaggttaccctgtctttacgcggaaagtgcatacagacgtgtcttacattgcttgtgcgaaaaaattattagcggcacaagatgtgatttatccacaatttgccacccataacgcgcaatctttggcgacggtctatcatttagcacaaggtaaacaatttgaattccaatgcttacacggcatgggcgaaaccttatatgatcaagtggtgggaaaacacaatttgaatgtgcaatgccgtatttatgcgcctgtcggttcatataaaaccctgttggcttatttagtgcgccgcttattagaaaatggggcaaatagctcgtttgtgaatcacattgtcgatgactcaatccccgttgaagccttaatccttgatccagtgcaaaaagcgaaagaaaccgaagggacaatgcaccctaaaacaccattgcctcgcgatctctttgctggaaagcgtgtaaattctaaaggttacgatttaaccgatgcgttgcagttacaacagttacaaaatgcattaactgaactgagtcaaaatgaatatgaagcctatcctttattagaaaataccactgcaccaaccggtaaaccgcgtcttgtatttaaccctgcaaaacgtgcaatgctagttggtaaagtgattgacgccagagaagaagatgtcgaacaggcatttgaaaatgcgcttcgtcataaagacaactgggccaatacaccggtagaacaaagagcggtcattttagaaaaaatggcagatttaatggaacaacacatgccgcagttatttgatttagcggtacgtgaagccggcaaaaccttaaataacgccattgccgaagtgcgtgaggcggtggatttttgtcgctattatgcacaagaagcacgtaaactcggcaatgagaatccaccacgtggtattgtggtggcaattagcccttggaatttccctttagccatttttattggcgaagtttgttctgccttagtcacaggtaatgtggtgattgccaaaccagcagaacaaacctcattaatggcgcattttgcggtgaagttgtttcaacaagcgggcttaccgattggtgtgttgcaatgtttatgtggtgcaggaaaagtgattggtgaaaaattagtctctgacgcccgtgttgatggcgtcatttttaccggttcaacagataccgccaaacgcattaatcaaaatttagcaaaacacaacaaacttattccattgattgccgaaacaggcggacaaaatgcaatgattgtggacagttcagccttagcagaacaagtcgtgcttgatgtactcaattccgcgtttgactcagcagggcaacgttgttctgcattacgtgtgctttatgtgcaacacgatgtcgcaccgcatattttaactatgttaaaaggggcaatggcagagttaaaagtcggcaatccacaacacttaaccactgatgtgggacccgtgattgatgaaatggcacaaaaacgcttattacaacatattgaaaccatgcgaacagtggcaaaagattgctatcaagtgccagttgatccagaaatgcaacaacagggaatttttgtcccaccgactttatttgaactcgaaaatcttcatcatttgaaacacgaagtgttcggtcccgtgttacatgtggttcgttttcatgcttcagaatttaatcaagttattgcacaaatcaattctaccggctttggcttaaccagtggcatacacagtcgtattgatgaaagcattaatcactggcttgaacaggttcacgcggggaatctgtacgtgaatcgtaatactgtcggtgcagtcgtgggggtacaagcctttggtggaagaggtttatctggaacaggaccgaaagcgggaggaccgttctatttgcaacgtttagtccatgcaaaacattgggcattaacgccattgcattacaatacgccgcgtgatttatctgatttagcggcaaaagtgcggtcaattttcactaaatctgaacaagctcctttactctcgcttattgatcaagttgcgcaatgttcgccactaaatacgacctttagaatgcaagggattactggggaagagaattatcttacctttacaccacgttcgttgattgccattgggaatggaccattagcacaacaaatgcaagcgttgattgccgtcgccgcagtgggcgcaactgccgtaatcagtaaatattctcaacttgcggcttatgaaaaacgcttagcggattatctgtttgttgctgaagtggaagaatgcgaggaaataagccagttgattgttctcgatccgataacggccaagcaaaaagcccaatatgccgaccgtccaggcgcgatcttgacctatgtggagcagctagatttagcgttgtccttgttcccattactgcatgaacaagcgatcagcattaacaccacagcagcaggaggtaatgcaagtttaatggcagaaatggattaa

SEQ ID NO: 12659 - protein, 1198 aa, Pasteurella multocida
MTYQLLPKLTSLREPLSQHYRIDETTLVQKLLSDAEIPSDLQTKIQQLARKLVENVRNARQNASGVDALMHEFSLSSQEGVALMCLAEALLRIPDKATADKLIRDKISKGNWRSHIGQSPSMFVNAAAWGLLITGKLVSTHSEQQLSSSLTKLIAKGGEPLIRKGVEVAMRLLGKQFVTGETIEQAIKNGEKRFQQGFRYSYDMLGEAALTEEDAARYYQDYVDSIHAVGQRSSGLGVYAASGVSIKLSAIHPRYSLSQHQRVIDELYPKVKQLFLLAKQYDIGLNIDAEEADRLDISLDLVDRLLADPDLAHFNGIGLVVQAYQKRCTFVIDYLIEQARKHQHKIMVRLVKGAYWDSEIKRAQTDGAEGYPVFTRKVHTDVSYIACAKKLLAAQDVIYPQFATHNAQSLATVYHLAQGKQFEFQCLHGMGETLYDQVVGKHNLNVQCRIYAPVGSYKTLLAYLVRRLLENGANSSFVNHIVDDSIPVEALILDPVQKAKETEGTMHPKTPLPRDLFAGKRVNSKGYDLTDALQLQQLQNALTELSQNEYEAYPLLENTTAPTGKPRLVFNPAKRAMLVGKVIDAREEDVEQAFENALRHKDNWANTPVEQRAVILEKMADLMEQHMPQLFDLAVREAGKTLNNAIAEVREAVDFCRYYAQEARKLGNENPPRGIVVAISPWNFPLAIFIGEVCSALVTGNVVIAKPAEQTSLMAHFAVKLFQQAGLPIGVLQCLCGAGKVIGEKLVSDARVDGVIFTGSTDTAKRINQNLAKHNKLIPLIAETGGQNAMIVDSSALAEQVVLDVLNSAFDSAGQRCSALRVLYVQHDVAPHILTMLKGAMAELKVGNPQHLTTDVGPVIDEMAQKRLLQHIETMRTVAKDCYQVPVDPEMQQQGIFVPPTLFELENLHHLKHEVFGPVLHVVRFHASEFNQVIAQINSTGFGLTSGIHSRIDESINHWLEQVHAGNLYVNRNTVGAVVGVQAFGGRGLSGTGPKAGGPFYLQRLVHAKHWALTPLHYNTPRDLSDLAAKVRSIFTKSEQAPLLSLIDQVAQCSPLNTTFRMQGITGEENYLTFTPRSLIAIGNGPLAQQMQALIAVAAVGATAVISKYSQLAAYEKRLADYLFVAEVEECEEISQLIVLDPITAKQKAQYADRPGAILTYVEQLDLALSLFPLLHEQAISINTTAAGGNASLMAEMD

SEQ ID NO: 12660 - DNA, 2967 bp, Gamma
  CDS (1)..(2967)
atgacccttcgatttcaaaaaatgctcaataaaataattgatgcttgcagagagaataagagcgagagaacaaaactagatgcatttctaagcgaatatgggctagataataaagaaggtgttgctctgatgtgtttagccgaatcaatactaagaatcccagacaaaaaaacaagggatctaataatatctgagaagttatctgagggtgcgtggatagagcatttaaacaaagcggatagtgttttcgttaatgcatcaacatggggtcttcttcttgcaggcaaggtagtttctacacccgatgagtggaccaaaaacccaagcgccctattaagttctttaatctcaaaatctggcgagtttccaattagaaatgctgtagttggtgccatgcatattctcagtcaagaatttgttatgggcagagattttgatgacataaaaaaaattaagaatatagaaaatgaaatttattcatttgacatgcttggagaggcagcaagaaacgctgaacaagccgacacttattatcagtcttataagaatgctatagatgaagtcggcaagataaatctgacaaaaaatacaattaatggtgtctcaataaaaatatcagctttatctcctagatatgaaatgaaaaagctaaaagacataaagtctgatctacttccaaaacttattcagctcacagagtatgcaaagtctaaagatgtagaaattacaatcgatgctgaggagcaagacagactggccgttagtttagagattattaaagagatggccctttcaccaaatattaaaaactggaaaggatttggtattgctgttcaggcatatggcaaaagagctatagccacaatagattggttagaagagctactagaaaacagagcacctatgcatgttcggctcgtaaaaggagcatattgggattatgaaattaagcatgctcaaatctatggctatgatggttatcctgtctatacaaaaaaatctgttacagacttagcttatttagcctgtgcaaaaagaatttttaatgtggaaaaaatttaccctaaatttgctacacataatgcacataccatttctgcaatccatcatcttggctcaaataaggattatgaatttcaaagactatttggaatgggagagctgctttataagtccgcaaacaaaatcttaaatactgaaaaaaatacctcaatttatgcgccgattggcaaatataaagacttgctaccctatcttgtaagaagactattagaaaatggagcaaacagctcatttattaataggttacttgatcctgaaacagattctgcttggcttgccagagggccccatttaaaaattgaggatgaaaaaaaagagataccaatgccaagaaatatatttaatgacagaccgaactctaaaggatttgatttaagtgaaagggtgaatttagaaatgcttgaagaggagcttggaaagtttgattcaaaagaaataaaggcttcatcgatttataaagcaaaggattataagaaaaccaatactcatgacatctcatctcttgcagatggaagaaatattggtacagcctcatatgatgatctagattatataaagggcagccttgaagaacaaaatattagtgaatggtctttgatgcatgttgaaaaaagagcatccattttagaaaaaattgcagacgacattgaagcaaatccttctgagctaatttattaccttatgaatgaagccggaaaaacagtacaaaatactattgatgaaattagagaagctatagattttctcagatactatgcaaaacaagctgttggcctccaaacagaagaccatattcttgagggtcccaccggcgagatcaatgccctatcttactcaccaaaaggccatattttatgtattagtccatggaactttcctgttgcaatacttatagggcaaataagtgcagcccttgcatgtggaaataaagtaacagttaagccctcagaacatacttcaattcttggctacatcattgtgaacaaatttcatgagattggggtcccaaaagatgctttaaatttaatcctaggagacggcattcatggtgacatgctttcaaaggttaataacatcaaaggggttgcattcaccgggtctttaaaaacagcaaaaaaaattcaaagcagccttgcaagtaaccatgaatcaattattcctttgattgcagagacaggaggcataaattcaatgattgttgattcaagcgcacttctcgagcaagcaaccgatgatattattcgttcagcatttgatagctctggacagcgatgctctgccttgagagttctctgtgtacaagacgaaatatatgacgatcttttatcaatgattaagggtggtatgaaagaactaaaaattggaaaccctcaaaatcttgacacagatatcggtccaataattagcaaaacatctcttgatagtctcaatgcttacgtcaaaggttttgaagataagaattattctatttttaggtctgctgataatgtagatgaaaattttgtagctccaacaataattgagattgataatatttctgatctaaaagacgagcaatttggaccaatacttcatatcgttagatttaaatcaaatgaaatggatgcactaattgaaaatattaatgatagtggcttcggccttacaatgggtattcatactagagtagaaaaaagggccgacatatttagtgacaagtgtaatgttggaaatatttacataaatagagatatggtgggagctgttgttggttctcagccttttggtggacaaaatctatccggcagcggttataaggctggtgggcctaattaccttctgcaatttcttaacgaaaaggttgtctcaaagaactcggtagcatttggtggcaacactgaactcttaaatattcaagaggactaa

SEQ ID NO: 12661 - protein, 988 aa, Gamma
MTLRFQKMLNKIIDACRENKSERTKLDAFLSEYGLDNKEGVALMCLAESILRIPDKKTRDLIISEKLSEGAWIEHLNKADSVFVNASTWGLLLAGKVVSTPDEWTKNPSALLSSLISKSGEFPIRNAVVGAMHILSQEFVMGRDFDDIKKIKNIENEIYSFDMLGEAARNAEQADTYYQSYKNAIDEVGKINLTKNTINGVSIKISALSPRYEMKKLKDIKSDLLPKLIQLTEYAKSKDVEITIDAEEQDRLAVSLEIIKEMALSPNIKNWKGFGIAVQAYGKRAIATIDWLEELLENRAPMHVRLVKGAYWDYEIKHAQIYGYDGYPVYTKKSVTDLAYLACAKRIFNVEKIYPKFATHNAHTISAIHHLGSNKDYEFQRLFGMGELLYKSANKILNTEKNTSIYAPIGKYKDLLPYLVRRLLENGANSSFINRLLDPETDSAWLARGPHLKIEDEKKEIPMPRNIFNDRPNSKGFDLSERVNLEMLEEELGKFDSKEIKASSIYKAKDYKKTNTHDISSLADGRNIGTASYDDLDYIKGSLEEQNISEWSLMHVEKRASILEKIADDIEANPSELIYYLMNEAGKTVQNTIDEIREAIDFLRYYAKQAVGLQTEDHILEGPTGEINALSYSPKGHILCISPWNFPVAILIGQISAALACGNKVTVKPSEHTSILGYIIVNKFHEIGVPKDALNLILGDGIHGDMLSKVNNIKGVAFTGSLKTAKKIQSSLASNHESIIPLIAETGGINSMIVDSSALLEQATDDIIRSAFDSSGQRCSALRVLCVQDEIYDDLLSMIKGGMKELKIGNPQNLDTDIGPIISKTSLDSLNAYVKGFEDKNYSIFRSADNVDENFVAPTIIEIDNISDLKDEQFGPILHIVRFKSNEMDALIENINDSGFGLTMGIHTRVEKRADIFSDKCNVGNIYINRDMVGAVVGSQPFGGQNLSGSGYKAGGPNYLLQFLNEKVVSKNSVAFGGNTELLNIQED

SEQ ID NO: 12662 - DNA, 1482 bp, Thermoplasma acidophilum
  CDS (1)..(1482)
atggatacgaagttatacatagatggacagtgggttaattcttcttccggaaagactgtcgacaagtacagcccggtgactggacaggtcatcggaaggtttgaggcggcgaccagagatgatgttgacagggccatagatgctgcggaggatgcattctgggcctggaacgatcttggttcggtggagagatcgaagataatttacagggcaaaggaactgatagagaagaacagggcggaacttgagaacataataatggaggagaacggaaagccggtaaaggaggccaaggaggaggtcgacggcgtcatagaccagatacagtactacgcggaatgggcgaggaagctcaacggcgaggtcgtcgaaggaacgtcgtcccacaggaaaatattccagtacaaggttccttacggcatagtcgttgcgctgacgccctggaatttcccggccggtatggttgcgaggaagctggctcctgcgctgttgacaggaaacaccgttgttctgaagccgagcagcgatacgcccggaagcgcagagtggatcgtgcgcaagttcgtcgaagccggcgtaccgaagggcgttttgaacttcatcaccggaaggggatcagagattggcgattacatagtcgaacacaaaaaggtaaacctaataacgatgaccggttcaaccgcaaccggccagaggataatgcagaaagcatcagccaacatggcaaagctcatactcgagctgggcggaaaggcgccgtttatggtgtggaaggacgcagacatggacaatgcactgaagaccctgctgtgggcgaagtactggaacgcgggccagtcttgcatagcggctgagcgcctctacgtgcacgaagacatctacgacacattcatgagcaggttcgtggaactgagcaggaagctcgcactgggcgatccgaagaacgctgacatgggcccgcttataaacaaaggcgcgctccaggccacatccgagatcgttgaagaggcaaaggagagcggtgcaaagatactgttcggcggaagccagccaagcctcagcggaccgtacaggaacggctacttcttcctgccgaccataataggcaacgcagaccagaaatcgaagatattccaggaggaaatattcgcaccagtcataggcgccaggaagatatccagcgttgaggaaatgtacgatctggccaacgattcaaagtacggcctggcatcgtacctgttcacgaaggacccgaacataatattcgaggcttcagagaggataaggttcggcgaactttacgttaacatgcctggtccggaggcctcgcagggataccacacaggcttccgcatgaccggacaggcaggagaggggagcaagtacggaatatccgaatacctgaagctgaagaacatctacgttgattactccggaaagcccctgcacataaacaccgtgagggacgatctgtttcagtga

SEQ ID NO: 12663 - protein, 493 aa, Thermoplasma acidophilum
MDTKLYIDGQWVNSSSGKTVDKYSPVTGQVIGRFEAATRDDVDRAIDAAEDAFWAWNDLGSVERSKIIYRAKELIEKNRAELENIIMEENGKPVKEAKEEVDGVIDQIQYYAEWARKLNGEVVEGTSSHRKIFQYKVPYGIVVALTPWNFPAGMVARKLAPALLTGNTVVLKPSSDTPGSAEWIVRKFVEAGVPKGVLNFITGRGSEIGDYIVEHKKVNLITMTGSTATGQRIMQKASANMAKLILELGGKAPFMVWKDADMDNALKTLLWAKYWNAGQSCIAAERLYVHEDIYDTFMSRFVELSRKLALGDPKNADMGPLINKGALQATSEIVEEAKESGAKILFGGSQPSLSGPYRNGYFFLPTIIGNADQKSKIFQEEIFAPVIGARKISSVEEMYDLANDSKYGLASYLFTKDPNIIFEASERIRFGELYVNMPGPEASQGYHTGFRMTGQAGEGSKYGISEYLKLKNIYVDYSGKPLHINTVRDDLFQ

SEQ ID NO: 12664 - DNA, 1548 bp, Thermoplasma acidophilum
  CDS (1)..(1548)
atgccattcgaaaatgaaaacacatatgtcaggatggtagaagccggcaaagaggatgaattccacagaaagtatgaggaagcgctcaaagaggtggaatcctatttccacaaggaatatccgaatataataaaggaagacattgttgagagcaaaaagataaaggatataagcccaatagatggcagtgagatagcgactttccaattggcatcggatgaatccgttaacaaagccgtggacatgctctatcggtcatacaagaactggtacaatataggatacatgaagcgcgccctaactttcctgaaagcagcaggcatgctcagcgatcagaagttcaagttcgctgccatacttacgtacgaaaacggaaagaatagatatgaagccattggtgatgtggatgaagccatagacttcatgcgttattacgcaatcaacctcatagaaaatcagggcttcataaaattaacgggcaaagcctacaagaatgaggaatcgatgagtgtgatgaaaccctatggcgtgtttggcgtcatatctccattcaacttcttctcgatcggcgtcggcatgagttcaggcccactcgtcacgggcaatgcagtcatattgaagccgagcagcgatataccgctttcgctgtacctatgggttcgcctgatgcacgatgcgggcgttccgaaagaggtactggcctacgtttcaggttcaggtagcgttgtaggaaagcacatagtcgagaacaagaaggttgcgggaatagtattcacaggatctagggaagtcggtctagacatccagagaaggtctatcgacaatggaccaaaggtcgtcataacagagatgggaggcaaggatgccataatcgtgtccaacaaggctgatctgaacaaagctgtggaaggagttgcaagagcagcctttggattcgctggccagaaatgcagcgcatgctcattgctctatgttcacaaggacgtgtatgatgagttcatgaagcgcctcaaggaaagaaccgaccagataaagccagatgacccaaggaagaaggagacatttctcaacccggtcataaacaaggaggcatacgagaaattcatcaagctgaagcctgaatacaacaagggtaagatactcactggaggacatgaactgaagaggcctggattctacgttgaaccaacaatagtgacggatctgcccaaagatgcctatattgcacggaatgagatcttcctgccggtgctgagtgtgttcaaatgcaacagcatacaggaagccatagaagatataaacagcatggattatgggctcacaggaggcatattcactgaagacccgaatgagatacagtactatttcgacaacgtagaggtaggcgttctctacgcaaacaggaagagcggaggttccaccggttcaatggttggttcgcagcccttcgttggctggaaactcagcggtgtttcaggaaagggaaccggttcgttctactacctgatgcagttcctgagagaacagtcacagacaatagcacattga

SEQ ID NO: 12665 - protein, 515 aa, Thermoplasma acidophilum
MPFENENTYVRMVEAGKEDEFHRKYEEALKEVESYFHKEYPNIIKEDIVESKKIKDISPIDGSEIATFQLASDESVNKAVDMLYRSYKNWYNIGYMKRALTFLKAAGMLSDQKFKFAAILTYENGKNRYEAIGDVDEAIDFMRYYAINLIENQGFIKLTGKAYKNEESMSVMKPYGVFGVISPFNFFSIGVGMSSGPLVTGNAVILKPSSDIPLSLYLWVRLMHDAGVPKEVLAYVSGSGSVVGKHIVENKKVAGIVFTGSREVGLDIQRRSIDNGPKVVITEMGGKDAIIVSNKADLNKAVEGVARAAFGFAGQKCSACSLLYVHKDVYDEFMKRLKERTDQIKPDDPRKKETFLNPVINKEAYEKFIKLKPEYNKGKILTGGHELKRPGFYVEPTIVTDLPKDAYIARNEIFLPVLSVFKCNSIQEAIEDINSMDYGLTGGIFTEDPNEIQYYFDNVEVGVLYANRKSGGSTGSMVGSQPFVGWKLSGVSGKGTGSFYYLMQFLREQSQTIAH

SEQ ID NO: 12666 - DNA, 1683 bp, Leishmania major
  CDS (1)..(1683)
atgctacgccgcaccgtgtcctgtgcctttgcggccttcaagtgcccgcctgtgctgaatgagcccatggacaacttcgagccgggctctgtctccgcgaaggggacgctggaagcctgcaaggaagctcgcggggaggtgcgggagtgcccaatcatgattggcggcaagccgtacacctcctcgaacatcatcaaggccactatgccctcggatcaccaggtgcagattgccaaggcctacaacgcgacgccggagctcgcgaagaaggctgtggaggcggctgtggaggcctccaaggagtggagtcaggtgcccttccgcgaccgcgcggccatcttctacaaggcggcacacctcctgtcaaccaaataccgccacgagatgcgcgccgtgacgatgctgggccagagcaagaacccgtggcaagcggagatcgactgcgtcgccgaggcctgtgacttcatccgctggaacattcactttgccgaggagctgtacgcgcagcagccgcgctccgtctcgaacagtggcgtgtggaatacgacggactaccgcccactcgaggggtttgtgtcggccatcacgcccttcaacttcactgccatcgccgcgaacctcgctggcacgccggcgctgatgggcaacacggtggtctggaagccgagcccgacggcggtgctctcgaactacctcatgtacaagattatggaggaggcggggctgccggcgggcgtcatcaactttgtgccgtgcgagccagcggtgatggatagcgccgtgaacgccgacccgcgcctcgccgccgtcgtcttcaccggctcgacccgcgtctttaccgaaatcaacaagaatgtcttcagccgcctcgagacgtaccacaactttccgcgcatctccggcgagacgggcggcaaggacttccacctcgtccacccctctgccgacgtgaggcacgttgcggccggcaccgtccgtggtgctttcgaattccaagggcagaaatgcagtgcgtgctcgcggctgtacgcaccacagagctgctggaaggagctgaaggcgttgctcatcaagggccagaagcaggtcaagatgggccagccggacgacttccagagcttcatgtgcgccgtcatcgacgaaacgtccttcaacaagaataagaagtatatcgaaatcgccaaggcggactcgagcaactacgagatcgttgcgggaggcaagtgcgacaagacgagggggtacttcgttgagccgaccatcattgagacgaaggacccccgcgcgcagctcatgcgcgaggagatcttcggccctgtgctgacggtgtttgtgtatgacgacagtaagccggggtactggaaggaagtgtgcgagctcgtcgactcgaccacgaagtacggcctgactggtgccgtcttctctcgcgagcgtgcgccgatcagggaggcggacaagtacctgcgctacgcggcgggcaactactacgtgaacgacaagtgcaccggtgccgtcgttggccagcagccgttcggcggctcgcgcctgagtggctcgaacgacaagccgggtgccggccagttcgtcacccgcttcgtctcggcccgctccatcaaggagagcttcgacgtgacgcccaccatctcgtacccgcaccagctgccggatgtgtacacactgtag

SEQ ID NO: 12667 - protein, 560 aa, Leishmania major
MLRRTVSCAFAAFKCPPVLNEPMDNFEPGSVSAKGTLEACKEARGEVRECPIMIGGKPYTSSNIIKATMPSDHQVQIAKAYNATPELAKKAVEAAVEASKEWSQVPFRDRAAIFYKAAHLLSTKYRHEMRAVTMLGQSKNPWQAEIDCVAEACDFIRWNIHFAEELYAQQPRSVSNSGVWNTTDYRPLEGFVSAITPFNFTAIAANLAGTPALMGNTVVWKPSPTAVLSNYLMYKIMEEAGLPAGVINFVPCEPAVMDSAVNADPRLAAVVFTGSTRVFTEINKNVFSRLETYHNFPRISGETGGKDFHLVHPSADVRHVAAGTVRGAFEFQGQKCSACSRLYAPQSCWKELKALLIKGQKQVKMGQPDDFQSFMCAVIDETSFNKNKKYIEIAKADSSNYEIVAGGKCDKTRGYFVEPTIIETKDPRAQLMREEIFGPVLTVFVYDDSKPGYWKEVCELVDSTTKYGLTGAVFSRERAPIREADKYLRYAAGNYYVNDKCTGAVVGQQPFGGSRLSGSNDKPGAGQFVTRFVSARSIKESFDVTPTISYPHQLPDVYTL

SEQ ID NO: 12668 - DNA, 3948 bp, Pseudomonas putida
  CDS (1)..(3948)
atggcgactaccacccttggggtcaaactcgacgacccgacccgtgagcgactcaaagcagctgcgcagtccatcgaccgcacgcctcactggttgatcaagcaagcgatcttcaattacctggagaagctcgagggtggtgccaccctgaccgaactcaacggtcatgccagcaacccggccgacgatgccggtgaagtccaggccgaccacagccaccagtgcttcctcgaatttgccgagagcatcttgccgcagtcggtactgcgctcggcgatcaccgccgcctaccgccgccccgagcaggaagtggtgccgatgctgctggagcaggcgcgcctgagcgcgccgctggccgacgccaccaacaagctggccgcaagcattgccgaaaaactgcgcaaccagaaaagcgtcggcggccgtgccggtatcgtccagggcctgctgcaggaattctcgctgtcgtctcaggaaaggcgtggcgtgtgcctggccgaagccctgctgcgtatccccgacaaaggtacccgtgatgcgctgatccgcgacaagatcagtaccggcaactggcagccgcacctgggcaacagcccgtcactgttcgtcaacgccgccacctgggggctgctgctgaccggcaagctggtcagcacccataacgaaaccggcctcacctcctcgctcacccgcatcatcggcaagagcggcgagccgatgatccgcaagggcgtcgacatggccatgcgcctgatgggtgagcagttcgtcaccggcgagaccattgccgaagccctggccaacgccagccgtttcgaggccaaaggcttccgttactcctacgacatgcttggcgaagccgcactgaccgagcacgacgcgcagaagtacctggcgtcctacgagcaggccatccactcgatcggcaaggcctcgcatggccgtggcatctatgaaggcccaggcatctcgatcaagctgtcggcactgcacccgcgctacagccgggcccagtacgagcgcgtgatggaagagctgtacccgcgcctgctgtcgctgaccctgctggccaagcagtacgacatcggccttaacatcgacgccgaagaagccgaccgcctggagctttcgctggacctgctcgaacgcctgtgcttcgagccatccctggctggctggaacggcatcggcttcgttatccaggcctaccagaagcgctgcccgtacttgatcaactacttcttcgatctggccaagcgcaccccccaccgcctgataatccgcctgttaaaaggcgcctactgggacagcgagatcaagcgtgcccaggtcgaaggcctggaaggctacccggtctatacccgcaaggtgtacaccgacgtgtcctacgtcgcctgcgcccgcaagctgctggccgtgccagaagccatctacccgcagttcgccacccacaacgcccacaccctgtcggccatctaccacattgccgggcagaactattacccgggccagtacgagttccagtgcctgcacggcatgggcgaaccgctgtacgagcaagtggtcggcaagattgccgatggcaagctgaaccgcccgtgccgcgtgtatgcaccggtcggcacccatgaaacgctgctggcctacctggtgcgccgcctgctggaaaacggcgcgaacacctcgttcgtcaaccgcattgccgaccactcgatttccatccaggaactggtcgccgaccggtggccagcatcgatcgcatgggtacccaggaaaggcagtatcggcctgccgcacccacgcattcccctgccgcgcgacctgtatggcaccgaacgggccaaattggccggtattgaaatggccaatgaacaccgcctggggttgttgtcctgcgccatggtggccaccgctcacaaacagtgggaggctgccccgctgctggcctgcgccgccagggagagcgctgccgcaccggtgctgaacccggctgaccaccgcaacgtcgtcggccatgtgcaggaggccaccgttgccaaatttgacaacgccatccattgcgcactgaaccccgcgccgatctggcaggccaccccaccagccgagcgtgctgccattctggagcgcaccgccgacctgatggaggccgaaatccacccgctgatgggcctgctcatccgcgaggccggcaaaaccttccccaacgccattgccgaattgcgtgaagccgtggacttcctgcgctactacgcggtgcaggcacttaacgacttcagcaacgacgcccaccgcccactgggtcctgtggtgtgcatcagcccatggaacttcccgctggcgatcttcaccggccaggtggccgcagccctggctgccggcaacccggtactggccaagcctgccgagcaaaccccactgatcgccgcccaggccgtgcgcctgctgctggaagctggcatcccagaaggcgtgctgcagctgctgccgggccgcggtgaaactgtcggtgccggcctggtcggagacgagcgcgtcaaaggcgtgatgttcaccggctccactgaagtggcccgcctgctgcagcgcaacgtcgctggccgtctggacaaccagggccgcccgatcccgctgatcgccgaaaccggcggccagaacgcgatgatcgtcgactcctcggcactgaccgaacaggtcgtgatcgacgtggtgtcctcggccttcgacagtgccggccagcgttgctcggccctgcgcgtactgtgcttgcaggaagactccgccgaccgcgtaatcgagatgctcaagggcgccatggctgaaagccgcctgggctgcccggaccgcctggccgtggacatcggcccggtgatcgatgccgaagccaaagccggcatcgagaagcacatccagggcatgcgcgagaaaggccgcccggtctaccaagtcgccattgccgatgctgccgagatcaagcgcggcaccttcgtcatgccaaccctgatcgagctggacagcttcgacgagctgaagcgcgaaatcttcggccccgtgctgcacgtggtgcgctacaaccgccgcaatctggaccagctgatcgagcagatcaacaactccggctacggcctgaccctcggcgtgcacacccgtatcgacgagaccatcgccaaagtggtggaaaccgcaacgccggcaacatgtcgtcaccgcaacattgtgggtgcagtggtgggcgtgcagccgttcggtggtgaaggcctgtctggcaccggcccgaaagccggcggcccgctgtacctctaccgcctgctgtcgacccgcccggccgacgccattggccgccacttccagcagcaggacggcgaaggcacgccggaccgcaccctgcacgaacagctggtaaagccgctgcacggcctgaaggcctgggccgagaacaaccagctggccgacctggccgcgctgtgcagccagttcgccagccagtcgcagagcggcatcgcccgcctgctgccaggcccgaccggcgagcgcaacagctacaccattctgccgcgtgagcacgtgctgtgcctggccgacaacgaaaccgacctgctggcgcagttcgccgcggtactggccgttggcagctcggcggtgtgggttgacggtgaaccgggcaaggccctgcgcgcccgcctgccgcgtgagctgcaggccaaggtgaagctggtcgcggactggaacaaggatgaagtggcgttcgacgccgtgatccaccatggcgactcggaccagctgcgcggcgtatgccagcaggtggccaagcgtgccggggcgatcgttggggtgcacgggctgtccagcggggatcaccagattgcgctggagcgcctggtcatcgagcgcgcggtgagcgtgaacactgcagcggcgggtggtaacgccagcctgatgaccattggctaa

SEQ ID NO: 12669 - protein, 1315 aa, Pseudomonas putida
MATTTLGVKLDDPTRERLKAAAQSIDRTPHWLIKQAIFNYLEKLEGGATLTELNGHASNPADDAGEVQADHSHQCFLEFAESILPQSVLRSAITAAYRRPEQEVVPMLLEQARLSAPLADATNKLAASIAEKLRNQKSVGGRAGIVQGLLQEFSLSSQERRGVCLAEALLRIPDKGTRDALIRDKISTGNWQPHLGNSPSLFVNAATWGLLLTGKLVSTHNETGLTSSLTRIIGKSGEPMIRKGVDMAMRLMGEQFVTGETIAEALANASRFEAKGFRYSYDMLGEAALTEHDAQKYLASYEQAIHSIGKASHGRGIYEGPGISIKLSALHPRYSRAQYERVMEELYPRLLSLTLLAKQYDIGLNIDAEEADRLELSLDLLERLCFEPSLAGWNGIGFVIQAYQKRCPYLINYFFDLAKRTPHRLIIRLLKGAYWDSEIKRAQVEGLEGYPVYTRKVYTDVSYVACARKLLAVPEAIYPQFATHNAHTLSAIYHIAGQNYYPGQYEFQCLHGMGEPLYEQVVGKIADGKLNRPCRVYAPVGTHETLLAYLVRRLLENGANTSFVNRIADHSISIQELVADRWPASIAWVPRKGSIGLPHPRIPLPRDLYGTERAKLAGIEMANEHRLGLLSCAMVATAHKQWEAAPLLACAARESAAAPVLNPADHRNVVGHVQEATVAKFDNAIHCALNPAPIWQATPPAERAAILERTADLMEAEIHPLMGLLIREAGKTFPNAIAELREAVDFLRYYAVQALNDFSNDAHRPLGPVVCISPWNFPLAIFTGQVAAALAAGNPVLAKPAEQTPLIAAQAVRLLLEAGIPEGVLQLLPGRGETVGAGLVGDERVKGVMFTGSTEVARLLQRNVAGRLDNQGRPIPLIAETGGQNAMIVDSSALTEQVVIDVVSSAFDSAGQRCSALRVLCLQEDSADRVIEMLKGAMAESRLGCPDRLAVDIGPVIDAEAKAGIEKHIQGMREKGRPVYQVAIADAAEIKRGTFVMPTLIELDSFDELKREIFGPVLHVVRYNRRNLDQLIEQINNSGYGLTLGVHTRIDETIAKVVETATPATCRHRNIVGAVVGVQPFGGEGLSGTGPKAGGPLYLYRLLSTRPADAIGRHFQQQDGEGTPDRTLHEQLVKPLHGLKAWAENNQLADLAALCSQFASQSQSGIARLLPGPTGERNSYTILPREHVLCLADNETDLLAQFAAVLAVGSSAVWVDGEPGKALRARLPRELQAKVKLVADWNKDEVAFDAVIHHGDSDQLRGVCQQVAKRAGAIVGVHGLSSGDHQIALERLVIERAVSVNTAAAGGNASLMTIG

SEQ ID NO: 12670 - DNA, 1500 bp, Gallus gallus
  CDS (1)..(1500)
atggcatctctgcatctgctgccttctcccactctcaaccttgaaatcaaacacacgaagatttttatcaataatgagtggcaaaattctgaaagcgggagagtattcccagtatacaatccagcaacaggagagcagatctgtgagatccaggaagcagacaaggttgacacggacaaggcagtgagagcagctcgccttgctttttctctgggttcagtttggaggagaatggatgcatcggaaagaggccaacttttggataaactggcagacttggttgaaagagacagggcagttcttgctactatggaatcactgaacagtggcaaaccattcctgcaagccttctacgtagatcttcaaggagtcataaaaaccctgaggtattacgctggttgggcagacaaaatccatggaatgaccatacctgtagatggagattattttacgtttacaagacatgaacccatcggagtgtgtggacagatcatcccttggaacttccccctgctgatgtttgcatggaagattgctccagctctgtgctgcggcaatacagtagttattaaaccagcagaacaaacaccactcagcgctctctatatgggagccctcatcaaggaggctggctttccaccaggagttgtgaatattttgccaggatttggtccaattgttggtgcagcaatagcatctcatgtgggcattgataaaattgcgtttactggatccactgaggttgggaagctgatccaagaagcagctggaaggagtaacttgaagagagttacactggagctgggtgggaaaagcccaaacatcatttttgcagatgctgatttggattatgctgtggaacaagctcaccagggggtcttcttcaatcaaggtcaatgctgcactgcaggctcaaggatttacgtggaagaatcaatctatgaagagtttgttagaagaagtgtagaacgtgcaaagaggagagtagtagggagtccttttgacccaactacagaacaagggccacagattgataaaaaacaatacaacaagatcttggaactgattcagagcggcattactgaaggagcaaaacttgaatgtgggggtaaagggctaggaagaaagggcttcttcattgaacctacagtgttttccaatgtaacagatgacatgcggattgccaaggaggagatttttgggcctgttcaagaaatactgagatttaaaaccgtggatgaagtcatagagagagccaacaattctgactttgggctggtagctgctgtctttacaaatgacataaacaaggccctgacagtctcttcagcaatgcaggctgggacagtctggataaattgctacaacgccttaaatgcccagagtccttttggaggattcaaaatgtctggcaatggtagagagatgggtgaaagcggattgagagaatattctgaagttaaaacagtgacaataaagatccctcagaagaattcctaa

SEQ ID NO: 12671 - protein, 499 aa, Gallus gallus
MASLHLLPSPTLNLEIKHTKIFINNEWQNSESGRVFPVYNPATGEQICEIQEADKVDTDKAVRAARLAFSLGSVWRRMDASERGQLLDKLADLVERDRAVLATMESLNSGKPFLQAFYVDLQGVIKTLRYYAGWADKIHGMTIPVDGDYFTFTRHEPIGVCGQIIPWNFPLLMFAWKIAPALCCGNTVVIKPAEQTPLSALYMGALIKEAGFPPGVVNILPGFGPIVGAAIASHVGIDKIAFTGSTEVGKLIQEAAGRSNLKRVTLELGGKSPNIIFADADLDYAVEQAHQGVFFNQGQCCTAGSRIYVEESIYEEFVRRSVERAKRRVVGSPFDPTTEQGPQIDKKQYNKILELIQSGITEGAKLECGGKGLGRKGFFIEPTVFSNVTDDMRIAKEEIFGPVQEILRFKTVDEVIERANNSDFGLVAAVFTNDINKALTVSSAMQAGTVWINCYNALNAQSPFGGFKMSGNGREMGESGLREYSEVKTVTIKIPQKNS

SEQ ID NO: 12672 - DNA, 1641 bp, Agaricus bisporus
  CDS (1)..(1641)
atggccactgctcaactcgcgactttcaagatcccccctgtgtccaatgaacccatgctatcctatgcccccggctcgccggagagagcgggtctgcaagcagcattggcagaaatgcaaagccagctaccctttgaggttccttgtatcatcaatggccaagaggtgagaacgaacaacatccagaaacagcctatgccacacgaccatgctcgccacctgtgtactttccacgaaggatcaccagaactggtcgaaaaggctacctgtggcgctcttcaagccaaagacggttgggaaaccatgccatggaacgatcgtgctgcgattttcctcaaggccgccgatctcgcaagtggaaagtatcgttacaagctcatggcggcgactatgctcggccaaggcaaaaatacatggcaggcggagatagacgctgcggcggagttggcagacttcttccgcttcggagtctcttatgtagaggaactatacgcccaacagccgccgaagaatgctcccgggtgttggaaccgtaccgagtaccgcccgcttgaagggttcgtccttgctgtttcgcccttcaactttaccgctattggtgggaatctacccggatctcccgcacttgttggaaatgtcgtcgtatggaagcctgctccagccgcgacttattccaactacctcgtcttcaagattctttcggaggccggcgttccccccggtgtcattcaatttattcccggaggagctgaaatagtacaagctgccatccagagccctaactttcgttcgcttcacttcactggcagtactaatgtcttcaaatcgctctggaaggatatctcctcgaatctagacaagtacaaggtctaccccagaatcgtcggagagaccggtgggaagaactggcacgtcattcacaagtctgcggaagtgagaaacgctgtgctgcagagtgttcgaggagcattcgaatatcaaggtcaaaagtgctccgccctctcgcgtctctacgtgtccagatcagtctgggaaaacggtttcaagacacagtacctcgaggaaattgccaagatcaaggttggcccttgtctcgactggaacaactacatgggacctgttattggccgtcgggcatatgataatatcaccggttttatcaagaaggcgaaggaagagggaggagaggtgttgattggtggatcaggtgatgactccaagggattcttcattcaaccaactgtcattcttaccaaggttcctcgatctactaccatggttggggagatctttgggcccgtcgtgactgcctatgtcttcgaggacagtgattacgagaaaacgcttgaattgatcgacacaacttccatctacggccttactggagcaatcttcgcttctgaacgtcaagctttacttaccgccacaaaccggtctcgcaatgcggctggtaacatatattacaacgaaaagtgcacgggagcagttgtcggtcagcaaccgttcggtggcgccagagggagtggcaccaacgacaaggccggtagcattagtatcttctatcgctttgttagcgcgaggagcatcaaggagaactttgtcgggttggaagacttccactatccctctaatttggtttga

SEQ ID NO: 12673 - protein, 546 aa, Agaricus bisporus
MATAQLATFKIPPVSNEPMLSYAPGSPERAGLQAALAEMQSQLPFEVPCIINGQEVRTNNIQKQPMPHDHARHLCTFHEGSPELVEKATCGALQAKDGWETMPWNDRAAIFLKAADLASGKYRYKLMAATMLGQGKNTWQAEIDAAAELADFFRFGVSYVEELYAQQPPKNAPGCWNRTEYRPLEGFVLAVSPFNFTAIGGNLPGSPALVGNVVVWKPAPAATYSNYLVFKILSEAGVPPGVIQFIPGGAEIVQAAIQSPNFRSLHFTGSTNVFKSLWKDISSNLDKYKVYPRIVGETGGKNWHVIHKSAEVRNAVLQSVRGAFEYQGQKCSALSRLYVSRSVWENGFKTQYLEEIAKIKVGPCLDWNNYMGPVIGRRAYDNITGFIKKAKEEGGEVLIGGSGDDSKGFFIQPTVILTKVPRSTTMVGEIFGPVVTAYVFEDSDYEKTLELIDTTSIYGLTGAIFASERQALLTATNRSRNAAGNIYYNEKCTGAVVGQQPFGGARGSGTNDKAGSISIFYRFVSARSIKENFVGLEDFHYPSNLV

SEQ ID NO: 12674 - DNA, 1719 bp, Emericella nidulans
  CDS (1)..(1719)
atgcaatcatcgatgctgcttcgggtgagggctctccccaaaacagcgtcggttctctcccgtacaaagacggcgacatacgccacatacaaggttcctcgcattgacaatgaaccaaacaaacactacgccgcaggctcgccggaccgaaaggctctacaagaggctttggcgcgaacgcaacgaaatgctcctctgagcgttcctctagtcattgcaggcaaggaggtcaaatcctcttcatcactaacacaatcgaaccccgcgtcgcacggcccggtggccacctactccaatgcaaccgccaaagacgtccaggcggcgatcgagtccgccctggaagctcgcaaatcatgggcctccacgccgttcgccgatcgtgccagtgtttttcttaaggctgcagacctgatctcgacaaagtaccgctatgatgtgatggctgtgaccatgcacggccaaggcaagaatgcctggcaggcggagattgactctgccgctgagctttgtgacttcttccgatttggcgttaagtatgcggaggatctgtatgcgcagcagcctgtgcaccatgcgccgggtgtttggaaccgcgtcgaataccgtccgcttgaaggatttgtttacgcgatcagtccgttcaatttcactgccattggaggtaatctcgctggagctcctgcactgatgggcaatgttgttgtctggaagccttccccttcggccatcgcatccaactggctcgttcatcagatcctgctcgaagccggcctccctaagaacgtcattcagttcgtccccggcgaagccgaagaagtgaccaagaccgttctcgaccaccccgacttcgcagcccttcatttcactggcagcaccaatgtcttccgtaatctgtacggtcagatctccactcgtgtcgcagccggcaaataccgcagctacccacgtattgtcggcgaaactggcggcaagaacttccacctcattcataaatctgccgacatccgcaacgctgctgtgcagaccgtccgcggtgcttttgagtaccagggccagaagtgcagcgcaacctctcgtgtctatgtcgcgtcctccatcgccgattccttcctcgaacaggtcgcctcggaagcgaagagcctaaaggtcggccccccttcggactttaccaacttctgcgggccggttatccatgaagcctccttcaccaagctcgccaaggtcattgacgaggcaaagaacgaccccgagctcgaactcctcgctggcggctcctacgactcctccaagggctggtacatccagcccaccgtttaccgcaccactaaccctgatcacccgctgctgacacgtgaactttttggtcctattctcgtggtgtatgcctaccctgacgcgacggaggccgactttgcccgtattgcgcagaagatcgacgcaacaggcgaatacggcctcacgggctcggtgttcgctcaggaccgcgaggcactggcggtagccaacgacgtcctccgcaatgcggccggtaacttctatatcaactgcaagagtaccggcgcagttgtgggtcagcagccgtttggcggggcgagggcgtccggtaccaatgataaggctggtagtgggaacctgctgagcaggtttgtgagcctgcggtcgattaaggaggagtttgttcctacctacaaggttgcttatcctagcaacgaggcgtga

SEQ ID NO: 12675 - protein, 572 aa, Emericella nidulans
MQSSMLLRVRALPKTASVLSRTKTATYATYKVPRIDNEPNKHYAAGSPDRKALQEALARTQRNAPLSVPLVIAGKEVKSSSSLTQSNPASHGPVATYSNATAKDVQAAIESALEARKSWASTPFADRASVFLKAADLISTKYRYDVMAVTMHGQGKNAWQAEIDSAAELCDFFRFGVKYAEDLYAQQPVHHAPGVWNRVEYRPLEGFVYAISPFNFTAIGGNLAGAPALMGNVVVWKPSPSAIASNWLVHQILLEAGLPKNVIQFVPGEAEEVTKTVLDHPDFAALHFTGSTNVFRNLYGQISTRVAAGKYRSYPRIVGETGGKNFHLIHKSADIRNAAVQTVRGAFEYQGQKCSATSRVYVASSIADSFLEQVASEAKSLKVGPPSDFTNFCGPVIHEASFTKLAKVIDEAKNDPELELLAGGSYDSSKGWYIQPTVYRTTNPDHPLLTRELFGPILVVYAYPDATEADFARIAQKIDATGEYGLTGSVFAQDREALAVANDVLRNAAGNFYINCKSTGAVVGQQPFGGARASGTNDKAGSGNLLSRFVSLRSIKEEFVPTYKVAYPSNEA

SEQ ID NO: 12676 - DNA, 3134 bp, Homo sapiens
  CDS (31)..(1722)
tccagcgaacagccccgcttctaacccgagatgctgctgccggcgcccgcgctccgccgcgccctgctgtcccgcccctggaccggggccggcctgcggtggaagcacacctcctccctgaaggtggccaacgagcccgtcttagccttcacgcagggcagccctgagcgagatgccctgcaaaaggccttgaaggacctgaagggccggatggaagccatcccatgcgtgatgggggatgaggaggtgtggacgtcggacgtgcagtaccaagtgtcgccttttaaccatggacataaggtggccaagttctgttatgcagacaagagcctgctcaacaaagccattgaggctgccctggctgcccggaaagagtgggacctgaagcctattgcagaccgggcccagatcttcctgaaggcggcagacatgctgagtgggccgcgcagggctgagatcctcgccaagaccatggtgggacagggtaagaccgtgatccaagcggagattgacgctgcagcggaactcatcgacttcttccggttcaatgccaagtatgcggtggagctggaggggcagcagcccatcagcgtgcccccgagcaccaacagcacggtgtaccggggtctggagggcttcgtggcggccatctcgccctttaacttcactgcaatcggcggcaacctggcgggggcaccggccctgatgggcaacgtggtcctatggaagcccagtgacactgccatgctggccagctatgctgtctaccgcatccttcgggaggctggcctgccccccaacatcatccagtttgtgccagctgatgggcccctatttggggacactgtcaccagctcagagcacctctgtggcatcaacttcacaggcagtgtgcccaccttcaaacacctgtggaagcaggtggcccagaacctggaccggttccacaccttcccacgcctggctggagagtgcggcggaaagaacttccacttcgtgcaccgctcggccgacgtggagagcgtggtgagcgggaccctccgctcagccttcgagtacggtggccagaagtgttccgcctgctcgcgtctctacgtgccgcactcgctgtggccgcagatcaaagggcggctgctggaggagcacagtcggatcaaagtgggcgaccctgcagaggattttgggaccttcttctctgcagtgattgatgccaagtcctttgcccgtatcaagaagtggctggagcacgcgcgctcctcgcccagcctcaccatcctggctgggggcaagtgtgatgactccgtgggctactttgtggagccctgcatcgtggagagcaaggaccctcaggagcccatcatgaaggaggagatcttcgggcctgtactgtctgtgtacgtctacccggacgacaagtacaaggagacgctgcagctggttgacagcaccaccagctatggcctcacgggggcagtgttctcccaggataaggacgtcgtgcaggaggccacaaaggtgctgaggaatgctgccggcaacttctacatcaacgacaagtccactggctcgatagtgggccagcagccctttgggggggcccgagcctctggaaccaatgacaagccagggggcccacactacatcctgcgctggacgtcgccgcaggtcatcaaggagacacataagcccctgggggactggagctacgcgtacatgcagtgagcccctctcgggctccaccgtccagctgtctgtccgtccaggtggccgacctcactgcacagaccccactccagcccctccaccccttcttcatgcacagctgcctttctataatccgggcttgactcccttcttaccactgtattctggcctctcccatgcctcaggctctggtttgagatcgtgctggggaggaacatggccactaccccttatcccatcggccatgtgggaggtatgaccctggtgcctggcaggttctccctctgccctccactgggcccagtggctcagggacctggggaaaggagatggagcagctcttgggatcctttggggaaaaggaggccattctgggccccttggcaaacctcaccactcacagaggctcctggccttgatccctgcccctccaggtgtccagggtaaagtgtaactcagactgacctgtggggcacagggggcaccagctggccttgccctctctggtctgggctgtctaccttcctcactgtatctttgcccagacccacctgggccagtaggcctgtccccagccacacaccttagatgctggcatgccttactccaggtgcctgtgtttggccgaggcctgtgtgattcccggtctgcaccacatggcggggttggggggccgctggaggccacctgccaaggcgtgggatgggatggtcctgccggtttaggccgtgattctggaaaaccttggatgggccttcgtcctatgtcagccttccctttgatcctcaggccctacctgtagagacctccactcctagagccagtctcagggtctgggatttccctgcaggagctcagccaccactgtgccatggtgacacaggccaaggcagacattggccctcccttctcccagcccccagaggcctggccttgggttcgtcagcatgggccgaggacgttgcctgtagaatcctcctctgcctgggagtggctctgtgtggaccagtccctcactggcccattctttttttgacgcagccaatctgtgaccacgattcctcccacagatgcctcctgcttggattctgagtggtcagagatctgtaaagcatgactttcaaggatggttcttaggggactgtgtaaagtgttgggtcttcctccaggatgcctgcatgggaccccacccggagctggtgtggccattccccgaagtgccactggcccatggatgggggtgggtgctggtgcacctgggctgggtgtgggttctgtgtccttccaggatctgtgtcatttcccatgaggggccggggcaggtggctgggtgggggcacaggctggagtattcttagttctactggttctacactgtgaggtggcaatgggatttgctcagatgccacccaataaaatgcctgttactt

SEQ ID NO: 12677 - protein, 563 aa, Homo sapiens [sequence omitted]

SEQ ID NO: 12678 - DNA, 4051 bp, Klebsiella aerogenes
  CDS (26)..(3964)
aacgataaatgacggagttttgagcatgggcaccaccaccatgggtgttaagcttgacgacgcaacccgcgagcgcattaaatccgccgcgagccgtattgaccgcacgccgcactggctgattaagcaggccatctttaattatctggaaaaactggagaacgacgagacgctgcctgagctgccggccctgctctccggggccgccaacgaaagcgatgacgccagcgaaccaacggaagagccctatcagccattcctcgaattcgccgagcagatcctgccgcagtcggtgaggcgcgcggcgatcaccgccgcctggcgacgtccggaaaccgacgcggtaccgatgctgctggagcaggcccgtctgccgcagccgctgggcgaacaggcgcacaagctggcgtatcagctggcggaaaaactgcgcaaccagaaaaccgccagcggccgcgccggcatggtgcagagcctgctgcaggagttctccctctcttcacaggaaggggtggcgctgatgtgcctggcggaagccctgctgcgtattccggataaagccacccgcgatgcgctgatccgcgacaaaatcagcaacggcaactggcagtcgcacatcggccgcagcccgtcgctgttcgtcaacgccgccacctgggggctgctgttcaccggaaaactggtgtcgacccataacgagaccagcctctcccgctccctgaaccgcatcatcggcaagagcggcgaaccgctgatccgcaaaggcgtggatatggcgatgcgcctgatgggcgagcagttcgtcaccggggaaaccatcgccgaagcgctggccaacgcccgcaagctggaagaaaaagggttccgctactcctacgatatgctcggcgaagccgccctgaccgccgctgacgcccaggcctatatggtttcttatcagcaggcgatccatgccatcggcaaagcctccaacggccgcggcatttatgaaggtccgggtatctccattaagctctccgcgctgcacccgcgctacagccgcgcgcagtatgaccgggtgatggaagagctttacccgcggctgaaatcgctgaccctgctggcgcgccagtatgacatcggcatcaatattgacgccgaagaggcagaccgtctggagatctccctcgacctgctggaaaaactgtgcttcgagccggaactggccggctggaacgggattggcttcgtgattcaggcctaccagaagcgctgtccgtttgtcattgattacctgattgacctcgccacccgcagccgccgtcgcctgatgatccgtctggtgaaaggcgcctactgggatagcgaaattaaacgcgcgcagatggaaggtctcgaaggctatccggtatacacccgcaaggtttacaccgacgtctcctacctcgcctgcgcgaagaagctgctggcggtgccgaacctgatttacccgcagtttgccacccataacgcccatactctggcggctatctaccagctggcaggccagaactactacccgggccagtatgagttccagtgcctgcacggcatgggcgaaccgctttacgagcaggtggtgggcaaggtcgccgacggcaaactgaatcggccgtgccgcatctacgccccggtgggcacccacgagacgctgctggcgtatctggtgcgtcgtctgctggagaacggcgccaatacctctttcgtcaaccgtatcgcggacaataccctgccgctggacgagctggtggccgacccggtcagcgcggtagaaaaactggcgcagcaggaaggccaggccggcctgccgcatccgaaaatcccgctgccgcgcgatctctacggcagcggccggagcaactccgccggtctcgatctggcgaacgagcaccgtctggcctccctctcctcttccctgctcaacagcgcgctgcataaatggcaggcattgccgatgctggagcagccggtggccgaaggcgagatgcagccggtggttaacccggcagagccgaaagatatcgtcggctacgtccgcgaagccagcgacgctgaagtgcagcaggcgctgaccagcgctatcaacaatgcgccgatctggttcgccactccgccgcaggagcgcgccgccattcttgagcgcgccgcggtgctgatggaaagccaaatgccgaccctgatggggatcctggtgcgcgaggcgggtaaaaccttcagcaacgccatcgctgaagtgcgcgaagccgttgacttcctgcactattacgccggccaggtgcgcgacgatttcgataatgaaactcaccgcccgctgggtccggtggtctgtatcagcccgtggaacttcccgctggcgatcttcaccggccagattgccgccgcgctggcggccggcaacagcgtgctggcgaaacctgccgagcagacgccgcttatcgccgcccagggcgtggcgattctactggaagccggcgtgccgccgggcgttattcaactgctgccgggtcgcggggagaccgtgggcgccgcgctaacctccgatgagcgcgtacgcggcgtgatgttcaccggctccaccgaagtggccaccctgctgcagcgcaatatcgccagccgcctcgatccccagggccgcccgacgccgctgatcgccgaaaccggcgggatgaacgcgatgatcgtcgattcgtcggcgctcaccgagcaggtagtgatcgacgtgctggcttccgcgttcgacagcgctggccagcgctgctccgccctgcgcgtgctttgcctgcaggaagaggtcgccgatcacaccttaaccatgctgcgcggcgccatgagcgagtgccggatgggcaatccggggcgcctgaccaccgatatcggtccggttatcgatgcggaagcgaaagagaatatcgaacgccatattcaggcgatgcgcgccaaaggccgcaccgtctaccaggcggtgcgcgagaatagcgaagacgcccgcgaatggcgtcacgggaccttcgtgccgccgacgcttatcgagctcgacagcttcgacgagctgaaaaaagaggtcttcggcccggtactgcacgtggtgcgctataaccgtaacgagctggacaaactggtcgagcagattaacgcctctggctacggcctgaccctcggcgtgcatacccgtatcgacgaaaccatcgcccaggtcaccggcagcgcgaaggtgggcaacctgtacgtcaaccgcaatatggttggcgcggtggtcggcgtgcagccgttcggcggcgaagggctgtccggtaccggtccgaaagccggcggtccgctgtatctgtaccgtctgctctccagccgtccgcaggacgcggttggcgtgaccttcgcccgccaggatgcagagcgtccgctggacgcccagctgaaaacgctgctggaaaaaccgctgcaggcgctgcagcagtgggccgcgggccgtcctgagctgcaggcgctgtgccagcagtacagcgagcaggcgcaaagcggcactcaacgcctgctgccggggccaaccggcgagcgcaacaccctgacgctgatgccgcgcgagcgcgtgctgtgcgtagcggataacgaacaggatgcgctgatccagctggcggctgtgctggcggtgggttgtgaagtactgtggccggacagcgccctgcagcgcgatctggcgaagaaactgccgcgggaggtcagcgagcgcattcgctttgccaaagcggagcagttgcctgtccaggccttcgacgcggttatctaccacggcgattccgaccagctgcgcgagctgtgcgagcaggtggcggcgcgcgatggggcgattgtctccgtgcagggcttcgcccgcggcgaaaccaatctgctgctggagcggctgtatatcgagcgttcgctgagcgttaacaccgccgcggcaggcgcgtaacgccagcctgatgaccatcggctaaaacgggctccccggtggcgctgcgcttacccggggctacctaccaccgccaaagggtagccc
